United States Patent 8,067,671 (METHODS FOR GENETIC CONTROL OF PLANT PEST INFESTATION AND COMPOSITIONS THEREOF) - sequence listing, part 47

SEQ ID NO: 108680 - DNA, 1003 bp, Heterodera glycines
  Promoter: Source sequence=SeqID_7519; Location=1618..2620; Strand=-; Gene=SeqID_65100
atttaatttataggcgtcgcctggaatttcaaattcgagtcacatttgttaacagattttaagtaaaattgttatttttgaatagggcagtcaaattgtaactctcgcaatattgaactaaattgcaaaatgtagggctttctctattgcagaaagcaactcaatttgggtctgttcgacaatattatttttttaaagaaagaacgccaaaattttaactttaatttggattttgagcgaaatcaaaaatcagaaaacgatcgtatgcattttgtcgacgaaaaggagagtactgtgataatttcataaaaaaatcaacaaaaaaagtcttgctctcccccatgccctttttcctctctctttcattccactcatatgctcaaatacatactatacaactaaatgcttttacattttttttaaacgatggaaagaaagagacgtttgaatacggtcgtccgccacaatttacgataatgtgaagagataggtatatggtggggcaaaaggaaatgacaaacatacaaaacgtaggggggagggagatagaaggtgagatgggagggaaggagagaaaaacagatttgtccaaaaaaaatcaaaatgatcaaaacaaataaatttgaaaaagaggacaatacgtcaaagggaatcgaaacaatgaaatgaatctatttaaaagtaaataattagtgaaaatttaaaaatttgccattcaaaaggatttaaaaaactgatcattataatttcaaatagctcaacctttaactagcgccttttttcctttgaatattaagttctgctccgaataaatggcttctactattacgcacgtggtcttcgaccttgatggtgttctgatcgacactgaacgtcattatacaacggccaacgagcggacgttggagaaatttggagcaaaattcactcgagaaatgtgggagttttgtttgtttaatacgttataataaagcaaaacaacgacaggaagctcaaaatgatg

SEQ ID NO: 108681 - DNA, 310 bp, Heterodera glycines
  Promoter: Source sequence=SeqID_7279; Location=1625..1934; Strand=+; Gene=SeqID_64336
atataaataaatggcaaaataaacaaaaatattattttaaaataaacagaaaatttttttaaatataaaccgaaacgttttataattattgtcccaaaagtggacttaattgaaaaccgaaaattaaaatgaattttctatcaatattaatttggcacaattctacataatataattttttatttcattggagtaattctatttttattgatagataaaagaagagtatgtaaaaagtgtatttttttctacactatcttttaaaatataatttaacaaatttttattatttacagtacataaacgaatg

SEQ ID NO: 108682 - DNA, 467 bp, Heterodera glycines
  Promoter: Source sequence=SeqID_44647; Location=403..869; Strand=-; Gene=SeqID_72110
cttcttcaccaatttcctactcttttctcgaccagacccccattcttaccagtgcaaatttttaccggcggtaccggtactagacaaaccggtaacggtaatttcatttttgaaaaaaccggtaccggtaccgctagcgccggcacagaaagcaaaaattaccgctcagtaccggtaccggtaccggtaccgctcaaccctattttaaatgccttggactaatttctataacttttcatctttcctctaaatattaaatattctcattctttatactttggaactttgtaaaaaattagtttttatttttaatttctgccaaaatcagtttataaatttctgccctaaatgtttctttaggttcaaagtgccatctcagcacgtcaggcaatggtggtgatcggcacaaaaataaggaacgccataatggcatcgaaattttgattggaaaattaatgcaaaatatg

SEQ ID NO: 108683 - DNA, 1003 bp, Heterodera glycines
  Promoter: Source sequence=SeqID_7140; Location=102..1104; Strand=+; Gene=SeqID_63950
gtgtttttcccttttttttcgccgcccgtctctgtcgatgataggggtcaccagtaaaacggcaacaacagaagtgagtccactgccccacagctcacacccattcgccaatccgatccctcccaaaaataatcgtcgaatgttcggatgaatcatcgtccgacggcgggcggcgggtcaccggtccaatgaatgggttcactcactcaaatattcgccattttatacgttacattacccccattcccacaccctttctatccgagcaaatgagtggggcgggggagaggggagggaggggtctcccatatgtgaaaagaaaaaagatccccctccccggacccgcataatcattatctctttggcatgaacagtgccgggtcaatgattgctccctccattcaaatattgcacgcgaacgcctccaatttatcatttacggcaaaacgataaaactatgccgataattaaaagtgagaattgtcagtatatcaaatttctttttgatttttccagcgtattgagagaataaagtgcatagttatcaataaaatattaattaccccctcgccccttctttacaagcgacgtccgattataaaatttaaatagattttgggtgagaaaaaaacctttcatggcttaatactagcatatttttatttccatatattttcaaaaaatgaataaagaataacaaaaatttttatttttaaaatgagtgaactcataagggaattttatggctattaaaattaaccaattaaaataataattggtatttacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatg

SEQ ID NO: 108684 - DNA, 208 bp, Heterodera glycines
  Promoter: Source sequence=SeqID_11272; Location=1174..1381; Strand=-; Gene=SeqID_74641
aaaaccacatacacagacaaatgcagaggagtgtgttgctggtttgtgttagccatttccatcgttgtaagcttccgttttcaatttcaaaaaattaaaattctccgtctccccccaggcgttcgttgcgttgtctgtgtggatgattatacattacttcattgagacaaatgaaactctgccttcccctttagtgactcttgcgatg

SEQ ID NO: 108685 - DNA, 912 bp, Heterodera glycines
  Promoter: Source sequence=SeqID_663; Location=4864..5775; Strand=+; Gene=SeqID_58497
attatagcccatgggggattatttttaaacctcctaagaatacaggggataattagagaatgggggataaatagagactgggggattatttttcaacctcctcagaaaggtgggatttggacttcaattcctgatcattgtcccaaaaccccaaaaaatttttttaaaaaatccgagaacctcgagcataataatttatttgaattcccgaaaaaaagtctttatttaatgaatcgaattttctaataaatatacatatcacaaaaaatggatctcttcgcattgaggtattttatacaattatttgaatctttgaaaagaagcttaaaattttaaaaatgcaacaacagagcgctttaaaaataatgaatacaaagcaaaaaaaattattacagacataaattggttgaaaatattaaattaaaaaataaattaaaacagaaagtacaataaatttctttttccgttgtcaatcaattgtttgagtgttgcatttatagttttaataaaattattaaagaaagaacgaaaaagccttaaaaactttaaagatttcgttactttaataaaaacctatgtgaaccattcaaacaaattaaaaataaattgcaactaatgtttataagtcggtctacctcagttgggcgcgcacggttgggcgctcacggttgggcgctcacgtttgaacgcgcacggttgggcgccagcacgtttggacgccgacacatttgggcgccaatattccaacaatttttttaaatttgttttttttattaaaaaaatgttttaaagcgacaataaattccaatttttatgttttaaaatttattaaaaggatataagtaaatattattccgtacggatgcagcagcaaattgaccaaaagaaataggccaaagctagagcacgatg

SEQ ID NO: 108686 - DNA, 105 bp, Heterodera glycines
  Promoter: Source sequence=SeqID_25416; Location=1..105; Strand=+; Gene=SeqID_56158
tgactttttcggactatgcccgaattttcaatttttaaagttgaaataaaccgtttatttctaaatgaataataataattctcagcagttaaaaattccttaatg

SEQ ID NO: 108687 - DNA, 138 bp, Heterodera glycines
  Promoter: Source sequence=SeqID_31146; Location=1..138; Strand=+; Gene=SeqID_61522
attgtggaaaagtgggggtccacgtggcaaacatgttcctacctagttgttatattcctaataagaatcaaccgttccccataaaaaatcaaaaaatgggaggagaaaggcagcagcagcattaagatggagaacatg

SEQ ID NO: 108688 - DNA, 1003 bp, Heterodera glycines
  Promoter: Source sequence=SeqID_3209; Location=1004..2006; Strand=-; Gene=SeqID_83714
cccaagtcgagaaatttctcgggttttttggggtctcggttctcgtatcgtttccctgggtcatttctcggttctcgtatcatttcccggggtcatttctcggttctcgtatcgtttcccggggtcatttctcggttctcgtatcgtttcccggggtcatttctcggttctcgtatcgtttcccggggtcatttctcggttctcgtatcgtttcccggggtcatttctcggttctcgtatcgtttcccggggtcatttctcggttctcgtatcgtttcccggggtcatttctcggttctcgtatcgtttcccggggtcatttctcggttctcgtatcgtttcccggggtcatttctcggttctcgcatcgtttccctgggtcatagctatacgatgatattttcaatggcaatcaccgaaaaacgacgaaaaagagacattctatgacaaagaactgtttgagacggcaaaagcatccgttttggcactcaatgggaacggcacagacgaagcactaaaaggcataatccaaagaaaatacttttgaaggctaagtttggcattttgacgcaggcatttgcgagtagagaatggcaaatcaacatttttcacttagaaatattttttttgcggagaatcaacctcaatgttgatatttatttaaatcaacaaacattacgccatcaacttaaatatcaacgtaatttttaaaaatttaaaaatgaattccattatttagtatatctcattagctataaaaggaattgaaggaaataaaaataaatatgaaagcaaaaaattatgttgtcaatcaatttgttgtctttcaattgaaacattgactaatctcctattttccgatcgcctacagccgtctctccgtccgttgacaatcatttcgatcgtttacagcgatttcttcgagaatgcttcttcttgttgcttttcctctcttaatttttctacggatttgccttgttaacataataatttagaatttatg

SEQ ID NO: 108689 - DNA, 1003 bp, Heterodera glycines
  Promoter: Source sequence=SeqID_4924; Location=3854..4856; Strand=+; Gene=SeqID_56215
aacaactgaattctaacaaaaagtcgaaagtatctcttattaaaggattgattttgcacacttgacaatgttacttttaaagaatatattaattttttttcctttgactctaattttcatcactaatttttcactcagacccccattcttaccagtgcttgtttttcccggttgccctaccgggaccgggacctgagcttttcaaaatccgggacctcggatgaccgggaattcccggcccggtcccggtcccgtggcactctactttaaatcttaaacattttttcgaaaaatcctcatttttgcaataaattttaattatatatttctttaaataattttatacaaaaaaatagattttagtttctaaaaatcgcgaaatatttgcatagatagttgctaaaaaactggtaaattcccaaaatagttgctaaaaaagttgccaaaaattggaaataactgcttttttgggtaaaatctgttaacaaatcgtattataaattacaaaatttttcccggcgtcgcctatcggcaccgccggcccccggttccccaaaagttttttggaaaaagcgcagtaaaaatgcgcaacgcagattttttcgcgtccagaaacccgaccgatgaattttcggccgacccgacccaaatcccgacccgatattttttggaaccgcggcaaccctgttataaatgacaagaaattgatgaatttgattgtttcaaacgaaaaatatgacagttgactgattttgttcgcaattttatgatgttttaaaaatgaggattttttatggctgaaatgaggattttcaaaattttgagatcgaaaccctgatttaggcgtttctccgtgccaccactgtgccagtcacattctgtcacttactttacccaactcagcgcaaattgtgccatttgaattggtcaatgaacgaactcgagaaaaactgacactgctgaagaaggaatgaggagacttatcgatatataatagtcaatg

SEQ ID NO: 108690 - DNA, 552 bp, Heterodera glycines
  Promoter: Source sequence=SeqID_3876; Location=2094..2645; Strand=-; Gene=SeqID_52241
ggttggggtttgtttgtgtgggtggtgtctcgctggggggaagtgtttttgatggggcctttcgctcttacttttattaaacagtttgaagtttgtgcccttcgcggggtcactctttcgtgactaccccccccccccccattttttctctaattccctcctttttccttttccagatcatttggtgcgctatatggaaagttaccatttttgaaaatttttctcactttttttggtaaaattttttttttttatttatttacacataatgatgtatattaagcattaccatcacaattatggtgaatagaaagtatattcacaattttttatctcaaaaaaattttgcaaaacaaaagggtccccccttttgtttttgataaaattaaaaatctgtcactttataactatcgccaaatttcttaatatgcccaaataattgtcatatttatgatcagcgacctctaaaacccccgggtactacttggtgtcatgactttttaaacaaaaaaaaatttaccaaaaaaaagtttgaaaaaattttcaaaaatg

SEQ ID NO: 108691 - DNA, 776 bp, Heterodera glycines
  Promoter: Source sequence=SeqID_3624; Location=1442..2217; Strand=+; Gene=SeqID_51165
atcgagcaaattgaaaccgaccaaaatttttacctcaaaagtttccccagctcgtccattttttattttcatatgtaaaaataccggtttccaggtacaatttggaaataagtacagttaacatttcccaaccatgtcgaatccgagataattttctctgctaattatttgaaaaaatgtcaaatattgtgtaaaaataagtgtcaaaattattttaggggctaaaatttaaaaatacggatttttaggttcgaacatctaaaataggaattctagggtcgaataggcgcttgaaaaggaagcattttcgcgctacaaatatgtttttcgtgcttttctcattgacttaaagacgcggaaaaataagtaaaagtctaaaaatgaatccgctcccaaacagatgataataatccaattttcattgtctttcagatcaattttgcgccactgctgatgggttggcccataaagataaagtcatccgttccctggtcattactcattacatttctttttttatggaaaaataattctgtgaatgttttttttgtcccactgctgattgatgataatgaataatcaaaattcattttttattgaacataagcattaccattttcataaaataataaatgaattaaattaaataaataataattctgccttaatcccttatataccgtgccgtaatcattcatttccccctttctcggcgggctgtcctcctcgtcttccgccgtgttgttgttctcctcttcctcctccgtttcgccatg

SEQ ID NO: 108692 - DNA, 1003 bp, Heterodera glycines
  Promoter: Source sequence=SeqID_7567; Location=3030..4032; Strand=-; Gene=SeqID_65251
atgtaaaataaaaagtaagtgactaaattaatgatgtcattggctacaatatgcaaaaaaccgcatgtctctacgacttctgtacgctgagactccggacgattaatatcgaagtgatcaaaactactgtaaaatgcactgtttcttaagaattatacaatacttttttgctgttcgaaattaaacatgtaaattctcagagttcagaagtcgtagcgacatgcggttttttgcaccttatagcaaattttgtgctctttctgtccgccatattcatcttccacgaaaatttttttccagccccctaggaattttttcccaaatttaccccgctttcaagccattttgaggttttcagatcagcccgaaggagtggtctgatcacggtggagcaaaggacttttttgatcagcatgaaaagttatgtttgttaaatggccgaaagatggcgtagcaaaggccaatgtgacaaaaggctgaaaaacaaaaggccgaaatgtaatggaccaaaggccaatgggacaaaaggcctaaatgcaatggatatatgttatttgttttggtcatttgtggtcccaaagctgggggataaaatggataaatgaaatgattgaattattgcaatctgtgcccgttcaaattgggagtttttggtagccgttttacataaaaatggctatttttgaggattttttgtaataaatattggacagaagtggacaaaattgtacagtggacgttattgcagaggcttcttgtaccccaccaaatttgacaaatgaaaaatgtttctatggtaattttaggcgctgatcgagaatttggcgacaaaaggaaaaaacggtattttcaaacaaaaaattagataagggtttaaagaaaatggattcgattttggaatttaaaattccatgttctattatctttgactgacaaaaatatttttttcattggaaaatatttcctccagaaaaggtgcaaaaaaatcagtcaattaaggatg

SEQ ID NO: 108693 - DNA, 478 bp, Heterodera glycines
  misc_feature (11)..(12): n is a, c, g, or t
  misc_feature (39)..(39): n is a, c, g, or t
  misc_feature (45)..(46): n is a, c, g, or t
  misc_feature (59)..(59): n is a, c, g, or t
  misc_feature (63)..(63): n is a, c, g, or t
  misc_feature (68)..(68): n is a, c, g, or t
  misc_feature (70)..(70): n is a, c, g, or t
  misc_feature (84)..(84): n is a, c, g, or t
  misc_feature (89)..(89): n is a, c, g, or t
  misc_feature (95)..(96): n is a, c, g, or t
  misc_feature (105)..(105): n is a, c, g, or t
  misc_feature (108)..(108): n is a, c, g, or t
  misc_feature (114)..(114): n is a, c, g, or t
  misc_feature (120)..(120): n is a, c, g, or t
  misc_feature (133)..(133): n is a, c, g, or t
  misc_feature (159)..(159): n is a, c, g, or t
  misc_feature (162)..(163): n is a, c, g, or t
  misc_feature (174)..(174): n is a, c, g, or t
  misc_feature (176)..(176): n is a, c, g, or t
  Promoter: Source sequence=SeqID_25592; Location=1107..1584; Strand=-; Gene=SeqID_56330
ttttggacgtnntgggccaagtcacgtcattccactagntatatnnttgtgttattatngatnatttnanaagtacttggtggntgaancaatanngaataaatnagnagattntgtagnaaaagtatttgtngaaaaatttttgttattttttggaanganngaaaaaaattnantccgacaaaggaaaggaatttatgaccccctttttaaaagaataaaccaaatttttgggtttgagagggccttttccggctgggtatgacccccaggccaaccggtttgggggaaagagtaaatggagttttgatttaaatattaaaaaagtttccagcaagtaattggacgtgggacgaacgatttttatattcagtttttggttacaatataacgccatccgagtcaacgggtttttcaccatttcttttaatgtttggcagatcagcgaaaatttccgatggataagatcaccgaaatg

SEQ ID NO: 108694 - DNA, 528 bp, Heterodera glycines
  Promoter: Source sequence=SeqID_12637; Location=629..1156; Strand=+; Gene=SeqID_76313
ttttgttcaatgcgttcactttaaataggcattttgaatgtgtttttttcgagtgatcattttcaaggacattttgaattctagggataaaccggacgcaaaaaggggcacctgccagaggatccaaaaagggtaaaaacccaactcgttttcagccaactcgtttttaccccaactcgtttttgacccaactcgtttttattaccccaactcgttttttgggtcgaaacccgaaaatcgatgccaaatcgcttaaatttcaaaatgttttgacctaatttaattcgggaatactttttatgtcaaagaccaaaatttaggaaatttgaaaatccgaattttctaactttctttcgaacttagttttttttttgaaaaaaaaatttttttttattacggcctgaaaacatatttccgggggttttaaggttcgctgatcacaaatatgatatctcttgctaaatttacaaaatcaaaagtaattttgtggactattttcagtgtttattcggcaccttttgagttatg

SEQ ID NO: 108695 - DNA, 154 bp, Heterodera glycines
  Promoter: Source sequence=SeqID_5788; Location=1796..1949; Strand=+; Gene=SeqID_59230
actggattttttgaaatttgttttaaaaagcaaataaatttttgaaaaaatcaattaattgcttgggaacatctaaaaatatctaatttataatagacctggacctggatttcctggacaaaaaatccaggaaaatccaggttgccgaaaaatg

SEQ ID NO: 108696 - DNA, 997 bp, Heterodera glycines
  Promoter: Source sequence=SeqID_5875; Location=391..1387; Strand=-; Gene=SeqID_59517
tagtcaattaattggtctgaaaaagctgagggatttgggaaagggaatttttaagaaggaaaataaatgtaaaatttaaaaagaggaattaattttgtattttgaaaaatttgaaatatcatttaatgcttataattagctgcttttttaaaatattattgaggaggggcgatggctttttaattgcctcccctcccctcccccaaccctaatgccagcccttgtataataatttttatgttaaatttgcctgattgtgagcattacatttacgcacgtattattagccatagcaaatgccagcaaattcataattatttaatcatgtgtaatttaactttcattagcattaaacgaatgaatgaatgaaagccaccatcgattattcaccacttaaccacgtcaattatgacagcaatgatggcattgttgcttaatagcaatagtaataaaaaaaaattaattaattcaaagccaaaaaattggataaacgaaaaaagaaacggaaaaaaactgcaaaataatttaatattaatgaatatgcatatagttagtgaggaggcgttgtaaaacttattcattcattttcaaaatttcatctatttcactgaaaatgaatgaaaaaataaagaaaatcagttttcgaattaaagggggaagactcaaagtgaatttaattaatttagaaaataattcacaaaatttggtataatttgcattatcaaatttcttattttaaatctgtaagtttgtcagaattatcagacaaacaaataaataggtgattaataaaattcaattaaaatacattttacattttgaatatttaagcattttccaaattgtctcattttattttatttattcgcagaataaaataagccgtcaacagagggtgaaagagggttgatccccgattctcgggaagagaaagttcgggattgggaaggaaattctcgacgatattgtcggactggctggagaaatttggaaaatg

SEQ ID NO: 108697 - DNA, 1003 bp, Heterodera glycines
  Promoter: Source sequence=SeqID_13376; Location=2418..3420; Strand=-; Gene=SeqID_77259
tgggtggagccaccgcccaagtccaacgcggccaccgcctttgactctgtttggggggaagaaagccacgggaaaatcttccagaaagcggaaaattttgacgctaaaaaagagagggaaaaatgtaaagggtaaaaaatgaaaaaaaagtaatggctaaaaaatgcaaaagagaaaaaagcatcgccaacggcggtgccaagcagacggcagaaattttttgaaaatttagagaagattttttctaacagagttgccgagaaaatgcaaaaaaacgttatttgggggcatacattaaaaaggggggtgtgggaggtcggccgccgatgaccttttttttgcttttcaaacaccgtttttttcggcgcgctttttccaaaaaacttttcgagaacttggggccggcggtgacgataggcgccgccgggaaaattttttgagctttgggtgtgatttgtcaacagattttcaccaaaaaatggccaatttttgcgattttgagccaattttttaagaaaaaattgggatttttggggtccggtggtgccgatgcgtctgagccaagcataaaacatcataacttttttcattgttgttaaaattttataaatttggcatcattcgaaagctctacatgtttagaagcttttggtaaggtttttctaagcgattgaacaacttataaaaaagttgcaacatgaatactaccaattgcttcaaatctttcactgtgtccatgccattcacttcaacagttattgttttatgggccaaaatgtcttgaatatatgctcatcaggtgtcactgttttctgtaatcagtgcatggtggcatcatcaacagaagaagcattgtcatgagtctagctgaaatgccgccaaaaagaaatgatctgaatgcggaattttccgtttatcttgaatgcgacaacaaaaaattggtgaacaaagtcagcggaaaaataaataaaattgtggggggggggacgaaaacgggggaatg

SEQ ID NO: 108698 - DNA, 944 bp, Heterodera glycines
  Promoter: Source sequence=SeqID_17512; Location=1..944; Strand=+; Gene=SeqID_82017
ttgatcctcaaaaattctgatcaaaactttcttagaaccagcaaaattaagaaaatttaatattattcggtagccctaagtattttcaagttgcctgcaaaaatttaaaaaaattcggccaagcttcaaaaaagctttggacgaaaatgtctgaaaacctgccactttggtacttttggctttaactttgttcaaagttgatgaaatttttttgaaatttggttatctaatagaaaacttttagggatatcgaatgataccaagaatgtttaatttagttgacttagaaaaagttgtgggctgtttttgttgaaaattttcatttgatggttttttatataacgcccttattgatggttttaacatattacgacatagcaccccctcaagcaatcctgtaaaaattcataaaatttagttaattttcaaaaagtgatgaggaaaaggttaaaaaacctagttttttgagtgcgtctgactatgcataagtagcctaagccgaggctaggcctaggccaaatatgctgagatttgatattttactattttaaagcttacatatttctttttacattttaatcgccgaacattttaggacttttaatgaaaaaatatcaatatatataaaatcattattaacataaatgaataaagaaagatccagaccattaacattaaaaaatcgaaatatttaatattaaaaaggggggaaagaaaaagatccggaccaaaaataaagaaaaatgaaaaaatcattaaagaagaaaaataccaacactattaataacgaataaaaaaaatcgactacatgttaaatgattattaacataaaagaataaggaaagatccaaaccattattaacataatagaaaaccgaaatatttattattttataaaatatttttatttattaaaattaaaatgaattccttcgaaagcaatg

SEQ ID NO: 108699 - DNA, 120 bp, Heterodera glycines
  misc_feature (71)..(71): n is a, c, g, or t
  misc_feature (79)..(80): n is a, c, g, or t
  misc_feature (114)..(115): n is a, c, g, or t
  Promoter: Source sequence=SeqID_705; Location=4375..4494; Strand=-; Gene=SeqID_59299
aagattcatgaaaacgtgctggaatgatctgacccagtttctcaatgacggctttgctgccacatatttgncatactgnncaagcatatcacaacgaaaagtggtcgtgtgacnncaatg

SEQ ID NO: 108700 - DNA, 140 bp, Heterodera glycines
  Promoter: Source sequence=SeqID_12286; Location=305..444; Strand=+; Gene=SeqID_75878
gcgaccacgggggtcatctaccggacgccacgacactcgggcggagttgagcaggtaattaagaataatcactacctactggcttaaatcgcatttcgccttagggccgtctttcgcgcggctcttcgccgttgccaatg

SEQ ID NO: 108701 - DNA, 286 bp, Heterodera glycines
  Promoter: Source sequence=SeqID_9802; Location=1..286; Strand=+; Gene= SeqID_72747
ttcaaagggtcagtcggcttttggggagcgtcatttttgccccttcggaatgcattttgcctacgccacgcaacaatgcacggccaattctcttccggccgaagtgatcagagacagcaacgaattgttccaaattggtaaggcatacatcgatagtttcagtggagtttatgcttggtctggttaagcaattcttaatgggtcgtgtgccaacggggaacggtgcattgggggtacggtatgcgaccggacggaaaggcgttgcctttgtccgtttgggacaatg

SEQ ID NO: 108702 - DNA, 188 bp, Heterodera glycines
  Promoter: Source sequence=SeqID_997; Location=471..658; Strand=-; Gene=SeqID_65662
ttttttggcattcgcatacgccgtttttgttatttctcattttggtacggagaaagcgaaaattcaagaaaacgcgctgctggctggacttgttgaggaaaattggaaggatacttcgaaattggaccattttctgagggatttgcgcaggaatgttggtgacaaaaagaggtgatggtttggaaatg

SEQ ID NO: 108703 - DNA, 1003 bp, Heterodera glycines
  Promoter: Source sequence=SeqID_19801; Location=494..1496; Strand=-; Gene=SeqID_84536
gtggtgattaccatgtattcggtgtcgcaaattatcgcatcgccactcctcggcatttggtcaaatcaaatagggaagctgaagccgcctctgttagtgccgtttcattcgttattcgccaaattattgggaggaaaattgggaaaacataacatgttcaattttggaagtcaaaatgtttcttcaccttctgacttcagaaggtgcttcgtatttgttgcaattcctttttaagttcaaaagcgtagcgaatcaacagaaagtttttcaaaattgaaaattcatctaaaagagaattaaatcggcgctatatgcaaagtgacagattttgaaaattttttcaacttttttttggtctaatttttttttctttatttttatgtaaattgtttttttaacatatggtacgcatttcacgttatttaataattgaaaaaagtgaaaaaaaatttcaaaaagatactttttagactttgggtttttgaattttatcaaaaaccaaagggggacccttttgtttttataaaaatctgcttattgttaaactaccctgatttgttgctcaattcagaatcctttgcaatttgaccatgtttgtcggcaacttgatttactttctgatcgagttgttcccccctgaacatacgcgttatgtgatgctcgtctctcgtttcattgtcggcatcggatgggcacaggtgaaaaccaaatttgtttttgtaaagaaatttagggttttccattggtttaggttggcctgctcaaatccttcgcttcggctgcaagtttgcccgaagacagaaccaaagcaacggcgtacatcaccggcggcgtagcgttgggcgtaatccttggcccaggcaaatcatttaaatggtggaaaaccacaaaaagtgccttctcaaattcagcccttcaaatggtgttcactttcatcggcgacggagtgcttttgttcgaattcagcgaccattctttcctcaaactttccatgttcacaatg

SEQ ID NO: 108704 - DNA, 61 bp, Heterodera glycines
  Promoter: Source sequence=SeqID_11884; Location=3004..3064; Strand=-; Gene=SeqID_46993
tagttactactctttggttaggtattgattcttcagagttcagcaacggcctgacaaaatg

SEQ ID NO: 108705 - DNA, 240 bp, Heterodera glycines
  Promoter: Source sequence=SeqID_12719; Location=1..240; Strand=+; Gene=SeqID_76412
agattttggatgtcaatcactttttttcacatcaatgatggatcagcattacattaaccacaagtgatatgcatcgaaaacagaattgtgcattgatcccaacccattcattaattcatcatttcattttggagagacaatttatttaattaataaaaaataaaataaattataaaaacgatttaaaataaaaaaaaatttcatttgtttttaaaaaagctaagaaacatcctttaaatg

SEQ ID NO: 108706 - DNA, 167 bp, Heterodera glycines
  Promoter: Source sequence=SeqID_11098; Location=331..497; Strand=+; Gene=SeqID_74428
ggtggtctaagcttggaaaatggcaagtcttgcaattaaaaggccatttcatctgtataaaaataaactgacgtttcaattaaaatattccaaaaccttttaaagtgaattagcaatgatttaggctcaaaaaattggcatcggtcggtgactcatcggaagtgatg

SEQ ID NO: 108707 - DNA, 120 bp, Heterodera glycines
  Promoter: Source sequence=SeqID_2383; Location=8180..8299; Strand=-; Gene=SeqID_79460
tgtgagtgattaattctgtacaatttttgccgtgccatcttcacattccattccatttgttaaggttacggcgacaaaatgtgcaacaggttgcgtttgctgatcaccgaattgaccatg

SEQ ID NO: 108708 - DNA, 241 bp, Heterodera glycines
  Promoter: Source sequence=SeqID_21154; Location=1271..1511; Strand=-; Gene=SeqID_51735
accaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttgatacctgtcctgagtgttttagcccaacatttattagaaaaaataacatcatg

SEQ ID NO: 108709 - DNA, 201 bp, Heterodera glycines
  Promoter: Source sequence=SeqID_23534; Location=1160..1360; Strand=+; Gene=SeqID_54222
aaatggggagtagggggtgagagaatttcaagtaactaattgatttttaccaatagattcgccttcaaccttatggggacggaaatgggcgcaccgggcaattattaattaatttgattcttcgccgcagttcacaccccacattcattatcaaagaggattgtcgcaaaaaaattaataccttattaaaagaaaaagatg

SEQ ID NO: 108710 - DNA, 283 bp, Heterodera glycines
  misc_feature (58)..(59): n is a, c, g, or t
  misc_feature (69)..(69): n is a, c, g, or t
  Promoter: Source sequence=SeqID_16743; Location=1..283; Strand=+; Gene=SeqID_81154
tatggacaggtctttaatgattaaaaatctatatgtctcttttaggacagagaaaggnnggctcttggncgaggctctatcttgtccctccaagtctctttgatatttctcgtcgaattgttgcagaaaaaatgatggaagaatttttaaaactgccatcacactttcgaattgctttttataataaatattaattgtgtaatttttttttttgccttagttatagtcgaaatttatttttaattgtttagttttctaaaatttattttagtctcgaaaaatg

SEQ ID NO: 108711 - DNA, 446 bp, Heterodera glycines
  Promoter: Source sequence=SeqID_6300; Location=686..1131; Strand=+; Gene=SeqID_61070
gcttattttgaggaggcgctttctctcacccattccctcgttttggtgcacatttcgcctgagatgtggacggtttttgaccatatttacaaggcttttctggaggaaggcacttcatttttctcaggtaaaattgtatagtctttagattattcttccctactcgatgtttgacagtttttcgccaaaaaatgtccaattttgtgcatttttgattttagtggtttggggttttcctcatccacctttgttacggcctttgctgttctaaaattcttattgttactaattgattgaccgttccgtgtttaattaggtcttttcttacatttcttattggcttcttcattcactaagattgtgcaccagtgctccacgcttttttgaccaatgacactgacaattttctgtctgtttttgaccgagtgcaacattttctggcgatg

SEQ ID NO: 108712 - DNA, 128 bp, Heterodera glycines
  misc_feature (38)..(38): n is a, c, g, or t
  Promoter: Source sequence=SeqID_3150; Location=21..148; Strand=+; Gene=SeqID_83422
gaaggagctggtcagtcatcagttagaccacgaattanaatttatttcttgtaaaagttgtttcacattaaaatgatgccccattataatttcaacaattttattttttcatttttcagctgacgatg

SEQ ID NO: 108713 - DNA, 188 bp, Heterodera glycines
  Promoter: Source sequence=SeqID_27554; Location=1..188; Strand=+; Gene=SeqID_58255
ttatatttgcacatgctttggcgtaaagtgaaggtctcacacacatacataaagctaacattcgggggcctgggaatggttgcgcatcagtgggaacggtaaaaacccggtttggtgtaccgttttttcgacataaaatctccataataatttttttggtttgaaaagaaaccaaggtccctaaaatg

SEQ ID NO: 108714 - DNA, 294 bp, Heterodera glycines
  Promoter: Source sequence=SeqID_29416; Location=1207..1500; Strand=-; Gene=SeqID_46163
gaggcttgggcattttgtggcttggacatttcgtgggcttgggcatttcgtggcttggacatttcgttggtcagcgggtatttgtccaaaaaacgattaaattttgcgtcacacttttaaattttctctaaagcaatgacattatgccatatcattccaaaattacgaattaaatacatttggacaattcagtctcgggtctgtaactctgtttagaattggcaccgattgaaaaatttcaggttttcgccaagttttctttagcataacgaatttacactgtcactaaaaatg

SEQ ID NO: 108715 - DNA, 922 bp, Heterodera glycines
  Promoter: Source sequence=SeqID_789; Location=1..922; Strand=+; Gene =SeqID_61292
ttcttccgcgcattgatgccgcttagatgaaagaaaaatggcggcaaaatcaaaattttagccgaatatgtacaattggcaccataaatttaaacgacaaacgtcaaattaggcattttgtctccgaatttggtcattcattacgagagcttccttttttagccaaatgcctaaaattttgcgcacttgatacgcaaagataagcacgaaaaacgcgttttccgcttggtttgggttgtccacgatgacttttaataatgcctatttttgcctatttcagggtttttgtgcctaaggtgcctattttaggatttttgaaaaaatccttaacaaaaatgcaataaaaacgaaaaaaacaccactaagatccgacccgaaaaaaaatttcagaaaatacacacctaagaattgaaaaaatttttttaaaagaatgatcccaaaatttaatattttttctcaataaaaatttttggtttaaaatttttccttattttggaaaaaactttaaactatttaatatttcttttacaattgaaaaatttaagtttttacgtgttttaatacctaaaaagcgttaataaaaaaattttgtttgcctattttagtgcctattcgaggatttttgtgcctatttaatgcctattttgcgattttttaatgcctttttaggtgcctacgcgattttttgtgcctaaaaaggaagccctagtcattacgacaaaaaattctgtcgtttaaatatggcgtttttaaaaaatctaccgtaaatttgtcgtttggtcgtcacttttcttttggatattggatatgagtttttgaaaaaccgggatccgctccagaaaagccgggattttcggaactccgacctagtgcaaacattaatttcgaatataatttgaaactgcttaagactatgaacatg

SEQ ID NO: 108716 - DNA, 95 bp, Heterodera glycines
  Promoter: Source sequence=SeqID_10108; Location=1..95; Strand=+; Gene= SeqID_73190
ttttcagcattttaccattgaccaatcgttcggtgcttccgtttccggcgctgcctttcaaatgcctttcgacgagtgaaagtgaaaatgaaatg

SEQ ID NO: 108717 - DNA, 74 bp, Heterodera glycines
  Promoter: Source sequence=SeqID_7582; Location=1255..1328; Strand=+; Gene=SeqID_65307
ttttattggccacttaaataaaataaaattaatttaattaatattttttatcttttggccattcacttcgaatg

SEQ ID NO: 108718 - DNA, 487 bp, Heterodera glycines
  Promoter: Source sequence=SeqID_25842; Location=799..1285; Strand=-; Gene=SeqID_56609
cccccttttgagggcccggttgccaggtcaagcagtgtttaggtgttcttgtgttgtctccaattgtgatgacgtcatcatcattttgaggggaaaaattttcccgtttcgactcatccatttctttaaatttaaaaaaaatttaaaattattataaaaaactcaaaaaatgattacttttgttctcaaacaccaattgatcattgatttttctcggggccattacgattaagaaatagtttatgattataattgttaaaagcataaaatgaacctgcgaaaaaaacacgtaattattgattgatagtgagaggggtgttagcgcgcagcgacctccagacgggctgtcccttcttaatcgataggccacgcccatccacaaacacatagacgagagagtagtggttagagaaagatacaaaagggcgccaattcaaacacacagtgaatccccaagccgatttattgattttttttacagattatg

SEQ ID NO: 108719 - DNA, 1003 bp, Heterodera glycines
  Promoter: Source sequence=SeqID_32428; Location=482..1484; Strand=-; Gene=SeqID_62735
caaaatttggtgagccgctgatcaattacaaattatttatggacgatcaaattttttgaaattttttaagtgcaaaagtggtgggtgtctgcaaaaaattttcaccgggtttaaaaaatctaggaaaataagtaagcttttgtagtgttccgatacgtatctctgcaaaatttggtgagcccctgatcaattacaaattatttatggacgatcaaattttttgaaatttttttaagtgcaaaagtggtgggtgtctgcaaaaaattttcaccgggtttaataaatctaggaaaataagtaagcatttgtagtgttccgatacgtatctctgcaaaatttagtcagcccctgtcaattacaaattatttatggacgatcaaattttttgaaatttttttaagtgcaaaagtggtgggtgtctgcaaaaaattttcaccgggtttaataaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtcttacagcttaactaggcccaattaagcttatttccagaaaatctcgcatgaattctcatttttaaattttttatagatttttaaatgtttggattttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 108720 - DNA, 192 bp, Heterodera glycines
  misc_feature (165)..(165): n is a, c, g, or t
  Promoter: Source sequence=SeqID_29594; Location=788..979; Strand=-; Gene=SeqID_60072
ttttagaaattctatccgtcatatcggctttggaattttaatgagtaaatcaggaaccgtaaatgacattctctgcttctcttgttggatacacggaagaaataatagttagtccttttgttgaatttttagaaattctatccgtcaaatcggcttttggaattntaatgagtaaatcagtaaccgtaaatg

SEQ ID NO: 108721 - DNA, 343 bp, Heterodera glycines
  Promoter: Source sequence=SeqID_42094; Location=529..871; Strand=-; Gene=SeqID_70076
ttagtcaaattagttcaaaacgcccaaacacccgtttttttttgcggatgggattttagtaacgagataaagctgggatttcagttcgggaaaccaacccacttttattgttttcccattctgtcctgcaatgattttttgttggactcgtattctattttaatttaaaacatttagccaaatttttttggcattatttttttctttttgaattcttttggcttcgaagttcaagcaaaacaacagacccaaacaaacaaggagatcaagcatcttaaaattgcactttgtatgtttgttcaaatttttgtcttttaactataatattttttttaaatagatg

SEQ ID NO: 108722 - DNA, 377 bp, Heterodera glycines
  Promoter: Source sequence=SeqID_9051; Location=1737..2113; Strand=+; Gene=SeqID_70108
tcggtggctgatggaccataaaaacggagtttaagatgcagacaaataactaaaaattatataatatacaacataaaatacataaattaaaatcacaatgaccatattaaaataataaaaggactagaaaacaagaaaaagcgaagggactaacaataagattctttgtgcttcgtacacacataaaaaacaaaaatagttaaacatcaaaattaaaattctattttgattgcagttttataattgtcaattaaaaaagagacaaaatgaaattacgaaaaaatgcctcgtacaattctcaaattttcagccaaaataaaaataagtggataataaattaaaaaattatttgatttttatttacaaaaggttaaatg

SEQ ID NO: 108723 - DNA, 468 bp, Heterodera glycines
  Promoter: Source sequence=SeqID_37440; Location=893..1360; Strand=+; Gene=SeqID_66518
tggcaaaaaatatttttatttaattaatgaataaaatttgaattgatgatattttttttgtgttttttctgtgcacttaaataccccctttttctgacttaattaattgacgtggcctttagtagacaaaaacatcaaaaaatcatttttgcggaaattgctgctggttttcttataatctacgctttcacatgaattttcaaagacttaggaaatgtatgcagagaattataaatattaatattttttttaaattattatatttttcataatatttttgaacatgaaatatttcatatgtaatttctcaacaattttaaaaattcgccatttttattgcaaaaatgtatttcggccgaaaaagcaagccaaaaattttatttttttttatcaaaaaactttcttatttcttttctataaataatcaaattaaaatattgatatttagaactgagaatttaagaaatg

SEQ ID NO: 108724 - DNA, 342 bp, Heterodera glycines
  Promoter: Source sequence=SeqID_22730; Location=1890..2231; Strand=-; Gene=SeqID_53422
catcgaaagggggacaaaatgccatcgaaaaggaggacaaaatgtcatcgaaagggggacaaaatgtcatcgaaaggggggggggacaaaatgccaacaaaatgccatcgaaaagggggacaaaatgtcattgaaaggggagacaaaatgccatcgaaagggggggacaaaatgccatcgaaagggggggggacaaaatgtcatcgaaaggggggacaaaatgccatcgaaaggggagacaaaatgccatcgaaagggggggacaaaatgccatcgaaagggggggggacaaaatgtcatcgaaaggggggacaaaatgccatcgaaaggggggacaaaatg

SEQ ID NO: 108725 - DNA, 116 bp, Heterodera glycines
  Promoter: Source sequence=SeqID_13939; Location=2291..2406; Strand=+; Gene=SeqID_77893
atgaatatttttgtgccaaatttttgttcccattttcggcactctcgcactttttgacggatgcatcaccggggcaagcaaaaactgtacggcaaatgtgaaaattgattacaatg

SEQ ID NO: 108726 - DNA, 124 bp, Heterodera glycines
  misc_feature (46)..(46): n is a, c, g, or t
  Promoter: Source sequence=SeqID_624; Location=1..124; Strand=+; Gene =SeqID_57745
ttaaaaacggaaaatggaacgggaatcatattggggaaacattttncgggaataaatggagtaatgtacagaaattttcataagtgaaaaagaaaattatgacgaccaaaacgagttcagaatg

SEQ ID NO: 108727 - DNA, 104 bp, Heterodera glycines
  Promoter: Source sequence=SeqID_21816; Location=1..104; Strand=+; Gene=SeqID_52443
atgcatggtcttcttgaagacggaaaatttgggacaaaactctggcagaggcagctctgtcgcgctggccagatcagatgagatggctttttgtgagcatcatg

SEQ ID NO: 108728 - DNA, 994 bp, Heterodera glycines
  Promoter: Source sequence=SeqID_13151; Location=493..1486; Strand=-; Gene=SeqID_76963
aataaagaaaaaaataataagaaattttaataaattcaatattcccaaattgaaattagtgaaggtaagctgatgcaaagcgatctgtctcaattggagagaagtcttatttgacataacttttttctttcttttttatagaatttctaacttataataaatataaaagtcagttcaagaattttataccaagaaaattttttatcttgtttcacttccacgctttagttaaccgagagcttaattttttccggcatgtcaaaccaattaaattaacaaacaaaaactaaaatagtttatctttttctcaaaaattgtccgtaatttgctgttattaaaactatgggcccaaaattaaaaatgagcaactacatactatatttatctatggaaactaaacttctttaaaaaatgggttctttcgatgttgattgcaaaaagttgatcgattactcttgaagggcgatgttcaacttggtaaaaatcacaaataaaactacttagtcactcaatttttgaaaaaattattatttttttttgttttttttgacaattcaacccaaaaatagtggtccgcaaatgtcggtccgcaaaagtcggtccgcaaatgtcggctaaccatcattttgtatcgcactgaatttcaaaaagggtattcaaatctatcaacttttcggtatttattttcataagcggttctggatagagctcggagcaggaccggatcctgcgcaggattttgcaggatcccagttcgcaatcctgcattttttggaaaatgcaggatttgcaggattaatccggccggatccggtccggcaaaaaattttgaattccaatccttcaacaggatccgcaaatttgaaatttccgggctctagttctggacacggtcaagattggtaactttttttccggccaaggaatgactagagaggcaaacaacggaaataaaaataaaataaatatttagctaattttagatgaaaacatg

SEQ ID NO: 108729 - DNA, 875 bp, Heterodera glycines
  misc_feature (27)..(27): n is a, c, g, or t
  misc_feature (31)..(31): n is a, c, g, or t
  misc_feature (41)..(42): n is a, c, g, or t
  Promoter: Source sequence=SeqID_24681; Location=809..1683; Strand=-; Gene=SeqID_55427
agagtgatgatgatgatatttgctatntganccttatcttnnctaattggcatccctatttttcctattttaaagtcttttcgtattacgggctattttttcatatttcgggattaaattcaacaacaattcctgactttcttgattatgtaattattatttaaaggataaatattaaaaaatgatatagactattacttaattgactcatattttatttactgaaaaggaaattgaaaatattttggataaaatatttataatatttttaatttgcaaaatatttgcttaatgttaaaagtgacaaacattcttttcaagttactggttccaacaattttgcatattttcttaaaaatttccatggcgctgcctttcggcagcctccagcctttcataaaatttaaaaaaattaggcctatcataaaaaaaagttgtgacgaagagtaaaagtaaattgcattagctccaattttaattctgatcgctcggatttgcaatgatcttcatttcattcaaaaaaataaattaaattaaatcttcacatttatttcatgcttatttgttttggcacatatcctctcaaaaaaacgattaatttataaacattgatttttagttgattaatttgtggcggaagtaaaaatgaataaaccaaacttgcaaatatgtttgtaaattatataaaaactgaatgaataattattgtaaattaatttattcagaattttttaattcaatttgcttatacatatgaaatagcaatttattttttaatttaataaaaaattatgaatattaattaattatgtaaaaaggaaaaggaaatgtttaagcattctccatttaaatattactcctaataaatgaaaatg

SEQ ID NO: 108730 - DNA, 960 bp, Heterodera glycines
  Promoter: Source sequence=SeqID_26585; Location=1..960; Strand=+; Gene=SeqID_57318
gtcagtgtagtgcttttcgccacttgtttttttttcgtgttggctttggtcgttggagtaatgaattaggagtcgctctgtccacttaattatttaaattagtgatgggtttgttgtagggtttattatgacttttaatttatgtttggctttttatggtgtcctttttcggtttttttaattgggtttggcgatccgtgtgtgtgtgtgtgtttgttttttttaattgggtttgtcaacccttgattttgtatgggcttggtgacccttatacttccggatgacgagcagttggggagcggcgattttgacgtggcacaggtgcagaccgaacaggcagcacagttgaacgaacaggtgcagaccaaacaggcagcacagtgaaggacaagcaagtcaaacgggcacaacaggacgaacaagcacggcaggacaaacgggcagagcggcaggcacggcaggacaaatgggcacagcggagcagacagacacaacagggcgaacgagcacagcgggacgcacggcaggacaaatgggcacagcgggaaaggcacggtcccgggtcgtggcaccaattcttgtcgtggcgacaagaaatttgcttcgaactctgcggggtgaaggggacgggaaggggatgaaatgggcgaggcgcgcagagtagccgttcgggggaatgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaatcagaaatggaaaaatgtggcaaaatcaaaaggggtcagaacggcgaaacggcgatg

SEQ ID NO: 108731 - DNA, 320 bp, Heterodera glycines
  Promoter: Source sequence=SeqID_23791; Location=1..320; Strand=+; Gene=SeqID_54492
caatagtaaaaatactcacccaaaacaccaccactactgccaccgcaacatccgagaagccagctgaacaaaatttagcagttaaagataatagtattgctgataaaggtgacgcgggtacgccggcatcaagtggattagaacagtccgatgatgctgctacatcaacgactcgagttgaagacggtggaaatttacctgaagcagccgcgttgacctccaataacccaaaaattgttgctaagcaatcaacggtagcgacagagagaaggaaggagaaaataattgaaaagctgatcgacgaacaagtggacagaatg

SEQ ID NO: 108732 - DNA, 95 bp, Heterodera glycines
  Promoter: Source sequence=SeqID_36539; Location=1..95; Strand=+; Gene= SeqID_65822
catatcatccaagggaaggggtgccaactccttgcccaattgtctatcggcatacggatgaagcgcagtcgacatccaaggccgctgagctaatg

SEQ ID NO: 108733 - DNA, 608 bp, Heterodera glycines
  Promoter: Source sequence=SeqID_10186; Location=1376..1983; Strand=+; Gene=SeqID_73300
aactttataataatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgcaattaaacaggatttccttattttattaagtaaaataatgatttattcagttttttaatcagaaaaaaatcatttaaatgcctcaaaaaatgaattgccatttaattgaagaaaaataaaataaaatcttgaaaatgaaattctgtattttattatttttatttttgattgccctaattataccaattgaatcagaaaagaaaaaacttcagcagaaatcatttggcgaaatatttggagaaaaatgggaagaaaaagaagaagaaaacgaaatgaactcaaaaaaagagaaataattggaaaattttataaaataaaagagaaaattaagcaaaaaggaagaaaatactcagcaaaagaatgggataaaattaactcaaaaatagcgaagaaattggggacaaatcgacaatatatttataaatg

SEQ ID NO: 108734 - DNA, 77 bp, Heterodera glycines
  Promoter: Source sequence=SeqID_1066; Location=9991..10067; Strand=-; Gene=SeqID_67109
ttaattctttccgttaatcaacgaataaattttttaactattatatttttgattttttcaattaaaaaattgaaatg

SEQ ID NO: 108735 - DNA, 217 bp, Heterodera glycines
  Promoter: Source sequence=SeqID_9375; Location=463..679; Strand=-; Gene=SeqID_71149
ttattaattatttatttgcacagttttcattttttaaattttactgtcaaaattccaaaagaatgtgaaaaatattttataaaattcaacgttttatttgctcagcttttgaaaattttgacaaaaagcggaggaaaaagcctttataaagcgaacgcataacacagaaaaatcataaaattaaaagcttaattttaatttataattatcaaaaatg

SEQ ID NO: 108736 - DNA, 202 bp, Heterodera glycines
  Promoter: Source sequence=SeqID_45381; Location=1..202; Strand=+; Gene=SeqID_72680
ttttcaaatgtatttaattttttaaaatcaaaaattattactaggggttataaaaaagggaaatcagcgatacggctgcaaacactgcaatttcaagcatgatcgccctcagtctgtcgctgctcacggtgcgcgagagcacggcgatgagacggcatgcgtggatttgctgtacaactttgagagtcaattgttggcgatg

SEQ ID NO: 108737 - DNA, 442 bp, Heterodera glycines
  Promoter: Source sequence=SeqID_8885; Location=1200..1641; Strand=+; Gene=SeqID_69532
ttttttcaacctaacctagattttatttaatttcctaatatcagtggacctgccaaaatagtcaaagattgaatccgcgttgttttggaccttgggcaatttaacaacgcaattagtactgattttcagtataaaaacgctgtgtaaccaaattaattaattaattaaaaatgaaattattgtcaaaaatcctttttctgaccaatttatttgttgtgagcaattgccacccaattgctaccctttaccaagccgccaaaacactaaaaactctaaagagtgcgcatattttaacaagcgcgacaatcggtgccctcggtggagcaataactgcacaattaatcgaggacttaatcgagatgctagtcgaaaaatttgaaaataacggtattataatcataaataaacaacattaggttaggtatttgtttcagacgacatg

SEQ ID NO: 108738 - DNA, 915 bp, Heterodera glycines
  Promoter: Source sequence=SeqID_17455; Location=1..915; Strand=+; Gene=SeqID_81939
ctcaacaggaatggaaaatgtaacgaaacacaacccaccgccaccgcaccactcccaacacagccgaggaatgagtggggggggggggggtgacgcgagtgggctcggggggaaaatgaacacaaaatcaaacgaaacgaccaaacaaatcgtggccattggttcacaaaaaacaaaaccaaaaatcacttcattatcattgtcatcttcaccatattcatttaaatgttgtttgtttgctccgcttttcattcattcattataatttccaattgcatttttcactaaattttgtcaaaacgtttgagtgcaaaacgaaccttttcccctccttccaattaaattgcttttgttttacatgtaattatcaacataatcatcagaatcatcagcacattccccgcgggggaggggcggcagaagaacagaggccaatgagcaaaaagtccctccgcccactctcgtcacttttcgctatgcactcacgatttcattctccgcccccctccctccaaacgttttccatttttaaacgcttcataatttttggattgaatttaaatttattaaaaagcaatttaaaaatttcagtgagcttttccatccctacaaattaaattatataaattttattcctcgcgaaacatttggcaaagtctttcaacgcgaaaaccgacaaaaaaacgacctcagaggccatcaaaaacgacaacaataacagggtgaagcttatccatttaaacgcatcgccataagcagaaaatgttctctttgggcgaaccgcccgcggcaactgtctcctcttcgccagcgacagcggtgcggcatcaccaccaccatcaccagccgcatcagcagcaacacaaccactcgcaacagcagcagcaccaattcggctccccgtcgccggcaatg

SEQ ID NO: 108739 - DNA, 1003 bp, Heterodera glycines
  Promoter: Source sequence=SeqID_8313; Location=1671..2673; Strand=+; Gene=SeqID_67664
tttttgagctcctttcttcaaatcaattgagcaaaaaaaaagttttttcactagaaatcggtgccctacttatatcatacattttttactttttgagatttttatgaattttttaaattttttaaattatgactttttatcgtttttatatggctttttcatactttttgacgatgaattttttaatcgactgttggcaatttttagtgaattaaatacagtcctattaattaattcattttttggatcgctagaaagttgcaaaaaaagctcttttttatcaaaaatgaatagctcccggtcgtttcgacagcaaaggaattttcgacagtaaacataaaaacaaataattcttattaaaataaattatattacttgtcagttttactaaatttcttttaaattaagttactaatatgtattgcttgttaataggaatatgattttacgttttttacctagaaaaacttcagaaaaatacacccttaagaattggcccttaaaattttaaaaacacacccctaacaaaggagggcccccaagtgaatgtggagtttcgggatgaaacttggtgggtgggtagatttaccccggtttgttatgtgaattttttaccgtttttgctgaatggacatgttcgccgagttatgcggcttttccttttttccttccttatataatttgcaaagaaaataaaagcaatgtggttatgcctgtggctttactttttccccaaaaagttcgaatcccacgattttaatttaattttttttgttcacaattaaatattttttatcagatcattatcaaaatacattgttttgatcaaattattatttttttaatttttgctaaagaaattaattcattttttggacgaaaaatgtatgcaaacaaaaatgacctagttcgcttatcagcatggggaaagtgctttcggtggaccttttatatcataattcagaacaaatacctcgagaattccccccccccccccaaaatg

SEQ ID NO: 108740 - DNA, 224 bp, Heterodera glycines
  Promoter: Source sequence=SeqID_31880; Location=1024..1247; Strand=-; Gene=SeqID_62189
ggtcgataggctctattgcactttatgtttcctatcgacttttctgcggccaacccttttttatgagtactttcaattagatatccctgctttttatacaaaaactgtggtgatgccataagtaaccctgtctcctcgggtttgtaatttagcacaacgtgtaacctttattttcttgtcaacatttcaaggagtactcgaccaacctgaagctgggcgtcatg

SEQ ID NO: 108741 - DNA, 643 bp, Heterodera glycines
  Promoter: Source sequence=SeqID_1087; Location=1..643; Strand=+; Gene= SeqID_67536
ggggatctctagagtctgaattgggctcatttcctccgatattttccacggccgacaattgcgcattttgtctttctctgattgcgatgggccgagttgggcactttggacccaaaacgggcacattgaaaaatgttgtctgagtgcagaaggatttgcaggttgacaaattggcattggagggtcgcgtagaccaagtcggtgaaagggggggaggaacgggaaggggaggggggtgaaaaaaccatttttggatttctcacggttcttttcccacttgaggttatctctgtctgtgcttcctcctccgcttcatcttccccctcttcttcggatgagctgtttctcctctccgccccttccctccatcccctccaacaacgccgtcgcattttccgtctgtctcgtcgctcctccgcccatccttccctcaccatttgctcgcctcctcccaccaacggttattctcttctctttggttacctttacggcactgtcggaagggccgtggacgaattggggcgactaaaggacgccgctgcaggaagcgatggcattgagaagagtaaactgttgccaaaaagttcggaggaactgttaggtcgtctgaaccgggaattggatctttttctgatgggagatg

SEQ ID NO: 108742 - DNA, 154 bp, Heterodera glycines
  Promoter: Source sequence=SeqID_17924; Location=1477..1630; Strand=-; Gene=SeqID_82482
ttttgctgaggtgcgacttgattttggttggaaattcgtttgaatacaaatggaaacactatttgaaatgcctgtcgatattccgtactaatagtaaaaaaaatattaacataatttttaaattaaataattacaccttgtaaaatataaaatg

SEQ ID NO: 108743 - DNA, 236 bp, Heterodera glycines
  Promoter: Source sequence=SeqID_19919; Location=162..397; Strand=+; Gene=SeqID_84678
taatgaaataattagtggttggttttacgcaaatgatttatgcaaatcactagaagacaaacaacaaaaaatgtataaaaagaaaagattttgaagaaaaagaggcagaatggtgtggattatgcacttgtgaaatggaaagggtatagcgctcgcttcaatagttggattcccgcaaagtcaattaccgataaagatatataaaaaacactatttgtcaaaatttaacaaaaatg

SEQ ID NO: 108744 - DNA, 68 bp, Heterodera glycines
  Promoter: Source sequence=SeqID_23084; Location=470..537; Strand=-; Gene=SeqID_53788
ccttaattaaacaggggaaagcgaattagaaaggcaatgtacaaaaatgaacaaaaaaatgcaccatg

SEQ ID NO: 108745 - DNA, 323 bp, Heterodera glycines
  Promoter: Source sequence=SeqID_34534; Location=1..323; Strand=+; Gene=SeqID_64299
agagaaggcggaggagaagcttagggaggaggaaaaagcaattgggaggagaagtaagctaaaaataaatcgaaaaggaaggaaaagccaaaaaatagggaaatcagaaaacaacggcacgaaagacggaggacagaagagaggcacaaacccagactgaagagccaaacaaagagcaggacaaaaagccaatgccaaacgaagcagggggaacagaacgcagaagtgaggggagaattcggtcggcaccgccttcagcgggaaaagcggcaccgacggcggaatgggagggcaaatggagagaggccgaaatgagagagatg

SEQ ID NO: 108746 - DNA, 747 bp, Heterodera glycines
  Promoter: Source sequence=SeqID_15098; Location=616..1362; Strand=-; Gene=SeqID_79276
tcgaaattttgaagtttttttcttaataaaatttattccaggctaaaaaatctttttgtttttttgtaaagcttatagagcatctgaagatctttcgaatgataccaacaatgttggatttggatgcaaaagaaaaaagttatagccaaaaacctaaacttttttgaaaatctggacgcagataaccgacaagtaccaataattgtttatttaacgaaagtaaatgctgaaaattttagcccacgaataggcacttatgtgatcaataaacaaactccgaacaaacaaatttggctttcatcgccagtttctggtccaaaaaggtatcactcactattcattaaacgctaatcccataaaatttatttgaggtacgacctcagcgacaaaggccggtgggtgtataagcatgatggagttacgctacacgaattgctcgagaaagaatttagacacattttcaaaaacgatcaaatttcgttacatcagagttaaagatttatcgttttttataccgatataaattttatttggtgaacagtgttttgctggttcaagttaataaaacaataattattcatttaaattttgaagttatgctcttggttttttattctgatgttttctgcccgttcgtctttcacttttttgcgcattttccaatgctttgcccgtcggtgtcgggcttcgcttgcagggaatgcaactgcagcagcacaagcacagccgtccaatgcaaatcaaatg

SEQ ID NO: 108747 - DNA, 752 bp, Heterodera glycines
  Promoter: Source sequence=SeqID_1792; Location=1..752; Strand=+; Gene= SeqID_75995
tcgcttcttaggggtgtattttttggttttattgcattttgttaaggaattttccaaaaaatgtcgaaatagtgaaaaaatagtgacgatacgccaaaatagtgatttctagtgactgataatgacatcagaatcgaaaaattttaatgcagaaatgcgttttttgagctcctttcttcaaatcaattgagcaaaaaaaaaaagttttttcactaaaagttgcggccctatttattacgtccaattgttcattatcgtgtaaaataatgtctataaatttcaattatgcacttaaaatcctaaataaatgtttgtttccatttcaaacaccggttttatgggcgaaaaaatatcaaaataatggaatacatttcttatttatgtttttttgaaaataaattaaattgaggcaaacattttattcactggtgtcaatttatttctttttttttgagacacatcaatagagctgagatttttatgaaaaaaacacttgattttcccatttttaacacatatttagtatatatttcagtattttttggcacatattttattatatttcagggtttttagcacataaaagtcccagccagcagctctactgatcaacaaaattttttcatcattatttgataagtaaattttattccatagaatattttaatagagcagaattgctatggttatgtgattgatcgtcattataaaataaatttttatgaatttggttacaaaatatttttagaatg

SEQ ID NO: 108748 - DNA, 145 bp, Heterodera glycines
  Promoter: Source sequence=SeqID_40650; Location=1..145; Strand=+; Gene=SeqID_68914
ttattaaagtaaaaaagtcttaataatttattgtgtatacttaggattggccacatatgcctttattacggtaacaaataaatgatttaactctcttttaatacagcgtgcgagatcggcatcgcgccattagatcgaagaaatg

SEQ ID NO: 108749 - DNA, 432 bp, Heterodera glycines
  misc_feature (41)..(41): n is a, c, g, or t
  Promoter: Source sequence=SeqID_8140; Location=1..432; Strand=+; Gene= SeqID_67110
tttatcggagattcgatcaattacacttcatgtgaacattnagcggacattattgcacattcatttgatagagacgacattaatggaattcttttatggacattttatgtgagaattagcaatttattccggagaagaataagcttaggtccatttttttatgtgatgcagtgaataatgcgctgatttggcaatattttggttttattttcagcataaaaaaataataaaaatttgcataaattcaccgatttctaaatgtatgccgacaaccctcggggggtcagcaccaactctgcctgcgggcaaaatacagaatttgattggagcaaccccgcctgcgggcaaaatacagatttaaaggtgaaaagtgaggatcaaaatgtagtgatcaatcgacctgtgtggcgcataaacatgctgagccacatg

SEQ ID NO: 108750 - DNA, 111 bp, Heterodera glycines
  Promoter: Source sequence=SeqID_14073; Location=916..1026; Strand=-; Gene=SeqID_78045
ttttggccgtaaactcggcctcacattggcacttttttcgccacgtttcaatgttttaattgacaaatatttcgatggcaaaagggaattaatattatttggagaacaatg

SEQ ID NO: 108751 - DNA, 881 bp, Heterodera glycines
  Promoter: Source sequence=SeqID_18799; Location=2011..2891; Strand=-; Gene=SeqID_83478
tcattttccttcttattgtgacaaccatacctataacaatcaaagttatcaaataaaagaagttatttttgattaaatttaaatatttatttaattttgtttttactataaataatttaaaaaaatgaaaaaattggaaaattaagtgtctttttttgtttaaaaattccaaaaaaaaatttgaaaatattttaagaaatgacatgaaagttgattttaggggtatatttttcaattttcttgtatttttcttacagaatcagagtatatctaattgaagatgaatagaatcaattttattttgcatacgataaatttttttctcgaataatgtaaatgtttagttgaataaatattaatattgtaaatattatttttacttaatgggcgttatttaataaataaaatttttataggttattatagcattttttcaattcgcaatataatatttattttttaaatttaacttctcatttgttagtcatctttatgacaagtagttgtttggttttcatattttttgtttttaagtttataacaaaacattagtttggtatattatttgcataatatttttcgagattttatcgaatattattttaatttgtatattcagttaattttcggattttatcatgcattttcacgcctaaattccttcacattcaagaaattatactgtcttctaggttcttaatgataaataataaaaatcagtttatttaaaaaaaataataatttgcttatttaaaaagatcaaataataagttttagtgaaaagagcaaaattaaaatattttaaaaatagaaaaacaatatttataccttctcatatatacaaaaaagaatattatacattgaactccagattgtacatg

SEQ ID NO: 108752 - DNA, 726 bp, Heterodera glycines
  Promoter: Source sequence=SeqID_3524; Location=4601..5326; Strand=-; Gene=SeqID_85031
ccattcgaataacctcaacccaaaatttcatttctgaaggagagggaagatagtgatcaaaatgatgaacacgaaattttggaagaaaatgaagtaattaacgaaaatttattaccatgtacaattaccgaaatatttttggagggtgaagtaaaattggcatacacgagctggccagaaccaaatttgattcctttgaattcgtcaatcccaacaaatttcataaaagaacattggaaagtactcacaaacgaatttggaaaaaaatatttaaatgcgtggctttttgggacagaatttgaattgtctttgaacaatgaagctgataaaattttgttgggaattcgtgaacaatttctaattaatgatgagtggacttcgaaaaccaatggggaaaatgagacgtattgggaaaaagttggagaatttaacggccaaattttagaacttcaaagaattcccgaaatattaatctcccgtaatgaaagcaaaattgaaaataaaagggacagtgatcaaaatggggatttaatgcaaaaacagagcataaatgttattactgaaaaagatttgttcatgagtatattcgatttaaatgaagaaattaataatgaaaaaggagaaaaatcagagaacaaaaacgaattaaaaattaatgacaaaaaatctaatgaatgtcataaaaacatggattttataacaaaaagttttagcagcgagacaatg

SEQ ID NO: 108753 - DNA, 358 bp, Heterodera glycines
  Promoter: Source sequence=SeqID_37678; Location=1..358; Strand=+; Gene=SeqID_66687
aatcacaaaaattcaaaatacatttaaaaaaagcctcgttttaaaaatttagcctattgtcctcaaaatggtttgtctaacgtataattttcgattaaaataatgatctatcttttttcaaaaatctaaccccgttatttcattaagctccgctgttctcgactgtctgaattcgtgtcttgaaagtgctgacggtgagcttgttttgccagtgcaacaacatcaacaatcggacatttttcctggtggcacacagttggaggactccaaagttcgacggcatgcaaattttcggtgaaacaaaaaaatgacatttttcaatacttttttgtcattcttcaggatattctttacaatg

SEQ ID NO: 108754 - DNA, 949 bp, Heterodera glycines
  Promoter: Source sequence=SeqID_6123; Location=1479..2427; Strand=-; Gene=SeqID_60443
aattaacgtaacagaaaatcttaaaatgaatttgaagctttatttcaagttcatttagatcacttaaaaaatttgttttatgaaagataaaatttttaggcaaaattggctaaaacattaattttgccgcagatgaaaattggatttttgggttagatctctaaacagattttaggctgaaaatgtcattttacggtaaaaaaaaatttccagcctctatgaatttttttccacacctaaccctattttttcacagcgatccgtcgacacaaatgtcaatgtcatgaagtgttgctcactaataactcgaaaactagcttaacaacaacaaccgagattttcgtgcttttcaggccatagggagctcaggaaaaaatagtgaaaaaactataaatatcatccctactcatttgtaaggcacgacagatagaaaacccgaaatattaccgccaaattgtcattttaaagattatgtgaaataaaaattaaataaaaaattaacaaccaattgttattttcttattttattaaaattaattaattaatttttaaccaatttggaaacaattattgatggagtggtcgcagattcaaattgaaacgtgaagcgaaccaaaaatagagttaacttcttcagctttgacagctgcataaaagtttgaaatcatttgaaaattttgttccacgtagtttgaagcgaaaaggtaatcaatttgaatatagaccgaaatagaagtgaaactgtcaaaacgcatgcattacgcttcagcaagtcacgaattaattaatcattggttattaaagctaaacaaagattggaaatatctttcaaaacttttctctctctaagttttggcttaaaaggcaaagctttgccatttgtcgacagttaattcaatttttccattcatttatttcccaacaaaattctctccaattccccgtcatg

SEQ ID NO: 108755 - DNA, 850 bp, Heterodera glycines
  Promoter: Source sequence=SeqID_16377; Location=481..1330; Strand=+; Gene=SeqID_80767
aacaaaaaaaaaattgtataaaaatgcaaaaatgaaaaattttgaaagatttcaccggagcaaaaaacttacaatttttcttcagagaatcgaaaaaataaataataaatttttattttttattttgcaaaatactgaattaaaatttattttttgacaaaaaattgttgtaatttatgataaaataattttttataaaatttttgaaaatctttttttttggttgatttattataaccaattagattatttagcaccaccaaaatcattattcgaataaattctgaagtccgaatttagccaaaaatgcctgaactaggattttggttgcaccctcggaatactgccaattgttctatattttttttgtgaaaatctctagaatcgtttgaaaatttggctactttaaatcaaaaattctcgcctttttgagtttctctccgttctcgcaaatatgggaggagcaaagttcctattttagtacacattttggcaaatcataagttaattaatatacaaaaaggaattatttttattcctcataaatttgttatattttattttgggtattttttagtaatattgtagaataaaatttactcttaattatgaaaatttgcacatttatcgcttctcatttaataatttacaaattacacacccaaatcaccaatcgtttgtacttcagtttcaatatatcctcaataacagcagcacatcggatccatttttaaagcattacaaatcccacacagaaaaggatgtagaaaacagcggccaaaaaaatggtcacccatccaattaaattgcctttttgaatggacaaataaacggccaatttcagcgcatg

SEQ ID NO: 108756 - DNA, 720 bp, Heterodera glycines
  misc_feature (41)..(41): n is a, c, g, or t
  misc_feature (93)..(93): n is a, c, g, or t
  misc_feature (140)..(140): n is a, c, g, or t
  Promoter: Source sequence=SeqID_24116; Location=1..720; Strand=+; Gene=SeqID_54819
gggtgtattttcgctttttcgcattttcttgtgaaatctcncaaaaatgaccaaaatatgctctaaaaatgcaaaaatggcaaaatatgcatntattcttgaaaaccccccaaaatatgcttaatatgcactaaaaactntcaccaaatcaaaaaattttaacgtagaaatgctatttttgagcccctttgttcatagcatatgcgcagaaaaaatatgcaaaatcatacaacttcgaacccctattaattaccatttcaaattgaaaaactaaaaaattaaaatttagcaaaaaatgataaaaattattgcaatttatccacaaatctccaaacattgaatgcactgaattctcaaagaattggtgagcattgaaacgaataatttggataaatattgcattaaaattataaaatataaattatttagccaaaggaaaaaggctaaaaattgttcaatcattggaaaataagcgaccaaatttgacgcataaaactcactttgattacatgaatcagttgaagattatgctggcaaacaaatcggaaattgaaaaagtgcgaaacgcaacaattgctgccctcgggggagaatttgaaaaggaaaaagtatcgtaaaacaaaaataataataaattaaaaaagtgattaaattccacaggaaaatgatgcttattcaatttgcgcattaaatgaagcattaggaaaagccaaagaaatg

SEQ ID NO: 108757 - DNA, 308 bp, Heterodera glycines
  Promoter: Source sequence=SeqID_16018; Location=2077..2384; Strand=-; Gene=SeqID_80369
ctgggatttttatgttttaacatatttttttgcggcctatttatggcgagagaagcccaaaaatagcattttctccgactatttttgatttagagcgagttataaaaacataaaaacacatattttggcgttttggcacataaaaacatatggcacatatttcggggttttggcacatattttgcacatattttggcatttttgagaaaaatcgtaaaaaaaatacaagaaaatctgaaaatgcaccctaaaaattgactattttacgtttcttaagcatttagaaaatttctttatatatttaaatg

SEQ ID NO: 108758 - DNA, 60 bp, Heterodera glycines
  Promoter: Source sequence=SeqID_5291; Location=1697..1756; Strand=-; Gene=SeqID_46016
agttttaatttaaaacattgaattttcagaattcacacaattggtcttaaataccggatg

SEQ ID NO: 108759 - DNA, 284 bp, Heterodera glycines
  Promoter: Source sequence=SeqID_11293; Location=851..1134; Strand=+; Gene=SeqID_74665
acacaagggtgcaccccaaaatctcgccgtcgaattttataaaaagcctaggcctaacctaattgtaagcctatgtgcgagttggccattacgccgatttttttttcttgaaattttcttataaagaaattttggaactttcttaatttacaatttagaaaaaaaatcggcggcgacattttgtcccgtccccctcacacaatgccatggatttgcatgggcacaattcatgagtatcatggtactataacgtattcccctcttttttcagcgcttggccaatg

SEQ ID NO: 108760 - DNA, 1003 bp, Heterodera glycines
  Promoter: Source sequence=SeqID_20089; Location=668..1670; Strand=+; Gene=SeqID_84875
acgcattaaaaaagcaaaaattctcagcgaattttcaaaaattttcgtcctcatacttttcaaaaaaagacaatatgcttacaatcgcttagctacgttaaaattattgtctgttgatgttgaaaagggccaaaaaacaataattagaaaaatttaaataatttttttctttcttgcttatgaaaaacaatttcattaaaaaaatatgtcggaaaattggccaaaatggcacgacaaaaataaaatgccaattttacataaattctcactcaacgacgagagtcttgaataggcacttaaatgatggcacatgataatgccgagaattcggaggggagggatgcaaatttgccgagtgccgtcctcaagagggccatgtaaaaattcaattttgtcacctttcacaaaatttagtggcacataaacacttgatgagatttaaaattatcaaatttataaaaaaagagaaaaaaatctgaatcttcgagaaagacactaaaagcaagaaaagggtttttaaagtatgagttatcataaatctgtgatgatggcattggatagtgccgatgggcgatgccgaattggccgcgggtccttccgctggtgccgcccataatccgggaaaatgagacctcccccgtttaggtgagagggcgggggcggcgtttgtatcaattttcaacctccagtgcccgccgcacttctccgcttggtgggacgacctttttaaattggccattgtgtggtgccaatcggagaaaattgggcacatttttgtgaaaaaatgagtttttgaaattgagaagcatgaaaaaatggcaaggagaatgaaaagcatccatttacacctcaaagtggtgacatcattggctgataagatattagcatattatacaaagttttgagggaaataaatatttattaaaaattctttaatttaaattttcgttaaaagaattttaccgaaaaaagcattttcagagcagagaatttttaaaaaatg

SEQ ID NO: 108761 - DNA, 510 bp, Heterodera glycines
  Promoter: Source sequence=SeqID_33019; Location=441..950; Strand=-; Gene=SeqID_63209
atcagaagagaggcaatgaacactcacccagtggcaaaacgggtttatgacgtcattttgcgatgctttttgggttcccgtcaatcattttcggaaacatttcctgatcctcaaaatcttaaaaaattatgtattaataaaatgttttaaattcattttactaatacaaaatttttcatgttttaaaataaactttaaatattaaaatgaaatttgaaatttgattcccaaataatcaaataaaaaattgtttatttggacagtccgtagtcacacaattacgaaaaaagaaaatattatttattacacaggcaattgaagaaaatattgtttatttgaacattgaaaaaaggcgagaaggccgagcagaaagaaaggcgaacgaacattcattcattcgtacacttttatttggtagcaatttttgaaagttttaaagcattttccgaaaacaaaatcatattttatggaattttttaatttttttttttattaaaaaagcaaaaaatg

SEQ ID NO: 108762 - DNA, 213 bp, Heterodera glycines
  Promoter: Source sequence=SeqID_24048; Location=1141..1353; Strand=-; Gene=SeqID_54741
tagtgacactgggcttgacccatagtgacgcacttggaaattttttcactttttttgatgtaaatttttgttttgtttttcaagtgggaacccttttcttagcgcccaaaaatttatctcatatggaactggccagacaaactgattgatcactatcgaacaatattctgtataatatatataaattaaagttgatttgattaagcaaaaatg

SEQ ID NO: 108763 - DNA, 71 bp, Heterodera glycines
  Promoter: Source sequence=SeqID_40507; Location=873..943; Strand=-; Gene=SeqID_46628
gtaactttatttcaacttcgttcccaatttagctccagcatgaaaatttggctgtccgaatttgggctatg

SEQ ID NO: 108764 - DNA, 1003 bp, Heterodera glycines
  Promoter: Source sequence=SeqID_11181; Location=3703..4705; Strand=+; Gene=SeqID_74527
aaaacgaaaaattacccaaatttttaccgtttcattcagtgaaagttcgtgcgctaattggtagcgccggggccgtgaaaggtatttggtctgggcaaattggcgctccaactcggccaactgatgggaggagaaagtggtgcggggacgacgcatgccacggctcaacgtttgccaatgccaaactgaaaaagagtcaatttgtgattttggaccaaagcaaattaacgaaaatgtgccgaagaattcacacaaaaaatcatttgaccgaaaaacttaaaactttggcggaatgaaaaaacaaaacaactaacttttgatgaccatttatttgattggtctcatttcattttcactcttttttctctttttgcaactcacgtgtcaatgccatcagttggtcaattgaaatttgcttctgcgaaatttgcaaagtgccatcatttaaagggggaagggttgtgccattctgctcaattggacgcggtggtggcactgagaagctgaattattggaagtacttagaattcaaaagcatagctcattaatcgccacattatttttaaaaaaccacagattttaaaatgccaaatttaaaagttttacccttttgaattgtcccattttggtgccttttcttccttcccatttattttacaatcaatttgatcagcagcagaaccaatcaaagcactgatcgaatgaaacattggcaagagaaaaagcaaatgccaaaatgggaggacaaagggaaaaggaaatgccaacgaatgaatgcctttctttctttctttgtgttactgtggcaccccttttcccctcccgccacctcaaaaagtgccaaattgcgctcgccaacattttaatccatcattcgtccctcctccctcacattttggcggaattctttcaaattttcccctgggaacagtgcgagaggaggagaagcgaagcattggcgaaatcggcaccctaaaaggcgctaattgaattatgcaatatg

SEQ ID NO: 108765 - DNA, 166 bp, Heterodera glycines; identical to SEQ ID NO: 99009
  Promoter: Source sequence=SeqID_3501; Location=1207..1372; Strand=+; Gene=SeqID_84922

SEQ ID NO: 108766 - DNA, 100 bp, Heterodera glycines
  Promoter: Source sequence=SeqID_15902; Location=1412..1511; Strand=-; Gene=SeqID_80248
tttgaggaagtgagcataaacattgaagactggcccaaatataaagaaggtttcggcagtttgcttttccttttttgattcatttctcctctcagaaatg

SEQ ID NO: 108767 - DNA, 179 bp, Heterodera glycines
  Promoter: Source sequence=SeqID_6393; Location=2217..2395; Strand=-; Gene=SeqID_61385
ttggcaaaaactgtaaattaatcagtaattagtgcttttaaaacttcaataaaattttagaaatttttgtaaggatttcattgatttgcaaatcaatttaaatgaatttttatttcaaaaacgaaaaacacataaatataataagtgcttagaaacgacttgaactgctcgacgagatg

SEQ ID NO: 108768 - DNA, 60 bp, Heterodera glycines
  Promoter: Source sequence=SeqID_7863; Location=388..447; Strand=+; Gene=SeqID_66213
tcggcagcttatctaattaaaaaaaaattagtttaaagaacttatttttagaaaataatg

SEQ ID NO: 108769 - DNA, 586 bp, Heterodera glycines
  Promoter: Source sequence=SeqID_30842; Location=510..1095; Strand=+; Gene=SeqID_61238
ggtgaacactttgacaaattgttggatattttttgaggataaaagcaggaaaacgacagcaatgctgaactgattgagcagcacaaaaaagttggcaattcgtctaaaataaaaaaatattaatagataaataatataaacaaataaaattaaattttgaacaaaattattaaaggaaaaaaaaattcatcaaaaatgctatttatagttattaaataatagctgaaattacctattaatataatcactcaagaaaaaaaaaacatattaaattttataaaatttatcaattattatttgttttaacttttaattaaacaataaaaaatttaaaaaaatgataatattattttattttccctcttattaattcaatatttttatttttgataccaaaaacatattatttttcttattgttattatttgttctattcaattggaatggttgtccattctattgaaaaagggtgtgtgtaagagtatataaacgaaacaattttggacaaaaatattatttcaataaaaaggattattatttaaattttttcaattattgtacaaaaaaattttttttagaaaaaatg

SEQ ID NO: 108770 - DNA, 1003 bp, Heterodera glycines
  Promoter: Source sequence=SeqID_16168; Location=1984..2986; Strand=+; Gene=SeqID_80534
tggttttatttccatcgtctactgatttaagaaatcggttaagtgcagaaaatttggagaagcttctttttttgcatcggaatttaccaatttataatttttcttattgatttttaaacaaattaaaaatttgtcaattgacccgatacccgaaacccggcctttttctcgacccgaaacccgaaacccgacccgatgatttttcggccgacccgacccgaaacccgacccgatgatttttctcgacccggaacaaccctggtgctaaatagtgaaatgaggtgaaaaccaatatgcgacaggtgaaatgtccttcgataattggtaaaagaggtgaaaaacaataggaaataggtgaaatgtcctggtgaaaagagcgaaacacaataggaaacaggttgaaatgtcctgtgataagtggtgaaaagaggtgaaaaacaataggaaacaggtgaaatgtcctgtgataagtggtgaaaagaggtgcaaaaacaataggaaataggtgaaatttttaagctatagatggtgaaaagaggtgaaaaataataggcgacaagtgaaatttactgtgataagtggttaaatgaggtgaaaaacaataggaaatagatgaaatgtcctgtgataagtggtgaaaaaaggtgaaaaacaaaaggaaataggtgaaaggacctatgataagtggtgaaagaagtgaaaaactataggcgacaggtgaaattttcagttctaggtggtgaaaagatgttgaaaattctaagaacattgatgaaattctaaagaagggatgaaaagaggtgaaaactaaaaacggaaataagtgaaatgtttcaaaaacagatgaaatgacaacgaacgacggtgagatcttcgtgagtgacgataggcaaaacaaaacaataattgagatagaagctattttaaactggtgaaaaggcaaagaaataatggaatatgtagaaaaataataaaaaaatttaagagatttaccttaacaatg

SEQ ID NO: 108771 - DNA, 388 bp, Heterodera glycines
  Promoter: Source sequence=SeqID_1184; Location=1..388; Strand=+; Gene= SeqID_46655
acttataattagagaaataatttctgtgttttcccatttccggagaaaatttatgaaaaatattctcatgagatttttaatatattttatgaaatatatgtttttttgaaatttttataaaatcctctggagattattaattattttataatttttaattatttgactgacggggagagaaaaacagtttaacacactctctctctctcattgattgagtgaggcgatcgtttgatgattaaattttgttgtaaaagccaaaattggccgcaatcttcagtcttttcttaatcatttctttacttactttactgataaataattaaataatatttatgattttaaatttaaataatttttttcaaaatttatttaaaaggaaaaaatg

SEQ ID NO: 108772 - DNA, 165 bp, Heterodera glycines
  Promoter: Source sequence=SeqID_3292; Location=5371..5535; Strand=-; Gene=SeqID_84092
aaaacaccgttttgtacatttttttatttttgtttttatttgcgtattttattttggaaagtgtaaaaattttatttttaaaaatataaaattgcccattttttcccggcgacgcctatcggcaccaattgaaccatgattttttgaaaatgtgagcccaaaatg

SEQ ID NO: 108773 - DNA, 573 bp, Heterodera glycines
  Promoter: Source sequence=SeqID_16868; Location=1825..2397; Strand=-; Gene=SeqID_81297
agtggaggattagaaggagaagagaaagaatttgtgccacaaaaatacgcccaattttgccttaggaatttcggctccactttaaattaggctcttgagccccccgataccgggctccccaaccttactcgcctttgaggaacgagcaatttttacactgttaaggattggcttcccaaaaacttgagaaaacttttttttcgggtttaaagttatttttttggaaagaagcattgtcaggtttttaactaaaaattacactgaattttgttaaaaaatgttagtttttatagaaaataaaaaaattcaccggctctcaaaaatctataaaaagaacacaaagcggacctaaattttttcaaatgatattttgcgctccccaactccgttctccggataggccctctccgctctccgataaaaatttatgtaattttgcaattttgtaccatgtacaataaaatacttaatgctacagaaccgttattttagaaattctgtatttctgacgcattttccgagagccttttttaaattccatccatttctgccaccgattgtcttaatcaaatg

SEQ ID NO: 108774 - DNA, 56 bp, Heterodera glycines
  Promoter: Source sequence=SeqID_11444; Location=485..540; Strand=+; Gene=SeqID_74844
ttttttaattgaataattttaaataatttattttcgatataaattttgaaaaaatg

SEQ ID NO: 108775 - DNA, 664 bp, Heterodera glycines
  misc_feature (47)..(47): n is a, c, g, or t
  misc_feature (56)..(56): n is a, c, g, or t
  Promoter: Source sequence=SeqID_13088; Location=1..664; Strand=+; Gene=SeqID_76874
aaataatttatgtaatattttctcgattttttatgaaaatttacttntctctcccngagggtcggggagaaaccctattgaaaacatttaaatagcaattttaaatcaatttatgaacaaaaataataaaagaaagaaaatgatttaataaatggaatgaaattgtaaatattggactcgggaatgaaaaaagtgaaacttttgcgacagaaaatcaaaatattttttttttgtaaaaatgttactgcgtcgtaattcaccacttgaagaactcacagtaaagacaaaataagaaaattggaaaattgattttgataaaatacagcaacaattaaatttgggtacggatatttcatcattagtgctgctaatttcatttaaattatttttttcctgggttaaataattatgtttgggaacaaaaatttggacttttatttacatatttatttcaaaaattattaatgtactttttttaaatgttgccctaacaataaagctatttgaccacaaatatatttttaacaaagaaagcagagatactaaaatattaagtttaaaaataaataaaaattattttttatgtttacaaaagccgatcatcaggggcttaaaaaaagaatcaagaccgagatcgaataacgtgaggaaatttgcaaaaatg

SEQ ID NO: 108776 - DNA, 993 bp, Heterodera glycines
  Promoter: Source sequence=SeqID_33986; Location=380..1372; Strand=-; Gene=SeqID_63895
attattgaggagggttttgtgtttggagactttgtgaggtttacaaaaaatccgcaaggtttttgttgttgaacaatattcggtggaaattttattaattaaattttaaaataacagcacttttacttacatactttaagaagcatttaaaaagaatcatatcgaaattttattctcgtccgagggtaaaaccaaggcgtaatcaaagaaagtgtggtcatttgacttaaattcccattcctaattattattgaaaagcattctatcgaaaataaatcaacaaaacatcgaacgctttttcgtggtttaaaatgcgaaatcttaaaatttatttttcttattcaacggttccccgggtctttcgcttaaatcagtcgtcattagcagggaacggatttttaggttttcacctatttttttttgccggagtaggacaaaacgtcgtcgaacgaatttttcgaccataacttttttctttctcaaccaaattaaacattcttggtattattcgaaagcattcgaaaaatgctattagcctgcaaattttcaaaattttttatttatgcacaaaaaaatcagagcaaaaaaagttcgaattactggggttttgagttccttctggccataacttttttgaaacttaacgaaaatttttgtagattttgcaaattaataataaacacatagagctattgaacaacaccaacaattcttaatttgattgacagtgaacaaagttatggttcaaaaagtcttccgacgacgtttcggccgaagacgttttggggtgcaccgcctgcccacaggggacaaaaactatttttctgtttaaattttgggaccattttttaaaaaccaattcagcaaaaaaaaaacatgacgacacctattgacactgcgggataaaagaaatttccggtttcaaaaaatcacaaaattttcaattttctataaaggcaaccccacatttgggtagaaatcttgctggcaatg

SEQ ID NO: 108777 - DNA, 280 bp, Heterodera glycines
  Promoter: Source sequence=SeqID_14041; Location=889..1168; Strand=-; Gene=SeqID_78019
ttggtaacagcagcagaacgccgactgaacgtcaccccccccacccatccacaacttatggaggcgaagtggggccaattcttacaataataatcatcatgaaacagaaacttattttacaaatttatttcatttcctttttagacttttaattgggcaaaaattaatgaagcgccgatttatcaacgaaaaaattgttaaaaagggaaaattgatggaagaaattgatgacggaatgacaatggagggggaggaaccgtttgaaaaggtgccaaagatg

SEQ ID NO: 108778 - DNA, 127 bp, Heterodera glycines
  misc_feature (45)..(45): n is a, c, g, or t
  Promoter: Source sequence=SeqID_13775; Location=2485..2611; Strand=-; Gene=SeqID_77699
aaaatggtgctaacacaaaaaactcgaagcacatagatcaatttncggaaaattaaaaagaagaagaatcaatagctcaaaaaatgaatgaaagaaatttaaatatttttacaaaaaataaattatg

SEQ ID NO: 108779 - DNA, 342 bp, Heterodera glycines
  Promoter: Source sequence=SeqID_6821; Location=1818..2159; Strand=-; Gene=SeqID_62998
taatccaatattaatttttttaagggatattaggcatctttcatagattgttttgtttttgaatggaaaatagttcatcctaacatttgtcggatggtaccatcccaaatggttctttggtcgatgatcggccaattcattggcttgccagccaactgtttaaggtcgatatattgtttttagcttaatgtgttaaatatttttaactttttttttctttttgctataatttttttaaattttttaaattaaatttataatttttattcacaagcaattcataattcgaaaatctttggtattaacatgtaaattcattaatgtcaattttcaggtcgaatg

SEQ ID NO: 108780 - DNA, 1003 bp, Heterodera glycines
  Promoter: Source sequence=SeqID_3311; Location=429..1431; Strand=+; Gene=SeqID_84168
ttcattcattccttttcataattaaggaattgaatttctaataatagcaattttatggtttcgcgttcaaatttgtttgttcttaaggtgaatggtgagctttttatttagggccaaaattaatttacttttttggaagtttttttaatttgctataaatcgctataatttataaaaacaaaaattggcgtttaaaatgaataactttgagcaggtgtgcaatttgaaggacaatttgtaaatgaattggattcatattatttttgttcgtttcttaatcttcattgttaagaattacggctgaatcttgtttcatattttgtggctttttaaataaaattaaagcaaaaactgcgtgccatcgcggttactctccgccaatcattcgtttaacaatgccaatttagtagggtcgtagccgggcgagggggatgaccccggttaagccggggaacggggagagcggggatgacgaaacgggcgatcgccgaaaatggcgactcataaaccggaggacgagaatttcgtgtttcgttttcgtgaaaaataaatattgaattttaaaaagaaaaaaaaatttcacaaatgcactttttaaaggggaccgacgatgccgaaaacgggaccagtaaattgggcaccagacaccaagcggaaaactggacaccaccagaattttgtacaacaaaggaaaattggacaccaaattactctttttaaaaaaaataaacccatgaattaggtgaaatataaatttagtaggataaatgattaatgaattaaggcacttagagtcgatcaggcatttagtaggcacgatcattggacaatgtgccaaaagctcacgaaaaatggcaactctatattcatttttatatccaattgtccaatttatttattttaattttccctgcgatttaaatggaaattttaattactttaaccttcaacttttcctaaataccttaattataatgaattcaattaacaaatgttcaaaatg

SEQ ID NO: 108781 - DNA, 68 bp, Heterodera glycines
  Promoter: Source sequence=SeqID_6214; Location=3685..3752; Strand=-; Gene=SeqID_60752
gcggcgtatagatttgtaatagacatatttctttccgcttaggagcaaaacaatatgcactaaaaatg

SEQ ID NO: 108782 - DNA, 1003 bp, Heterodera glycines
  Promoter: Source sequence=SeqID_10270; Location=952..1954; Strand=-; Gene=SeqID_73431
cgaaaaacaaaggaaaatatgttttgaatctatctttattttaaaagtttgaaataattttcaaaaatattatttaattattttacaaacattcgagtaaataaaaagtaattaatgtaacgcactgcgatacacgagatctttcatattctggaaaacacgtgttgattcaagcagtttacaaatggttttactataataacgagtaaattaatatttatcttaaaataaactataaaataatattatttatttttctttgcgaaaaaattaaaaatctaaagggaaaataattaaaaaagaaagaaaaattatcatttaaagatgaaaataataacaaataaattaatgtgtgtctttttttgaagaaaagtttaaataaccttagacaaaacacatattaatttataaaagtaataaagggctctaattagtgctggaagatttatgttatttttctgattatgcccaaaatattgatttggaaaatgttaccaaaagagacagaacggagaaaaagagaaaggaaaagaatgagagatagtgagagggagaaagaagaaaataatggtgagagaaaaagaggaatgtgagggagtcaaaatcaagagaaatacaaaggaacggggagagaggatgtagagaaaaaagagggagagtgctgtgaggaagagtgacggagagagggagagagagagaaagagatgggtagaaaagaaagagagcgagagagtgaggtgagaagagtgaaaacgagaaaaatggagaggaaaagagacagaacggagaaagagagaaaaggaaaaaaatgtattaaatgcatcagtacgccaaaccctgtttattttacaaccctattcgtgataaaatttaaataaaccatcaaaacatataatattgctcgaaatttacataaaattaagagtacaacaattataattgaaacaaaaataattaaaaacaattagataaatgttttgttataaacgaacaattaacaatg

SEQ ID NO: 108783 - DNA, 533 bp, Heterodera glycines
  Promoter: Source sequence=SeqID_7771; Location=1501..2033; Strand=+; Gene=SeqID_65894
atcaaacgtattttaaaacgaaaactttaacaatttccgaattcatttgacagttcgggattattaaacaattcgaagtaaactctacgaaagtatgtgccaaacccaatccagacagcctggatctcttacaaatttatccctccccaggatcgagcacctaccgaattttaatttttaagatttaattaaacaatattatgaattttagataatgactcttgtatttgtttctttattgttcttagtctctttgcgtatattttctaaggcaaaaattcctttactactttcccagcagatgggctctattttaacgatccatcggggataggctaatgagggagggaggggtgaaccttaatagagtaattaattagttctattattaaaaattatcattattacattattttctaaaattaattatttattatttttttaaattttctcggcttagagtgaagcggtactcaattggccaatggttcctcagcatgaaaaagaattatattgagataaataaaaaaatg

SEQ ID NO: 108784 - DNA, 443 bp, Heterodera glycines
  misc_feature (6)..(6): n is a, c, g, or t
  Promoter: Source sequence=SeqID_4637; Location=1..443; Strand=+; Gene= SeqID_55185
agagtncattttgcaaaaaataaataattaatgaaaaagtcagaatctctaaaaattttaaaaacaacaagcgttggcattttttcagcttaagttagtcctttacaatggagaaggcctgcaacatttggagagattttatcgattttagtgcgctaggttcgatgaaactttttaaaatataagcctaaactttttggcttatttaaaaagcaattaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 108785 - DNA, 497 bp, Heterodera glycines
  Promoter: Source sequence=SeqID_14759; Location=1..497; Strand=+; Gene=SeqID_78891
ttttgtttggatttttcacaacaaattttacgaccgatgtttcccttcaattgaaaatgccataaagccagacctttgtcgtccaggagcgccagaaagtgagcgagcgaacgggagaaaaaagtgtgagagaaagcatcattttgatgggcatgcccgcggggggagggggatggggggggggtgagatggaaagctgtggaggggaggagaatatgctgagtggagtgaagatgagatagtgtgatagagagaaagagagacggaggggggggggggtaatgctcgtcgctcattatataaaaaaaatgctggtccatcgattgtgatgaccaccgaacgagtcgttggtcatctccccaaccccattttatttatatatattttgttgttcattttttcattgtaataatatttttttttccaatttagcaaaaaaatgaatcaagcctgtgtacaacagaattgtgtcactcccgtggaggcagatccaaatg

SEQ ID NO: 108786 - DNA, 65 bp, Heterodera glycines
  Promoter: Source sequence=SeqID_31562; Location=1522..1586; Strand=-; Gene=SeqID_61894
tcccagctgatcacgtgtgatgagaagtgggtttatctcaacaacaaaacggcacaaaaacaatg

SEQ ID NO: 108787 - DNA, 458 bp, Heterodera glycines
  Promoter: Source sequence=SeqID_29255; Location=1..458; Strand=+; Gene=SeqID_59784
tcgaaaataatgtcagattcggttatttggcccttaaactctataatacatatttgtatcggtgtttaaaaaaatttcatttttcgaaaatggggggggcaaaccagactattaccggatcccgtcctgcgcgcgccggtctcttcgttttcgggtcactggtcacaaatctagcatccatttcgaacagttccagccccggacccattcgaacaaaaagtccaagattcaaaattttcgaatttcacttctatattataaaaactgtttgatgatcttttattgaagtatgatgactttttgttcgtccgtgtacttaaacaaaattaaatttgtgctgccgtcgaaaaattttaccgaaaatgcctttaagctccctcttctttatcattaattaaaacaagagaaattactcattcctttttcatacattcaattttagtgtaatccgaaaaatg

SEQ ID NO: 108788 - DNA, 321 bp, Heterodera glycines
  Promoter: Source sequence=SeqID_4462; Location=5171..5491; Strand=-; Gene=SeqID_54530
ataaagagaggaaatgtgtgttaaatcttatttttaatctgaaattcgaagattctcccgatttacttacctaattattttttatactttattaacttttttccggacattttctatccaggtttcctacatttttactgtgattataacgccaattcatggctagcgataataaggtacgttctttttgtcctcgctcctctaaaatgttaatacattcaataatatttaatgggtgttaatttttgggagaaaccgttggggcattaattcaaaattcagaaacaaataagtcgaatagagctgattttggatgacatg

SEQ ID NO: 108789 - DNA, 794 bp, Heterodera glycines
  Promoter: Source sequence=SeqID_34953; Location=1..794; Strand=+; Gene=SeqID_64636
caaacgttcattcaatttgaccttaagaaatttaaagaaaaggttaatccattttttggggcgatattatgcgataaataaaacatgaaaattaaagggaattcggttaaaaggaaaactaaatcaatgataaaatgtttttgtaaaattaataataaaaattcttaattttatatggttaaaatttgtccatgggttgaattttgccttatctggggaaaacaatcaccggcgagttcaatttctggcgaaatcaaatacagacggcgagaaaaagagaaatagttcactggcgaaatcactcactggcgaaatcacacactggcgaaatcacacactggcgaaatcacacactggcgaaatcacacactggcgaaatcccactggcgaaatcaatcactggcgaaatcacctggcgcgtttttattatataggattttttgaaataacgcacaaaacttacgccattaatttatttggcataatgtctaaatatatgaaaaaaaaccgcgaattccccacaatcttgaaaaaccgagttttctacgtctgttcgtgtttcgaatccggtttcgggctcaaaatcagtccattcggaattttgaggttctttgtttgtcacaattagctagataagctgactcgtaaattatgtgtcgtaatttacaccttaatgttttttcaaatttcattcctattaatcaaactttcctatattttgggccttccatttgtccacaatgaatgtgtattaagaaaacagcgtgaaaatttcacgcaaattgaccaaaatg

SEQ ID NO: 108790 - DNA, 295 bp, Heterodera glycines
  Promoter: Source sequence=SeqID_807; Location=1550..1844; Strand=+; Gene=SeqID_61773
aaatgtcgatcgatgaccgatttgttgatagtgatgtggatatatgatcatttttttttgggacatttaaaaaattggtgatgaattttgtcaaataaatggtggtgaatattttgaaagggcagaatttaaaattgatttaaataatagttaaatatggcggtgttctcatgttctacaattttattgattggctctaaacactcagtgaggtggggatgaggcctataaaaataaactgaaattgacttccgctcattttccgttttcattcttgaaattttccgctaaaatg

SEQ ID NO: 108791 - DNA, 116 bp, Heterodera glycines
  misc_feature (58)..(58): n is a, c, g, or t
  Promoter: Source sequence=SeqID_17606; Location=1..116; Strand=+; Gene=SeqID_82116
tgtgtatataattattttggcaataaaaaaaagagataaaatggtgacaaataattgncattgttatgcaattttttaattatttatgaaaagcaattcgatagttcaacattatg

SEQ ID NO: 108792 - DNA, 547 bp, Heterodera glycines
  Promoter: Source sequence=SeqID_7168; Location=1..547; Strand=+; Gene= SeqID_64032
attgctgccagtttgattcagttagtcacatgtttgagttgatttaagcctcataggccttgatttctccggaaaacttggaaaattcaatacaactctacctaaaaagcagatttcggtctgcaaaacaaacaaaaatatgaacaaatatttgttgtttattatttagcttgttttatctgtttctttttgttagttgttaagattttgttcgtttttaacaagtgtctttatattaatgttacacccctttttcggaaaaaaatcgtaaattttttttcaatcgtcatttcgccttctcgcttttcgaatcttaattttcagaattgctacttacgtaaaatttcagctacgatcggttcatgggaagtggtcaaactcataaaaaatagggtgtatttatattaatgttacacagtgtatacgcgcgttttttctctttttaaaatttgaaggtgcggccgcataaccgaaaagtaccaaagagcttaaaagcttatgtttattttgaattcttttactgtttttagctgcgatttttcaaatg

SEQ ID NO: 108793 - DNA, 1003 bp, Heterodera glycines
  Promoter: Source sequence=SeqID_831; Location=1975..2977; Strand=-; Gene=SeqID_62336
gataacattaagttaaaaacacgattatttaaaatcaatagtgaaatgtaaacaatcaataattaatatttatatcataatattgttaaataaaaaaataatttatatagattagcccccaaatgaacatgataaaattaagcattgaaatgtacaattaagcaaagcccaaccccgtggttaaaagtatttttttttaaattttattattactcaataaaaacaaaggacaaaataaattatttaatttttcatttgctttacacgattataaaataataaattcaacaatggaaagaaattatgtcagtaatttttttttgttacgaaacaaatacatttattacattaaatatttaaagataaaaaataaatatactttttaatattcaaataaatgcataaataaatgaactaattaactaaatttaaacgacgattacagctcagtttaatggaaatgaggaatacttatgaaaaatatgatattggaaacaaatgggaaaaaattattttaaagcacaattttatagaaaatgaaaaatgaccaatagaaacaatagacaaataaatttaaaaaacctaatccatatttgaatctttgttttaataatattaaagattgagtatatgacattagtttaaaaattttcatttgattaagcactatttttactattcaattattacacttataattgaaaacaatttaaataataaagaaaaatttacaaaaacaaaattttttgaaaaatcaaaattgcaatattaataaacagcgagttttgagcattttataaataaatttattcaaccctttccctaataaggaaattattaaaaaataaatgaagttagaatttattacaaccaaagtgatgaattctcgaaatatttaaaaaagaacaaatgataataaacagaatttataatagaatctcattgcggtggatgtttgttaaataagctttaaaagaaaacatttatattttagatataaatg

SEQ ID NO: 108794 - DNA, 549 bp, Heterodera glycines
  Promoter: Source sequence=SeqID_30222; Location=993..1541; Strand=-; Gene=SeqID_60657
aatttttgagtttttcgattttttcggtttttctcccctggttagaccgattctcttatccggtctctaattaactcaagtaatattatcaaaaaaaacttaattttagtcatttaaatgattttaaatattttgtaattcggataatattttttaatctagaattttttatcaataaaaaaaaataaaattttaactatcaattttgacaaaaattttcaattattagtagcgtattttaccgatttaattgcatttttacttttccattcaacatgcatttgaattttttcaaaaagcaaaaatattatgccaaaccaatacataattttcaagatcaataaatatcgtcgataaaataattaacaaaattttggagatgattttttgaaacatttttcatttctcagggggtgtgtttttgaaaataaacaaatttcttgtatctgaattttaattggataatctgactcaatccaaaaatctctcggttcgcctaaataactgcaattttatgattaattcagattttttaatatttaattaatg

SEQ ID NO: 108795 - DNA, 205 bp, Heterodera glycines
  Promoter: Source sequence=SeqID_41686; Location=852..1056; Strand=-; Gene=SeqID_69757
ttgttaaaatgatcagaatccccccaaaaaaaacttttcatggatgccatccattcaggttataatggctaacttaggataaaatttttaaaatttgatcatcaaaaactctattcgaagaccaggctaaaattacaacaattttttttgaagggtcttctatgtgagcagcgtgatttttgcggcaattcattgggtgacaatg

SEQ ID NO: 108796 - DNA, 414 bp, Heterodera glycines
  Promoter: Source sequence=SeqID_22273; Location=949..1362; Strand=-; Gene=SeqID_52943
ttttttaccccgtaatcgaatttttgtattatttttttgaccgaatgatatcacgcgacacattcatttatttttgcccaatttatcatcctcccaaatccatttttatcgtctcttctctctcactcaatgacggcgaatattttgttgttcgttcattcattcacacaattattttatttgcacatcgattttttaattaataaatgaattgctccataattagtaggaaccggatttgtataggttttcataatttttaattcgaaaatacaccccttaaaggtcaaaaatttttgaaaaaatccaaatctccaaaattaatggtttagaattttcgaaaataaatatttttgaattttccctaaatcgtccatagattttgactaaatggtccactttctccgcccaatg

SEQ ID NO: 108797 - DNA, 146 bp, Heterodera glycines
  Promoter: Source sequence=SeqID_16533; Location=1..146; Strand=+; Gene=SeqID_80942
cggaaatttctttttttttaattttatttttcaaattacaaaaacgttttgccaattcaaaaagatttattttcgggtgccaaataattaatttttataattttctattttattttcaaatgaaataaactattttcagctcaatg

SEQ ID NO: 108798 - DNA, 248 bp, Heterodera glycines
  misc_feature (24)..(24): n is a, c, g, or t
  misc_feature (33)..(33): n is a, c, g, or t
  misc_feature (42)..(43): n is a, c, g, or t
  misc_feature (47)..(47): n is a, c, g, or t
  misc_feature (77)..(77): n is a, c, g, or t
  misc_feature (152)..(152): n is a, c, g, or t
  Promoter: Source sequence=SeqID_19584; Location=1017..1264; Strand=-; Gene=SeqID_84321
ttttcagaaatcagaataattctncaatgtgcncaatttagnncccnccagccacagccccttgcttctcccagttntaagtcttggatttgtcaaataaattcaagacttcaaaataataatcaaaaattctcttaaaatttttttgaacncaattcaaaaaaggaaaaaaatttgcagtcaaaaaattattcgaatttctccaattttgtttccataatttccgaaagttattcggtatcataatg

SEQ ID NO: 108799 - DNA, 63 bp, Heterodera glycines
  Promoter: Source sequence=SeqID_8699; Location=815..877; Strand=-; Gene=SeqID_46631
tgtgagtgccgtttgaaaccttatgccatcaaaattaagttttgccacaactttttcaggatg

SEQ ID NO: 108800 - DNA, 137 bp, Heterodera glycines
  Promoter: Source sequence=SeqID_23358; Location=2259..2395; Strand=-; Gene=SeqID_54071
ttaaatcccttaaaatttagtgacaaaatgcatttttcaatgccacttgtaatcagtgcagaaaccatccgaaatcagaggcatttttgtataaccaaaagttgcgccttacatttggcattgtgggcattttcatg

SEQ ID NO: 108801 - DNA, 377 bp, Heterodera glycines
  Promoter: Source sequence=SeqID_29570; Location=1..377; Strand=+; Gene=SeqID_60046
tttcagcacaaaaaatcaccgattaagcactgtaaacatcaccaaattatctcaaaataagtatgaaaaaagcacaaaaaaggcaacagcacaaaaattcgaaaaaaataaaaaaaacacaaaaaagcaaaatcagcacaaaaattggaaaaaacataaaattaagggattaaaggcacaaaaaattgaaaaaaggaagcaaaaaaaaaaactttgttgcttcctgattataaaaacctccaaaatagttgctaaaaatggcaatgagatacacttttcggattgattcttaggggtgtatttttcaattttattgcatatttgttaataaattttttgaaaatcgcttaaaatattttagaaaattcctcaaaatg

SEQ ID NO: 108802 - DNA, 184 bp, Heterodera glycines
  Promoter: Source sequence=SeqID_24152; Location=1477..1660; Strand=-; Gene=SeqID_54858
gacagctttcatttattcattaatcttaaagtatttaacaggaaaaaatgattaatcaccgcccatctgaactgaaaatgtatataaatgacaaagacaaattacaaattgcaaaaaataaaaatgtttattgcccattcactctaattctgtcaggggccactgggagcggtaaaacccaatg

SEQ ID NO: 108803 - DNA, 600 bp, Heterodera glycines
  Promoter: Source sequence=SeqID_16239; Location=1812..2411; Strand=-; Gene=SeqID_80618
ttgtgcaagtccccgcccccggccattgtcaattgttgcccaactcttttttatttgctgacattgggtcttttggccaactttagaaatataaaaaataaaaatcactgccgaaacaaatgtaaaaaaataaataaaatagttcacacattaaaaattaatatgttatttttatttttctcttttgatggaactgttggacaaaataaaataacagaatcaaattcaaatccaaagcggacaaaataatcttagccaatttcatttattaaccccaaaaagtttaatgaattttaaaaatccaacttaggaatgctcaaaaatttaataagaaataacaaataaacacaaataattagagtaattattgaattcaaaaacttaatttgttagtgcaatgggacagcccgggggaatggaatgggctgatcactccgccatatgctgaaggagaccgcccaaaggacctttaatcagtggactaataatactgatcactcgattattattttaataattcggagccaataattacccattgaattttttaaatttaattcaatgttttagacatatttttcttattattgttataaaatg

SEQ ID NO: 108804 - DNA, 1003 bp, Heterodera glycines
  Promoter: Source sequence=SeqID_22434; Location=865..1867; Strand=-; Gene=SeqID_53103
agaattcttacaaattcgggctatcgaatggcctagagaattaaaatttgcttctttcgagcaaagttatatgaaataatttttaatttgatgataggaaaagaagaaaatttcagaaaatttgactaatttttatttacgcggccggcggccgggcttctaaccattttaaaagttcgtttatttgtttaattaaatttaaaaaggaaaaccttttacttggctgctcaaaaaaaagtccgcataatactaattggttatgtaaagcaacgccaaaattaaaattaattagtgactccgtctggcattttgaaaggccccccccaaccaaggccaggacagcttcttcttttcaaataatttttcatgcaatccatatgtgtgcaattaaatttaatcaaaaccttttctttggtggtttctgtgtgtgtgccaatttaggccataaatttttcatatgaaatcctttaaaaaataaaaataaatttaagataggagtttaataaaatggataataaataaatgtttaatatttttatatattccattttatttcgacctacataccaattagagaacaaaaatttttgaataaattgcctctgaacattggctcaaaggtaatgaatgtcagtcagtcttatgcttggttggatatgctgaatttggcagatacgaagaaaaaaaaatttaatttactctttttatttgagagaaagtttcacattgggcatagaaaaacgaaaatggcatccgaatgtgccaaaaaagagtgccaattgcccataaaattcccataataaaagctcgactactgcccattgtttgtcatttcgtatttatacattcagtgcgcccaacttttgtcattaaaaagcttttggctattcacaaggatattttattcactggaacgcgcctattttctctactcatgacaaatttcaaatgttttataaaattaaggataatcattttttaaatatttccaaatttcgaaatg

SEQ ID NO: 108805 - DNA, 116 bp, Heterodera glycines
  Promoter: Source sequence=SeqID_5128; Location=3283..3398; Strand=-; Gene=SeqID_57016
aaatgcaaatatattaaatgaaaattttaaaaaaatttagccacaaacaacaataaaattgcggaagaaattcaaaccatggaagggtaaaggcatgaaatcagctgcttattatg

SEQ ID NO: 108806 - DNA, 692 bp, Heterodera glycines
  Promoter: Source sequence=SeqID_1970; Location=1298..1989; Strand=-; Gene=SeqID_77097
aaaattgagcaaattttccaaaaaattattgatcaaatgctttctctttaaattgttcgtttaatgggtttcgctgataaactgatcaaattttgcaaaatttgctgcagcaaaattttttaaggtttctttgataatgtgaattctttaaattgttcttaatgggttttggcgataaagtgatcaatttttctaattttgtgctttcatgtgattgtgcattggcttgacaattataaaagggttaatttttcttaaaaattatatttttataaaatggctaaattaaaaatttttttttttgcatttttgattttgtcacaaaatttgacaatttcaaaaccaattcgtcgcaaagaaagataactggggactcttgcggctattgcaattatttcggcaattgttctaactccaataatacttggttcggttgcaaccggcattgtatttggttatactttaaaagatggaagtggtcgtgaatgtatgaatataaatttaaatttaaaaataataaataaaatgataattaaaatattaattaataatttaaaaaatcaaaaaatttgttcagataaggagtacctcaaacttttttccccatcaaattttcgtttggcgaccgcgaaatttcaattgatttggaaaactttaacaatgaatttttgtttcgaaaaattggtgaaatg

SEQ ID NO: 108807 - DNA, 205 bp, Heterodera glycines
  Promoter: Source sequence=SeqID_24869; Location=433..637; Strand=+; Gene=SeqID_55614
aaatttcgcaatttattttttatttttttgctcacaagcatacagaagttgcctgatttaaacaaattaatcccctagtcttagtgattttatcccgcaaaatcccaaaaaaatttctgtttttattatggcataaagccgttttgtgcctattatcccactccccttttagcttctcgataagaagacatttcaaggtgagatg

SEQ ID NO: 108808 - DNA, 483 bp, Heterodera glycines
  Promoter: Source sequence=SeqID_6331; Location=1..483; Strand=+; Gene= SeqID_61164
atagctagggctgggatttttatgtgctaaaaatcctgaaatatgtaataaaatatgtactaaaaaacccaaaatatgtgctaaaaaccaaaaaaaggcctaaatatgtgttaaaaaatgcaaaaatatgtgctaaaaattggaaaaaccaatggtatttttgcataaaaattccaaaaaactcattctttatcatttttgcccgcacaattgcaaataaaaaacatttggaggtgtttggggtaaaattagtccttttttgataaattgtttttaaagataatttttccatcagttgagtaccagcaagaaacttcgatatccagtaacgaattaatgaagaattcgattttcggtacacgaaataaataaagaaaattttgaaagagcctataaaaatggcaagaaagttgatttttagtggtgcatttttgaattttttatgtttttcttagatatttttttcaaaaatgccaaaatatg

SEQ ID NO: 108809 - DNA, 144 bp, Heterodera glycines
  Promoter: Source sequence=SeqID_3190; Location=143..286; Strand=+; Gene=SeqID_83598
ttccggagagatcgcgtctcaaggcatcgtcgacgccttccgttgggacgcaacagacgggccaattctttgattatttgtaccggtcaagtgggttaacattgggagaccctttatccgcttcacctttctctcccagaaatg

SEQ ID NO: 108810 - DNA, 224 bp, Heterodera glycines
  Promoter: Source sequence=SeqID_6177; Location=2420..2643; Strand=-; Gene=SeqID_60607
ttaattttaatgcataatttttaatttaaaaaaaagaaaatattaattttaaaacataatttaataaataaaaacgccaaagagcatacatatactgttcacagattatccaaatattttcaaaaccgaaagattgaagaaatggcattttacataaaaataggttgttatcaatgtagctccatcaaaggaaacatttccgacaaattgttctaccgaaaatg

SEQ ID NO: 108811 - DNA, 326 bp, Heterodera glycines
  Promoter: Source sequence=SeqID_3859; Location=2165..2490; Strand=-; Gene=SeqID_52181
cctgcaaaaacaaaaaaaaaattaaaaagagttttcagatcgatgccgattttgatgttttaaattaacatattttgccatgaaaaaatttaaaaaataaagccaaaacagcagatttctttatgaaatcataaagtaattaataaatgatttgtttaaaaaagaaaaaatcaagacaaaaaataaatttattataattaaaaaaaagtcttgcactaacttgatcagatcattcctttatggtgattgtacacccaaaaaacattgaaaattgggaaaagtttaggaaaaattcctaacaaaggagaggtacccaagtgaccatg

SEQ ID NO: 108812 - DNA, 54 bp, Heterodera glycines
  Promoter: Source sequence=SeqID_43792; Location=1076..1129; Strand=-; Gene=SeqID_71380
aatcttaaaaaagaaaagagcaaattacttcgcattaacccattaaatacaatg

SEQ ID NO: 108813 - DNA, 1003 bp, Heterodera glycines
  Promoter: Source sequence=SeqID_12922; Location=714..1716; Strand=-; Gene=SeqID_76671
aaatttattatttaaaatgataaaaataaattgatcttaaactgtggtacgtaaatattctttaataatattaagaaacaatcgatgcttagccaatttattaatattttttcaacctatttctgattttattcattaatgtgttttttaaattcaaaaaaagattgttcaattcttaatgtttacgccgtttttgagtcaattaacaaaaaataaagtgacgcattttggggcgtcggcggtgccgaaaggcgccttaatttatctggctattattctgtgcatttcttattactcattatgtatccaattcctaatttttgaactttctaaagaaatggtgatgtaataaaacaatgcgtggaaacattgattaattaatagtgcttgaacattttaaataatttttttttgcttcaatttaattatttgcattattcggacttcatcctagcacggtttgtttgaagcggtgctgggacattaatcaaaaaccatgaaaatgggcgtgagacaaaaaaccatcaaatgggaatttttgattttaaaattggtttcttttgagaaagttataccaaaaaatattttcatttgatgattttttgactaacttcatagcatctttgaagcacccaattatagaaaattatacagttcaaatccgaaatataagtctggtggataagtcagtgcgtaacacggggcagaaatatcgttactttgatcgggattatggccaaaaaaaaggataaggaattttattttttatttccccacaaaaaaagctccaaaattataacccaaatctttaccttaaaaacggaaatatgcttatgtattcgtttctgcttttttttttacaaagcgtggctttttttgccatgtgcaaaattaatcaattcaccattatgaataaaaaattatttacacaatttacaacatttatatttaaatttttattaataattattattacgatttttttagaaatttttgtaaaatg

SEQ ID NO: 108814 - DNA, 221 bp, Heterodera glycines
  Promoter: Source sequence=SeqID_10133; Location=2098..2318; Strand=-; Gene=SeqID_73225
attaaaaattcagtatataagtcgatacccactgctatccagtggtaccaaatttatacccactttctgacttacagttcgcgaggtttccttgttagctaaaatgagaaattgaataatttaggctaatccttcacatatatttggaaatgaaaacatgaatgtttatttaggcaaagagcgttctccgctttgaacgtgaggttgatcaaattcaaatg

SEQ ID NO: 108815 - DNA, 388 bp, Heterodera glycines
  Promoter: Source sequence=SeqID_42971; Location=1..388; Strand=+; Gene=SeqID_70757
atgccaaattccctcactttctctttttaccgaaaatgccttcgattaccctttttccctgtgctttccttttctgtttaattcatttatcgattgtctttgctcgccttcgttcgtttgtttgtccatctgtcctctttcactgatttcttcttttgaccaacttttgcatacctttcttttcgtttaaatatgttggcataagaaatatgggtatttttgtcattccaaaatgttcttttttgtttaaattgataaattttagggaatttctttgttggtttaaattcaagttaatttttcattgtaccttttcggatttttaattattcgactaattgtaattggagtaaggttaaacgttcccattgcctttccattaaaaatg

SEQ ID NO: 108816 - DNA, 286 bp, Heterodera glycines
  Promoter: Source sequence=SeqID_45077; Location=1..286; Strand=+; Gene=SeqID_72461
ccgttcgccaatggatttctgacaacagcggaaacagtcacagctggcacatcaatgccatcatcagcagaagctgcagcagcagaaagggggacgaacggagggacgaaaaagagacagccgaagggggaggggaaaagtgagcaaaaaaagggggattaaagggaaggcgggattttgattttaaaagccaacgaaagcattgaattgccaaattttgaaagggagcaaaagagcgacgcagagatcggcacaacaacaacagcagcagcaacagcagcaaatg

SEQ ID NO: 108817 - DNA, 585 bp, Heterodera glycines
  Promoter: Source sequence=SeqID_17031; Location=610..1194; Strand=+; Gene=SeqID_81454
tgtaggattttgaggaatagtttttttttaaatttttgattcaaatttactattttttttgcaatttcctttggtcgattttcgaaatttctcgggctttcggttttggtttagggcaaagctgaacaagtcaatttgttatatagtatgtagtatctgtgattaggtccaaattaaaattggatccaggattcaaggacgccttccctgaaggcacaaaatctgttgttcacccaaaaactcaaggatttccctgaatgcgtaaaacctattcaccctaaaacaaggaattcactagtggcatgaaatccgttcacctaaattcaaggactttggcaaaaaaacctatccacccaaaactcaagcactttccgggatgaaacctggtcaccctaagggaaaaataaaaatttccaaaaaaaacaacaattttttattttgcacaaaaatagggtttaataaaaatgtcaaaatggcgcagtgatcaaatttaaaaaaaatagactaataaatatcggctcagtttcagtaaatgtgatcggttgccagtcagtgtcttgtgtgatccgcaaatggggcaacatg

SEQ ID NO: 108818 - DNA, 463 bp, Heterodera glycines
  Promoter: Source sequence=SeqID_7609; Location=387..849; Strand=+; Gene=SeqID_65402
tttcaaaatttaaaattttcagttctttttctgcccggcatttaaattctttttcctgctttttgttttggccgacctccagaattttggttgttgacaaacgtgctgagccgaagcgacaaaaatatgggtgtttgtaataattaaatttaattattattttaattttattttccaagtaattaatcataacttagcttaagcttagtcaaattaataaaattaagtatttagcgacagctcgaagcatcctctactatttatgaaattttcaaaaaattagtaaaaatttacaaaaagttgtgactaaaaaagtgcgaaaaattttgactcaacaattttgaccctagctttcttgaaattcaataaaattttttgaaatttagcagaacaatagagtaatctttgggctatctaattatataaacaaaattaaaattgattgttttagaaaaaagttatg

SEQ ID NO: 108819 - DNA, 195 bp, Heterodera glycines
  Promoter: Source sequence=SeqID_18508; Location=1441..1635; Strand=-; Gene=SeqID_83127
tcagagtcgcgggggcgggggtgagaaatttctcgcccccggggacgggggcgggggtttgtttttaattagctccaaaaaatctcacaaaaatttttttttgaatgatgtgtttggctccacattcctttattcgatgtatcgcctcgattcaattcttttttggtataattgcatagatattgtctaaaaatg

SEQ ID NO: 108820 - DNA, 618 bp, Heterodera glycines
  Promoter: Source sequence=SeqID_19005; Location=1..618; Strand=+; Gene=SeqID_83743
ctagagaccggcgggatcgggactcccgcgggattttacgggagtcctgctcccgactcccgcttttttcggtgaacgggatttttaacgggagcgggattttaacgggattcccgttcgggactcccgtcccgtaaaattttgaactcccgatcccgctcccggaaatttttttttaccggtctctacaccctgcttttcatttatatttgctaaaattgcaaaaatatcaaaagtgctaaaaagtagaaaagatgctaaatttgtactaaaaacccgaaaaaagtgccaaatttgcgctaaaaacccgaaaaaagtgcaaatttttgctgagaaaatgccaactttgtccaaattaattttatcaatgttatccacccagctagaccgcacttttaatgaatagtcggaggacaatcctcggccacaatgtgggcaaaaatgtgcggacggatttgtggacgatttgtgcgactttttcgtgcccttgctcgccgtcgtcgtcgtcatgttttgttgttgttgcgttttttcggtgcccaggagtgccgtcgatgactgtgccggtggcggtggtggtgccgttgagctgcccgtggggccaatctgttgcaaatg

SEQ ID NO: 108821 - DNA, 443 bp, Heterodera glycines
  Promoter: Source sequence=SeqID_30394; Location=939..1381; Strand=-; Gene=SeqID_46206
tttcgaacaaaaccgaaatatcacaaggcaatcaccactgaaatagcactgataaaaaagataaaaaattttgtatcgaaaaaatgagagcttttgaccgtaaaaaacataaaaaataacagaaacaaaatgccaaatttaatttatacgagattttctctaaaaaagactggcattgagaaaataggtaaatagttcgccctttgacccattctgtcacttgtacttttcaccatttttttgttatttcctccctttgttatttataaaaattgaaacactaaaaccacaaaaagtcaggatttttgtatatttttattttggtcaacaaagaaaaaagttatgacgctttaaacctggctcagacgcaattggcccgtttcgtgtgccattgctcatctctcaattttatttgattgattagatattttaagatagaaatg

SEQ ID NO: 108822 - DNA, 74 bp, Heterodera glycines
  Promoter: Source sequence=SeqID_22743; Location=1314..1387; Strand=-; Gene=SeqID_53435
ttcatttttggcttagaatccaaagtgtcgaaaatctgcgagttgccaatggggaagaagcgcaacagcaaatg

SEQ ID NO: 108823 - DNA, 247 bp, Heterodera glycines
  misc_feature (66)..(66): n is a, c, g, or t
  misc_feature (80)..(80): n is a, c, g, or t
  Promoter: Source sequence=SeqID_4364; Location=1..247; Strand=+; Gene= SeqID_54184
gccaattttgcaaaaacttacgacagttttttacgatttggatgactcgccggagaatcacgcgtntaaaattaaaaatntaagaaaaatattatccattttcaagaattatttggacaaaataatcaatgccaaaaaggcgaagagtgaccgcgtggtttttgcggaattggcaaaaattattggaagcggcggcgactctctgccggcgaatggcaaggaaacgataaacgacatcaacggaatg

SEQ ID NO: 108824 - DNA, 330 bp, Heterodera glycines
  Promoter: Source sequence=SeqID_10218; Location=2387..2716; Strand=+; Gene=SeqID_73359
acttaactttttttttaaaaaagaatttcaaaaaatattggagggtcgagggagatttttataaaatttttccattggaattttcttattaaaattttttcaaatttcttgaaaaatttctgtttgaagaattaaaaatatatgcctacttctagaatatcccttccccgtggtaaatgtccgccgagagcgtcccgttttcactgccaattctatccaatccagcgtattaaaggtatatttcacaaatgggttttttagtaatttgttcctcctcttatctcttacctaaaggtgctcaatgattttcgtttttggtcctaccgaatg

SEQ ID NO: 108825 - DNA, 112 bp, Heterodera glycines
  misc_feature (53)..(53): n is a, c, g, or t
  misc_feature (83)..(83): n is a, c, g, or t
  misc_feature (104)..(104): n is a, c, g, or t
  Promoter: Source sequence=SeqID_27918; Location=1272..1383; Strand=-; Gene=SeqID_58579
atagatttatttcaggaatctatatttggatgttcacgctaaaaatccctatnttgagtgctgccccctaaaataatttttcncccttattttggcatttctcnttaaaatg

SEQ ID NO: 108826 - DNA, 231 bp, Heterodera glycines
  Promoter: Source sequence=SeqID_8201; Location=403..633; Strand=-; Gene=SeqID_67292
ggtaaaaggagaacgaggaataacaggaccaagcgaaagacgaggacaaaagggaatcggacattggactgaaaaagagggggccaaaagcagaaaaagaaattctaattcactaattaccccccccccccttatgacgacccttttgttcgcgtgttgtccatcaaacgggccgagtacagtccgctcaatgcccacttggactctcaacgcatcggcagcttcgaaatg

SEQ ID NO: 108827 - DNA, 684 bp, Heterodera glycines
  misc_feature (26)..(26): n is a, c, g, or t
  Promoter: Source sequence=SeqID_25783; Location=1196..1879; Strand=-; Gene=SeqID_56523
tttttcgcttgaaaaaatcattatanttaatctgcttaagttttttcttttggaaaaaatattcttttgttaaaatttttgattaattattaagtaaaaaaaattttcatctctttttctcgtgtttttagggcgtctcgtcctcgttttcgtttttgatttttcttctcgcaacatcccttgaattctattataatttcaaaatttttgattcctgtattgacttttcaaattgcctccagaattcgaaattaatcaaaatgaatgtcatattcttgatcaagggcatcgacagtatattaaacgagaaatattttctaatgtctctcatgcgaaagctttaaaataataaaaaaagaattcatttcattttccaattcatcttcattaagggatgttctgtatttgggacagtgacaatttttttttatggttcataaatcattttttggcatagtgtcaaatttatgtagaatatataaaacgacttttgactacgaagtgcattttgacaagtacttgcgatttttataacaccacacttcgaacaatttaccaatgaacaacagaaaataaatgaaagtttagtcgctgcgtattagaattaattcaagattttttcaaaatcaatttaaattatttaaattcattttataagtttccgtcgacacattcactcaaatg

SEQ ID NO: 108828 - DNA, 52 bp, Heterodera glycines
  Promoter: Source sequence=SeqID_8992; Location=1668..1719; Strand=-; Gene=SeqID_69936
ttttctttgcccgaattagcccatccaacgaacatttacttcttcacaaatg

SEQ ID NO: 108829 - DNA, 453 bp, Heterodera glycines
  Promoter: Source sequence=SeqID_2099; Location=644..1096; Strand=+; Gene=SeqID_77840
gggtccgaagttgtatgcactaaaaaatgctaaatatgcgcataaaaatatgcactaaaaatcccacaaatacgcactaaaaaccgaaaacgccgcaaatatgcagcaaaatatacttaaaaaattgccaaaatgacttttaactaaaaaaatgccaaaaattgtttaaaatttagcttctaaccctagtgataaatagaaagtccgaggcaatagcgggtcctaagccccctctattgtaatatatgaattgaaaagcttaaaatattggagatatcaatttattgctttgtatttctccagactcttcttccccctcaccgccgcccctccccaaaacgcaaccgcccgcttcgacgccgtccagcgctggcacagaggaagaagcggaaacggaggaggaggacgggcacaaagtgcgccgggaacggcacggctcaaacggcaaaaatg

SEQ ID NO: 108830 - DNA, 1003 bp, Heterodera glycines
  Promoter: Source sequence=SeqID_431; Location=4101..5103; Strand=+; Gene=SeqID_52503
tccataggtgtcggattatccgctagtgccggattttccataggtgtcggattttccggctcccgggaatttaagtcattaaaaatcttcaaaaagtcataaaaaacgcaaaaaagtcacaaaaagtgcatgttaacttggtaaatcggcactcgacttttaatacaaagagagggttttaatgaaaaaatgtaaaatattaacttactataacataagggtgaaaaatgccaaaacaaatggtaaaagttacagtgcattttttcaatgaaaaaaatcagggctaacaaatgatttcaattgaaaacgaataaattgcattttctttgaatttaagtaaaaactaaaaattgcttacattgttgaaaaaagtttttgtaattatttaagaaaaggttcgatcgccaagaactttatactttagcagaaaatttttataaattttaaaatgacttaaaaacgtgaccggaaaatcggtcagtggaaaatgcgtcagtggaaaatgcgtcattatcattttggacaagaatttttaattccattttataaaaaatgaatttttttgccatactgtaaatcacagttacatggagccagaacgatccacattctacctgagttttctggcattttttaataaaattttaaaaaacaattcttttatttaatttaaaaataatttttattcaatggaataattctctttttggatctttaaaaactttaaataatattttttatgatatatttctcccaatttaagcataaaggatttgtccattgttcttgcccaaaaggtcaacgggaatgggggagggaatgaatgcatcaaaatagcacaataattgagaagcatcgaaatagagcaccggtgaagaggtagagagagtggaaaatggagaggggaaaagtgaggagagaaaggagagggtgacggagtgacgacgaggaggaaagcgttggcgaggaagaggggatgaggaggaaaggaagacgagaaatg

SEQ ID NO: 108831 - DNA, 110 bp, Heterodera glycines
  Promoter: Source sequence=SeqID_37374; Location=652..761; Strand=-; Gene=SeqID_66467
ttgagtgtgagcagaaaaagagatagacgttttttcaaattttcagagccaaactcgcccagaaagaaaatccagaaaaaatcagggtcgtcgctactattccgaaaatg

SEQ ID NO: 108832 - DNA, 129 bp, Heterodera glycines
  Promoter: Source sequence=SeqID_13168; Location=1490..1618; Strand=-; Gene=SeqID_76990
gaaatgtttctttataaaaaagtgttttgagagtccaataaaaagtttatttaatacctacaaataattatttcttataaattggacactataaatatagcaccaaattttggaactgttcccaccatg

SEQ ID NO: 108833 - DNA, 824 bp, Heterodera glycines
  Promoter: Source sequence=SeqID_5323; Location=1..824; Strand=+; Gene= SeqID_57679
tcagtggcgaaaccgcggacacaagagggcgatggtcggcaactcctcgttggcgcgggcgagcacgacaacaattcgggaacgaatggaatgggcaagacaggggattcggaacggatggataattttgatacttaccgatgaaaatagtttagaaagaaattatatttgacatattttaaatattaattgtaaactcaattaaattttgttgcattttaacattcaacaaaaaaataaaaataaataaataaaatgcaacaaaataattagtaaattgtcggggacaattttctctcaggaggggaatggtatctctataattaattgtacattagatatttcttattttctgactgtctgattttgttagtgcctctgatcactctgatcaactttaactccgccccttctcgtaatgtggcccatttcctagcgatcacctcaattcattcttataaccgggatcacatttaccccgatcccctccccttccgtcctgtacggatcggggtccctttcccctttttactcattacattagcatattgtatttcttggatccgccttcggaataaaggacattattccatgtgtatactattattgtacggggaaattagggcccacaattagaacggacattacatagaaatcaatactaattaaatttttactattttgtttggtttctttttttgtgttttccttattaattaaggtctaattagttctgtccccaaaattagtttcttttatttatgcataaattgtggctttcaaattcgctttgctacctgagcttgtactgctccaaccccatg

SEQ ID NO: 108834 - DNA, 143 bp, Heterodera glycines
  Promoter: Source sequence=SeqID_43072; Location=1..143; Strand=+; Gene=SeqID_70837
tgcgtttcagagcactttctgaaaaaatacttatgccccccctgtgcaaaaaataaataagtaatgaaaaagtcagaactttgaaaaattttaaaaacaacaagcgttggcattttttcaggttaagttagtcctttacaatg

SEQ ID NO: 108835 - DNA, 1003 bp, Heterodera glycines
  Promoter: Source sequence=SeqID_17229; Location=520..1522; Strand=+; Gene=SeqID_81695
gtgtagagtgtagtgtagtgagtctctacactatagaacacacctacactctacactatagaacactctacactatagcatctgtaacatagctgcaatggaataatagccaaataatatgcagggaaataatgcatagctgaatggaataatagccaaataataggcagggaaataatgcatagctgaatggaataatagccaaataataggcagggaaatattgcatagctgcaatggaataatagccacatattaggcagggaaataatgcatagctgcatggaataatagccacatattaggcagggaaataatgcatagctgcatggaataatagccacatattaggcagggaaataatgcatagctgcatggaataatagccaaataataggcaagtaattaatatgggatgatcaaatgcgttgtacgtagatggataataccagatttagtagcataaaacccaacatatgaccatataaacatatgcataggttttatgccacaaaaaatgtttttttccatggaggtatttcactccagattcgcagcacacttgagcggcaccagcacctgaagtttaaagtttagggagatttgaaaagtaaagaataaataaatatataattaataatattttccataaaaccccatattaactttaaacatattttgtgcgtgtcttaaaggttagtaatttaaatttaacgccaccctgcccacttgaggaatagtgcactttagaatggtgtcttaaaacagaaaactaaccaacaaaagaaacaaagcgccaacaaaattaccaaaaaaagtaaacaactaaattttaaaatattgaatgatggtggttttaaattatgtcggtttaaacttataaaattttattaaaagcaagtcttagcatttctaatcataaataaaattctgtggcaaaggcaaactcggcaattatcgcaaaccattcttttatatattttttgaatattagaaaaaaatg

SEQ ID NO: 108836 - DNA, 187 bp, Heterodera glycines
  Promoter: Source sequence=SeqID_15535; Location=1813..1999; Strand=-; Gene=SeqID_79816
tcttgataaataaaaaaaaatcaaattccatcggagaagtctgctagcaataccagaaacctattctctttttaaaacctaacggcccaaaaaaaatctggtccctatttcgagtcacggaaaattttccgtgtccaacaaagtctgtattttgattgaaaaatgttttttacagctctctctgatg

SEQ ID NO: 108837 - DNA, 114 bp, Heterodera glycines
  Promoter: Source sequence=SeqID_12365; Location=2680..2793; Strand=-; Gene=SeqID_75969
attttccaaatgataaatagggaaatttttttaagcaattttcaagattgttcattgatgactttttgagttaaagcgaaaattccgattcattttcagtaccgaacacacatg

SEQ ID NO: 108838 - DNA, 62 bp, Heterodera glycines
  Promoter: Source sequence=SeqID_16761; Location=361..422; Strand=+; Gene=SeqID_81172
ggcacaaattatgcaaaaagtgaaccaattaatcatttcttccgccccaatttttaggaatg

SEQ ID NO: 108839 - DNA, 370 bp, Heterodera glycines
  Promoter: Source sequence=SeqID_33578; Location=232..601; Strand=-; Gene=SeqID_63599
tcatataaaaaaacaattctataaaatcagttttagtatcttcttcctaataataatacttttcttcacatttgtttcgatttgtgaataaatatgtaataccgtacttcttcgattatagcccccgggggctctattgtttaacccccctcaaaaggggggctttattcgagagggggttctaatcgaggggggggatataatcgaagaaatacggtatttttgataaaattgtttatttgttaattatttgcaaatgttttctgttcatgaagactgaattaggaagagtgaaacattaaataatgaccggggtatttaatgcacacctttttaaaaaaaaagttaattaagctgcagtttcaacatg

SEQ ID NO: 108840 - DNA, 985 bp, Heterodera glycines
  misc_feature (107)..(108): n is a, c, g, or t
  Promoter: Source sequence=SeqID_5794; Location=1..985; Strand=+; Gene= SeqID_59250
aaaaaattttaaaattattttttttatggtaaaattgacgttgctcacggatctggcaaaaagattgtttcttttaatctctgactaacatctgcaatgacttctanncatttatacaatagactaatctttgaacagcagcgtcgctgattttatgcctttttcaatgggacttaattttgtatgtcatcgaaatggatccgatttaatctaattaatgcgctttttaaagttttgttttttggatttgtcttgttattttcttttttccatcattagacgattgtcgcaagattgagcatgcgacagcggaggatcgcatgcgaatgcataaccccgaaccggcacgagcagcacaggcaattagcaattacatggacgagccggaaagtgttctgttcgttgcaatgtcagacaaaatgaatttataaatggcaataaatattatgcaaaaatgaagttaaattttaattgattattttggcagtcatttaaaatttaatttaaaaatttagtttttttatcttaacagaacagcatatgatggcagtgccaatgtgattgcgtgttgtcggttgaaattgtgccaaaatggcaacacaataaacggaggaccatttgcgcagattggcccttttgcaacattaataggctaggctggtttcgttgatttgattgtttcaattgaagataattatttaattacactaactaatataaattataaaaatttgtgaagggattttaggtgctaaaaagtaaaaaggtacctaaaaagagctaagaaaacgccaaacagatgctaagaaagtattcacatttttttaattaaatgaattcctgctttactatttctgtaaattaaatttttatttcttttgaaaaaatgaaaaatttccttaaatacaaaatttaaaaaataattattttttctttaaaaaatttctattaaaagccgaatagccaatttagctggtagttaatg

SEQ ID NO: 108841 - DNA, 188 bp, Heterodera glycines
  Promoter: Source sequence=SeqID_2518; Location=108..295; Strand=+; Gene=SeqID_80183
tttctgcgcacctttcaccaaattggaccgtaccatccaccgtattcgagctgacgtatgaatcaggcaaggaaaatagaaaaataaattttatattttttaaatttaattttatttttaaattcttttgttttaaatgtttttccaaatcagaaccattattacacaattaaaactgttcaaaaatg

SEQ ID NO: 108842 - DNA, 608 bp, Heterodera glycines
  Promoter: Source sequence=SeqID_6460; Location=1359..1966; Strand=-; Gene=SeqID_61666
gaccctctcccctcgcccattcctcagaagttttttgggaaaattacgccgctaaaaaattgcattaaaatttacgatttgctaatttcctccccaaaattgttaaaatcgttaatgggaggtgaaaatataatatttaatacatttttgattgaataaattgtaaaaataactgttttgaagcaatgaagcaaaatgtcctgattttcgacccaaaatctgattttttgggctcgatgttctgattttgaaaaattttcgatcgcatccctgatttaacactttaccaatatttttttcaaaaaaaataactgtttaaaaaattttttatttatattttcgtacatattttaaggtttttatatatatttcttacatatttccggaatttttttacatatttatgtacatattttgaccactttttgtacatatttttgacatccctagacataattgacctcaagactgaaattgagtccgagactttttgagatatttgagagcccgagcccaacagaacagttattaaaaatgcgagcgaaatctcgaaaacagtttgtcagaaagccaaaatttgtgatttccaggacagcgttaagcaaatg

SEQ ID NO: 108843 - DNA, 195 bp, Heterodera glycines
  Promoter: Source sequence=SeqID_8344; Location=4318..4512; Strand=-; Gene=SeqID_67746
tgttcaatctgcacagtggtccattggtgaagctaacgttgaggacactggttaccgccttgatggattagtcacacgagatccacctgaacgggaccttgccattgagtatatgggctgcttttatcacggtaaaaaaaatgttattattctttttctttaattttcataaaacggtgaaggctgtccaaaatg

SEQ ID NO: 108844 - DNA, 1003 bp, Heterodera glycines
  Promoter: Source sequence=SeqID_16459; Location=261..1263; Strand=-; Gene=SeqID_80859
cactcctcccctccccccctttccccctccgccacgccattttctccaaccaaaaaaatttcccacgcaaaaatggttggactcaaaaattcattcattgagctccgtgcttctggcagaatagcatgcgagtgactccgaaaagcttttgagaaatggcaaaaattaaaagtgtcaattttggcatttaacagataaaatcggagtcaaaattggcatgaaattggttaagcaattgaagtagaaaagctgaaaacggcgccacagattttatcagaatccagcaattcttcagcaatacttcaaatgtttttgtttttgtttctgatttgtgccgtccgaatcgggcatttctatgccaacactctcaaaaagcggtgctgctgaaattggatacggctcggcgtccgggccaatttgtgccatggcccttcccactccctttttgccctccccatttcccctcccccgtcagatttaatattccatcccccggccgcaacctctccaaacgagtggtaatttgccccattctgcgcccattcccatcatttacacgcctctttcgcattattctcatgcactcgtcgcctttgtaggattttctcggacggactccgccggcacacaaaacccttaggcagaaacaaaaattgggggggaaggaacgcggcggcattcctccggcggcgcattctttcccccgccccgggggcggcacagttcagcatttgtcgggcacagaatttgacaacctaaaggaattattcgtgcagcaaaatacgtcggaagttctaaatcttcggccagcatcggtccctttccattcgtcggtttttggcgctttttcctttcgctgtaaaataaaatgccattttgggaatgggcagaaaacaggcaaagaattgagtggacacctgattgagaattttgtacattaaggcattccccaattacccttaattactcttaattaccctttcgacccctccccttcaaaatg

SEQ ID NO: 108845 - DNA, 422 bp, Heterodera glycines
  Promoter: Source sequence=SeqID_14062; Location=598..1019; Strand=+; Gene=SeqID_78037
aattaattaaaccagatgttgcgtgcttttttgcttcaaattcaattggacaaagtgggcaaagcaaagaaaatgtcatgtttgttactgttgcgtacagagattggtcgagattggaaagtcccgcgacgctcgtgaaagatcagaagggtatgaatatgatttaaggcaataataaacgaaaaaataggtataacaaagcacgaagcaacacaatatcattcacaatctgttcaaatggccgcacattttttcgcaagtttttgagagaaagcgtaaaggaattgacgccattgtcaataatttgcaacatgaacaaattgaacgaaatcggtacggcattaaaattaaattaatgatttgaaataatatattttcattaattttaataattattttatagtgaaatattgcggccaatg

SEQ ID NO: 108846 - DNA, 68 bp, Heterodera glycines
  Promoter: Source sequence=SeqID_1135; Location=356..423; Strand=+; Gene=SeqID_68379
aagaccagccaatccatgtgcgtgtggcagccaaaggggccaaaccatgtgccaccggcttcatcatg

SEQ ID NO: 108847 - DNA, 664 bp, Heterodera glycines
  Promoter: Source sequence=SeqID_10133; Location=633..1296; Strand=-; Gene=SeqID_73226
aggcattcactccctttctgccatttgctgacatttattgggtcgttccgcctacgaatctatttgttattattgttttacagtagtgcaatgattgagtctaatgtaagcaattggtaaaaaatagggcatcagtagggtccccaattttcgtaaatatatttttaaactcatcctgactgaatttgaactaaggtcgaaaattccaaaatttgcattttacaccaaagctcaaaaaattgcgaaaattttaacttaaacattttttcttgaaaatgagacaagccctactgtctcggaatattgcattatttttatttcacttggatatttgtgcttttattttttatatttatgagagtacagattaattgaagtgaccttttttgagaaaccaaaattcctgtgtaataagtaacaacaaaatattattattccttaactatattcatttctgtaccctcaatttgcgatttgttgcaaaaattgatagacattttatttatttatttcgaaagagcaggtaagtcatgcttttctttcttttcttcctttccaagtaaaaaacctatatacttttatatttttaaattttatttggctttttcttataattagcttctttcttttttttttttgctttattctgttggctataaagatg

SEQ ID NO: 108848 - DNA, 567 bp, Heterodera glycines
  Promoter: Source sequence=SeqID_15117; Location=1..567; Strand=+; Gene=SeqID_79300
gatagcgacaaccgacgtatattgcgacaccttgggcgttggtcgtttatcttttgtcgttcgtaattgtgattggcccctgctggggtccagtggtgccgaaacacgctgccgggaacacaaatcgtctcacatcaaaacgagattttgtttcggtacgagtttaagagtggaattagcacgaacttagttagaatttcatttgtttcggccttcaacttttattgagcttattgtctctacatagaaatggataaatactataaaatgtcattagagtaagcagacagttaaagtgtcacgcaattttcattttgaatctgataaattatagcacaaaaaaaactcacacgctaaatttctctttttctccgttatccaaatgaaattgccatatcatattttataaaatattttactaaataaatctgtcaatgaaattaattttcgatttggtgcaaaaataatttcaaggacaaaatcaaaaaaaaattgttgcgatttggccaaaaatgctgattttattttttaaaattgtttattagatatttcatctatttgaaaatg

SEQ ID NO: 108849 - DNA, 336 bp, Heterodera glycines
  Promoter: Source sequence=SeqID_40661; Location=671..1006; Strand=-; Gene=SeqID_68919
gggcatcgatcaaatcacagatccttatacatataaccggactgcacatttaatcaactcagacatatcttctcgtggtccgccgaagtaataattaagcaataagatgggcttatttactgagtaaatgatccgggtttttagtcttttaatctggggtttgttgttttaatttcgggtttcctggcctttttgcatgcgctttcgatgtatttcgaattagttaattgatcaacatttttatattatttttagctctttttatcgttttaatctttgtaaaaaaatttttttttggttgatagttctttaaaaatttcagtgtaatttacaatg

SEQ ID NO: 108850 - DNA, 226 bp, Heterodera glycines
  Promoter: Source sequence=SeqID_20562; Location=1..226; Strand=+; Gene=SeqID_51114
ccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 108851 - DNA, 180 bp, Heterodera glycines
  Promoter: Source sequence=SeqID_6154; Location=1187..1366; Strand=-; Gene=SeqID_60530
ggtgaactccatttctttggttgtcctttttgccatcaaacggacctttttctttaggtgtccaaggccaatcattgctcccgaattgtttggaatgtccttccgcgcttcgctgctgcgattactttttccaaaagaatcggcgcggttggcgagcagcgatcgcagtggtggcgaatg

SEQ ID NO: 108852 - DNA, 156 bp, Heterodera glycines; identical to SEQ ID NO: 106092
  Promoter: Source sequence=SeqID_6080; Location=3177..3332; Strand=+; Gene=SeqID_60243

SEQ ID NO: 108853 - DNA, 272 bp, Heterodera glycines
  Promoter: Source sequence=SeqID_10478; Location=3709..3980; Strand=-; Gene=SeqID_73684
tgtaatgactaatcgatttttacttaaatgcctcgttcggtctcaagaaatatgtaaaggataaattaccaagattcttctcttaaattgggagaatattctatgcgtttcccatggaatgattagcaaaatgaggacaaattattataatcagaaaccatttgtctagaaacagatcaattatccccaaagcccaagtcgagagtgtcccactcgctatcgggcattttcattttccgttgctattgtccccaaaagttgccgccccaatg

SEQ ID NO: 108854 - DNA, 78 bp, Heterodera glycines
  Promoter: Source sequence=SeqID_2965; Location=4712..4789; Strand=+; Gene=SeqID_82541
agtacgaatttaatagtaaaacatttgattgcttctttctgttagcattagtgtcattattaaattttgagagaaatg

SEQ ID NO: 108855 - DNA, 450 bp, Heterodera glycines
  Promoter: Source sequence=SeqID_124; Location=4936..5385; Strand=+; Gene=SeqID_73170
tttttgaacagaataattggcttaaaaagagtaatggttttacgcaaatttttataaaagcaatgagcaaaagaaaacccaattctcaagtaattttggatttaaaacgactttttttaaatagccacctaaaagagacacgaaaaaaggcatctaaaatgcatgaaaaggacaaaaagtagggatgtgcgagaagtgatttttactgggaaccgagaaataaccccggaaacgataagagatccaaaaaccgagaaatttctcgactcggaaatcgagaaatttaaatgaaaagaatccaaataaatcaaaaacacattaaaaatggggtagatcaaagggaatttttgcgtagaagtctcagaagtctcaacattaaagtgacagcgttttttgctgttaaaaacgctttttgcacactttttacaaaaaaaaaacttgggaaacatg

SEQ ID NO: 108856 - DNA, 322 bp, Heterodera glycines
  Promoter: Source sequence=SeqID_29200; Location=1090..1411; Strand=+; Gene=SeqID_59735
aatatcacaatttaaataacattcaaaaattcattctaacggtcacggtcacaattcacggggctattcacgggttttcttcgtaattgtcgcatttttataaaataaataattaaattaattattaaaagcttggaattattgccgtcccacttaagcattggtcgatttcaccagggacttccagtcgttgccgactttccgcgaattggctttgctcaacatcaatgaacacaataaccaggaatacgtaagcaaaatttaattacattttatttattaattactgattatttcttgactacaggtgagtcaggtgatg

SEQ ID NO: 108857 - DNA, 672 bp, Heterodera glycines
  Promoter: Source sequence=SeqID_1911; Location=1..672; Strand=+; Gene= SeqID_76731
tcgactctaatgcacttaatgagtcccaatcaattgaaaataccggctgcttatacaataactttgttcatattcgaacaacccctatctttttggtagcattcgaaagcacaaagtctaacgaagctaaaatatataaaatctcatcgtttaggcaattacgaaaaaagagctgattaattaagtaattgctgattattttcgtttgtaactttcttgaaatgttaaaattctattgttttctcatattattacattattcagactttgtgcttttgagtgctaccaaaatttaggtgttattcgaatatgaaaaaagttattacctttggactcataaaagtcaattagactcacaaagtgcattagagccgaaaaatcatgggagcgtgttctgtgcttgaaccaaaacataaaacacgttggcatccacctttcaggtacgttgaccacactgtgctagcatttctccgttccaatcagcaaatttgggacaaaggcaccaaattggacttgcgcatgtgcccggacgggccttgggatgtttttgtccgccaaatttggcccctttttgaagcaaacattcgcaaattgcacttttggagtggttctcatttggacaatttgcgtcgtctcatttcgcccacaattctctccgacctcaatcccatg

SEQ ID NO: 108858 - DNA, 994 bp, Heterodera glycines
  Promoter: Source sequence=SeqID_20105; Location=1..994; Strand=+; Gene=SeqID_84894
actgattttcagattttgattttttacaacttttttggcttttccttcatttgagttttgaacacatattgaacaaatcaaaattatacaaaaaattattgccaatttaaaatcctttttgatttccattttaacaaaccttaaataaaaaagaagctgcttcattttttcatattattataattaaaataaaatggaaataagaaaaaaattctctaaatggaaattggaatatcaataaaattgatttgcataaatttctttttttatataatatgattattaaataatatttttaatgtcttgtaattatcaggcatggaattattacgcaaatgcctattttagccaattgtttcatcgagagaagcatcattttgtgccaatttttgccaagtgcacctttttgtgcttttcacaaatgcctcaacaaatgaaattttttcgcactaaatttttttttaaatactcttatatttttacagacagaaaatgttttttatttattttattttgaatacaattgaccaattttttgaccgttcttaaattgctgattttgaaatacattattgaattcaaccattttttgtataatattgccattaaaacatggcatttaattcatttatatttaattattggtaattaccataaaaactatgccaattaacgaattatggataattaatggcttttttgcttttcttctcgtttagactttacacctgaacaaacattatgcattccattatttggttttcggagcgattatttgccaacaaaaataataaaaaacgattttttcgctccctccagcagctgccttcaattcatagcagaaacagctaaaaaatcaaacgtacagcagtggccaaaatggtttattaggaaaataattaacacgcgaaaacgtaaaaaaatacaaaaattattttagataaatatttttatttaaattaattttgatttaaaaattgctctaaaacatatg

SEQ ID NO: 108859 - DNA, 183 bp, Heterodera glycines
  Promoter: Source sequence=SeqID_5949; Location=1535..1717; Strand=+; Gene=SeqID_59767
atagttaattttttttgttcgcaacaataaacaattttggccttcggcttggtagggtgagcaagaagaaattggggattttgtttattgcacagaaaaataatttacaattaatttggtgaagggaactttttgtattgggtgaaaaactgttgctgaacgggggaaattcgacgagaaatg

SEQ ID NO: 108860 - DNA, 88 bp, Heterodera glycines
  Promoter: Source sequence=SeqID_33825; Location=927..1014; Strand=-; Gene=SeqID_63776
atagttagtccttttgttgaatttttagaaattttatccatcaaatcggcttttggaattttaatgagtaaatcaggaaccgtaaatg

SEQ ID NO: 108861 - DNA, 138 bp, Heterodera glycines
  Promoter: Source sequence=SeqID_44354; Location=1..138; Strand=+; Gene=SeqID_71854
gaataagccgttcaaggagcgaattcgacacttctacagcatttggatctccaatgaggcggaaaaggagatcacatcagcgggcaatccaaaggcacctgctcttcatgtggtacttgattggatccaccgatcatg

SEQ ID NO: 108862 - DNA, 1002 bp, Heterodera glycines
  Promoter: Source sequence=SeqID_6422; Location=1..1002; Strand=+; Gene=SeqID_61513
aaatgattggactttccgctcaaactgcttaacgaaagtatatcaaactttaaaaactgttgtgaatttttgtccccagttatataatgagaaaattatatgtacaaatatttgcagtttaaatgaagtaaaacagtgaaagttttgaaaatagttcagtgtcgaaaatactcagtgtcgaaattacccagtgtcgggattaccggacacgtctaaaagcccggatagcgcccaaaaatatcattgtatattttgttttgttttctcttattaatgcatttcgaaatccaactcgtactgtttttcgcattcgatagcccttaaagtttctatatctgcaggaaaaaaagtcaagaaaattttattgcttttcaaaaaagttatgaacaaaaatcatcgcaaaacgaacccattttcggagggcattcaaaaattgtgccggattataccaagaatatttaaataagtccattagggcaaaactatggcattttttttgtcgaaagacagtacgagttatgtttttccattttggtcaattttcaaaatttgaaaaatgcgaatttaacctttacaaatgaagttggataaaaaattatcagtcgaattgattatttatttggggtaaagtaaaactccccgaaatctcatcatttgcaaaatattctcctatttggtggtcctcttatgtgcgttccctttttcttccgatccgtcgtcattttatgtcaaaatgtttccgcgccttccgtttttggcaatgatttttcgcctcctattggcacttgtccaacccctcgagcccattggcaacagttgaagctgaactggttcaaaattgttttaataaaatgcgattctcgtgtttttctcatcaagtattatccgtaaaaaataggaaaaccctaaaaatccaggctttatccaacgcaattatttttctgctatttgtgtgacatcattcgaaattcaacagcaaattttgctaattgccaaaaaatg

SEQ ID NO: 108863 - DNA, 200 bp, Heterodera glycines
  Promoter: Source sequence=SeqID_17838; Location=1884..2083; Strand=-; Gene=SeqID_82370
attaattatcgagcattaaataataaatttctacctcaaattaagctttaatttgggagaaaaattgcatcaatttttaattatcttcggtgaaaatcgaattggtgagcaaaaaattggtgaaaaaatatttaattcaaaaaaattaatttgcatttgcagaaaattattcatttaataattcagatgagtgtgccatg

SEQ ID NO: 108864 - DNA, 1003 bp, Heterodera glycines
  Promoter: Source sequence=SeqID_3328; Location=1740..2742; Strand=+; Gene=SeqID_84240
ggcaaatgcctcaaaatccgagctctagtaataatataaaattcgatagaaagaaaaaaatttccatttacacatatttcttcaatttgattttatttatttgtgtcaattataaatcaaagctggtggatgggatgaagaaagaatgcatgaacggatgggatgacagatcaaaattagaaaaattgaatgaaaaaacgcacaaaaattggaataataattaaaaaaacattcgcacaaaaatgggatgaatgaaaagcggaagaaaaagagagagtcactatcatcagagtcatcgtcatcatcaacagtttggtcctcctcacatacataatacagtatattctccacaccgtatcccatcagcaatcgtaccgtgtgctgtacatattgagggaaattttttaaaataaaattataacaattttcaagttttatccggtgtcaccagttgtacctctaatttccaatggattttaatggaaatttgaatcacataaatccgcaaattggcatttttgtggcataaagtctaactaagatcaccgttgaaaatatcggtgcaaaaaaattttgacaattagacggttcatgaaataaatacccatcacatatcgttttaagttccttaaaccaaatttcgtttcttttttcaatttaccgctttgccgatggctccggtccgatgatggcacagcctccgctgcccgagctgccgtttgctggaagagaacaaaaaaaaattagtgatgagtgaattttttttacctaattgttttttggagcatatggagggacatagaaattaaaaattatacgtagacaactgagcataggtggacaggggggggggtaatttggtaaattgtacggggattcgaggcaatttcctaaaatattcggcgaaaatcgaatagcacagctaaagacggaaatttttttttatgaaattgggaaaaaaaatttaatttttgttccgaaaaaacacattatttttaagatg

SEQ ID NO: 108865 - DNA, 287 bp, Heterodera glycines
  Promoter: Source sequence=SeqID_43530; Location=647..933; Strand=-; Gene=SeqID_71174
tggtgcgcttctgatcagtttctgactttaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 108866 - DNA, 138 bp, Heterodera glycines
  Promoter: Source sequence=SeqID_599; Location=5807..5944; Strand=+; Gene=SeqID_57256
accatagtgttagcaaaaacggacgacaaatcctggctcaaaaacaagaatgaatgctaccagttggctaaagcggccaaggcaggctttttcgtctaccaccggcgaaccggtgaatcaagacaattaaccaacatg

SEQ ID NO: 108867 - DNA, 301 bp, Heterodera glycines
  Promoter: Source sequence=SeqID_13108; Location=2318..2618; Strand=+; Gene=SeqID_47106
aaattcgaattggtcagttattcttgcgcaccagcaaagtgcgtggaaggcattcaagaaggagggcaaaagtgtgggaacgcccggcaatgccagggcggggaatggcacgagttcatctgtgagcacggaatggcatttgtgggcggacgatgcagcgaccgcgtgcgttgccaaagcaaaagtgatcaatgggccaaggggaaataggaacaaattctgatcagacccaccgagcaatggccaatgtgccgagggacacacgcgggcacatggcagagactgctcaaagtatctgatg

SEQ ID NO: 108868 - DNA, 65 bp, Heterodera glycines
  Promoter: Source sequence=SeqID_2195; Location=4676..4740; Strand=-; Gene=SeqID_78424
aaaagggggagggaaaccgagggcacagcaacaacaaaaaaaggtagaaagggagagcacaaatg

SEQ ID NO: 108869 - DNA, 168 bp, Heterodera glycines
  Promoter: Source sequence=SeqID_23105; Location=371..538; Strand=+; Gene=SeqID_53814
aagagtaacaatgcaagcaaaaatttaccacaacttccagttgcttgcaaacgataccgtaatgaattgttgaaactgatccattcctactgtaaacatacgcaaaaaatatacggtaaattaaattttttaataaattaactctattttttttagcttccaataatg

SEQ ID NO: 108870 - DNA, 244 bp, Heterodera glycines
  Promoter: Source sequence=SeqID_27195; Location=1233..1476; Strand=-; Gene=SeqID_57883
aacaacaaaattgggacaaaaatatttttgttttcaatataacccaaaaatttacttaaaaaaattaatataaattttgaaaaataaataaaataaaattaaattggaaagaaaacgtggaaaatattcaaacattagaaaaattttaaattgagaaaaagtgggtagccaattttgtaattagtgagtttattgtcttttacttttctaattaatgtttcaattttgcatccccggcaaaatg

SEQ ID NO: 108871 - DNA, 488 bp, Heterodera glycines
  Promoter: Source sequence=SeqID_9793; Location=68..555; Strand=+; Gene=SeqID_72699
tttcgttcaaattccataatgcaccaaaagttggttttcgatttgaagcaaataaagtgtccggacggatgtacggaacagcaaaaaccaaaagaaacaaaaagtgaaagaaagaatcgaaaatgcgatgaacatgaaatgctaacatattttgacctaaaccattaaaaatcgacggtcagccgtaggcggaaactgatcttggaggacaacatccgaaatgggacagcaaatcacaggaacaaaaaaaaaaaattaagctatcttaagacttaagctaaagcaaaaaaaaaaaaatcttctggcgaaatgtattaatttaaaaaaaagttttcaaaattgaaatgcatggcacttaagtgatttaaccagaaattcatctttttattcatgtctgcttttgaattgcattttttagaattctattttattgttttattcgagtttctttggttgttttttgtccatcttttctttttcttccaatg

SEQ ID NO: 108872 - DNA, 205 bp, Heterodera glycines
  Promoter: Source sequence=SeqID_20957; Location=2021..2225; Strand=-; Gene=SeqID_51537
ggtcgcgtcttttgtttgtggaaagtgcagcacataaaccaagttttagtggttctactggacagcggatgaccattacacgggcgcgtggcgcgaattctctcagctgtcggttgcgcagctgaacaaagctgtcaatgagaagaagacttctgttcgtctgacggttgcccagagcgtttacttcatcgacctgaacgagatg

SEQ ID NO: 108873 - DNA, 352 bp, Heterodera glycines
  Promoter: Source sequence=SeqID_17635; Location=2463..2814; Strand=-; Gene=SeqID_82164
cctcggattaccacctttttctttctctcaaaactttcttctgggtaggcgcttcactgaagacgccgaggtcgaggaggcggtggggcagtacctgacctcaaagatcggcacagattttttccgtcgcggcattaggaaacttccttctcgttggagaaaggttgttagggtccagggaaactattttgttgagtgatattgtatttacagttgttatgattattatttttgatattttatttataaaattttttttctaaaaaagcgcccttttttatgcaacgacctagtaaaaatcatttctttgttgcttaattttcaattttttagcgacctgttaacagcgatg

SEQ ID NO: 108874 - DNA, 359 bp, Heterodera glycines
  Promoter: Source sequence=SeqID_266; Location=8292..8650; Strand=-; Gene=SeqID_80660
aataataatttaatagagccaaaaaataaataaaaattacatttttaaaaaatcaaaaaataaataattaaaaaatattaaataaataaaaaataaaatttaaaaaatcaaaaaaaaaattaaataataattaaagtaaagaaaaaaaagaaataattatttttattaagcaaagcagcaaaaaaaaaacagaaaaaaataaatttaaaaaaataaattaaataataaagaaaaaataaatgtaaataataataattttattaaggattacaaatgcggataaattttgtttgttttatgctttggtggcgtcaaagctttatttggaagtgcatcgaaacatttttaatcgatttatg

SEQ ID NO: 108875 - DNA, 270 bp, Heterodera glycines
  Promoter: Source sequence=SeqID_29028; Location=1278..1547; Strand=-; Gene=SeqID_59599
taaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacaccaaaaatttagattctctagcttttgctcatcggaaggggcggtgtccgttggtggaggggaaatttttagggtaaaacataaattttgaaacgcatttaaattgtggttttaagggagatg

SEQ ID NO: 108876 - DNA, 125 bp, Heterodera glycines
  Promoter: Source sequence=SeqID_1074; Location=1..125; Strand=+; Gene= SeqID_67303
gaaaacgaagaagaaaatgatgaggaggatgaagacgattttgacgaggacgacgatgatgaaccatccgacgaggagacgctgcgcgacattccgctcgacaaaattgacatttgtgcttcatg

SEQ ID NO: 108877 - DNA, 1003 bp, Heterodera glycines
  Promoter: Source sequence=SeqID_14777; Location=103..1105; Strand=+; Gene=SeqID_78916
tgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatattaatatttaggaaaaaagtcgatttttagggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctactcatgaggaataatattttcgatattctttcttccaatttagttaagattttaataattcataattaatggcgccatttcaccctatttggaaaattgggttgtttgagaagagcaaggaaaacgacaaactggcagaatgcgttgaatgcaaagccaaaaaacagccaaaataccaattcaagctttccgacgggacgggactcccgttaaaaatagacgggatttgaacgggatcgggatttttacgggaatcccgttcgggactcccgtcccggaaaatttttttttaccagactctagttataactagggctgccaaccaaaaatatgtacaaaaagtggtgcaaatgtgtacataaatatgtatgaaatcattcattcacgcataatttcaccagttattttgttaccgtaatg

SEQ ID NO: 108878 - DNA, 61 bp, Heterodera glycines
  Promoter: Source sequence=SeqID_14375; Location=3087..3147; Strand=-; Gene=SeqID_78412
aaaaaagaattgattaataaattaattgctgattattttcgtttgtaactttcctaaaatg

SEQ ID NO: 108879 - DNA, 392 bp, Heterodera glycines
  Promoter: Source sequence=SeqID_13729; Location=307..698; Strand=-; Gene=SeqID_47151
ttatgaaaagtcagagttttgaagtggtattctaaaacaagtgataataagaacatatcgcatgaaaaacatgcaaatttatgagaggaatttactaaaataaatattttttgtaattttactgtacatatcaaagtcaaatattaaataaaaataatgatgaaaggccaaaaaaggacgaatctttgaaaaaaggatttgtgaatttccccttcaaaccaggacaagtcttagaaataaggacaaatctggtggttaccacgctagtaagtgttgtctcattcaaattaaccatgtcgtaacattttgaaaagcatttatagattacctaaatggcaacagcacatcatttagctaaaactcatcaacacacagaacacctgcaagaaatg

SEQ ID NO: 108880 - DNA, 52 bp, Heterodera glycines
  Promoter: Source sequence=SeqID_9616; Location=1..52; Strand=+; Gene =SeqID_72097
aaaattatgcgaagcggacagagaatttgccgaatacgccaacgcgtcaatg

SEQ ID NO: 108881 - DNA, 574 bp, Heterodera glycines
  Promoter: Source sequence=SeqID_5749; Location=360..933; Strand=+; Gene=SeqID_59117
ttgtcaaaaaaaagtagttatgcaccaaaaatgccaaaaaaaatttgcgcgaaaaatccactcaaaatcaaaaaaggaaaaaaataggcatttgtttaggaaatcattattatgatagataaataaataaatgaatgaaattgtcaaaatttatttctttttacattattattttatatatacagaattgcaaaaggctgtgtaaaaatggtaaaagtgaaatttacattttttataatttttgaaaaagcggcaattggccaagctcgacacagcaaaaaaaaaaaatcgacaaaatgaaatgagcaaaagtgaacaatggaaaatagagaataaaattaaaatgaaaaagttgcaaaatagcaatacaaaaaatggacggaataaacagcaaaataaatatacatattggacaattctcgagcaaaaaaagatcagttataaacggcagaatttaaaaaagagataaatgaatgaaggcaaacgatgaggaggggaggagacgatgggcccaaaaaaaaactgaaaacttcaaacatatgaaaccgaaaattgttgcgaacaattaaaaatg

SEQ ID NO: 108882 - DNA, 209 bp, Heterodera glycines
  Promoter: Source sequence=SeqID_9145; Location=1..209; Strand=+; Gene= SeqID_70395
gacaaaatcaaagattttctaaaatctcgcgctccgattcgtaatcagcgtatttttccacctcagagaaaaaaataaaataaaaatttttaagtttatttttcgtcgggaccacaattctacacaatcgccgttttatccctataaacaccgccccgtttaatcggtaaaaacatataattttaggttgaatacacttaaataatatg

SEQ ID NO: 108883 - DNA, 92 bp, Heterodera glycines
  Promoter: Source sequence=SeqID_2471; Location=4668..4759; Strand=-; Gene=SeqID_79884
ttatgtataattctttaattaattgtttttctccaaatctatttttgttttttactcaatatccaattcgttttttcattatctgaaaaatg

SEQ ID NO: 108884 - DNA, 450 bp, Heterodera glycines
  Promoter: Source sequence=SeqID_124; Location=4934..5383; Strand=-; Gene=SeqID_73171
tgtttcccaagttttttttttgtaaaaagtgtgcaaaaagcgtttttaacagcaaaaaacgctgtcactttaatgttgagacttctgagacttctacgcaaaaattccctttgatctaccccatttttaatgtgtttttgatttatttggattcttttcatttaaatttctcgatttccgagtcgagaaatttctcggtttttggatctcttatcgtttccggggttatttctcggttcccagtaaaaatcacttctcgcacatccctactttttgtccttttcatgcattttagatgccttttttcgtgtctcttttaggtggctatttaaaaaaagtcgttttaaatccaaaattacttgagaattgggttttcttttgctcattgcttttataaaaatttgcgtaaaaccattactctttttaagccaattattctgttcaaaaatg

SEQ ID NO: 108885 - DNA, 64 bp, Heterodera glycines
  Promoter: Source sequence=SeqID_12176; Location=1076..1139; Strand=-; Gene=SeqID_75752
aataaattaaactaatttaaaaaatgtaaaaaaaaaaattaagataatttatttggcacctatg

SEQ ID NO: 108886 - DNA, 178 bp, Heterodera glycines
  Promoter: Source sequence=SeqID_25438; Location=1..178; Strand=+; Gene=SeqID_56171
tttttggtaattgggcagaagcgtaccaaactcttgctgggatactccccggtaatggactaacttacaccgaaacgagcgccgtgctagctcggctcaaaaaaattttcgaaaatctcgagtctttcgtttttctttattttttgcaaaattaattcttaaatcttttttcagaatg

SEQ ID NO: 108887 - DNA, 57 bp, Heterodera glycines
  Promoter: Source sequence=SeqID_5543; Location=877..933; Strand=+; Gene=SeqID_58399
ggtgcgattaaattaatcacactcaaatggacattcgcgcaatgcgtataaaaaatg

SEQ ID NO: 108888 - DNA, 553 bp, Heterodera glycines
  Promoter: Source sequence=SeqID_884; Location=559..1111; Strand=-; Gene=SeqID_63279
tttttcagcaatttttttttgaaattttatgaaatttactgtttttttgaaaaattttcaaaaaaacttagcaaatagttttttttttggaattttcttattaaaaaaatgttctaaaattttttccttgaagaatttctaagtttgaatttttttttgaaatttctgcggcgagatttcggccggcgagatttcagccggcgagatttcggcggcgagattttgtctcggcgagatttcggccggcgagatttcggcggcgagatttcgtcccgtccccggtccggggggggggggagcttcaagttttttattttctgaaatcggaattccgaccccaaaaacgtcgtaagtcggaaatttttgaaaatttccgaattttatcaaaatttcggaaatccgaattctgtgccatccctgctggtgtggctccacatttttggcaaatgactgatttttgttttccaatcaaattgtttagcaatttctccgtgccaatgccatttcttccgtcagttaccaaattcatttttctgttcatgtgccgtcaatg

SEQ ID NO: 108889 - DNA, 123 bp, Heterodera glycines
  misc_feature (43)..(44): n is a, c, g, or t
  Promoter: Source sequence=SeqID_39941; Location=1..123; Strand=+; Gene=SeqID_68392
acaagaagtgagactgtctttgtcgtttgtttttatttaattnncattctcaattaggcggaacgactgagggaggaaaagaaatcactcgaattatacgtgtcaaaactgaaagagcagatg

SEQ ID NO: 108890 - DNA, 261 bp, Heterodera glycines
  Promoter: Source sequence=SeqID_7; Location=1310..1570; Strand=+; Gene=SeqID_61200
atatttcttctcagcatttttataatttctgtggaataaaaattatattagacacttcatcaccgttttggcataccaatccgtacgcgacctcccgagagaagggtgggtgaaagtgttcgtttattttattgtaactgatttgctcttaaaacaaaggccaggatcagagatcattgtttacaaattagtccaacgatattttaaaaggtgaatcgttcgattgatgactccttcgtaattgaacgtacaacaccaatg

SEQ ID NO: 108891 - DNA, 357 bp, Heterodera glycines
  Promoter: Source sequence=SeqID_11813; Location=1..357; Strand=+; Gene=SeqID_75315
catgaaaacggtggaggaataaagcgatcaatttgatgggctaattagctatgattgctacctaatttgttccttttgtcatttttttgtggaacattcaatgaaataatttgatgttttatcatttttaaattagttattgctttccatttttgatagtccaagttaaatggactcattataagttttttttaatttaattttcaacgctaaaagaaaaaataacaaaaaataatatggaaagcgtttttatttatatttaaaccagtgttcattaaatattcctctgagttccggggttcggaattggacagaccgagttcagaaccctcgaaactgatttttagaccaaaaatg

SEQ ID NO: 108892 - DNA, 150 bp, Heterodera glycines
  Promoter: Source sequence=SeqID_10686; Location=3453..3602; Strand=-; Gene=SeqID_73935
ttctcccgcctcctcctccccttccccctcatcgtcttcatcattattattatcatcatcatcatcccaaaactgctccaacttctccgactcctccccaagcactttccttttttccgaaccgattttcaatcggcccaagcgccaatg

SEQ ID NO: 108893 - DNA, 256 bp, Heterodera glycines
  misc_feature (15)..(16): n is a, c, g, or t
  Promoter: Source sequence=SeqID_13108; Location=1..256; Strand=+; Gene=SeqID_76902
ttccgcgtttgcgtnntgaggtacgtgggtctcggtgagtctatgttgagagagcctcggaattggtctttctgcgacaatggcaaaatgtttgacttgtcgaaacgcatctgtcggcgcattttgcccggggatcggtgtccgttcaatggcgtttgccggtgggttaaataataattgctttcgctaattaaatggtcgttttgccattaattcaaaggggttgggagtggcgaatgagccccgtgggcgaatg

SEQ ID NO: 108894 - DNA, 1003 bp, Heterodera glycines
  Promoter: Source sequence=SeqID_19598; Location=690..1692; Strand=-; Gene=SeqID_84336
ctggttttttaaatttatttttccaattattttaaaaaccaaagttttttcgactatactgtaaattatataatatttacaaggaatttacataaaaatggcgaaatatgaaatatttggcgaaaaatgggaagaaaaagaagaagaaatgagtagaaaaaaagagaaataattggcaaattccataaaataaaagaaaaaataaaggaaaaaggaataaaatattcagcaaaaaaatggagaaaaattgatggaaaaatagcgaaaaattggggacaaatcgccaatatattcaaaaatggatcaaggaattggggcttaatcaaaaatttaatctgtcaaaattaaaaacggatgaacaaacatttgaaattgtacaaaaatttattaaaatgaaaaatgaatattagctaaagagaaaatattcagaaaaagaatggaaacaaaattataccgaaatttgtaaacttaattggaaaattttttgttatatatataaaatatatatatatatatatatatatatgtgtaaaaatttctgatttcggttgtggaaacccacaggtgttcaaagcattcaaatattcaagtttctattattttcgtgaacagcaacatttttcggcgctaaaatttcatttttggccattttacaccaattttctgatataatgaaatttcataaaatctctttaatttttctaaaatctctttacattgtgaatttattttatttttattgaaaatatgtttattattttcgaatgagctgtagtagaaagtaataaaattttagttaatcattaatttaccaattggcaattattttgtcattaagataaaattattattattatttctttgaaattaaacaggatttccttattttattaagtaaaataatgatttattcagttttttaatcagaaaaaaaatcatttaaatgcctcaaaaaatgaattgccatttaattgaagaaaaataaaataaaatcttgaaaatg

SEQ ID NO: 108895 - DNA, 515 bp, Heterodera glycines
  Promoter: Source sequence=SeqID_1509; Location=1..515; Strand=+; Gene= SeqID_74081
atcagaaatttccggattcattactctaaaaaagttcaaaattaaggtctacaactaaaatatgtgtgtgacgaataaaatattgcatctttattttaaattggcataatgtcaatatttttccataaaaattctcattcataagctcattttcttattatgaaaagccaaatcattaggggtgtaaaaaagtctcggtctcggtctcgaaaatcgagaccgagacttgaaaacccgagaccgagaccaaaaaaacccgagacttttctcgagtcgagaccgagagtctcgaacagcactaattggctcctacagctcttatgtaattgtgccccttggtgcttcgatgttgcacgaatatcggcacgtctcacatttttcaaattaaattaaaggaaaaaaattctttttttttcattttcagttttttgctgctcttccgtatcgtcgacttctgccaactcttttggtccgtgcaaaagttcgtcgccgacatcttcggcattctcgacatg

SEQ ID NO: 108896 - DNA, 143 bp, Heterodera glycines
  Promoter: Source sequence=SeqID_26433; Location=1457..1599; Strand=-; Gene=SeqID_57161
aatgatgcaagttattatccgacagaatcttccgccgttttcgacaagttatcccatcaattctcaacgattcttcatcgcttcgtgttttctccatctgctgtgacgatttcttcaccaaattgctggcccatagtgccatg

SEQ ID NO: 108897 - DNA, 588 bp, Heterodera glycines
  Promoter: Source sequence=SeqID_3103; Location=305..892; Strand=-; Gene=SeqID_83194
cctgcaaattttcaaaaatttttatttatgcacaaaaaaatctgagcaaaaaaagttcgaattactgggtttttgagttccttctggccataacttttttaaagcttaacgaaaaattttgaaattttacaaattaataataaacacatagagctatcgaaaaacacccacaatgcttaacatcgcacttgataagaaaagatagcacaaagatttctctattattcagttaaatttcgaaaaattttagtgaatttcaaaaaaaagtaggggttgaagtctaatttttcgagttttttgcttacaactttttgtaaatttttacttatttctaaaattatataagtagtagagggtacgtaaagcaacattttaataccaagattggtaaattagactaagtttaagctaatttatgattaattatttagcaaattaaattaaaataattattaaatttaattattatgaacattgatacttttgtcactttggctcaccacgcttcccttacactccccagaaaaaaaaaaataaatttattgtttgataaaaattataatttttcagcttttcactccaaaaatg

SEQ ID NO: 108898 - DNA, 394 bp, Heterodera glycines
  Promoter: Source sequence=SeqID_5928; Location=512..905; Strand=-; Gene=SeqID_59705
tgttccaaatatgtgaagtgagttttttgtatctcccgccgataaaaaataaaattttctcaatgcctaaggtgtcaaaaaaaatattgtcaaaaaaaaattttcaatagcactatttttcataattttatttcacttaattatacagcacagacaaatgttaaattttgaatgacgaggggtaattagggtaattagacctaattaggccttttcaaatcgaagcctcttatgtatgtgctcaacgatcatcttttttaggccatccgctacatccacagccaaaacatcatccacttggatttgaaggtggtgccaaattcaaaaaagggggctttttgtcggttgtgccaattgccaatactctccatcggttaagcctgagaacataatg

SEQ ID NO: 108899 - DNA, 135 bp, Heterodera glycines
  Promoter: Source sequence=SeqID_19154; Location=1559..1693; Strand=-; Gene=SeqID_83902
tgtttgggattttcaggccctggtcatttctctcataattttccgattttttgaccactattggcgttttcaccactggatcaaaatttgaatcgattcagatttcttttggaagtgggagcagacccatatatg

SEQ ID NO: 108900 - DNA, 158 bp, Heterodera glycines
  Promoter: Source sequence=SeqID_42845; Location=1337..1494; Strand=-; Gene=SeqID_70653
aaatatttggtcaaaaatgggacgatggagcagaagaaaacatttgtcgaattgatcaaataatttattgacaaaatgctgatcagaataaccaatttggacaaaatgttcgacaatttgatcatttggaagttaaagaagaagagagtgatgaaatg

SEQ ID NO: 108901 - DNA, 1003 bp, Heterodera glycines
  Promoter: Source sequence=SeqID_2676; Location=865..1867; Strand=-; Gene=SeqID_81027
ccgatctcaaattaaaaacttaagtttgataaaataaacttggaatcggtagaggggatcaaaataggaagctatgaaaaatttaaagagaatgagccgaggaaaaatttttgaccaggtgaaaaaaaaattttttttttctctcatattggcgcactattttcatgtatctaactcaaatttttccttcaaaatgagcataaaatggttttatttagtctattattgatcaagttataagctaaaaaatttaataagtaggagggcgaggatttatacatttacaaaaatcatgaaattaagaaaaatgctaaaattcaagaaaatactaataaaaatgaaatttctatccaataaaaaattgaaaattctttttagttttaattaatttggcattttgtttatttttttgtgtctttcattttcattttatttttttttttcactcttcgcccggacttaaaatttgtgatgcggattgtgtgtggtaattttaatggtgcttttaattgttgtgttgtttaaatttaattgatttggattgctgtggctttaagtgattttaacttccttctcattcttctccttcgccccgttttggaattaggcaaaagagcagagaaggaccccggcaaaaaggcggctattttacgacgtggcgctcctggaaaaaggtgacgatcaacgcggtactatccggggcatttgtagactataagtccgacagcgtctccaaaaagtgaaaagtaactcacaagctgcgagattcggaaaagtgaaaagtaaatcacgagttggaaggagtgtaaaagtgaaaagcaaatcacatttggtggagaaaagcggaaagaagttgacagttatcagctcggtaaagtaaaaccgtcaacaaagctgagtttttatcaaaacggtaaagtaattccgctgcttggacaaccgacttggcacttcgaatttgaatttggaagagaaattgaaaaacggcgaagtaaagccaatg

SEQ ID NO: 108902 - DNA, 75 bp, Heterodera glycines
  Promoter: Source sequence=SeqID_35279; Location=1..75; Strand=+; Gene= SeqID_64865
gacccattcaaaatcaaaataccaccagacactttttatgggcttcgaaaactttattattttataggaagtatg

SEQ ID NO: 108903 - DNA, 547 bp, Heterodera glycines
  Promoter: Source sequence=SeqID_6707; Location=3914..4460; Strand=+; Gene=SeqID_62573
aattttccattttgctgctcccattttgtgtgtttttctttgtctgtttagtcagccaacactttggtcatacaaagccttaagagagagcaatgggcaattgaatgtgccaaacccttcgggcaattttcgcctggcgcctgagggcatggaagcaattaggggcaaatgtgtgttggttggcggatcgaaagttggagagcgataaaagattggatgtttccgccttttcagtgccgagagaattgtacgattcgttttgcttgaggcatttttgataaacttagcaacaaaaaacggaccaaattctgtcgataaaaggtgcacaatcaatcggacttttaaaagcgatgtgtgctgtttaattgcccaccgccaattcaaaatggccacaaatataatcgcaggcgtttcaagcgtaattggcggtatgttttttaattcaaatacaataattaatgtgttttaatgggctgtaaattgaaaacttttgccagaaaggccaaagggatggaaggtcgtgcaaaaatcacttccgcgcattatg

SEQ ID NO: 108904 - DNA, 117 bp, Heterodera glycines
  Promoter: Source sequence=SeqID_9846; Location=347..463; Strand=+; Gene=SeqID_72869
gctacaaaatagtgattgccagcagattttggccaataacaattgcatcagaatcctgcgcatccaacagatgatctccagcatccacacgctgcttggaaacttctcgacgatatg

SEQ ID NO: 108905 - DNA, 467 bp, Heterodera glycines
  Promoter: Source sequence=SeqID_22445; Location=1125..1591; Strand=-; Gene=SeqID_53115
tcattagatataaagttcaaagtttaaacctactttataaagtgacgaactcagagactataaaaaataataattctttttaaattatcaaaaaaattgattcagtctgcaaaaaaaatccaaaaacaaatatttaaaaaattgaatttttattttgtttcgaaaacatattaaagccacgataagtgccaaatgataattacgtgataatgtgccatcagcagctgaccgactttggcaccacttgcacacaaaattcaatttttggcaccattacagcttaaaagaatcatcgcaaaatgactacaaaaacaaaaatgttgaaatttgaattatttttactgaccaatttcaagcggtctcaaatgtggaaaatgcaacggcataaatcaaaatctggcatttttctcggcgcgtacgcattctgcttacacttaagcactcttgtccaccatcactagaaaatg

SEQ ID NO: 108906 - DNA, 128 bp, Heterodera glycines
  Promoter: Source sequence=SeqID_26607; Location=1453..1580; Strand=-; Gene=SeqID_57348
agcagtggccgctgttgcatttgtcgttggcggcagaggagctgcaacagctaattgagccatgtcagcaaataaataacaaacaaataaaaatgacggactccaataccctaataaaataaagaatg

SEQ ID NO: 108907 - DNA, 1003 bp, Heterodera glycines
  Promoter: Source sequence=SeqID_11925; Location=1630..2632; Strand=+; Gene=SeqID_75436
gacaattcgtggcttggacaattcgtggcttggacaatttgtgggggcgcctatataggtcataaaatttgaatctagttgaagggtatttcttcccttcaagaaaatgaaaaacaaaaaaaggtatgccaaagttgacttttctctacttgagacagataatctcgactacttacagaccagcttaaacgtcattaatttcaatattggaagtatttgaaaatttatgaaaatatatgtagattctaatttgttttctttctttttttggcatttcagtcgcaaagtttgatatttcggtccgcaaatgtagcactacgctatttttatgccattattatgctataagaacgatattatgtgtaatagtcatattgaaaacaaagttaaccccatttattcaatgctttattttctcatgagaataatcatagaaactgaaatacaatcagttaaattaatcataaaacttcggtttcgtcacccccctcccctccttaatttataaatctgattttttcatctctaaattctcatcgaatcactcgcaagctttcataaatcccttcccgaataagtcatcctttatatgcttaaattatttaaaatataaatcatcattttgatttttctaataggtaaattaagaaaataaaagccaaattctggcaaacaaattcgctgttgttctttcaaatgcgctttgttcagtcggtggtgccaatatttctattacggagtcaatcaaatgctgtgaaagtgatctttataataaggggatttaaaaaagaagttaaactcgataaagagatcatcaaaataaatccttttaacaaatttagctgaactcaagctattaaaaattctttgaaaaaactaattaattaattgagatttggtcgtttttataattattttcaacggcttttattcggccctacaaaacagcgacgtttttttgctgtccaacgggtgttttggcgcccggcgcttcgtggaaatg

SEQ ID NO: 108908 - DNA, 563 bp, Heterodera glycines
  Promoter: Source sequence=SeqID_9713; Location=3213..3775; Strand=-; Gene=SeqID_72458
atgagaaaacagaatgcatttgttaataaattttttgttgattgatcgttttatgtaaagggttgagaaaattccctgattcctaaaaatttaagtgacagaattaagttttaggaaaatgttaaacgacacagaaattaatcagaaagaaaataacgaaaaaataattggattggctttgattttagtcatttattcgttttcgtttttgtgtttctgtgccgttatcgttagagaatgccaccgtgtcttttttagctaacaatgccactgccccctgagctattgtttgaaataattgaagccttcccctcctcaaaattgtctacagtcttcttgagcaatcatctcctgtcgtcgtgggctcaaaagcgtctcagagggactttcaattcgctgatgtcacagaaacaagaatggaaaaatctgttaaaaatatctcgtttggtttttgaaagtcacaacggattaaatgtgtaataattggtttttagtttttagtggttttatgctattttattgttaattcttaacgcgtttttaattagttttcagcaaaaatg

SEQ ID NO: 108909 - DNA, 1003 bp, Heterodera glycines
  Promoter: Source sequence=SeqID_16781; Location=1093..2095; Strand=-; Gene=SeqID_81197
ttaatgataatttttgaaagaaatgttttttgaagcgaattaatatgcaaaatcttaacaagtttcagttaaataggtattcaaatttttctctcggcggtttcttattctcttaaaaaaattagctcaaaagcgtaattttgtcattttttgaacaaaatcgttaagaaatcgcattaaaaattacaagaatttttccggcggcgcctattagagcaggggtgtatctgttcttatttctaagaaatgttctgatttggggtagtgtcttattttcatttaaaagaggaaatttctgaaaaatttggctaattcctaacaaaattcattaaaaattcttaaaattttcccccagcggcgcctatcggcaccgccggccccccaaaactcctatttttcttaaaaattagcccaagatcgcaaattttggtcattttttggacagagctcgttaacaaattgcattaaattttaaaaaaatttccctcggcggcgcctatcggcaccgccgaactctcttccctcacccatacccaaaaatttttcggaaaaatgcgccgaaaaaattgttaaaaatatgtttttttgattctaaatgcactgaaatttaccaattgcttatgtttcgacaaaattgttaaaatcttataattgattttcggaaatgtataaatttctcatttctaagccgaaattgctcagaaaataggttggcggtgagtaatgcttgattttgttgaataaaaaagcgattcaaagttttggaagcgtgttttaaaaaatgtccttatttttgaccctaaaatcttatttttgaccagcgatgctcttatttcgggaaactttcaagggtaaccctgcatttatgggcttaaacactgatattttttagcaaatgatcctataaatttataaattacacaagtaccattttaatttgtcaatttttttttcagtttgcctatttttctaaatttttgtttgattattaattcaaaaaatg

SEQ ID NO: 108910 - DNA, 108 bp, Heterodera glycines
  Promoter: Source sequence=SeqID_8278; Location=1..108; Strand=+; Gene= SeqID_67548
aaaaaattatatgacaaattataacgaaatagacctatcatctcaagattattttgaattctttaaatttattttttagcctcgattttgttcctagtttaatccatg

SEQ ID NO: 108911 - DNA, 993 bp, Heterodera glycines
  Promoter: Source sequence=SeqID_15063; Location=1317..2309; Strand=+; Gene=SeqID_79237
agtttgtatgcatatttaaatgcacacggcgattcaattttgggctccaagtacaaataagtttattatttatttagtaatcagaacgccaaaactttgcaaaacttaaaatttattggggattttcccttaaaataaacttgaaatcgatagagggggtcaaagtatgggcctatgcaaattttaaagaaaatcccaactgtagaaaaaaaaattcaactagacaaagttttttctttttctctcattttgacgcactatttccatgtctctaacatataaaataacacatggttcatttttttgtcaataaacaattttttttaacttttgactaattaagaaatattcttcagaattttccctccaaaatgagcataaaatggttttatttggtctattattgaaaaagttataagctaaaaaaaaatcataaaatcaagggtaaaataaaatgtttaccttttattgtttgtatttgttcttttggcgttctgtttttattattttttaatttatttgctttaaaaaaatgaaatttatacacaaacacaaagaggatttgaacctgagacccactttttggtgactaactcacagaccactaagacgaaaaaaacaacttaattgtacttggagcccaaaattgggccgctgtgtacagaattgtgtgttatattccttatttgctaatctgaaacaaaaggaaaaaacttttcatagccctttaaaaagcaggagagccttaattaaaagaacttttatgaatgggtcaaacaattcgctttgaaattgcattgttttcccggctctagtgcactttatgagtccaatcgacttttatgagtccaatcaatgggttttatacaataactttgttcatgcacgaacaaaccctgtctttggtatcattcgaaaatacaaagtctaaataatgtaataatacgagaaaacaagaaaattctaacatttcaataaagacaaacgaaaatg

SEQ ID NO: 108912 - DNA, 793 bp, Heterodera glycines
  Promoter: Source sequence=SeqID_7195; Location=39..831; Strand=+; Gene=SeqID_46388
agttcattttctttaaaatatgcataggccatattttgatcacacataggagaataagacaatttaaaaagcgaatggggaggaaaaacggagcaaattcaaatcgaaatgggcaataaaatatcaatgattgcacaaaacgccgaataaaatgccgaaaagaatgatcccttttggttaccccccctcccctttcattttatctgtcacatggacacccaaagggggtccactgcgttttccgatccgatcacttccaccccccccccccgccatccctcgtcattcttccgtcgtccatccctcccctccttcggattttgtatttttagtgttgaatagcttaatcaatgtactatcagattcgaaataatttttttgttcgaattcggaaccggggttcggaattgggtaaatccgagttaagattcgtaatcagcaccctcgaaaaccccataaaattgatttcgagcccaaataaaaaataaattaaggaccacaattctttaccagtgctgcttttttggcaaccaaatttatcagtgagcacagatttaaaatctctgtacttgaaaaaagtacacatttatttaattattgtattttatgccaattcaaaaatttatttttttgatttcactacaagcactttttcttttcttttcgttatttcttagattggtttgcttcgttttgaaatcacattaagccatactttgtaattgttcattttcgtgtttatagagagaaaccgaccatacatacaataattaataaccattgtaccccgatg

SEQ ID NO: 108913 - DNA, 344 bp, Heterodera glycines
  Promoter: Source sequence=SeqID_6812; Location=1727..2070; Strand=-; Gene=SeqID_62967
taaaaatattgtatcagtatgcattttcactgacgcattttagggtcatgttctctactctatttaggaatgacaaattgacacaatgccaaaaaatttcagtcactacttgtgcttgatggtgatgtaaacgatggcactgtttagcgcaatgccaaaaagtgacaaaatttgctgaatgattgtcacccaaacggtgtacacgtaaatttggtcggactctccaaattcattaacggacgaagatggtgatgaattaccgttattactcatattattcgatggtttatttagaatattatcttatcaaaaaatggcaattcaatttgaattaattaaaaatg

SEQ ID NO: 108914 - DNA, 179 bp, Heterodera glycines
  Promoter: Source sequence=SeqID_11780; Location=1312..1490; Strand=+; Gene=SeqID_75280
ggaatccccgaaaaaggaaaaatagttggtcccagtggacaaattcattcgtttttggccattactctggtttgaaaaatcttcgatcggaaaagtcgaacgagtgggactcaatcagtgagactggaaaatttgttaagtagcccaattattcggttccacgaaatatgaacaaaatg

SEQ ID NO: 108915 - DNA, 662 bp, Heterodera glycines
  Promoter: Source sequence=SeqID_17347; Location=502..1163; Strand=+; Gene=SeqID_81825
aagggctacacctttggtttacaaaacttgaaaacatgtggcagaaaacgttttaaaaaatggaagaatccatacgtatatttttttaaatttaattttatttgagtttggatgtttgagtataaaggaggtaaattaaaaaaacgtcgggatttcttctttccatattcaccaatgttttgacttttggtctttttcgccattaaaattcctagtgattaaattttgagagaaacaacgataattggtgaattttcgattttagaaaaattgacactacaattcggcacaaaacgcatttcgtgatgtcaaaacaattttgattggaactggcactgaacctcaagaagtgccttctccaggacataatcagtgaaaggctttttcatcgcaaagcaatccaggaaatggaaaacatcattcggctggacgtgcttagaatggtatggacgtgccgaagactgagtccactgtttttttgaaaaattctccaaaattatccgtttatctcgtattttaatccatgttttggtgttttttaatcaatataaatcccggcctttaatatatgataatagatttattaaataaaaaattaattaaattaaagattattgtattctttaattaaatttcattataaacctactcacaatcagatg

SEQ ID NO: 108916 - DNA, 1003 bp, Heterodera glycines
  Promoter: Source sequence=SeqID_235; Location=4230..5232; Strand=+; Gene=SeqID_79196
tgatttatgctcttccaaatttgaagtttcgttgttttcacttaaattcctaacaattaaatcttttgcattattttttggtaaattgtccatatcacttggcaccatttcatttgtaaatttggttaacacttcatcaaatctgtcaatttttttcaagaaaatttcatccattctttcgtctaacaatgaaaaatttcgttcagatgcagttaaatgcatccctttaaacaaatcaaaatcggcatttttatgagtttttggcgtccttgacaataattgtcgttgtctttgaactgtgatgggttcgccttcactttttggcactgtactcatttggccatttatttttggcactgttttcatttggccatccgattttgtatttaattttgacgtcgttcgaactctgttcaaacttctctctcggctttggtgtccgtaagaaaatgtgtttgtgttttcattattcggaactttcgagagtattcgtcgcattgcccgcggaggttccgatggtgttctgaccgacgtttttttaatgtttggtgttgaatttttaaatgcaaagatttcatttaaataaagaattaacagagtgattgaatatttattcataattttagaatttcgcagcaaaataataaaatgaagaaacaatgattttattagtattttttgtttgcttttttgctacatcaatctgtcaatactatgtctgtgtaataaaataaaataattggatttccggacgcctaatattttcttaaatattagaaaaacaaattgcacaaaacaatattcttcatttctattcacattgaaaaataccagttatgtaatataaattagtgaataacaagcttccctggtgtgctgattttcagatttgtgatttaattgagtcggacagcctttaattcaataattcttaacggggtaaaccaactcatccacaaacaattaatccatgaaaaaaatgccataatgcgaacgcacaatg

SEQ ID NO: 108917 - DNA, 383 bp, Heterodera glycines
  Promoter: Source sequence=SeqID_3889; Location=2764..3146; Strand=-; Gene=SeqID_52306
tttttgatcacatttacgcacattttaacacctaacaccttttgcgcattgaaccaattacctcccagctcaggtcccaccccaattaaatcagtaaaccaagtaaacccctggttacgaagtacagtatccagtgatttaagacaattaaatatttgtgccttttccgtttctaatactcaagtctcatttatatattttgctgattgaaccattcatatccgccccagatttatccccaattaaatacagcaaaacaaattaaatcctggttattgtgcgatatccagtgattatacacaattaacttttactttatttctttccctttacggtgcgcaagtccagtaccctctctgatacatcccacttcccctatcatg

SEQ ID NO: 108918 - DNA, 468 bp, Heterodera glycines
  Promoter: Source sequence=SeqID_14452; Location=2314..2781; Strand=-; Gene=SeqID_78494
tttgcaaattaattcttaaatattttttcagaaagggtcctttaacgcaccaaattttatttacatgttagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttatttttcaaaattttgaagggcgggggggggggcgatgggattggaaagatcacgttgacaaagtttgataaaaaaggaaaaaatggtaaaaagttaaattttttgtatatctaataataaaaaaatcagattcttcggtgaagccaactctaatg

SEQ ID NO: 108919 - DNA, 968 bp, Heterodera glycines
  Promoter: Source sequence=SeqID_39390; Location=1..968; Strand=+; Gene=SeqID_67966
aaaaaaaaatttttttggtctaaattttttcaatttttttttggtttaagaagacatgaaacaaagtacaccgggtttttcaaagtcgctgatcacgaatatgacaattatttgggcctatgtttgggcctgagttgtttatatgctcattttaattctaccaaattttcttaataaatttaataattttgaaagtccaattctgggtttatgtttatgtataaaaatccatccctaataattattaacttttaattttcaatttaggtgcttgcttcggagcgtctacgagaagtactcgtcgatgaggcatccaatcaatcggcttgccgaaattatttccattgacaccatgaaaatcgtaaagatttttttacattatcaattgaaaaatgctactttgaattatccacatgggttcagggggcttcggtatgaaatttatgagtggttggatatccaacaagggaacatttcgaactgtaaccacccagatcacttagaaaaatcgataaaaataacaaatttttaaaaattcataaaaacttctaaaataatgatagagcaattaaattaatttaaaatgataagcaaacaattctctatgaaatagcatcataaaataaatttttttaatcggtaaaaaaaaaagaaaaacaaattgacttgggttacttttttctgctcggttcgagttcgtttttatgtaattttattttctatttaaaattgtgtcttttattatcttcccattaaaatctttgacattttttatctcggtacacatgcttatttggcaaatattttaagtccttttcttaagaatccttggtgctctacccacccataaaatttcatacagtaaagccgtgatgtcccactacccagtgcttatgagggaaattagtccagggggccctcttacgcgtccgtaattaggcccctcagggcttggaagggaagggatg

SEQ ID NO: 108920 - DNA, 1003 bp, Heterodera glycines
  Promoter: Source sequence=SeqID_12943; Location=676..1678; Strand=+; Gene=SeqID_76694
tttaaaaattcaaaattttggactttcgaaaggccattttttgcataacaaatatgaaaatttatatttgaataagttttagttggaattcatttggatttcaagacagataatttaatagtatctgaaagaacagagaattgtagcacagaaataaattcgacgatcaaactgatcgattttaatggtaacttttgcttaattatcgcagatttaaatcattacttttttattaatatttttattttttgtcgctctgttgctgtatgttttttaaatttatgattatttataaacaactaaaagataattttaatgctattgtattaaagtttgaattaaaattttttattaaattattaaaataaaattaaaataatttttattcaattaaaatcaacttttattaagctttaattttatttccttttaaattaagaatccattcaaaattgtaaaataaacttgttttatttattatttcaaaattttatgaaaaattatattaaaaatatattttattataaaaaatatctcttttagttcaaattaaaaatgttaatttattaaaaaataatatttttattaattctttttattttttcaattaagaatccgttctctatttggatggacaaaaaaagggaaaagttgagaaaaattttaggggttacactaatagttttgctgcgcctgagctgcttcaggttataattttttatttttctttttttttaccacaataaacttattttcgaaattggctaaaattttaaaattagtaaatgcaaaatttttttcctaatttaattttaacaatttaaaatttatttaaaaactatggtcttatcattttagaaatcagctgatgataccgagggttatgttgaggtgactatttcaaaatttgattataaatttaatttaatttaaatattgccctatttttgccaattaaaaataaatttatttttactgtaaatgccaggttaccccaaaaatg

SEQ ID NO: 108921 - DNA, 243 bp, Heterodera glycines
  Promoter: Source sequence=SeqID_24556; Location=1..243; Strand=+; Gene=SeqID_55278
caagaaattggatgggctatatgtggttataaaaaacttttgggtatggaattattttttgaagtgagtcaaaccccttattagtgctttgctgtgccgagacccggcaggcaatggatagctttaaatctgcaagaaattagattggcaataagtggttgtaaaaaacttttgggtaatgaattattttttgaagtgagtcaaacaccctattagtgctttgctgtgccgagaaccggtatg

SEQ ID NO: 108922 - DNA, 712 bp, Heterodera glycines
  Promoter: Source sequence=SeqID_7640; Location=3079..3790; Strand=-; Gene=SeqID_65497
aaattgccaaaaaatttttattatctatcattaaatttatctttttgaaatttttgactaattacctaattaatataaatttgaaaggtatgccatgcgtaaaccatcacgtctctattcgttttttctcgttttgctgagttcgttgttatttcccggtttcattgttcaagcaattcttcgtttagtgctaaacataccggaacaaaagtaaaaaaatatattttcttggcattatttagttttgagtccaaagaattaaattttcgaaaaaataaataatttgatttttctggcggcgcctatcggcgggtccctcttttccccagaaattttttatgtccacacatttgcgcctcagacatttgcgcctatgtgcaaaatcggattttcaaacataaattttttcaagccctgatagcttaaaatctgtctgggattgaaaaaatttaagtttgaacccgattttggacataggcgcaaatgtggggtaacaacaaaaaatgctgtttgaattgaaaaaatgtctcgattataaaagtcgaaaattgtttattttctatttacaaaagctaatttaaaatttgttttctctaaaaaaaagcaaattttttcgtttttctattgatttagaaaaacctaacaacactatatgtattttatatgaatagaaaattgattaattaattttttcaatttaaggtctgttatg

SEQ ID NO: 108923 - DNA, 96 bp, Heterodera glycines
  Promoter: Source sequence=SeqID_25864; Location=578..673; Strand=-; Gene=SeqID_56634
taaatgaaactaattacctaaataattaaaggtttttttttatttaacacgggtcattcattactatttcattttttcattctacatttgctgatg

SEQ ID NO: 108924 - DNA, 347 bp, Heterodera glycines
  Promoter: Source sequence=SeqID_8686; Location=1..347; Strand=+; Gene= SeqID_68850
ttgggtatttcataataaaaaaatgtaacttttttttaaaaattggaaatttattccaaaaatagtcagaaaaaagaaaacttttcattttttttactcaatttcttcaaaataaatatattttacttttattttgtatttttggttctaaaatgactattcatactatatttagctattttcgagattttatgcttaaattcaacaaatttgaagaaatttataaaattttgccctcaatttggaaaatgtgcatattttgcgattttatgtgcatataattccttggccctatttataaccctattcatcaatattaatgattatatttcgtttgcaaattaatg

SEQ ID NO: 108925 - DNA, 1003 bp, Heterodera glycines
  Promoter: Source sequence=SeqID_19020; Location=295..1297; Strand=+; Gene=SeqID_83758
attttaatttccatttattccctaataatacacaaattttatatgcttataattacataattttttgcatttttctgaaaaatttgacccaaaaaggggacccaaactgcattagtaccgattaacccactctaaagttaattagaaataattagcgatcttttaaacccccgcaattctcttttctaacacatgaaaatgcaacatcaataattaataactttgcgattaacgggatatactataaaagttaattagcaataattagccagccatctttaaaccccccgcaattagaaaaaaaagagaaaatacaatggattttaatgagttttctcttagcggcaaagtgcgcaaaaatttaccgcatcaacgcattttttaattttacactgttttgaacattgttgcaatttggttttccgttacgtaacatccgtcaacaattatatcgtctaccataaaaagctcaactcaactcaacgttttccggtgccattgtaagtaaatgtgtagctgatgcggatttcagtcacactttaggaagatggcattttgtgccggtttacgtgtcggtaaacatcaaaaaaaagttggcaaacagagtacccattcatttggtaattttgccagcctctttaattgccaaaaaaagccaaaatatatgtgctattttccgtttacgtaaatccgtcatctggcatttactcgccaccatccactttgctaacccatattttccggtgttaatgccgaacagaattaatccaagaaagctggagatgggatggcattttgtcttccatttcacttaagtgtgtttgcgtgtttgtgtaaataaaaatgagagaaaaactggcatatttttgacattttgccaaacatttaattaagtattttgattttgctaaaatatattttttcatatttttacagatttttttatcattagtattgttatttgtgcataaagcaacgatattacacctcttttgtgcccatg

SEQ ID NO: 108926 - DNA, 77 bp, Heterodera glycines
  Promoter: Source sequence=SeqID_14331; Location=1743..1819; Strand=-; Gene=SeqID_78359
gttttgttttataaaaatcattcaccgaacatttatgtcatgaatttagcaacgagccatttttttttgttaaaatg

SEQ ID NO: 108927 - DNA, 53 bp, Heterodera glycines
  Promoter: Source sequence=SeqID_23707; Location=743..795; Strand=-; Gene=SeqID_54399
ggtgggtttgattattattattattattatttttttgaaaatttcatgaaatg

SEQ ID NO: 108928 - DNA, 211 bp, Heterodera glycines
  Promoter: Source sequence=SeqID_30405; Location=861..1071; Strand=-; Gene=SeqID_60815
attttcgtggacgcctattcaaaatggccgaaagtttggaaaatgaatcgcacgacgagtcaaattacgatttcggtgctgaaatcgatcgtaaaccattccgagagaaatcgtatccgacaatggcacgcaatttcgatcggccgaatttaaggaattttgtgaggaattcggaattcgccacacctttactcctccgtatcacccaatg

SEQ ID NO: 108929 - DNA, 53 bp, Heterodera glycines
  Promoter: Source sequence=SeqID_22755; Location=1540..1592; Strand=-; Gene=SeqID_53447
ttgagggactgaggacggaattggaagggataaggaccaaattggaaaaaatg

SEQ ID NO: 108930 - DNA, 171 bp, Heterodera glycines
  Promoter: Source sequence=SeqID_4396; Location=635..805; Strand=-; Gene=SeqID_54296
aactgtctgccatttttgttttcacgcaacatttttagctgttatgaaaaagtgttttttgcttgttttaattgcattcattggtatcttagctccaaaagattagattatacttaaattgctaattttttaaaactacagtattttcagtgacaagtcagaaaagggatg

SEQ ID NO: 108931 - DNA, 1003 bp, Heterodera glycines
  Promoter: Source sequence=SeqID_15995; Location=204..1206; Strand=+; Gene=SeqID_80355
gtgaactctttcgtttgttctctggcatctttgcctggctatttgttcgctttctttttttgctgtgcttgtggctctgtgctatttctatgctattcttgttttcttttccactttaatttgcctattttcgtatatacgcgcgtagcagggcactttatcaaaattttaagcatttaaaatactgaagagaaatgcacaaaaaaaaatttttatttttttgccgatttcttttaacgccaatatgcataaaattaaaaaatattttgggtattcgtcataaataaaatatttttatctttttaccaatattttaataaatattttttcgttttggaattcatcgcaaaaaattagtgcttttttagacaaaatctgttaacaaatgatcattttatagacttttttttgagtgcgtttgaaataattaaaaaaaggaagcttttaatccaaaaagtttcttttgacagtcctgttaaatatattctaaaaatgtctaaaattcagtcaaaacatcaatttggataaaaggccaaagaaattgaaaaaaaaatcaattaattaattttttctaaataaattacctgaattcattttttgaacaaattatttcactatgtcattttaggtaaattaaaaaatttttttagctttttaaaaaagatttattatttaaattttttccttagttttttcgaaaaattctaacccacaatcgcaaaatgcccacaaccaataataaaaataatgtaaaattgtcgcctattaaagtgaaattttgccaatttttcaaggcacacctccccaagaattcacggtgcaattggacaccgggtccggcgatttttgggtagtggattcggcgtgtggccagaacggttgctacaatggttgcacatcgcacgacgcgcaatggtgcaacgcgcaatgcgacccggaatgttgtggacaaaatggtggctgttgcacgacaacaactgcaacacaaccagtgccaaccatg

SEQ ID NO: 108932 - DNA, 389 bp, Heterodera glycines
  Promoter: Source sequence=SeqID_40357; Location=667..1055; Strand=-; Gene=SeqID_68718
aaaaatttttaaatttcagaatttaggggatttaccattcatagcaggtgctttttccttgttttttggatgccctccgcaaaatctggttcggtttgggatcagttttataaaaaaaaaagttaagccttaaaatttttcgcaaaatttaaaaagcaatttaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 108933 - DNA, 120 bp, Heterodera glycines
  Promoter: Source sequence=SeqID_10790; Location=1..120; Strand=+; Gene=SeqID_74053
acagaaaaaagaagacgaaggaacctttgagaagggcgagcgaatgaaacgatgacaataaatgacgtttaagcaggaaaagaagggaaagaggaaaaggagggaggggaaaagagaatg

SEQ ID NO: 108934 - DNA, 209 bp, Heterodera glycines
  Promoter: Source sequence=SeqID_8035; Location=990..1198; Strand=-; Gene=SeqID_66773
aaattaatttgcctaattaatttgaaattttttcatcaacaaataaattaattatattaattagctaatttaattaattaaggtgttgtgtaccaaaagcatccaaatggaaatattttctctcatttattccttcctttaaaatcattgtttatttttatatttcgtttttcttattgttatcaactggtattttaattgcaaaaatg

SEQ ID NO: 108935 - DNA, 111 bp, Heterodera glycines
  Promoter: Source sequence=SeqID_26856; Location=472..582; Strand=-; Gene=SeqID_57602
tgttttgcaccaaaacactgactgaaactgaccgtcactgagttgttggcacattcaaagtcaaacagtgggcccggcacttcgccaaccgcaattgtgaatgccacaatg

SEQ ID NO: 108936 - DNA, 304 bp, Heterodera glycines
  Promoter: Source sequence=SeqID_2651; Location=4324..4627; Strand=+; Gene=SeqID_80893
ataagacagacagaaacctttgaatcaaaagtgatctgctaaaattgtctacaatttattttagtgtgcctttatttgcaagtttttttttttgctttgattagtttttaaagcgctgtcaatattttttttgtgtgtttttccttttagcaaagttaaaaagcgactcatatacacaatgctattttactttatacttttcgttttggttatctcaatttaccattaactttggcatttttctttattcatttgacattgctcaaagcaaatccctttgttttgtctttgccgagcacaaatg

SEQ ID NO: 108937 - DNA, 261 bp, Heterodera glycines
  Promoter: Source sequence=SeqID_1948; Location=1236..1496; Strand=-; Gene=SeqID_76974
gtttttgcatgctttttttcatattacgctcaaatgtttgtttaatgcgttctctttgagacaacttaaagccttaaactgaaaatgctgccaaaaaaggtggttctaataattgcagcaaatggcttttttcgttattttttggatgcaaaaataaaaattgtttgctgtctggacgtatagactcagtagagcaagcacttaattgcattcatttctttaataaaagttaaatccccttaaacttttcagttcataatg

SEQ ID NO: 108938 - DNA, 132 bp, Heterodera glycines
  Promoter: Source sequence=SeqID_6971; Location=4148..4279; Strand=+; Gene=SeqID_63440
ggtataattaatgtcaaaaataaaaatacaaaagaataattgaaaagttttaagaagtggccgctcttgcactggcggcgttcacacagatcaaaatgcgcttggcggaggacattgagggccagggaaatg

SEQ ID NO: 108939 - DNA, 95 bp, Heterodera glycines
  Promoter: Source sequence=SeqID_21490; Location=1..95; Strand=+; Gene= SeqID_52102
tcactccgttgcattcggcactgatcagggtttccttgatcgctggtctgatcaatgccgatgatcaccaaaatgggccttaaaaatatgccatg

SEQ ID NO: 108940 - DNA, 674 bp, Heterodera glycines
  Promoter: Source sequence=SeqID_19734; Location=776..1449; Strand=-; Gene=SeqID_84477
gaaatggagtgccgagaaacaagacaagaattggcatcgagattcaatgccaaaaacagaaaaagaaatttccgaattaaattcaagactgttgagcagaagataaaatttttaaagtcgcaagtcctcgtttaattcatctttttgtctaatcgctcaattgtgtgaaggacagtttataaatgtttcaaaatcgtaaaaaaaagtaaagtggcgggcggcgttccatagagtcattagtgtaaaacaaattaaaaaagaaagaatgcacagaaaaccaaacaaaaataaaaaaacagaaaaataaatttaaaattctctcttttctctttggttagagaagggaaaggcaaaagagtcgagaaaaggaagaaaagggggcgcgaaaagagaaaagaatgaataataaaacaaattattcatcgccctctccattcattaatggacggaaaaagagaaagcgctatttttttttaatttaaaaattgacattcgtcgaaatatgaaagaaaatggaaatgtgctgcattctcgggaatctcgaaatgaaaaatgttaagggcacgagatcaccttatgatttagcgattttgatgaaaaaattagccaaaaataggcaatattcgagaaaaggtgttcaacttaattattagtttgacttttgctgaaaaatg

SEQ ID NO: 108941 - DNA, 715 bp, Heterodera glycines
  misc_feature (21)..(21): n is a, c, g, or t
  Promoter: Source sequence=SeqID_16525; Location=1447..2161; Strand=-; Gene=SeqID_80931
atgacccggacttaaaccaanagtcgaaagttcaaatttctcgttttataattatttttaattcaaatttaagttaggaagtcggaattggttaaaaaagatgtcagattcgtgatcaaggacccaaaacccccgagaacaagttttcaggagttttttttttcaatttttaggcagcacaaccatacataattaagggccccaaaatttatgttaaaataatattgtgtgaatatttttgtgaatgttaaaaaatgaatgtgcgaatatttttcgctttttgttgcgcatatttttttaaataatttattttattgtgcccttaaatttaataaaaattgtgtaaaaattttaatttatttttactgttattttttaaaattttatttaaatccattctctcgttttcaaccatttcttacggaaattgttttatttaattccttctttttctaaatatcttcttaaatttttataaaattggctacggaagcatgtcttccgtgacttttacttccgctctttttcttgggccataatatattttctttttgtgtgtgtgtgggcaaaacgccaagttggcagtgccattgaaatcaatgattccgaagaaaatatatttcgcctaattttgcgttttgctcaatttttaaatttgatttagcattaagcaaatctattttttctttctttccaggaaataaaaagtccaatg

SEQ ID NO: 108942 - DNA, 806 bp, Heterodera glycines
  Promoter: Source sequence=SeqID_10222; Location=2491..3296; Strand=-; Gene=SeqID_73367
taatgtcgcaaatatacttaatttaccaactaaaaataattttaaatgcaattacgtcaatacgttagaatcgatcaaataaaaattgcaatatccatagcacagattcaaaaataccaaatcacttataaatattattgaaaagatagcagtataatggacaaaagaaataaacaaaaaattaaatttaaatacaaaaaatcaaaacaaattttcctgttcagaaaaaccctgccaatatcttaacagctgtcgcccaaccctcaacagccaattcacatcataaggtgaatccacataaccttaatttaaagttattaaatgcccaataaaaaaaataaaactcacaatggaaacttaaatatttgtttcctcctccacatctacaaggaaccaaaacacagaacatgtactacgacaaaaaaagttcgcaagattaactaaatacgcacgatcaaaacattttttcatttaaaaaataataaataaaaaccttatttaatcagaaaaattaatttattaatttaattttttaataagttttactcctgctcctgccatagtcaatatggcgcgtactatgccgattaaaaattctgggcgcaaatgcagaagttttgtaaccgaaaagcgccgccgcggtgtagtagaactgctaccgccgctgcttctgctgcgctaattatatgacacttttgtctctgttctattcaaaatttgtgcttacctaatttcatttaaaaagccctttaaaattaaaaatttttcttaaatatttgcaggcgaaaattaattaattttaaatg

SEQ ID NO: 108943 - DNA, 548 bp, Heterodera glycines
  Promoter: Source sequence=SeqID_30548; Location=696..1243; Strand=-; Gene=SeqID_60964
aacggattaaaaaaaaaaattttttcgaaaaaaagttcgaatttcgggttaggggttcggaaattcgtccaatagagttcatattcgtgatcagcagccccgaaaacccctagaaacacgtttttatcattagaaacaaaaaattttttttatgtgggtcaaactgtataagtaccgagctgccgccattggaactcagtaagcaaatttgaaaggaataccaccccacattggttaaaaatcatagacaaaatgatggatttagcaaaatctgagttcagattaatgatcagcgcattttttaccctaaaatcattggaaaaaacactcaaagaaaattaaaaaattttgaaaaaaatcaagtacttgatgaaaaatcatagataaaatcaatgatttttcaaaatctgagttcagattaatgatcagcgcatttttttaccccagaaaaattggttttattaactctacgatttttttccgtcgggaccacaattccacaccattcccgtcaaactaaaccaaagtttagccaaaagcaaattatg

SEQ ID NO: 108944 - DNA, 329 bp, Heterodera glycines
  Promoter: Source sequence=SeqID_27823; Location=1..329; Strand=+; Gene=SeqID_58502
cttattttagttgatttttggcaaaaactcgaaaaacagaaaaaatgaagtaaaacgataattttcgaatattttacaaaaaaaaaacaaatatttttaaaaagaactaatattgcaattcctgattttgattacttttatcatttaaggataatttattttattttgttcaaaattcgaatttgaagtagctattcataagcacatttaatttttatgcatttgactcatttcattcaaaaggacaaatcttaaaaatggacagatgcttgaaaatgcccttctttttcaaaatttaattttatttaaattaaaatattaagaaaatg

SEQ ID NO: 108945 - DNA, 205 bp, Heterodera glycines
  Promoter: Source sequence=SeqID_38352; Location=1..205; Strand=+; Gene=SeqID_67191
ttttcttttaaatgtttttttcagtttattaaatagtatgcaatacgttccatgttaaaaaaacaaattctgcataaaaaaattatgcaaaaaaaaagtgaaaaaaatttccaaaaactaaataactgtataataggttcagttttattataaattttaattgtaaaatttagccagaaaaacaaaaattctaaataattcaatg

SEQ ID NO: 108946 - DNA, 85 bp, Heterodera glycines
  Promoter: Source sequence=SeqID_2551; Location=1268..1352; Strand=-; Gene=SeqID_80371
acgatggacccttgtttagacatttcgccgtgccaccacttctgtcagttacaatattcaattttatcttcgtgtggaaccaatg

SEQ ID NO: 108947 - DNA, 1003 bp, Heterodera glycines
  Promoter: Source sequence=SeqID_235; Location=2851..3853; Strand=-; Gene=SeqID_79197
gggcaataaaacagctaaattttgcattagaatgccttaattttgcattcaaattgttttctctaacaatataaaaatttattaagaagaaaatgtaagtgattctatcaattctgaggatgatgaagtgtcaagccaattgtcggaggaagaggaaaaaattttgttgaatttggcaccggaattaaaacaaatttcattcttcaaagcgaaagacagcaaaaattcaaacaaaatggatgaagaaataaagggacggaaaatttcgaaagaattggaaaattaccatgaacttttgttgcgtttatttaagatcaaattcaaacaattgataaatcaaaatgacaaatttgtggaggaaatgttgactaaagagtgggtcattgaattggtgggaaaatatttgcccaaattgacaatgtgaccatgggtgagaatttcggactgctttttgttttgaatacataataccatttctcatttgcagctttgtcgtcaattcaaaaagagaagcattaagaaaaatgactgttaggcaattgattgaattttcaaaaaaactattctgaaattctcattttatctgttgttttttcattataaagatgacattttggagaagtaaaaatttctcattgaaatatgcttcattttatgtaattcctacattttttttgtttattttactaaagtgcgctccttttcgaatgaccaccaatcgtttatttattagattattaatttcttaattgctttggttatttgctcgtctcttttgttggataaatttcttttctttttttttgatctatattttttataataatataatattattgttgctaaattacatatgttctctgcttctgctactgagttttcctttttgctttttccattttttctcctcccatttttctgtccccaatttttgtccgcctcctcactgatcaacgattatccaaatccgttgcgcgaggggcaattcgcaaagtgcaaaatg

SEQ ID NO: 108948 - DNA, 217 bp, Heterodera glycines
  Promoter: Source sequence=SeqID_29682; Location=958..1174; Strand=-; Gene=SeqID_60151
tttttaaatttataatttgtgtcgtggcttttcagttggcctttttgtgtgcgcattggcaaagggtggcgatgcattccaacgaaaatcaggtgaaaaaattgcaaaaatcgctcattaaattattcaaatttattttaaattctcttcatttcataaataaagcaactgaataccttttattacagtaacactttttatttcaatcacacagatg

SEQ ID NO: 108949 - DNA, 468 bp, Heterodera glycines
  Promoter: Source sequence=SeqID_4951; Location=4301..4768; Strand=-; Gene=SeqID_56342
aggcgcattccgctcaaagaagggggaaggaattgtagtgtttaagtggatattttgaattttaaatgcccacatttcccgcccattttactgcccataaatatggaattgtttccccttcctttgctttttccaccattcatttgtcatttaatttatctgcatttattatttgtcctttgacctcccaattttctgtgctttatttatttggaataaatcaatatttcctttaactgttgctcggacacaacagtaaattggcgcagtcagcaaaggaacaaagccagcataaaagcgacacaaacagcaatcaacatttacgaaaattgtttcgtgttaacaattttcgttgggaaattgaataagtctcgtgttgacttttcaatttcgcagattcgccgaaaaaccgaaacactcgtgttgtgtaaggttccgtgatatacggtttaaaacgtcgcagcgatg

SEQ ID NO: 108950 - DNA, 360 bp, Heterodera glycines
  Promoter: Source sequence=SeqID_14082; Location=481..840; Strand=-; Gene=SeqID_78055
aataaaacttgaaaccttttttaaattttcttaaataacgtttttcgttgtacaatattttaattttattaattttaatttttttaaagataaaatgtgttatgactatgaattctggaatgaccgatttaaagagcatgttttaggaataattatattaatcatcttttttagtttgcttgtgtttttttttcttgggatggctttgcggttcataaaatgttctaaaaaatataaaaaccctattggcaagcaaataaattttattatttaaactcatttaattttaatttttgttttcgatcggttaaatactttaaaaaataaatttaatttaacattttaagctatttaaaaatg

SEQ ID NO: 108951 - DNA, 260 bp, Heterodera glycines
  misc_feature (58)..(58): n is a, c, g, or t
  misc_feature (123)..(123): n is a, c, g, or t
  Promoter: Source sequence=SeqID_22561; Location=1889..2148; Strand=-; Gene=SeqID_53232
tcatataaagcaattagttaacattttcatcaccacttatgccttcggttaaaaaatntaattaattagttaattactctaatcgtttcttgcgattaccattcaatctctaatgtgttaatntagtagtgtttcttcataaaataagatttaaataattaatcccaattacctatgtgatttcccatcagtataaaagagaattaaataattattttttaaattaaatttaaatatacttctactaagataaaaaaatg

SEQ ID NO: 108952 - DNA, 246 bp, Heterodera glycines
  Promoter: Source sequence=SeqID_29863; Location=1446..1691; Strand=+; Gene=SeqID_60331
atttattttgaattttttttctaatcatttttttgatcacttttggcgccgagaaatttacaataaacaaatggaatatgctctatgacgaattatggatgggaggggggattaaattcttttggcccaaaaatggataaaaatgccataaaatttaccaaaaaccctcaaaatcaaagagatttcataaaaatccatgcctttttactagttttgacacaaaaaaaagaaactgactttacaatg

SEQ ID NO: 108953 - DNA, 427 bp, Heterodera glycines
  Promoter: Source sequence=SeqID_16148; Location=870..1296; Strand=-; Gene=SeqID_80508
tgcctgaacaaaaaaagtttgtttaaaaaaatttacaaaggaaaaaaaatttttacacctgtagagtgcgttctgctagcgatttgattatttccataggacagtaatagggaatagttaggcaaagtgatgatggatccaaaattcgaccctttttataaacttttcaagtgttcaaagaacgaatttttcttaaaaatttctaactaattaccaacgagaagggaacaactacctatataatgcaatgtgcaggtgcgaaacagctcattctttttacgcatttgtgtgtctttttttcacggacgacaaattcacggaacggacttttgcgtctgtgatttgcaggctcaagcggagacgaaggagggggatttggattccgttaatctttcagtgtgaacattttccttcccttcagaaaatg

SEQ ID NO: 108954 - DNA, 131 bp, Heterodera glycines
  Promoter: Source sequence=SeqID_34556; Location=725..855; Strand=-; Gene=SeqID_64318
tctaaaaaattataatgaatttaaggaaagagagagagagagagacaagttgagtgagttcaaaacaaagtcagaaacaaaatttgaaattttttataaaaatctgaatatctacgtgaatttacagtatg

SEQ ID NO: 108955 - DNA, 129 bp, Heterodera glycines
  Promoter: Source sequence=SeqID_27995; Location=1..129; Strand=+; Gene=SeqID_58658
gctgacgggaattgcttttataattctttatcagttttgcttactggatctgagttgaaagaaaatgctaggattatacgacgcgcgattacagagtatattgaatcagaggtttagcttaacgaaatg

SEQ ID NO: 108956 - DNA, 403 bp, Heterodera glycines
  Promoter: Source sequence=SeqID_24; Location=12772..13174; Strand=-; Gene=SeqID_80481
ttcacttcaaaaaaattataattaaatcttggatttaaaaaatttatttaatttcacatcagtagataatattcccaatcaaattatcgattgattttcgatcgataatttgagtgtgtctactttttttctctgacatccccttccacaaacccaaacctattggatggggtcgagagagagaaaatacagtatttgctctaattatcccccagtctccaattatccccagtctatgaggaggttaaaaaataatcccccccccccccaaaaaaaaaaaaggcaaaacctattgtaaggactgtacacaaataatcaataaacccaagcctattgcatatatcatatccgaagctttaagtaaattagcaaaaaactccaattcattaaattgtaaaaaatg

SEQ ID NO: 108957 - DNA, 1003 bp, Heterodera glycines
  Promoter: Source sequence=SeqID_11010; Location=93..1095; Strand=+; Gene=SeqID_74328
cagaaataaaacaaaaataataaattgaagaaaaaatggaaaatataaactcgcgaatttacccaacggagttggaaaagaaaatgtgcataaatgaagcaattattgctttattggtcattgttttgtcgcacccatcacaacgattaccacacacataaataaaaatattgttcaaaaataatcagcaaaaatagaaaaaaaaagtggaaaacaaattaaaaacgaaatcccattaattaagggaataaaacaaaatggaaaaaataattaaattatcaaattttaatccggatttaaataccgttactgaaaagcatagattaaataaatgcattcacaaacaaaactaaccccaccaaaaaaggggggaggggagaaaaattcgaacatttgtcggcaaagtacaaagaaatgcattgcgatggagtggccattaattaattaatgagtgcggtaaaatggggccaaatcactgcgcgccgccgcctcctcactaatttcccatcaattctctgctaatgatcccccgaacatataataacaaaaagggggaggagagaatggatgggatgggcaatggacccgtggggtattttcgtttatactttctgagcgtggcggcgccctaaaacgagttttgtgtcccaacattgcgcacctgtttttgttttcctctgcagtgcctggggctgaatttaacaccctctcacttttgcgttatctctcttcccattttattttccgccaaaagtctctttttaaaaaattgctttatattttcaaaaaatgatacaaattttaaaaatagcgttgatattaggttgatggcgtaatgttattttgatttaattaatagtagagttgctcggtaccggtaccggtactggccggtaattaccggtttttttggtaccggtaccggttttttcaaaaatcaaagtatcggtaccggtttgtctagtaccggtaccgccggtaaaaatttgcactggtaagaatg

SEQ ID NO: 108958 - DNA, 782 bp, Heterodera glycines
  Promoter: Source sequence=SeqID_18827; Location=1..782; Strand=+; Gene=SeqID_83517
aaacaatttttggacggttttaagcttttgaatccggagcaagaccgtgaagtaccatctatctttatttataatgaaagtggcattcttgaacccgagcgtttgtctcagaaatctatgacgaattaacatttaaaaattagcggaatttattaaaatcgtaaaatttttactgttatttgattatttatggttataaaatttaaaaaatattttgagtcacattaaatataaataagaaaccatgtgaaggaaactaaatttatttatttaatataattttctgtactgaaatgaccccatccctctgaaagtctctcacttatatttttgtcacttcgcccacactgatgcaaatacggtacctttttaaaaataaaattagatttggggacgaacgacgcaggaacgaaatgacagtgcgcctcaaatattgaacaaataatccatttaatttcaattattgacagtataaatgctgtaaagccataacaattctttgacaattcttcattatccggtcaacaattgatcaaattgatgatttgttcaatctttggttcttttttgaaaaatatgtatgggtactttttatgatcagcgctctggctctggaatatccttagaaactgattttaggaaaatgacctacatttaggtaattttatatacgcatttataaaatttttacaaatttttaatgggtttttggtccaaaaactgggtatataaatgctgactttttcctccctcacaacataatttgtgtcccagcaataatg

SEQ ID NO: 108959 - DNA, 697 bp, Heterodera glycines
  Promoter: Source sequence=SeqID_10512; Location=1754..2450; Strand=-; Gene=SeqID_73740
ctagtaagtataatttaatatagatgataacttcaattttaagaataaattaaagcaaagttaaggaaactttaaaaaaagaaaaattacttattatatagaatattgaataaatatattcagtgtatataataaacaatagcaaatatacaagaaatttaattcttacattttctaaacataatatgaacattcgacgcacaacacaactgcagccttgcaaatcaatgagcgcgcgcgcgttatcccacctcaacgtttactcacccatcaaaagttattcactctccaagtcgctatgacagatatttgccaaaaatttaaaataaaactatatctaaacagtataattatacaagaaatcgtttacaatattaccaaatctgtcagagattggtgaaaaggttaaataaacgaaacgtaaattaatgtacaaaatataaaaattatttcgtgaaataataagaaatataaatcatgaaaataattagcaaaaacgagttttcaacacccgtttaattcctctttgctttcatatcctaaatccttctaattctttaaggtattttgcaatttgtttccttttttatcaaaaactttattcagtttttgcaatatcaaataaactatggttgtgtctcacagtatgtatttgcataattctagttcgttttatttaattcatttaagtaccatg

SEQ ID NO: 108960 - DNA, 72 bp, Heterodera glycines
  misc_feature (41)..(41): n is a, c, g, or t
  misc_feature (67)..(67): n is a, c, g, or t
  Promoter: Source sequence=SeqID_31584; Location=1280..1351; Strand=-; Gene=SeqID_61913
gaagtgatcagcgtttatcagttcaattcccttccaaatgntcatgggatttccgacggacttttcncaatg

SEQ ID NO: 108961 - DNA, 439 bp, Heterodera glycines
  Promoter: Source sequence=SeqID_3173; Location=969..1407; Strand=-; Gene=SeqID_83525
gtgaattaaaagagaaatttaataaattaaaaaataatattcatatttaaatcaaaataaaattggctgaaccctaagaatgcccttcaaaaataacgggtttttaggaaaattcacataaattcatcgtcatagatgtttttctggaaagggtccaatcataaaaatttcaaaagacggcgaaacaaaaaattaaaaaaaaaaaaatttcgttttttacatttttcggtcaaaaaagttccattttttaaaatcaattcattatttaattttatcaatgtgtatccctgtatcaatatgttatttataggtgctaaatgatcatagcggcaaaacattgatccattttgttaattccggttactcagcaatttgcaatttttgtgccaatcggacagcacaattttcaggatgggagcacatttgtgtgtacaacatg

SEQ ID NO: 108962 - DNA, 239 bp, Heterodera glycines
  misc_feature (19)..(19): n is a, c, g, or t
  Promoter: Source sequence=SeqID_6183; Location=1..239; Strand=+; Gene= SeqID_60635
tttcggccgacgacgtttntggggtgcaccgcattgcgacgcccgtcgacgactttaaattgttttgttttcaaattgtgcggcttttccgctgtttttgttgtgtgattgttcaacaacattcgccactcaattttttttgttgtttgatttattcaacaacaaattttcgtcaaattcaactcctgttttttgttgtgtgattttaatcaacaacttttcttcaatttcgacaaatg

SEQ ID NO: 108963 - DNA, 100 bp, Heterodera glycines
  Promoter: Source sequence=SeqID_43398; Location=266..365; Strand=+; Gene=SeqID_71070
agtgaatttttaacgatctcatttaactaatacaaatgctaattaagcgggcgattatggcgcattcgaagcggggccatcgaatgatggccaaacgatg

SEQ ID NO: 108964 - DNA, 83 bp, Heterodera glycines
  Promoter: Source sequence=SeqID_15654; Location=2309..2391; Strand=-; Gene=SeqID_79957
ggtaaaaaaattaactaaaatttaattaattttttatactaaaatgttcataatcaaattatttgagaattaattcatcaatg

SEQ ID NO: 108965 - DNA, 131 bp, Heterodera glycines
  Promoter: Source sequence=SeqID_3774; Location=1760..1890; Strand=-; Gene=SeqID_51826
ggtgagcaccatttgagagcaaacaattggaagaatatagcagcaaaataaataaataaatcaattcaatgcttggttaccccaaaaaatggaaaaaatttttaaaattgtcggataattagggcaaaatg

SEQ ID NO: 108966 - DNA, 656 bp, Heterodera glycines
  Promoter: Source sequence=SeqID_28962; Location=1091..1746; Strand=-; Gene=SeqID_59537
tgccacctccaccggttgttgcagcagttgaagcagccgttaacgttgggacatttgtggtggctgttgatggaagaaataattataaaaaaaaaattatttatttaacagtttctaacccaatttttaataattaaaataatcaccgcttagaaaatttatttctgaatacaaaaaacacttagttaccgtatttcatgactaccgtattcccttgggtatgtgtggcgagaaatttcttaatttttttaccgaaaaccgagacacgagaaatgagccagtagtaaatcgaagccgaaaccccccccccccccccccgaaaaactggggacaaatttctcgggaatcgagatttaaaaaaaaaaattccacaattaaaaatagaattaaaaccaattaattttaaaataattctaatctatcctaacaaatttttgccatttctattttgattcaattaatttatcaattcactttaattaaaaacatagtgtggaaggaaatacagtagcaaaaaatattttccattactgtagcccctaattgattaaattaaaaaaaacaactgtcgatgaacacctgtcgttccagcggcggccgtattatctgtcggatggcaactctgtaacatggtgggcatcagcagcaacagaatg

SEQ ID NO: 108967 - DNA, 1003 bp, Heterodera glycines
  Promoter: Source sequence=SeqID_7741; Location=405..1407; Strand=+; Gene=SeqID_65794
gattgcggaaacgcaataatttttatttacattttatgcgtgtatttcacatgttaaaatatatgcccgtgggggtcacattatatttgcgccccgagcatttgtgccaatgcccaaaatcgggttcaaactcaaatttttttcaatccaagatggtataaactgcttttaaaaaagcaataaaagtgattttgtatccaacaataagttcgtcagaaaattttgaaaaaataatagattatttaaatccgatctttgggcataggcgaaaatgtccgggtctcaaatgtctgagcacgcctgcgggtgcttaatgttaagaattataataattaaaaactttagaaatatgcaataaatggtggtgaaaaattgattaatagagaaagtagaaatattagaataaaagggctaaaaaatttggaaaaattaattattttcttttaataattttaaattttaattccaattattttatttctttttcgaaaaccttggaaccatatacatatttaagcaatttttcgataaaactttaggaaaatgcttttattcaatttaccgccaaaattgttgtttttctttgctatggcaatgcttttagcgaggaaaagcactcaaaaaatgccaaatgtgaccaaaacacatgcaaaaaatggtaattatttgattcagttaaaccagggctcccaaattaaaattttcaaggccggcgatgggaaaattttgtaatttttaatgagattcttaccaaattttgcgatttaaaccgatttaagaaataataataatttatacgcaaagcgtgacgccgccaaaataaaaacaacaataagataaagcaaaatggtcacatatgagagtggttcataaatgtgtaaaacgaaccaaatcaattgagtcaagaagtttagaaaaaacagttgaattttgtaacctaacttctttaggtaataacctatagaagcgagaagcacgaacaaaaaatgaatggtatctaatg

SEQ ID NO: 108968 - DNA, 1003 bp, Heterodera glycines
  Promoter: Source sequence=SeqID_12819; Location=370..1372; Strand=+; Gene=SeqID_76545
aaatacactaaaaataatctttaatcattattaatgaataattaccgctccaaaagcattcaaaaagacattgagcagaaggatgagcttcatatcaatcttgtttcttagcttatctaaaaacaaataaaaaaatatttattttttaaatttttaattatttattattaaatgaataaattcactcttcaaaaaaaatgaatcgaatgaatggttgggtacacaattattatgttttcgatgcatatctcttatgattaataaaatgctgattcatcactgatgagaacaaaaagctaattgacacccaaatcagtaaaaatttatgcataattatttttctgacaaaaaaatcggttttgagataatgaatgataaattatgttattgtttgcataatcgtttaactgaaaccgatattcaaaagtcaaatggcggatcaaaattgccgacaaatcccaaaaatccgcaacccgcaatccgtaactccaaaaaccccgcaatttccgtaatccgcaatccgcaattgcgttcagccctggtagccagcccctttgctaatgtattttctgcaaatttcgcctcgttcaaaaaaaaacaatgaaatggatttacaaaaaacaactttttccattacgatgagtttttttatattaaatgtaaatctttaaacataaagaatttcttttacgcaaagaaaaacatcccaccggaaatcaaattaattaaaaatattattgctttgatatttttattattattaattttaatgtcaatcaatatgaataacaaatttatttacatcaatgaatacaggtgaaataaaaattttacatattatttcaacgataatgatacgtcaatgatgatgtaaaaattattttacctataatattaaatgaaggtaaaagtcgttttataataattatatttgttattcaaataaaattcattatacattttcataaaactctaattcttaaatttgaattaaagcaaaatg

SEQ ID NO: 108969 - DNA, 241 bp, Heterodera glycines
  Promoter: Source sequence=SeqID_21764; Location=608..848; Strand=+; Gene=SeqID_52367
accaaattttggcaatcgttgaaatttgtgcaaatatattgagttttagttttaaactcacgaccaaacaaaaaagaagattggcacaatacgctgatttctatagagaaattgctaaatctcgttcagaaaaaacggcaagaaaaaggatacagcaggggagtggtatagccctgggagctgtcttggtcccggtactaagtgttttagctcaacatttattagaaaaaataacatcatg

SEQ ID NO: 108970 - DNA, 109 bp, Heterodera glycines
  misc_feature (10)..(10): n is a, c, g, or t
  Promoter: Source sequence=SeqID_194; Location=2423..2531; Strand=-; Gene=SeqID_77170
gcgcaatcantttcgctcaatatgaattgccaaattgttttgaagcgatgaaagtaataatcaaatttgcgctttcataattctaaaatttagaaaatagtcactgatg

SEQ ID NO: 108971 - DNA, 99 bp, Heterodera glycines
  Promoter: Source sequence=SeqID_25128; Location=874..972; Strand=-; Gene=SeqID_55855
cctggacgggcaaaatgggaaatggtaaaatgattttgaattcgaaaaaccttcatagagaaatatgccaaatagaataaaaattttcagaaaactatg

SEQ ID NO: 108972 - DNA, 394 bp, Heterodera glycines
  Promoter: Source sequence=SeqID_33589; Location=1..394; Strand=+; Gene=SeqID_63607
agctttgatcagtgtcctctcgctgtctctcactctctagctgattagagtcggatctatgtgcctctctctcattaagttcaggctcgcccatccacactgatcggagggcaaaaatgaggaacacagagctattggtatttcaatttttaaaaacatttactagcaaaatttgacgcctccttttttcatatttttggtccattttacaagactttgattagtttatttatatccacacacacatacacgcatatcaccaatacatacaatttaagtgatcagatattgattgatacatgatacacacacatcaacgaaatacatatgtacaattcaaaggatcaataggataaatgtcaatttcttatccttcttctgttgttgtgccatg

SEQ ID NO: 108973 - DNA, 62 bp, Heterodera glycines
  Promoter: Source sequence=SeqID_24257; Location=831..892; Strand=+; Gene=SeqID_54975
aatatccgattttgctgaataagcatttgtccgactttttttactacgaaatttcagttatg

SEQ ID NO: 108974 - DNA, 234 bp, Heterodera glycines
  Promoter: Source sequence=SeqID_23353; Location=757..990; Strand=+; Gene=SeqID_54065
ttcttcggctttcaccaccaccaacacccttcggcaccgccagtccatccttccatggaccatcatcattccgcaagtgttcccccgcctttcatgactcatctccatcccccgcccttcggtggacctttgcctttctgtccttttacaattggatttcgtttaggccaccaaatccattcctccgctgtcggagggggccctttcaacgtccctccgcccgtttttccgatg

SEQ ID NO: 108975 - DNA, 79 bp, Heterodera glycines
  Promoter: Source sequence=SeqID_23744; Location=174..252; Strand=+; Gene=SeqID_54442
tgataacaccggtaatcaaagcatactaaataaacattcttcgcccttttccccctccgcaattttcctgcctaaaatg

SEQ ID NO: 108976 - DNA, 318 bp, Heterodera glycines
  Promoter: Source sequence=SeqID_25061; Location=140..457; Strand=+; Gene=SeqID_55792
tcgcatcatcaaaatggcggcaccgaaattggttggactttggaaaattaaacaacacattttgttaattaattgttaattgtcattcccaaatttttggcaattaattaatgtcaattaaagagctactaaattttgaatatgcaaaaaaaaaaaaacacttcattttcggcttggcttttttggtctagaattttcctcttccaattttttcctaaatttttatattttctcccaacagaaaaacggtccccctcctcctcctccacggcacttaactccggcgatttgctgtcagacaacaacgaagcggcaatg

SEQ ID NO: 108977 - DNA, 99 bp, Heterodera glycines
  Promoter: Source sequence=SeqID_8893; Location=4500..4598; Strand=-; Gene=SeqID_69552
caaattggggcatttatcacgccggactgttcatttgcggaatcggtacccatttttaaaaagatcattagcgctattttttattcattcggattaatg

SEQ ID NO: 108978 - DNA, 266 bp, Heterodera glycines
  Promoter: Source sequence=SeqID_13161; Location=381..646; Strand=+; Gene=SeqID_76973
caagcgagcaaatgaccggctatttatggggctcggggagggcgggtcaatgcggaagcgacgccaagccacaaaattcaaatgcattttttagcgcgcatcttttcgctgcgattcccaaagggatgccacgcccatcccacttagggctatttaaactttaccaatcccccaccttcctcacactgtgttcacggtgaaactctctgcctctctgctgttctttgtgcttcattcacacaaacattttcgctctcttcaaaatg

SEQ ID NO: 108979 - DNA, 196 bp, Heterodera glycines
  Promoter: Source sequence=SeqID_17382; Location=741..936; Strand=-; Gene=SeqID_81868
ccgtcgacgacttaaattgttttgttttcaaattgtgcggcttttccgctgtttttgttgtgtgattgttcaacaacattcgccactcaattttttttgttgtttgatttattcaacaacaaattttcgtcaaattcaactcctgttttttgttgtgtgattttaatcaacaacttttcttcaatttcgacaaatg

SEQ ID NO: 108980 - DNA, 83 bp, Heterodera glycines
  Promoter: Source sequence=SeqID_3390; Location=247..329; Strand=-; Gene=SeqID_84489
gctgaagaaagcttttgatttgcattttattttattttttgaattgtgccgtcctttccctcactgatcgctgcccaaatatg

SEQ ID NO: 108981 - DNA, 728 bp, Heterodera glycines
  misc_feature (10)..(10): n is a, c, g, or t
  misc_feature (75)..(75): n is a, c, g, or t
  Promoter: Source sequence=SeqID_20972; Location=1..728; Strand=+; Gene=SeqID_51547
ctaaaataantcttttctcgaaaaaaaaattcaaaaaatcttgtattttttgaaaaaaagggtgggtgctaccantcgggtccactcgcgtttcggcgccggcagtttcggctgccagcatagttatttgtgtctataactttttttctatagtaattcaatatccacacattgtctgatatacattcgaaagcttaacatgtttagaaactttttctaagcgattgcttcgcgattagacaattaccaaaaagttatacatgaaaattgcgaaaaagtcaaaatttacaagttttttcttaataaattttttacaggcttgaaaatctatccgctttttgtaaggctaataaagcatgataagagctttcgaatgataccaagattgttggacttggatgccaaagaaaaaagcttaagtggaaaaacgagctggcgccgaaacgccagcgccgaaacgcgtgggtcccctaccacctaaactattacccaaattttggacaaaacgccaaaataggcaaaaaaagaacctctttcaaatttttttaggctaaataaaagctaaaagcctagaaaaaaagtattaataattcgaaaagtagcttaacagcccaaaaaaacaacatgtttttcgtgtgtttcaggccacggggctcaggaaaaaaataaaaatgttagccctattcatagcattgtaacacatcggcacgtcgttctgatgaggcatg

SEQ ID NO: 108982 - DNA, 596 bp, Heterodera glycines
  Promoter: Source sequence=SeqID_1872; Location=2637..3232; Strand=-; Gene=SeqID_76482
ttagctgcttctatcacagctgaagcaagaatatatttaataaaacatttaaacatattaaaagattctgtattatattgtgacacagatagtgttgtagtcttaaatgaatctaaacatttatgggaagattgaatagatcctaaagagtatggaaaatgaaaaaatgagggttgttttaattatttttatggtagagaggcaaaagcttattgattaaaaaacagcatagatccgtctaaagacattgtaaagtgtaaaggtgttaataataaattattaaaaaatcagttagattgaaaaagttgaataagtgaaatctctttaaagtttactagtcttcattctaaaaagatagatggaggtgttattattactagagttgaaaaaataattaagctgaaagctcatgcactggtgcttcgtcgtctcgctcgcacacgctgctctcgctcaaccaaaaaggttttgctacagcacggagagggccttccctctattgtggggctcattgcgtcaattgctcttccgcttattatggatgtcattgaaaattataaataaggtgcaacaaagtaaaaaaaaaaagtaaaatg

SEQ ID NO: 108983 - DNA, 215 bp, Heterodera glycines
  Promoter: Source sequence=SeqID_8188; Location=3865..4079; Strand=-; Gene=SeqID_67254
agttttaaaaattatcgctatgcgttgaaaagaaatctcgagactctcgacactgtttcattgtgcttgaaaattctactcttaaaaatggttttaaaaagcaattttgattaaaaaatgatcctttgtcagcagatgaaagcgccgacaatcggacgggagaacgccgggcaaatgtgacgacgaccaaatcggccactgtcacacaaccaatg

SEQ ID NO: 108984 - DNA, 1003 bp, Heterodera glycines
  Promoter: Source sequence=SeqID_831; Location=2325..3327; Strand=+; Gene=SeqID_46278
gaaaatttttaaactaatgtcatatactcaatctttaatattattaaaacaaagattcaaatatggattaggttttttaaatttatttgtctattgtttctattggtcatttttcattttctataaaattgtgctttaaaataattttttcccatttgtttccaatatcatatttttcataagtattcctcatttccattaaactgagctgtaatcgtcgtttaaatttagttaattagttcatttatttatgcatttatttgaatattaaaaagtatatttattttttatctttaaatatttaatgtaataaatgtatttgtttcgtaacaaaaaaaaattactgacataatttctttccattgttgaatttattattttataatcgtgtaaagcaaatgaaaaattaaataatttattttgtcctttgtttttattgagtaataataaaatttaaaaaaaaatacttttaaccacggggttgggctttgcttaattgtacatttcaatgcttaattttatcatgttcatttgggggctaatctatataaattatttttttatttaacaatattatgatataaatattaattattgattgtttacatttcactattgattttaaataatcgtgtttttaacttaatgttatcgtttttattttgtaaaaatcggcgacttaaatacttctcaaggaatatttgttccagaatatttattctaatttgatataataaattagacttgaattgcttcaaagtttttgattttttaagtaaaaatttgacctttaataaacgttaaaatagaatgtaaattatttgaaagttttattttatatttaaaacattacataacttttaaaatttgatgcgtaaaacaatatctcctttttacaaaaattgattttttattaattaatttattaagattatcattttagttctgataatttgaagataccaaattttttcactaattataatataatatttaataaatg

SEQ ID NO: 108985 - DNA, 249 bp, Heterodera glycines
  Promoter: Source sequence=SeqID_6116; Location=4114..4362; Strand=+; Gene=SeqID_60422
aatttttaaaaattaatgaatttaaatgaattttatttgtttagctaaaagatgttttggaatttggcccacaaattaacagaatttgtcttccaaataaataaccacggagtggaacgacagcaacaatcatcggctggggaaagacaaaactaagtaaatttggattatttttttctaaatattttgtttaaaaaagaatgctctaaaatttttctgcctaaaatttttattttcttagacaatatg

SEQ ID NO: 108986 - DNA, 1003 bp, Heterodera glycines
  Promoter: Source sequence=SeqID_20575; Location=410..1412; Strand=+; Gene=SeqID_51130
atttattggtcggcttaattaccagcagcagatggagtcggattaaaatgaatacacaatgcaataatttaatcactttttcgctggagtgatcagcaacagcagttgatcattgagcaaaaatggggaggattaattgtccatcggcggagtgtacaaatatgaaaacggcaacggataaaattatacatgaattattgtacactaatgagatggtaaatgccatttttacattgtggcattccctcccaaaatgccatttgtcatttgtatgcaaatcgatggctgctcatttttcctctgctgctgctggttactcacttttatgaactccttgtaaatgaggagaccctaattgccttaaattacccaataaaattttctagtttgagaagcattcccaaattaattttaggaaaagctaaactataaaaatacataaaaaacaaaagttggattcatttctctgtcctattcaaaacgaagaagtgaaagagagcgagagagatagagaacgcagagacaggcaacgcaaggaaaggcgagagaacgcagagagtgttgccacaggagagaaaaagcgagaacagagaagcaaagacaaaagtgtgcacgttagaagtggaagcagaaaagcgagacagttctacgcaaaacccctcgggcgaggacgaaaagcggccgaatcattgtgaaaggacgaacgcaacgcaaggcatagagaaaataaaaaggagagagagagagagagaaggtgagagatagagatagagagtgaagaggaaaaggcagacaacgcagaagagataaagcaaacggaaaggagagaagaaacggccattccttctgctgctgctactgttactggcgagacgaaacgggccaaaccaagttcaaagtgccaatgtgacgacggcggtttttgttcaatgctaatcagctattgctcactaattaccccaaataacaaaactatgcttctcccaacaatggcccccaaatg

SEQ ID NO: 108987 - DNA, 104 bp, Heterodera glycines
  Promoter: Source sequence=SeqID_1119; Location=1..104; Strand=+; Gene= SeqID_68142
caatcagttccttgtgtacaccttgtgaacgaagagtacgaaaatcagcctgttgttgtagaaggaacacttgatctgataggcgatctgttcttttcaacatg

SEQ ID NO: 108988 - DNA, 190 bp, Heterodera glycines
  Promoter: Source sequence=SeqID_13032; Location=813..1002; Strand=-; Gene=SeqID_76812
tttcgaaattcattaatgtgttgtgttaaaacgagtttaaatgagcatttttcgatgatgattttttcacctttttactgtttaggtattcatacaattttacatttagtgttaatttatccaattaataaaatttaataatctattttaattccctaattttttttagacgagagtgaaaaaagtaatg

SEQ ID NO: 108989 - DNA, 116 bp, Heterodera glycines
  Promoter: Source sequence=SeqID_34975; Location=1..116; Strand=+; Gene=SeqID_64652
aatatttgagtttaaaattcagttcatcaaaagacggcaatttaaaggacattaaagagccgacagcagcaccttctcacaaaacaaaggcaaagacaacggtcaatttcgaaatg

SEQ ID NO: 108990 - DNA, 1003 bp, Heterodera glycines
  Promoter: Source sequence=SeqID_9171; Location=83..1085; Strand=+; Gene=SeqID_70482
tattatgctgttttaaaattcatttaattaaatataaagaaataataacacggatttttgtagtatattactttttcgtgagttctcatttaaatttgcaaaaaatttaaaaaaataaatgttacaaaatagaaggcgttttaaattttaataatgctaaataaattttaaattttttgtctgttattaatccgttcattttctgaatcttattttcttataaataaatacatttatttattatttaattcaagaaaaattcatttaatttaaatttaaataaattaataattaaacattttcatttttattttatagaaaaattattttaatttttttaaaattgaatttaaaaaataacaaaaataattttgacttaataattagcattaaaaaatagcagaaaataaatttaaaaatgatttacaccgtccggattcgaacctgaatgcctcagaatcccagtttacgcagggattctgaggccttaacgatgtcaaaagtgaaaactgatcacgtatccatgatcagcttcattaaatggccttaaagacatattttttgaagattttgggtgaaaaaatttttacactcaaaaatcctatgctcacccctttggtcccgaatcccaaaatcacttttatttttataacttttttcaaaaaagtgataaaaatgccaaataaaatttatataatagagcaaaaaattgcgcattttatcaatatttttttataccttagcactttgtttggagtgagttattaatttttatgtgaaaaattgaaattttcaagtttttcaggaataacttttattgtttgcaagatagaaatcccaaataaatctcataaaattctccctatttttctctattttttaaactttaaatggactgaattggacctttttgatgggagttatgaattttcaaaatgtagcttaaattttcaagggccaaaaaattctaaaatttcaaaaatttttaaaaaattccaaaatg

SEQ ID NO: 108991 - DNA, 284 bp, Heterodera glycines
  Promoter: Source sequence=SeqID_13373; Location=581..864; Strand=-; Gene=SeqID_77248
ttttggctaaaattagcaaaaatgttcaaagaaaacgaagcgtggaaaagtaattaaattaagataaaataacttttgaaaatgattgaccgaagcacagacacaacttgcttccgactccaaattttggcaaattgccatcccgtaaaaagttcaacaagcaaaatcccgaaggaccaaatgtcagtgcaaaaggacaatttctcccttcgattcaacacacattctggtgcaaaatacctaaattaaaattctaaataactgttgaacaaatattggaaatg

SEQ ID NO: 108992 - DNA, 1003 bp, Heterodera glycines
  misc_feature (85)..(85): n is a, c, g, or t
  misc_feature (87)..(87): n is a, c, g, or t
  misc_feature (93)..(93): n is a, c, g, or t
  Promoter: Source sequence=SeqID_3214; Location=17..1019; Strand=+; Gene=SeqID_83734
aagtgagaaacaatgtgatgacattaattgtttgtccatggttataagaaatggtgagaaacaaatattgcgaaaaaatcttatnancaattnaaaagattaaaattccaatttgaaagcggaaataaaaaacaaatcaaactgtgttgttgttctggggaaaacccctgttaattgcccaaagcatgttcaatagcataaaagataaaagcaacaatttgctccaaaatttcctcaaatgcatcgacgttaagtcagtcagttaatgtcttcgcgccagattaactcgcataaatacgagtccatcattttgcgatgatcgaccgcgctttgcttgctatttttttaaagaaataaatttttagcattcctgaaaaaaactgccatatttttgacactttctggcacttttttgtgtttttagaacttctttttgcccttattttgccatttcatgcttttttcgcccttatttcgcgatttttaaattttttcatgtaaaattcacaacttctttaacaaaaatgcattgaaaatttttttgacgtagcttttttggcgacttgtttaaatattcaaaattttttccactaaatttgtttttctttcttgaccaaatttggtttttgaaattttatttattttagaaaaatgtattcaaaaatttcgaatatatttaattatttgcaactgtaatcaatgaataaaatgtgtgccttaatttgataataaaacagtaattttaaaattatacccctaaatttggaactttttcgtgcttattttcgcacttatttcgcgattttttcgcccttatttaaggccttattttggactttttcacgcttaaaaatcccatcgctaatgatcatataatatcaaagttcactcacaaaggagtaggaaaacgaaaagcatcattcaaagcaacacaaaaaaagtcaccacctcttcagtaaaaaacctctttttctaaccaatttaaaaaggctaataccaaatg

SEQ ID NO: 108993 - DNA, 152 bp, Heterodera glycines
  Promoter: Source sequence=SeqID_35523; Location=1015..1166; Strand=-; Gene=SeqID_65070
ttgtttacaattcattattgatcagatcacatccattttcaaaaatatgtttttgattttgctttttaataatgcttttcctccgttccgtcgcactttttatttgctaattcattttaattgccaatttgtctcatttcttggttgaaatg

SEQ ID NO: 108994 - DNA, 808 bp, Heterodera glycines
  Promoter: Source sequence=SeqID_11348; Location=1628..2435; Strand=+; Gene=SeqID_74733
aaatgactcatcgatgtaaaaaataattagattttaattttaaatgtatatttttttaatgttttttaatcgacccataactaattgtttattgaaaaagtaattagtagggctgcttaagagtcgaaatttccgagactcgagatcaagacccaacccccgccccaaaaaaaaggccgagaaatttcagtacaagttttttttttgagaatttttagaatgtatataaatattttcccaacaaaacattttttccaccttttcttttattatttttgtgggcaaataattaaataattatcatcattaaatatttcaaaattcataaaaatttaaaaggcctatgctcggcctaacagctaagaccaatccaaagcacccaaaaaaatataaaatattcacaacaaaatgattcatcgatttttaattttaaattaattatttttgaaaatacaagaaaaattttttttttattattattattattattattttcaacttaaatatttataatcaattaaaattagaatagaaaaaaataaacttatagaggcttaaagcaaaaaattgccaaataaatatatccagcctaaaggaaatttgtgcaaaattttaaggattttgtaaaaaaaccaggaatcacttattaattttcaaacatttgcatttaaaattcttttgtaaaaatattatttttatatttacatttactatttttaaatttttaacatcataattttctgtaaaacattttgctagcaaatgcttcaactcaaataaaaattccaaataatttggcactaaaatg

SEQ ID NO: 108995 - DNA, 140 bp, Heterodera glycines
  Promoter: Source sequence=SeqID_12198; Location=1486..1625; Strand=-; Gene=SeqID_75775
ttttattcaatattatattcaatgcatgaaaacatttaagctaaaatggcaaatttaaaaaaatgcgtcttttgttattgctaaattaaagaatgcaaattgaaaagcataaacaatttaaggacccgccggttggcatg

SEQ ID NO: 108996 - DNA, 229 bp, Heterodera glycines
  Promoter: Source sequence=SeqID_32003; Location=610..838; Strand=-; Gene=SeqID_62318
ttttgggctacttttttgtcttgaaaatccacgccaaaaatggaagaaaaaacagcaaaaaaaaatttgcgagtaaatcacaaagcttgcgcagcattttttgggcgatgtaaaagggaacattgttggtaaaatattggcatattgatcagcttgagaagcatgttttatgttaatttgtgcgcctcttttttgacttttcaaaatttggtattcgatcccaaatatg

SEQ ID NO: 108997 - DNA, 81 bp, Heterodera glycines
  Promoter: Source sequence=SeqID_15352; Location=168..248; Strand=+; Gene=SeqID_79604
tgtaaaatgggcttttgtggttttattcctgttcaattttaggacaatttccaccaattttgccgcgttattagccgaatg

SEQ ID NO: 108998 - DNA, 199 bp, Heterodera glycines
  Promoter: Source sequence=SeqID_35942; Location=1..199; Strand=+; Gene=SeqID_65396
attaattggtccgcttttcgctcactttgctctcctaattgctcactttaatcgatgggtgtgggttgcccgtcacgtaacatttgaaccgtttcgattcgccgggttggccgttccacactttcggctcgacacgtgccgtcggtggctcttcctctgaatattttaattaacaaataaactaaaaatttagtgaatg

SEQ ID NO: 108999 - DNA, 113 bp, Heterodera glycines
  Promoter: Source sequence=SeqID_6449; Location=1..113; Strand=+; Gene= SeqID_61614
ggagaacctttatcagaacatgttatcaccgttgccttaaagctctagctctacccttcagaaagccatctttttgttttcccaaccatttcttaatttcaatttaaaaaatg

SEQ ID NO: 109000 - DNA, 372 bp, Heterodera glycines
  Promoter: Source sequence=SeqID_11681; Location=807..1178; Strand=+; Gene=SeqID_75152
gtatcaataaaaagtgccaaaggaaaattttgtgatggttatcgctattacaaacataaaacgaccaagttaaaactttggtgtaaatgtgaacttaattcacatgggtgccagggctgggattttgaaaaggaagggttttttacaatgacgcgccgacacaatcatcatccagacactatattgattgaaatcgaagaggaaataaaatatcataatttttctgcgggggcaaaatgttttttgggtgacaacaagaaatagttgatgatgctaagaaaaatccgagactccaaactgaatttagagatgaatttattgtttgtaaactataaataggatcaagaaaaaaataccaattaaataaaaatg

SEQ ID NO: 109001 - DNA, 187 bp, Heterodera glycines
  Promoter: Source sequence=SeqID_131; Location=4585..4771; Strand=-; Gene=SeqID_73959
cctcaatttacaaaatgaaaaaatttggttaggcccttcaggggaatgggagaaactcctgaacctcccgtaatgaaaaaaagattaggaaattgggtaggccatctcccaaccctcgaaacgaaaaaaaaagaaatttattgaaagaaattttgaaaatataaagcaattaaaacattcaaaaatg

SEQ ID NO: 109002 - DNA, 297 bp, Heterodera glycines
  Promoter: Source sequence=SeqID_9488; Location=1025..1321; Strand=-; Gene=SeqID_71607
ccattgcgctctctattgaaattgttttctctacctcctctttcaaaaatgttttgtatgactgggactgagatccagcactctctcatttttgcgttatctctcgcactaaaattataaaccgctcatataaattttaaaaaattttcgcaaattttaaaaattacgttgatatttgcgttgatggcataatgttagttgatttaattaaatatcaacatttaaattgataccccgcaaaaactaataaaaaggttgatttgccattctctatggagaagccaggaaaaaaatatg

SEQ ID NO: 109003 - DNA, 348 bp, Heterodera glycines
  Promoter: Source sequence=SeqID_16569; Location=2091..2438; Strand=-; Gene=SeqID_80979
ctcacaaatcagccgccccccctgcctgtgcccttgagggcaggggctcccaacttaaacacctcatcgtagcaggacttttttctttctcatccaaatcaaatattattcgtattgttcgaaagcactcaaaaacacaatgaacctagaaaatttgaattttttgcttaatttgattgacctgacaacgagcaaaattatggtttcaaaaaatttttggacactcgtgagtaagcttaatcaacaaacagccgaagtacctagatgctctcaaaaccaattgataaaagaagataaaaagaataaataataataataaatacatatattccaaattttagtgacatg

SEQ ID NO: 109004 - DNA, 304 bp, Heterodera glycines
  misc_feature (32)..(32): n is a, c, g, or t
  Promoter: Source sequence=SeqID_43960; Location=693..996; Strand=-; Gene=SeqID_71520
aaattagctgttttgcacgataaggggcggancctatcttactagggcaactgtgtatatgatttattttcagatagtcctttctgactctttgaataaatgtacgtgacaatttatccaaaattttgctaactgagttagaaatgataatctccacgattcaaaccaattttcgttgctctaattaaccgcgataaaaacattcgaatcaattaaataacttctgagataataaggtttatcataaaatttcatttaaaaataaaccctcaattattggtatgaacgatactttccaaacatg

SEQ ID NO: 109005 - DNA, 149 bp, Heterodera glycines
  misc_feature (27)..(27): n is a, c, g, or t
  Promoter: Source sequence=SeqID_15295; Location=1088..1236; Strand=-; Gene=SeqID_79522
accgatttttgttcatgaccacccacnccctccccttcagaaactgaatttttttcaggttttttttaaatgaaattaacaaacaaatggaccatcgtcatcatctcgaggtcttcgggaaaaataggcgagcccaagttgccgcgatg

SEQ ID NO: 109006 - DNA, 1003 bp, Heterodera glycines
  Promoter: Source sequence=SeqID_2868; Location=1022..2024; Strand=+; Gene=SeqID_82051
tattttacgtacttttttaccttttctctttttcaaaaactttcttttaattaaatataaatttttttttggggggttttagggaataaatctatattccgctatttttgcgtttttagtccatattttggccatttttggcaaaatttcacaaaaaaaatgcaaaaaaaaaggcgaaaaatacacccttaaagatcgacttttttggaaaagctagaatctaataaaaattggcagtttttagcttaaatacatttttcgtaattttttagggtttaaagcatatattttggcagtttttagtccatattttggtccatatttggtcatttttgacctttttagtccatatttcgggcttttttagtccatattttatgtccatatttgccgttttttagtccataattttattggtctgttttggagtgttttttaaattagtttcggattttttaataaattttttaattattttttataccatttaaaaagggatttttttaaattataaaactataaagtaaaattatttataattttggaatataaaaactcactttttctgtttttctttgttaaatctttagcaatgttttcttttgtacaaaacaattcaattcaaaatgggaaaattactttttgtccaccacaaattcagcaataaatgtcacttttttccagcagatcgtataatgggtaattatgatttgttttgtataaatacaattaaaaataagaccaatttcaataagttttttttcagaagaatcccgcgttaatttattttttgtaaagtgaaaaaatcggctttttctcaaatttctgagtatgtatttttgcatttccgagttgtcacccctgagcctaatcaacgaaattcgaaaaactaataaaagaattaagggctgaaacataaatacggatttcatccataattaattattaaatataaaacatttcatttcctaaattttgttcagttaaattttagacaaaaatg

SEQ ID NO: 109007 - DNA, 301 bp, Heterodera glycines
  Promoter: Source sequence=SeqID_11816; Location=730..1030; Strand=+; Gene=SeqID_75319
agtgaggggaggaagaagtgatcggacaaatccaatggaatgaatcgatttcaaaaattttgcgaaaatttttgaaaaattttcccaacggcacctcggcatttttgccacccgtttgttgaaatttttcaaaatttaaatcaaaagtcctcaaaaagttcgacaatggcctgctaggccccgatcaaatgagggtaattaacggattgatgacgatcggttatcgattgaccaaactgattgaactcacacacagtccgacaccagtgaggcggtgggcactgcccgtctggtggccatg

SEQ ID NO: 109008 - DNA, 330 bp, Heterodera glycines
  Promoter: Source sequence=SeqID_35290; Location=1..330; Strand=+; Gene=SeqID_64874
agtagaaaagagagatttcggagaaaaaggagatgaaagactaaagaagagaagaagctgacacttccccgccaaacggcaccaacaaaaacgaattatgaagtgatcaactcgttaaacttgactttgtgtgtttttaagaacaccgtatgccacatgtgggttaatttttttaaatttaaaattgattcaatttttggcattatgccatctccttgcttgttggttcactaaatacaaattatggtttacataaagggagggaacggacagggagaacaaatgagtgcattttatcattacagtattgttttggcttctgtagaaatg

SEQ ID NO: 109009 - DNA, 121 bp, Heterodera glycines
  Promoter: Source sequence=SeqID_39229; Location=1..121; Strand=+; Gene=SeqID_67847
aaaaaatgggaaactgttctggaaaaccaaaaaatatcaaaagaatttgaagaaaacattaagggcatgtgaagaaatcgaaaagaaaaagcaaacattggaaacgaataaacaagaaatg

SEQ ID NO: 109010 - DNA, 187 bp, Heterodera glycines
  Promoter: Source sequence=SeqID_10677; Location=2967..3153; Strand=-; Gene=SeqID_73924
aaatatatgaaatgaaaaagaaaagagaattaagttatgtgttttatgattaattcttttaaacaattaatttgggaattttttatgtaaaatattaattttcttataattttttgcaaaattctttggaaataaatttgataatctttggttatacggctgcaaaaaatattaattagcaagaatg

SEQ ID NO: 109011 - DNA, 392 bp, Heterodera glycines
  Promoter: Source sequence=SeqID_16800; Location=893..1284; Strand=-; Gene=SeqID_81216
ttttaaaattggttccggactttcccggccttttgaaataaattcgtagaaaaatatacgaaaattattttagcttttaattacgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtctttttgaaataaattgtgaaaaatatacgaaaattattttcggttttaattatg

SEQ ID NO: 109012 - DNA, 144 bp, Heterodera glycines
  Promoter: Source sequence=SeqID_20799; Location=2202..2345; Strand=-; Gene=SeqID_51378
tgtccagttccggttttagagcaattattgaatattttataagtatgaaatatgcctactttattattttgtcttctcaattttaaagccctttgtttatttaatcttgcttattatttattatcaccatgaatcctgctgatg

SEQ ID NO: 109013 - DNA, 198 bp, Heterodera glycines
  Promoter: Source sequence=SeqID_605; Location=295..492; Strand=-; Gene=SeqID_57371
ccgaaagaaaaaaaagtttataagaaaatttttttttccttaaggtagcaacacatcataaaacgccgaaaaaagggcctttacctttttttatgaaaaagtttcaggcggcgagattttaggttcaaacataaattcggtgatctttttttcataagaaattggtgattggacgatgtcaaaatttccttacccatg

SEQ ID NO: 109014 - DNA, 53 bp, Heterodera glycines
  Promoter: Source sequence=SeqID_31179; Location=1..53; Strand=+; Gene= SeqID_46246
caatttccaatgaaaagcgataaattggaaatttgtgagtatttagtccgatg

SEQ ID NO: 109015 - DNA, 562 bp, Heterodera glycines
  misc_feature (14)..(14): n is a, c, g, or t
  Promoter: Source sequence=SeqID_3919; Location=1..562; Strand=+; Gene= SeqID_52447
tgttcgggtggacnccgataagacattatttattaaatttgtttcatttccatttattgtttgtgtctgacctttcactgtcagacacattctattgattgtatttgtgaccatttgccctcccctcttttcattcattcagtttatgatatttgtgttcacattttccaattgtctcctccgccgtcctccgacatatttatttgttattttaatttgtcttcaataaatatttatttgttcgtccattcgacatttcggggaccgaacaaattggcgacgccctacatttgagctcagcgcctatttgaataaattgctgagtgcaatttattgaatttgtctgcaaaaaaaggtcggccaggaggcaccattattttcaacaagccaaattcgtcgatccgattaatccgccaggcgcggttaatcgtggaatttctacaaaaaaaaacccagataccaatacggttgcggtttccgccaggcgcggttttattcgacacaaaaaccaagaaacctaggcggttgaggttccgccaggagcggttattcgacgaaaatg

SEQ ID NO: 109016 - DNA, 702 bp, Heterodera glycines
  misc_feature (60)..(60): n is a, c, g, or t
  Promoter: Source sequence=SeqID_14472; Location=1..702; Strand=+; Gene=SeqID_78516
gataaagaatgagatttttgggaatttttatgcaaaaacacacttattttttcaattttnaacacatattttagcacatattttggcatttttgggggtttttagcacatatttcagcattttttagcacatattttattacatatttcaggatttttagcacataaaaatcctagccctattaatcaccatttcctaagtgaaaccagcagcagtttccaaatatgtaaaaacaatttgtcataatatgagcgccaaaaaacaattcataattttttttgaacatttctattttttccaaatgcgggttcaaacggagatgcaaattctattttttaaaattataaaaagcgaatttttttgcagaaataagttttgtaacattttgtcaaaaaaattaaaaacaaaatacaaaaagagttattcataataaattttatattttaaacaaagatccgacccatttttatttttacaatgtcttttttttataaaagcactttgctttacctctcgcaataatctccatcgctttcattgtataaaattttggggcattgattttcatttaataaaaattatcattttataataaaaatattttaaaaatagattttaaatttctcttttcatctttatggaatttgcttttctcttcgtatttcgctgaaaaacttcaacagttttggcctcccaaaaatg

SEQ ID NO: 109017 - DNA, 471 bp, Heterodera glycines
  Promoter: Source sequence=SeqID_5638; Location=1764..2234; Strand=-; Gene=SeqID_58729
acttttttttggtcaaattttttttttgttttttttacacataatgatgaatattaagtattaacagcacaattatggtgaataaaatgtatattcacgatttttatccaaaaaaaaatttacaaaacaaaagggtcccccctatggtttttgataaaattcaaaatctatcactttataactagcgccaaatttgcttaataggcccaaataattgtcatattcgtgatcagcgacctttaaaacacccgggtacttggtttcaggactttttaaacaaaaaaaaaatttgaccaaaaaaaagttgaaaaaattttcaaaagtttcctctttgcaactagcgccaaaaaaaattagggacccccattcttcaggaggattgcggaattgaaatattcagatataaaaaactaaagattagcagttgaccagtgaatcatatttttgcagatcatttcaatgttacctatg

SEQ ID NO: 109018 - DNA, 131 bp, Heterodera glycines
  Promoter: Source sequence=SeqID_25875; Location=357..487; Strand=-; Gene=SeqID_56648
tttttgtacctatccttgtcgcccttctgcattcctatcggtgatcatcttcaattgcagagcaccgagagactcttagtgatgatgcacgtgtgttgttgcccaagtctcggtcactacaacggacaatg

SEQ ID NO: 109019 - DNA, 187 bp, Heterodera glycines
  Promoter: Source sequence=SeqID_8711; Location=1..187; Strand=+; Gene= SeqID_68921
aaaaaatcgtctaggaatatttatctaacaaatttgtcgggaaagctgtataaattatgggaaaaagctttttcaaggaaaagctgaaaaattttcaatcgcatcagaaagcagcctcaaattgttcaacaacataatgtaaaaaaatattacgcaagaaattatttttagatcctttttagaaatg

SEQ ID NO: 109020 - DNA, 199 bp, Heterodera glycines
  Promoter: Source sequence=SeqID_3078; Location=271..469; Strand=+; Gene=SeqID_83097
agtgaataaaactaaattaaaatgattataaaattaatttccaaatattttcagcaaatttaaaaaaagcaaaaaaactcgcttttttattttgttacaatatattacattataaataaaaattaattttaaagatttaaagtccgaaagaaaaaatgattgtcagcgacgtgaaattcttagcaaattttttaaaatg

SEQ ID NO: 109021 - DNA, 296 bp, Heterodera glycines
  Promoter: Source sequence=SeqID_4428; Location=1..296; Strand=+; Gene= SeqID_54412
aatattttataattttttctaataaggaaaatttttaaacctaaaattttatatcaacaaaaaaaaaaaattaattttggcgatcaatttttgagaaaatttttcaattcttattttacaccaataaataattaactaaagtaggatcttggaagaaaaacatgttttcttggactgtttctatctttggtagaatttataaacaagaaaatgacggaaacaatgtttgtttaattaaaaaaaaatttccaattaaaaccctaataattagtgaacagttcaaagcgaaaaaaatg

SEQ ID NO: 109022 - DNA, 361 bp, Heterodera glycines
  Promoter: Source sequence=SeqID_13990; Location=1253..1613; Strand=+; Gene=SeqID_77952
actaattagtccccgttcagattctctccccgagcattctgtcgggcggtgggggcggaggagaaaaatgaacggaaaaccattttaagagaaatgatcagtcaaaacattgttttctttttttatgtgtcataataattggttatatttacaatgaattaaattcgtttcaaactgaaattgaataatgaatgttcaatcatttatactgtatgacgtaccgttctcatttctcggcttctgaggggaataataataatatttacttaattttcacttttcttttatttgtaccctttgatgttttgccgactatccctgcggcggtttgcccttttgttggaacggactttcgaagatg

SEQ ID NO: 109023 - DNA, 1003 bp, Heterodera glycines
  Promoter: Source sequence=SeqID_765; Location=456..1458; Strand=+; Gene=SeqID_60741
acaaaaaataatcgtggcttaaaaattactaaaaaattaataattaaaaaaaatgcccgacaaatcaaatcgaagtgatcactgatcaaaagtcattaaaataaattcaatacttaataaatttcacaaatcgtctaaaaaattctaaattttttagtaaaattttctttgggttgaattttaagttttgtttcacttatgttcaaaaattctcggcatcattaagccctgcttgcgccggaagaatcttggcacattgcgtctcagttttgcttcagtcccgacaaaagtcgctttattcccctctccctcgccccctaattatccatgtctaatgtggccagggttagcaccgaataatggcaaattaaggctttaattaactctattaatgcgcttcccccacggagcagtacaaaacgttgccggacgaatttttagaccataacttctttttttttctcaaccaaattaaaaaacattcatgatattgttctaaagcacttgagaaactacaaacttgcaaaatcaaaaaaagaaaaattcggacaataccaagaatgcttaatttgattgaaaatgaagaaagttatggccctaaaaaaatcttccggcgatgttttgggggttcaccgcttcccccatcagtacgcctgaaatagcaatgcttgatcaactccctgatcactttttttcatgttcagctgattgcttgttcttgtccaactcggcagctttccaccagcagcagcagcagcaacagtcgcccatggatttgatgtccgtgctccaagcattggccaccgcttcgtccgccgccggtgccttttccgcttcgtctcccaccgttgtgtctgcgtttggtggcaccgctgcttcgcaacattttccgtttggcagtgccggcaccgtcaacgccgccatctctggtgcttctccggtaaccgtaggcggcggcacgtcggcggatgcgggcggctttttgatggcagccgcagcaatg

SEQ ID NO: 109024 - DNA, 133 bp, Heterodera glycines
  Promoter: Source sequence=SeqID_14640; Location=1816..1948; Strand=-; Gene=SeqID_78735
atgcgaaatactcagatatccaaatgacgttggcaaacggccaaaaatcgcaggtgaaacaagtaaggcacgaaaagaagtcgcacttgacggaggtgcatttgttggtgttgaaattgatgcagaaaaaatg

SEQ ID NO: 109025 - DNA, 155 bp, Heterodera glycines
  Promoter: Source sequence=SeqID_27730; Location=1095..1249; Strand=-; Gene=SeqID_58398
taaaacatttcataccgcaaaattataatggcccatcgtcaaattgccatcctttttggaacaaaaaccaggcaactttggacactgacaatgagagagaaaaataaatgaaaaaaggcatacagtaataaggaattgggaaacggtagaaaatg

SEQ ID NO: 109026 - DNA, 1003 bp, Heterodera glycines
  Promoter: Source sequence=SeqID_25554; Location=277..1279; Strand=-; Gene=SeqID_56297
ttttatttcttataatattacaactctaaagaaagcacaaattcgaaatttcagcaaattccttttcatttttaaattggaatatccaattttattttgctagcaattattttgttgccaatttgtggattttcttctttaattcttaatatttttcatttatcctttctcattacattttccccattcgttgccgaaggtgctaagtatcagttataataaagataattaaatttaaatgttatagtgagtaaatcctataaaattccaattttttatgcatgtttcataaatatttttgcatttttaatacatatttatttacatattttgcaatttttcttacatataaattcaatcaagtaataaacaattcctttacttcttttcgtattttaattcaaacatcgatatcaatttttatgagaaagtattagctagaataagtgtttattattttaaatattatcatcaacgaattttccttcaaaaaattacatttattcggttcttaaattgcaaaatcattatttatttatgtgacataaaatgagtatgtaattgaaactgcttattagataatataattttattagatttactcactttataacatttaaatttaattatttttattataaccgatacttttttaggttcgacctagcaccgtgaaattggaccaattttaattttattattttggcaaaaaataaataaataaaaaagtcacggaaatcataaaaaagcaaaaggaaaagcgaatgaaagaaaagcaaaggcaaagaaaggactcatcacattttgttgtgcggattgaatgatcacaaaaccaaagaaaatgggggggggggggaaagacgggcgaatgaattcgcacaaaaagtgggccgacggaatgtgtcgaagtgtaaacagaaaaaatttgggagacattaacactttgccaagaattggaatgaaaataaataaatgtgaatatcattcagttagtcggtcaatg

SEQ ID NO: 109027 - DNA, 73 bp, Heterodera glycines
  Promoter: Source sequence=SeqID_2710; Location=1804..1876; Strand=-; Gene=SeqID_81206
tggacagcttttccactaagccactgtcgcgagacacatccaatcccactgattcgcataggatttggacatg

SEQ ID NO: 109028 - DNA, 197 bp, Heterodera glycines
  Promoter: Source sequence=SeqID_20510; Location=2538..2734; Strand=-; Gene=SeqID_51045
tctttccagtgagcttgcccattttctctagaaaaaatttcccaaccccctagggatttcgaaaatttccccgattttcagtgtattttaggtgccccggtcactaggaaggagtgatctgatcaagttgatataggagacttttttgatcagcaccaaaagttgtgcgagcatgaattatttcaagtttttaaatg

SEQ ID NO: 109029 - DNA, 132 bp, Heterodera glycines
  Promoter: Source sequence=SeqID_26624; Location=427..558; Strand=+; Gene=SeqID_57378
aaagaaaagcacaaaagaaaggaaaagagcagaattatcagaaaatattagaaaaagagtaaaaaaaaggtaaatgaattataagcaaaacataaaatggcattattttgctaaacaattaaaataaatatg

SEQ ID NO: 109030 - DNA, 87 bp, Heterodera glycines
  Promoter: Source sequence=SeqID_13205; Location=1..87; Strand=+; Gene= SeqID_77031
tttgcccctaatttaatatactaattggtcacttttgatgaatccaaagcccacaaaaaaattccaccggaactcctttttgaaatg

SEQ ID NO: 109031 - DNA, 154 bp, Heterodera glycines
  Promoter: Source sequence=SeqID_24715; Location=1230..1383; Strand=-; Gene=SeqID_55461
cggacatcccggcgagaacgtgacatcccggccagcctggaaaccccggcccgcaaggataccctggcgacggcggaagccccggccaacccggcaaccccggaggcaacggcgagcccggacagcccggagcacagggatccagcggccaatg

SEQ ID NO: 109032 - DNA, 365 bp, Heterodera glycines
  Promoter: Source sequence=SeqID_44715; Location=549..913; Strand=+; Gene=SeqID_72157
ttttggcccctgtctttttgctcccacagcaatttgagctcccacagctattttcgatcagccattacattcccctcctctcatattcgagcgccctcgctcgagagatggcgttgggccgttcccgctatgcaaggatcggcgcgcctccggttcttttgccccagtgccagctgttgtttctggagtgtcgagtggtgtgaagaccaaacgacctggggtgtccgccaagtgtcaccataagccttttcccattggaccgttttctcttttcacgatgatttgcatttgtttgctcctttccacagtatccaaagtccaatttggagccgtctccgtttgtggaggtttcgctgggccgaatg

SEQ ID NO: 109033 - DNA, 813 bp, Heterodera glycines
  misc_feature (39)..(39): n is a, c, g, or t
  Promoter: Source sequence=SeqID_30011; Location=729..1541; Strand=-; Gene=SeqID_60465
gaaaaatgacttaacacaaattttgagggataatgcacngcattttaccatttaaaaaaacttaaatatttttcgcaaaaatttgaaacagaaattgataaaattggaaattgaagattggtctctttgactccatttactgaggaataaaataggaattgttttcacttacctagttgaaatttcaaagttgcagctatagttaaaatttcagctcgaacagttcacaggaagtgtaaaaatttacgaaaatgggggtatctttatattaatgttagattttttgaaaaaaaattttaaaataatcattcaaattaaaaactaccattatatcattattattcttatttttaattttgatcatatttttaactgtttagaaatcaaaaacataatctttgtaaacatgaatttttatattttaagttttattttattattcataaacaatttaataatcaacgcttcgtctgttcaattgaataaaattaattcaaaaatacggccaatttttgatgaaatatttggccaaaaatgggaaaacatggaaattcaaaatgagcaaaatgatttagcttccattgtcaattatctgaatgccaatcaatgtgatgatcaacaaaaacgcgaaatgttaacaaataccacgcagtaaaagaaggaattaagaaaagcgggaaatattcggcaaaaattaagaataaaattgaacaaaaaatttgtaaaaaattgggaattagtcgaaagaaaattttcaaatggaaaaaagaatttggattcaatataaaaaaagataaaaattattatgaaatg

SEQ ID NO: 109034 - DNA, 166 bp, Heterodera glycines
  Promoter: Source sequence=SeqID_4273; Location=21..186; Strand=+; Gene=SeqID_53840
accgaagaaaccgagtccaaaaggcgactgggaaagtgcattaagccaaaattttgctaaattttatcaatctccgaaacgaaaaaccgcaatttcgcctgtggcaaaaggtttatagctcaaataaattttcgttttttaaaatgaatttttttagtgaaaaatg

SEQ ID NO: 109035 - DNA, 1003 bp, Heterodera glycines
  Promoter: Source sequence=SeqID_4027; Location=3256..4258; Strand=-; Gene=SeqID_52875
ggtatgaagcgagttattgcagatcaaaataaaaaatacaaaaaagtcatttttcagtgtaaattttgaaataacgcgcaaaaatttacgccaaatgcgctatttggcgttatgagcaattttgtctaacactgggcttgacccatagtgtatctggttttaaattgtgaagctaggatttaataaaagtttggcttttttgagttttttaattttgggatatttttaaagtttgtttaatcaaattgaatatattttggaatttgtgagtgtttaaaacgattttttggcagtttttagtccatatttggcaatcgctttttagtccatgttatttacaaccctatctatgagttaatcactaaaaaatttctaccaagcaggacattctgatacttcgaattattcaaaattaaaattttctttaaaaagcgtgtttaattttttaaaaattgtttaaataattttaaatcacttttattttttgattgttcggaaattctcgttcaatttaccccaaatttccaagggaattccttcaaattttcagttgactaagcgagccatcggccgggtttgaaaattcttagctaatttaaaagttagtgtcaacagaagttcataaaaaattcatttcgaattaagaattcagaaaaacaaatcattgccacaaatcaaatcaaattggacattgttaaaattgttgtcctccgaattttcgtctttcttccgctgaaccttcgcctttgtctcccaaattgggcatcgcttcaatatccaataaaattgggggtaaaactttacaaatttcttcaaatttgttaaatttttgcataaaaatctcgaaaatagctaaatatcgtatgaataatcattttagaaccaaaaatataaaataaaatacccaaaaaatgatatttttgaaaaatttccggtcattagaggcccaaatggccgctttaatatagggggccgttttaatagaggattttgttgaaaaatg

SEQ ID NO: 109036 - DNA, 64 bp, Heterodera glycines
  Promoter: Source sequence=SeqID_33600; Location=1..64; Strand=+; Gene= SeqID_63616
ggaagaagacttgaaggccaacgaaaaactcaccaagttttacggcttcaacatcattggcatg

SEQ ID NO: 109037 - DNA, 109 bp, Heterodera glycines
  Promoter: Source sequence=SeqID_1302; Location=1..109; Strand=+; Gene= SeqID_72086
acgaacaacaaagggaaaagggcgaccgcctgtctccgcacagtcgcatatcttcaaagttaacaacaaccacgacaactactgccttttttacgcgctggaacttatg

SEQ ID NO: 109038 - DNA, 1002 bp, Heterodera glycines
  misc_feature (161)..(161): n is a, c, g, or t
  Promoter: Source sequence=SeqID_14885; Location=813..1814; Strand=-; Gene=SeqID_79043
tttccaaactttcgttcatccgaaagaacggaaaatttcaggttgtttttgtccgcatttaatagagtttttagtccctaatattaatacgaatgcagcagtgctaatactcgggactaatatgaagacccgagactaaaatttccccagaatcggggcgnagtctctcaagagcagcaggggcggcgaattgaatttttatattttataattaatacatatgtgtaattgtaactattaaattagaaaatattctataagtgtcttatacatttatagaattaatttaaaaataatctactggtgctttgtataattaaaataaaacaattaataaatcactaaataaggatgataattgacacataatataataaaaatgaaaaaaaattttttttggaatgaaaacaaataaaaattcaagaatttaagaaagcgcagatgactcagccggggaccccaggaaaaacgggggtaaaaaactgagattcacaagaaaataaatatttcctcttgagtaggtgggtgatccaacttaattttccgcatcctattaatcatattcttttatttttctctgatttgaattccgctgtttttcctctcatgagtggcgaaacaaattccaaagttcaattaaaatatatcaatatttcaatttaaaatcacaatttaacaaatcatcgtgttttttcgtcacttttcattttgttggccttttcttctcacaatttctttttcattcggaataataaataatattaaataataatttcataaacagtaaataaaatggaaatatttggcataaatattccgtggatcattttgtttttgttgttatttgttccacatttatttaagcaatcaaaaatctgttgtcaaatacctaaataaaaatgagcctataaataaatgagaaattcaccaattaaaataaccatttccccgttaattttgcatttatttttcattttttaagaagcatttcaattttcaatg

SEQ ID NO: 109039 - DNA, 1003 bp, Heterodera glycines
  Promoter: Source sequence=SeqID_9751; Location=107..1109; Strand=+; Gene=SeqID_72578
ccccctgtgaccgtccctggaggaacgatgggggggggggggggaaaatgaagtgcacccaaaaaatttagcctattaaaatatttagaaaatcttattatattttttgaaaaatttccgatttccaatttccgaaaatttttggggcctcaaaatgccatccccggtgacgatgcttttaacggaaacacttgggcaggctcatttttgagagatgagaatctttttggcgtaataaagccgaaaaatgatgccaaatcattgaccctgctattagcccattttttaaatcaacctttagcttcctttctcctcattgcacaacaatcaacaacaaaaaatgacgacaacaaaaacaatggacgcaaagcaacggcgacagtaagtgactaattaaaatggaaaaattaattaaaatatttcttttttgcattcttatcaaatatatttctatacaaattttctttaccattttcttttaattggctttttctcatcaccaattttctaagtgttgctaaagggcaaagtccgattttggcaattttgggccaatttggcaatttgggacgggccaaattcaatcgtcccactataattgagtgagcgacgaagggacacccgatggaaaaaaagacatcgttccgtcatagcattctcaaggggttgccaagcaattccgattcatttgaaaagaaaagcaatttgagggagaagcggcgaacggagaaagaagctaaacatttttaaatggcaatgccaaaaccaacacataaaaggggaaactttttggcattttaatgccaaagaatgacaataaatatttcaattaaaagtaacacctttatctggcacggcacttacatttaacaatttgttgaatttgtatctgtcgtgcttcccgcccccaaaggcttccccctccctctccctccccccttagataattgctaataaaagggaatttgtgcaagttagactcatttttccctttccataaatg

SEQ ID NO: 109040 - DNA, 359 bp, Heterodera glycines
  Promoter: Source sequence=SeqID_4075; Location=257..615; Strand=+; Gene=SeqID_53063
tttgtttagcacaggaatctgagaaatgttacaaatgaaaataaagtgaatcatacgctcaattataggtagttaggaatgcaaaagcaaaagggatattttcctcattacgccacacaataaacattaaatacgccaaattgtggactcctatttggtgagttgctctggtgaatagacattcaatccagataaaaatataaaaaacaattcaaaagtggtgaaatcagtcaaatctgaagtctaacataatgaggaatagagatgagatttttccagagatcgcatcgaaaacttgggttttgggcctacaccacaaaatttggtaatactgacttttactggtcacataaaaaatg

SEQ ID NO: 109041 - DNA, 311 bp, Heterodera glycines
  Promoter: Source sequence=SeqID_29693; Location=961..1271; Strand=-; Gene=SeqID_60166
aatctattttagcggtgtggatgcgattggagcgtgcacatacactatgtttttgatcaacgccagaaaactttcaccattgaagagttggaacaaaagctcgttggtcaccaacgtgtggggttgtcagcctcggagaacgtacagaagcaaatgttggaagagcgagggatcatttataaaaaggcattttaaccagtcaaatttcatttgtcgtgagtgatatttgtcaggcggcacatttttgtgtcttcctatcgaaatgggcgctgaagccgtacaacgacagcatggaggcgtacatcaacatg

SEQ ID NO: 109042 - DNA, 395 bp, Heterodera glycines
  Promoter: Source sequence=SeqID_10181; Location=42..436; Strand=+; Gene=SeqID_73285
tgtgaaccatggtcaataattcttccaaattatttgttttgttttttgtaaggtgttgcctagtcatgcaaacttttcttatgtttttaagagtcgcttatcacgaatctgaatcgatcattccgagtgtttaatggagtttgaaacaaaaatttgaaatttgttaaattaatttttcgaaattttgttcgaattaggattcgaaattaaccaaaatggatgtcagattcataatcagcgaccgctaaaactccggtgaataatttttcacgattttttatcacaaaaaattttcaatgattttccactatggtttttgataaaattcaaaatatacactttgcacatatattacttggaattttcaactgatttgtccctttgggtttcagatg

SEQ ID NO: 109043 - DNA, 207 bp, Heterodera glycines
  Promoter: Source sequence=SeqID_14104; Location=412..618; Strand=+; Gene=SeqID_78086
tcgcccggtcaaaatgtattcagtcgctgctacagtaccatcaaaacggcactgcacaacaaaagacggtagaattttcgatcattgatttttatagttaaaattaaaataaataaattcataattaattttattcgcctaaattacgccaagaaaatttgttactaatttattcgtgccactatcaggtataaacaacggcgaatg

SEQ ID NO: 109044 - DNA, 442 bp, Heterodera glycines
  Promoter: Source sequence=SeqID_23974; Location=1322..1763; Strand=-; Gene=SeqID_54675
aagagatataactttaaccaaaacaacccaaaattaaattcaattggtatggcttcgatatcattagtctttctattggcctataaatttcaaaaaataatcttttttaatataaaagaaaaaaataattttgagcatttttgccaccccttctttaaactttttagaacatatttagagggcttacaaccaaggacgaaattttgaaatttggctctttctgaataaagataagaatttttaatgcccattttagcgggaccggaataaaaaaagtgccaatgtaaacaaaaagccaaaattagcccgttttagtgcaaatttttgaatatttttaacataaaatttgttaattttcattataattgcatttttaaagggaggagcaaaagaagtgttgcacggactgctacaagctattcaaaagttgtttccaagaatg

SEQ ID NO: 109045 - DNA, 401 bp, Heterodera glycines
  Promoter: Source sequence=SeqID_28006; Location=1..401; Strand=+; Gene=SeqID_58665
aggtcttttttactggggtaaaattacaattataatgttttttcaatttttttcatgaacggatcagattttaattaatatataaataatcttttttatttttattattatttgttctggaaggttattctttttatttagtgacattgaatgattgcccaaattcactgaaaaattattgggacggcaatttttgccattcggaactcaaaatcacaaattgtttgactgttcaaaagaatagcaaaaaaacgggtaaaaaatgatgttttatatattttaattatttattttcttcaaaaggcgatcgatctgtcttcgcaaaacatccgattttgctgaacaataataatgacccgtccaatcacattttttactatgaaatttcagtcaggaaaatg

SEQ ID NO: 109046 - DNA, 91 bp, Heterodera glycines
  Promoter: Source sequence=SeqID_7357; Location=435..525; Strand=+; Gene=SeqID_64583
ggtataattaatgtgaaaaatataaatgcaaattaataatttctaagaagtggcagctcttgcactggcggcgttcacacagatcaaaatg

SEQ ID NO: 109047 - DNA, 125 bp, Heterodera glycines
  Promoter: Source sequence=SeqID_37224; Location=443..567; Strand=-; Gene=SeqID_66348
caaagtaaaaaccttattttttcacgtttttttcccatataaagcttcaaccggcttatgcttgttcatatccaactatcttccgcttcatcaacacaatttgatatgagaaaagtcaattgatg

SEQ ID NO: 109048 - DNA, 571 bp, Heterodera glycines
  Promoter: Source sequence=SeqID_8215; Location=1537..2107; Strand=-; Gene=SeqID_67331
actttaatcaaatgtgacgactgattagtggaatgcgatcaatcaatatttggtttgttggcgatcgaaaatttaatcaaggagaatcggtctgatcaataaatgaatgattgaactttaatcaaatgtgacgactgattagtggaaatgcgatcaatcaatatttggtttgttggcgatcgaaaatttaatcaaggagaatcggtctgatcaataaatgaatgattgaactttaatcaaatgtgacgactgattagtggaaatgcgatcaatcaataatggttggttagtgatcgaaaattgttcaaggaaaagcggtcagataaaaaaaatgtgtgtcagtgaacttaaatcaaaagcgattgatcggcattaaaagtgatcgaccaaaagtaattttttttttaaatatattttgcctgtaaaatttggtgcgattttattaattatagaaagggttaaatttaataaaagttccaggaaacattttttaataaaattgacaaaaatctaaacaaaatttaattacatacatatagctaaatttctcacttttcagaaacgaaaaatg

SEQ ID NO: 109049 - DNA, 811 bp, Heterodera glycines
  Promoter: Source sequence=SeqID_11029; Location=1..811; Strand=+; Gene=SeqID_74358
agagggcgagagcaacactccctcgcctactctttttccttcccccttttcaccatctctcgctctctcgcctctttctctttccacccgactattgcgtattttctacctcctttccttccccctccctctctctttcttcctttcccacctttttcccactcccactccctccctctccatttccttttcctctctccctccttctctctctcccgcctctctttctcccctttccacgctatttcctgtatatgtgtagccaaaaatgcaagaggattccgcttttcgctgtctttctttatgttatgttatgatgggcggccgagtgggtgccgcccttgttgctattttgggcggtcccattaaatccgctccccccattgcctcccttttttccaagcgcccgcctggcggcggtcttccctttgccattgcttcttcttttaagttcataacgaaaaaaaaagtctttgtaaaacagtgaatgaattttattgccaagagaaaataaatcactgtttactccgttggaccgcgcgcgcgtgtgcgttatcccgcgaaaatttacacaccgttctgacactacgccgcgttttggttattattcccccgggcgcgccttttgccatttttgtggtcactcataatttgcaggtgttaagtgcttcctttctcttcgtatttttaataatgacaattaagtaattaattaatttacctacaaatgtcgccaattctttgtcagcaatttatccgaaacaaagacactgattgaattcgttcataccttttccttttttaaaaaatg

SEQ ID NO: 109050 - DNA, 406 bp, Heterodera glycines
  Promoter: Source sequence=SeqID_18841; Location=1557..1962; Strand=-; Gene=SeqID_83534
tatgcttttaacattttttttgctttgtttttttgaaattcctcttacttaatttgttcacaataactcttatctctgagtaccacaatttccaagccatgaattctttgcaaaataaaaacaggttttaaattggtgtggttggtaattggtctcgctgatcagcaaatgttttgcctttggcaagagagttttattttgtaaatatttacgaaaattgctgaaaatttccttttttgtgtggaatgatttgttgttgtttttgattatttttgtgctattattttgccgggtgcgcatttgaactgccaatttcggtttgcctataaaagtccgcccaaggtgttgaatttctctctctcctcacatttaattgcctttaattaattgtcgacaattaaaaatg

SEQ ID NO: 109051 - DNA, 242 bp, Heterodera glycines
  misc_feature (87)..(87): n is a, c, g, or t
  Promoter: Source sequence=SeqID_2411; Location=1724..1965; Strand=-; Gene=SeqID_79595
aaaaggcgtcgaactgctgactcagcagtgctgatttgtgagtgaattgaaagtacgaggtatatataaagggcaaaatttttattntagtatcattcacacaattattttccttgtcttttgtggtccgcaatgcctcgacaataattcttctgtttctcaaattttcgcatccattttttccatcatcattttttttaaatttgtcggaattccaatttttcgtcctattttttgccatg

SEQ ID NO: 109052 - DNA, 107 bp, Heterodera glycines
  Promoter: Source sequence=SeqID_10531; Location=1412..1518; Strand=+; Gene=SeqID_73762
ttcccctctttttccattcccctctttttccattcccctctttttccatcaaaaaaattcaaatcgataattcccacaataattatcctcctcaattaactataatg

SEQ ID NO: 109053 - DNA, 160 bp, Heterodera glycines
  Promoter: Source sequence=SeqID_28554; Location=651..810; Strand=-; Gene=SeqID_46116
tttttttccagggatggaggatttcgatatattaaaacactatttgcttcaaaaaagggctccgataatcacttgttcttttttataatgattaattttatctgattagtcggcagaaaaaaaagacatttttctgctttcggcccaaatacgaataatg

SEQ ID NO: 109054 - DNA, 229 bp, Heterodera glycines
  Promoter: Source sequence=SeqID_3208; Location=885..1113; Strand=+; Gene=SeqID_83713
aacatttggttgcccaggactttcccaggggaaatcccggtcctagtttttcaaaattaaactatttaattataagacaggcgcagtgtgtgataatcaaaaagatttttgtccgtaattctgtccgggtccttcgggaatacgagccgggttgtctcaaaatgttgagctattaaagttattatgattcttgtgattgatttgatgcgcctcagttgcaattcacatg

SEQ ID NO: 109055 - DNA, 694 bp, Heterodera glycines
  Promoter: Source sequence=SeqID_6209; Location=1..694; Strand=+; Gene= SeqID_60723
tttaattcaaaaatttaattcaccgattttaaaaacttagtcttcactttttgtacagccaaaattaggcaattaattaataaagaaccatattttggaaaaaaatttggaccctttttgagtcgttttctttcttttgaatcttttttgttcataaaataattttattttatatttttgattttaaaaagcttttattttattttaaaattaattggatattgaagagtaaattttaaatgaaaaaacgatttactaatttttataatatttaaaacacttttagaattcgactgaagtccaaaatgaaactttttttataaagcaatttgcgccgcattgttgtaaatacagtgacccagaaaagttggaattcgttcatttttgctcaactaaattgacctttcgcttaagatttggcatttcaaagatcaaagagaaatatttaaaaattgaagtaattaatttaatttattaaatttatttttgtatttttaaaatttattaggcgccatatttacaatcgtacaaattctttgcaaatcgaagaatggaaattcgccaaattttccagtttggacataaactttgcaaaacggtggaccaatcaaaaaggaattatttgggttggcatttaaatttaattactaataaattaaattttaattaaaaataaataaaatttacagagatg

SEQ ID NO: 109056 - DNA, 335 bp, Heterodera glycines
  misc_feature (32)..(32): n is a, c, g, or t
  misc_feature (139)..(139): n is a, c, g, or t
  Promoter: Source sequence=SeqID_3038; Location=1..335; Strand=+; Gene= SeqID_82889
atttttggatctaatccgaaaactgatttttnttttattataacataaaattttatgagtgatttatttttaagacatacaaaattagatttattattttttgaaaaaattaatcctctaaatttaaaagttttgtatntaatttcaattcaaaaaaaaattttcttttttcataatacggtacttctgcttgaaattaaatggaattgaggggtcgccaatgccaacaggcgccgctagtgaaaattttttggaattagctgaaagtgtatgaaaaatgattcgttaacactcaaaactaaatgctttattgtataaaaatttttaaaaaaatg

SEQ ID NO: 109057 - DNA, 706 bp, Heterodera glycines
  Promoter: Source sequence=SeqID_3814; Location=361..1066; Strand=-; Gene=SeqID_51987
tttcgacatggaatttgtacaactttaataaaataaatactttttttaaatttttaattttattttttgcccattttacttttggtgttgccatgatgaatatttatttgttatttgtgtaaaaataacgaaaataattatatttttaattggaatgctgctaatggaattaaaatgaggtgattttgtttggggtttatttgccaagaaaataattgaaaaaatattttaattttttttaaatggtgcgtattagtgaacaattagcagtttattgataaaattcaattgctctaataaatatgtaaggaaggaaacaaatgaatttttgctgcttgctaatacaaaacaccatagcagacaaaatggcagagaaagcaaatgggaagagagagaaaaaatagtacagaacaaagaaaatagaggaaagaaaagaaaagatagagagagaaatttgagaaatattgtgagaagagagaaaaaaatatggcagagaaagcaaatgcacaaagaaagagaggaaatgggagaggaaagaaaagaaaagatagagagagaaatattgtgagaagagagaaaaaaatatggcagagaaagcatatgcacaaagaaagagaggaaatgagagaggaaagaaaaggaagatagagaaataatatgagaaaaagagaaaaaaaaatgaatgtgttattttgttacacaaatg

SEQ ID NO: 109058 - DNA, 74 bp, Heterodera glycines
  Promoter: Source sequence=SeqID_1721; Location=1..74; Strand=+; Gene =SeqID_75502
cttgacatgactttcccccggcctcggcccatttttatgcgtttggcggcggccctcgcatttgcattggcatg

SEQ ID NO: 109059 - DNA, 1003 bp, Heterodera glycines
  Promoter: Source sequence=SeqID_10391; Location=251..1253; Strand=+; Gene=SeqID_73584
agcaaattcaaaaacaatgatgtttataccggtgcatttgtatatttttgacagccctgaaataaaaacacaaattgagaattcatattttcggttgcgtattttcctttcatgttcgggatcgtaaatttccttactaagatccctattggtgagatttagtgattacctgctttatgagataaatatgttaaaaaagaattcccgaaggtatagattcaagtgattccgagaaattaaaaaattcgttaaatatcgtctacaataacattttacacgacgactattaaataataaaatcattgattgattgattgtatgtcgtcatattttagcaattagaattccttccgactacgcataatatataggtaatttgcattttttattttcattcattttataatattattaacacattaacaaaatggttttcatcaattttattgcaattttgccatttcttacaatcttttcggcagttgtgggagcagacaatttaattcagaatggtgggtacgaattcgattcgacacgatttgactgggttttaaaaagaaatagcattttctatttgtaaaatttaggtaacattaattataaatgattgaaaaagaaattgaaaaaataatctaggatctattaaaaatgagaatttttgtgcattatatttttgattttttttaaattttttgattttttaattttaaaataagatgatgatgagctccttgaactgttccaaaaatatgtgttgctgctcaaaaaatcggagccaattttggaaatggaaaaacaattatttaacattgaaacttacaatttcaaaaatgaatttttgctcaccgaaataatgaattttgcgctgaatttaaatgccaaaaatgagacgcaatttgctcggattattaacgaagcgacggccgatttgaccaatttgggattattattaacaaaaaaagaccaaaccgaggaggggcagcaaaacattgtggaaaaaatg

SEQ ID NO: 109060 - DNA, 178 bp, Heterodera glycines
  misc_feature (50)..(50): n is a, c, g, or t
  misc_feature (57)..(57): n is a, c, g, or t
  misc_feature (171)..(171): n is a, c, g, or t
  Promoter: Source sequence=SeqID_28149; Location=1..178; Strand=+; Gene=SeqID_58797
ttgggggtgggtcgcctataggaggaactagctccggcccaccccacgtngggtcgncaagtaaagaagaaatatcacacttttctctgacttctctacctcaagcgtaggattcctacactatcaacaacgacctgccccttatgggattgtggtcaacaacgacctgcnccttatg

SEQ ID NO: 109061 - DNA, 493 bp, Heterodera glycines
  Promoter: Source sequence=SeqID_38678; Location=590..1082; Strand=-; Gene=SeqID_67420
agtaattagcgaaataaataaaatgtttatcttgaaatgtgcccaaatggcacacccatgcaacatggatggcacggaattccgattttgacatttttaattgttaataaatttgtttaaaatgttttggttttcccccatgaagctgtatttttaaaaataactctggaaaaccaatttttttttgttggcaaagcgaatttgaacacctcttgtgccgtggcaccgcatgaactgccaccactgcacgagctggtgctagccggggcagccggttggacaggggcaacaggttgaacctgttttttgcataatgccaattttttttttaaatttatgattaatataatttctatccaacctgttgtttttgttgtccgcatgttccgctgctgcacgaactgccggtgctaatactggtgccaccaccacttgctgccggggcaacgggttgaacgggttgagcctaacgattttttgccgtatgaaaatg

SEQ ID NO: 109062 - DNA, 51 bp, Heterodera glycines
  Promoter: Source sequence=SeqID_15368; Location=806..856; Strand=+; Gene=SeqID_47292
ggtccgatttattcttttgtattccaaaccaattttcagtttttaggcatg

SEQ ID NO: 109063 - DNA, 491 bp, Heterodera glycines
  Promoter: Source sequence=SeqID_8469; Location=2526..3016; Strand=+; Gene=SeqID_68183
tatcccaatggggaattgaacccaaaggacagacaacgaaagaaagaaggcttaaccaccagacacatatatgtgtccttcattaacagaaatgaatttattaatttaatttttctcaaataaattatatattacggaaatctacgctgtttttggacccgtgtaataatgttatcccaaatttaaatctagtaaaatccagactgctatcgaaacaaccggcccctaccttttcagaaatttaaaaacattaaaaataaaaattttcccctatcttaatcctgtgacgcttaaataaatgttgatttatattacggatgccaataatacgcacatgaatattttttccaaatttatgtgcatatttgggaattttttcaaaaaatcttattacattaaaacggccccctctgttaaagactttttgacctctaaggatcgaaaaattttcattattttgggtattttcagcaaaaaatttaatagaaatg

SEQ ID NO: 109064 - DNA, 891 bp, Heterodera glycines
  Promoter: Source sequence=SeqID_6473; Location=4015..4905; Strand=-; Gene=SeqID_61720
cctggcagggtctcaaaaaatggtggttaatggactctcggaaccaatttattatacaactttggctgatattttacaacaaattacgttttaaatatttttgaaaatttcgattcaataagatgattccctaggtatacgtatagtgaaaatataatttatccaaaaattctattttaaaaaataaaatgaaataatagtgaagaattgatttgcccattagtgaaacattgacttaaagataaattaatagtgaggaattgatttacccaataaatatataaaagaataattatagtgaaatacacttgttcatgccatttcaaaagatctaagaaatgaaaaaatttcccaaaagttaattccctaaaatataatttttttttgataaattttgattttcatttgttatattatttcatttacaattgaaatataatcaaaattacgttttaattaattttttttatgtattttggaacataaaatcatttacaaaaattttatttgcctatttttagtgcctacttaatgcctattttgcgattgtttcttctgcctttttaggttccagtattgccgtttttgtgcctaagaattgaaaaccgaatttcggcaagagaaatagaaaaatgcctaggtacttaataggtataaaaactgcaaaattctgtacttactgaattagaccccctcgaataaatacccccttttgagtggggtcgaaaaataaagcccccagggactcgatttcagtaaaacggtaggtattatatatggtagtggatggttcgcccgagtgtcgacaatttgattaattagaaaacttcctccattagtaatgaatcattttcaaattgataattccagctaaatattgaataaaagatg

SEQ ID NO: 109065 - DNA, 367 bp, Heterodera glycines
  Promoter: Source sequence=SeqID_31738; Location=1..367; Strand=+; Gene=SeqID_62045
caaaatgagcaaagaatgcaaatattgtggtgtggtttgggatttgcgtaataatacccaaaatggaagagaggacttaaacaaaaaatatatttctcagtaatgaaattattatttagggtcacaaatgcaatgagcgatggtgcgaaaattgtcaaattttccacgaattcaaacgggggtgtttcattcgaccgctggagttaagcccaaagaacgaagcacgggtgtggagattagtcattttcgaccttgaggcaatgcagcacgaaccagtggatccacaaatccctgagcgacggaaacattaagtcaactttgtcaccgcaaaagttgcttgtcctgactgcatttcaaatggacaatg

SEQ ID NO: 109066 - DNA, 518 bp, Heterodera glycines
  Promoter: Source sequence=SeqID_27834; Location=313..830; Strand=-; Gene=SeqID_58513
tgccgtcgttgtcccgtcaattggcgaaatgtgagaaattgcgcaaaatttgtcacgcacaacaaattcaaacacgcgcaccggcagcgccatcacacacagacagagcagaaagaagcaaaagttgcggaacagctgaacaaagtgaatgtgattcagaattttttttgaaattttctaattgttgtttcaagaaaaaatttttttcgaaaaaacgtaaactcatcataaaattttgaaaaaacgcaaaaaaaaactttcaaaaaatgttttcttaaaaaattagttcgaatttttttgaaaaattttcgacggaaacgactcgttccggaaatagaaatgatgggtggtttggtcagcaaaacatttcagtaacatttctacattaaaatagaatgataaaagtttggagacataaacggttttgaaatttgaattaaaaccgaactcgtttggccaagtgtcgagaccattcccgaaactcgggctgtccatcggacggcgaagcgcaaagaatg

SEQ ID NO: 109067 - DNA, 418 bp, Heterodera glycines
  Promoter: Source sequence=SeqID_16221; Location=549..966; Strand=+; Gene=SeqID_80595
tacgacgtcaagcaaattttccgcttgaacacttcagaagagatcatcaagtcaatgttgttctcaaaagtgttcagctctcatctggaattaaaattcacccatcctttattttgcccggaaattcacctttccgatggcaccctgacatcattcgtcccaatggttcatttgttatttctcgcatttatatttgatggtttaaaataagctctgcggagctactctacatatatatatattcacacaaatttgtctaagctctgcggagctgattaaattaaataaacacaaaaaaaaaacacaacaagtgagaaatgattattaaagggaaaagttcaatacataaattaaaaaaaaaataataataataataataatatttaaattaaataaatgaatgtagtattggtatatg

SEQ ID NO: 109068 - DNA, 92 bp, Heterodera glycines
  Promoter: Source sequence=SeqID_7443; Location=3177..3268; Strand=-; Gene=SeqID_64841
ggtaaggcggccggctttccctctttttttaatcatgagtttaaggatgtacgtggcacggatgtaagaaatgttacccaaatgacaacatg

SEQ ID NO: 109069 - DNA, 591 bp, Heterodera glycines
  Promoter: Source sequence=SeqID_18621; Location=396..986; Strand=-; Gene=SeqID_83274
ttccgtgccgtctttaatggcatttgaccccacaaaattgcgacgacttctgccaattcgggtaaaaagggcaatcatttgtttttctcgcattattttaattggataattcagttcaaaatttataaatttgaatattttatcatcgttctgtgataggaatgtttttgtcgccactttctgtcatttagtaaattcgttttcattcattcgaattggcattggtgacaatgacaaatgtccacagccaacgaacgctacttgcttataattaatttaataaacaccgccactaatttatcatttcatttcctttcggtggacatgccaccgtttaattcccatgggcttttttggtcattttggaatatgagcgaccaaaaaattattaattaatccgaacaaatgacaaaaaaaacggaaaataccgaaaagaaattttatagggaaaacagaaaatggcaaaagggcgaaaaggcggcaaaaagcaaaagaaaaaaagtgcgataaattggccctttaggaatttttgagcgacgatcaattggcattcgaacgcgcaattcggcaacccgcgggcggcgtcaaatg

SEQ ID NO: 109070 - DNA, 271 bp, Heterodera glycines
  Promoter: Source sequence=SeqID_487; Location=5191..5461; Strand=-; Gene=SeqID_54142
tctggaatgatgtgtcggataagcactctgccttataaagctgtcgttctgcccaggtttctcctaaccaggttgaacttgtaatgagcctttgggtatctggtcggggtctgcgcggagatagctcgtgaggagctgttattacattattggttgaacgcttttgggtcgtactgcacagataaatatgagaaaaagttttttacaacatatacctgagctttcaagtcatattgctatgtctgtgcctgcgagaaattatcccaaaatg

SEQ ID NO: 109071 - DNA, 564 bp, Heterodera glycines
  Promoter: Source sequence=SeqID_25072; Location=1164..1727; Strand=+; Gene=SeqID_55802
ggacatttcattcattcccttccaaaatcaattcaatttctgctgatcagagagcaaattggcgaaagcatcttttaaattaatttatatttatcgtcggtgacgaggaatgctttaataatgtgttttttgttgcagatgaaaatttgtagacaatcacgacgagattagcgacattaaaatgtgttgggttgcatgaatgggaggagaagactaatgaaagaacggacacacactgaactgatcagaggtgaattaaatgagaaacggcggagagcggtgatcagaggagggcactcatttgcatttgattctcgaagtcagtcgagtcgagaagggaatttggacacctaaaacaaaaagcggaaaattggaagaaatctcgactcgaaaaagctcaacaaaaagtgcacagaaaatgggggaggggggaaactaacggaagcgacgattagtgttctaattactcaaatttgaataaatttgaacagtcattggcgtgaacagagaaagaaaggcccacacaaagcgaaagaagtgcaaaagtaacagaacggtgaaatg

SEQ ID NO: 109072 - DNA, 1003 bp, Heterodera glycines
  Promoter: Source sequence=SeqID_5687; Location=2027..3029; Strand=+; Gene=SeqID_58909
aaattggctattttttcttgtgcctttttaggatttaacgagttttaattatatatatataaagtaaatcaattgattccgctgattctgagctaaagccccgcttatgactagcaattaccgcatcccatttttaaaaatatggtttcactaattgccaaattttatgatgtcttttccgtcatgtccgtatgaacggagtttgccattctgtccaaaatgcaccaagaagtttggcattttggtcaataaaaatggcatctcaatggatacctgttctgtcgagcatcccaataatccccgttccccgtcaattggcaggacctgctcactttatgcacattcgctgcacatggcactcggagcacccgaagaaagcacttggcccctgggacaattggtgaaaaacgtggacttggaccattacgagaacacctgtctgactggtcagtcagtccatttgccgttttggcattttccgaaacattttggcactctgtaagcattggaccgatgcggaagccgtcacctggcctttgttctaatccgaaatgccgaactcgcgggcttctcggtcggtctgggcaaaatgtccgtcagcgagtgcctttcccgctgtttggactcgccgcccgccttttgccgtgccgtccaattccgaacaccgggcaatgagtgctttttgggcacggagcgcccattcgcgccgctgccatccgacgacatggacatcttcgagcccgtctgtctgccggacccgccgcgcacatcaattttggagtgccacggcgaacacgtgttcgaacgggtgggccatcgaacagccaatttggggaaatgttttgagcgtgaccaattactgactttgtgatcacatttcagaaacttaaacgactatcgatcagttttaatcacttttaaataacggaaggattttttgtgctattttgaaatgcgaatattgctttcaaaatattaaaatgaaaagcaggtgccaaacatg

SEQ ID NO: 109073 - DNA, 229 bp, Heterodera glycines
  Promoter: Source sequence=SeqID_34019; Location=1..229; Strand=+; Gene=SeqID_63916
ggagcaagaacgacaacgcaccctggtcttctcccccaaggcggaaagcaatgccattcgcccatcggaacgtcttcaggaagacagggaagccgccacaaaaatcctggaccatcttgaagttgaggcccaaccaaccgccgtctttcgactcggacgttacgacccgcagcgaacaacaccacgcccgctcaaggtggtcatgccaacaaccacacaccaacacatg

SEQ ID NO: 109074 - DNA, 766 bp, Heterodera glycines
  Promoter: Source sequence=SeqID_20986; Location=1..766; Strand=+; Gene=SeqID_51562
attgtgccattacaaatttttaccgtttttaaatactcccaaaaaattagacaaataacagatattttttggtaaaatgtcttttctggatcataataatacaaatgattcaaaataatctcactttctttccacaaacaaatacaacaaattgaatgaaaggtattcttacgagatcaaaaaaggaactcaaacaaattaaaaaataaaataataaaaaataaaacattaaaatgtaaaataaaaataggggtttttaaatttaaacttaatttaaattttttgtaaatgaccaattcgctatttaaaattgctcattcgcctaacgttcataagaattgtcttattattatttaaaatatgtaaacatatgatcaattcttattaatagcttttttattgatatatcttataaattggtgcatttgatataaacatttcatacatttaatatactaaaaaagattttgcattttattgtttattttttgtttatctaaatttcgttgtttaatttgaaaaaatcatagtgatttgatcccgacagggcacgatttttccaaaacccttcctgattttcttatagaaatttcattattttatttattttatatttttaagtttgaattctcatcacggaatttgctaataatacaaggaataataatggtagggggagacagcattaattaataattatgcacttgatatgttaatacacaaaatttaaaaataattttaaattttagactgttaaaattgtatg

SEQ ID NO: 109075 - DNA, 507 bp, Heterodera glycines
  Promoter: Source sequence=SeqID_36673; Location=401..907; Strand=-; Gene=SeqID_65932
aaacagacttttccagtccagtagttcttaaatcatacatttttataagatatcaaattcgattccactcggtctcagctctgctggaggcaaattgggaagagaaataaaaggatgatgtcccccctcccccatttttaaaaaaaactattgaaaatgcttccaagaattttcgaagttgctgattaagaggccggcataaattcagaaaactctgcgctcgaattcggaaaataaactaaaaatttcgcattttttaaaccggtttaaaatagacggaaagattttatgaaacaaaaaatggaaaaggtcgaagaatataaaatattgaaaaccaataaacgttgtaaaaagtttctgttcattttcagtgattataaaaatttaaagtgtttcgtttgttgtttagaaagggatttttcaaagacaattaattacctaatttggcatttattctggcatcaatcaattggaaaacggaaaattgtgataatttcagcaaaaatg

SEQ ID NO: 109076 - DNA, 413 bp, Heterodera glycines
  misc_feature (28)..(28): n is a, c, g, or t
  misc_feature (70)..(70): n is a, c, g, or t
  Promoter: Source sequence=SeqID_11894; Location=1..413; Strand=+; Gene=SeqID_75406
aacccatgtaatgtttgaatgattaatnagttgcgctaacccacctaggtctctctctgtgtttttgggnttttcataaataattaatgagccagttaaagcccaatttgctggaattaacacaccggccgatttttcggccgaaaggtcacactgccaacgaaatttttattttcactaatattttcttgcttttttcaatttaaaaaactttgcgcgtcctttttcatttttcaattggttctacccaaaaggtttgcctataaattgggctgtgatggctcagaaaggcattaccaatcggcttcttcttctgctcacttccctcctaatttggtaaattaaatattcaatcgctttccctcattttggctttaatttgtccattttcagtgcttccctttgtccaaatg

SEQ ID NO: 109077 - DNA, 150 bp, Heterodera glycines
  Promoter: Source sequence=SeqID_31842; Location=680..829; Strand=+; Gene=SeqID_62153
gcgaaaagactgcgagaaaaaggctacaacagggaagtggtattgcattaggggcaatattagtacctattcttggtgcactagctcaacacttggtcgaaaaaattacggcctgacaatagcgagtcaatgaaatatacaaaaaagatg

SEQ ID NO: 109078 - DNA, 130 bp, Heterodera glycines
  Promoter: Source sequence=SeqID_37958; Location=727..856; Strand=-; Gene=SeqID_66921
ttgccaaggaaatgtgcggttggaaaagtaatgggctgtgggagagcgggaaaacatatggccaaaagggtaaaagaagtttaataatggcccaattgggggaggacaacaaggaaagggacgggggatg

SEQ ID NO: 109079 - DNA, 499 bp, Heterodera glycines
  Promoter: Source sequence=SeqID_1155; Location=1..499; Strand=+; Gene= SeqID_68976
ttgtatctttcatctgaattgtcgttaattagtctctccccagttttcgatatatttaccatttatcttaaatctaaaaaataaaaatttcagaatggaataaaaatctaacctgtatttgtactatctaattctaaaacttttttttacctgatttgtttgttatatttaatgctaaacaacatttctttatatttttatttaaaaaatttcttcataaacgacatatcctaacgacaaatatatcgttaatagttttcaaaaagggccccagatcaagacatatctctactaatgatccatttcataatgaattaatttgctaattaattaattatccaattaaaccaaagttcagttccaactgatgtgttgacaacggaaaagtgatcagcatttatcagcattattcccatccaaatttaagtgatgtccctgggcttttcccattgaaatttcccacgcaacggcggtacaaaaaggagaaacaattgagatg

SEQ ID NO: 109080 - DNA, 371 bp, Heterodera glycines
  Promoter: Source sequence=SeqID_14812; Location=1124..1494; Strand=-; Gene=SeqID_78962
tttcgcctactcgacatttcgcctactaagccaaaaacattcatttcgcctactaacccaaaaccggacatttcgcctactgtcatttcgcctactattcatttcgcctactgacatttcgcctactatttatttcgcctaccaaaccaaaaacattcatttcgcctaccaaaccaaaaacattcatttcgcctactaagccagaaacattcatttcgcctattggaaatacataatgccaatgagaaaataaaaagagagaatatacaatatctataatgtttttgcatcaaataaatcattcatttcatttttatgtcatttcaaattttcttcaaaaacaaagaaatttcagattctaataagaaatg

SEQ ID NO: 109081 - DNA, 317 bp, Heterodera glycines
  Promoter: Source sequence=SeqID_3727; Location=7094..7410; Strand=-; Gene=SeqID_51644
cctgcataaaaaatgagatgattaatttaagaatgaatcaagaaatttggaaagcgttcgttttcactcgcccacatatcttttaaactcgaaaaaaaaatttaaaattttttgtttaaaaatttaaaaaaaaaatgaaactagcgatttttccaaaaatatcttctagaattttcttaaaaataacgtagcgcaacatgaaatttcatcataaaaattgacaattgttcgtttggttggccgagtttttaggatcaaagttattttttgtattctcttacaaatggttaacctgaaatccgatgtcgaacacaatg

SEQ ID NO: 109082 - DNA, 542 bp, Heterodera glycines
  Promoter: Source sequence=SeqID_5116; Location=420..961; Strand=-; Gene=SeqID_56974
tcctgctccaagtcgtcgaccagcagcagccaaaaaagtgccggcattgttttcccaagaaaattttattagtattctcaactctagacattagcaatgatcttttttttatattagatgatcattcttgacattagcacattgatcaatcttcttatttatattgatcaattttggaataagcaatgatcaagcaagttttccattagaattgatcattttttgagaagaactgacaattagcattaatcaaattcctttagcagtgatcaatcactcttaccaccaacacactgatcaatcttgtaattttcattgaccaatttttgaattaagcattgatagagcactttctattgtgccattcgtgactctgatcactcaatcatttatcacccctcctccattcagcagatggtgctgccttcaattttgatcgcatcatttacggtccaattgatcaaatcactgacaaagaggatgaattattttatgacgaaaataatgaaactgatcagagagccaaaattgggccaatgatg

SEQ ID NO: 109083 - DNA, 93 bp, Heterodera glycines
  Promoter: Source sequence=SeqID_29288; Location=1057..1149; Strand=-; Gene=SeqID_59810
aaatgctctcgaccttgataggaagtgcggcgagcaatcgcacatttaatttcacagagcattttttaatttatgttatatgcaagaaaaatg

SEQ ID NO: 109084 - DNA, 72 bp, Heterodera glycines
  Promoter: Source sequence=SeqID_17133; Location=911..982; Strand=-; Gene=SeqID_81569
tagttggtttcttaaccttagattagttttgagacaaaaaagaaaaggaaagaaatgagaaattgaaaaatg

SEQ ID NO: 109085 - DNA, 447 bp, Heterodera glycines
  Promoter: Source sequence=SeqID_45515; Location=229..675; Strand=+; Gene=SeqID_72794
tcaccaacgagggcacaattcagtaattagtggagaaaatcgcgaatttttgaaccaattgcatgccgatcagttgaaacggttgttgagcccacaacagaggacagataatgataatgataatactgatgaacagaaacaaactgatggtgaagcaaaacaaaataatgaactgagagataaaatcgtgaagcaaattgaatccggtctaaattaacagaatcatatttttttaattattaattaataatttaaatagattttaatttttgaaaatgagctaagaaaagagattgtccagcaaattcgaaatttgtttacttataaaaattttttaattttttaacaaatttgtcgttaatttgcagagttaactcacttctcagttaatttaattttaaaaaatttaaaactaatttgtctgtgttaattataggtataactatg

SEQ ID NO: 109086 - DNA, 176 bp, Heterodera glycines
  Promoter: Source sequence=SeqID_9197; Location=940..1115; Strand=-; Gene=SeqID_70564
tttttgttcgtcgctcctctctcttgctctcccttttttgccttgctcttttgcaattgagcttgtgtggcaaatttcttttagccattaaacaattaaaaatgtcaaaaaatctaaaataagttttaataaaaaataagatggaaaattattaaaaccttatagaacattcgatg

SEQ ID NO: 109087 - DNA, 399 bp, Heterodera glycines
  Promoter: Source sequence=SeqID_32014; Location=1..399; Strand=+; Gene=SeqID_62328
agccgaagcaagaaacgagcccagtttttagaagcacgaagcttgaagttttaaaacataaccccacagcgaccaaatttgaagattcaaatagaagcttcttattttaagttttacactttacatattttggattttttcttgttgtatttttctatttttttattaaaatagaaaggatttggcgatgccaccataaatataatctaagatttagattttaaatgttaaatttaattcatatttttgcttctaaatatttaatagtaataaaccgaaggcaaattttcgttaaatgattaaattaaaatattttctaattgtaccaattttattttaattagataaattatttttaaattattttaaaaaatatgtaatataatacatcattaaatg

SEQ ID NO: 109088 - DNA, 337 bp, Heterodera glycines
  Promoter: Source sequence=SeqID_3875; Location=585..921; Strand=+; Gene=SeqID_45668
ggtcttccaaacggcgccggagggggcgttggcattgcgggatgtttgagcgggcaaaacggcggcagtggcacatttttgagacgcaaaagtatcgttgtataacacagagtaaaagtggacttcttcggttcagtgcacactccgttgattaggggcggccctttctgttacgggacgcaccagcggaacggcgcgggcgctgccgtaatggtaaattaatggacatatcagtgtcaatttcgctgactaattcactttctgataggtccccgcttcgcacggcaacggacaccttcccctccgtgtccccttgaggtcagaaaacagccgaatg

SEQ ID NO: 109089 - DNA, 142 bp, Heterodera glycines
  Promoter: Source sequence=SeqID_31190; Location=1154..1295; Strand=-; Gene=SeqID_61563
gcttgaaaaggccattgaagcgaagcgcaaatttattgaaaaaagtgcaaaaaatgaaattgcagaaaaaaacaattggaaaaaatttaatggaaaatggaaggaatttgtcggcataaaattggacaaattcgaaacgatg

SEQ ID NO: 109090 - DNA, 542 bp, Heterodera glycines
  Promoter: Source sequence=SeqID_15039; Location=85..626; Strand=+; Gene=SeqID_79213
ttactctctctttggaggaaggcaaatcaacacttttttaaaattagttttttgaggagaattgccattacttttgtacccaaaatctcaatatatatcccactcaatttgggtcattctgctcatttgtaagtgccattgttttatgcccttgcaattcccttcccaataataatttcactgacccatccaaaatgctctgagattgtttgttataatattgatccaatcattcccacggtttatgctgcgttttattttttccattcgttttcttataataagtccttctcctagaaaggggtaattccaaataatctaaagccttaaatccggaggtttgatgggtcggcaacaataaaatctatttgcacaaataattttaataaacaattattatgtaatatttttgttttgctttattctataaaaagtcaatttttaaacaaaaatacatgtttatttttgcttaattatatttaatttcctagtctttaaagaataaattctgctcctctattataagcattactattgctatg

SEQ ID NO: 109091 - DNA, 672 bp, Heterodera glycines
  Promoter: Source sequence=SeqID_16931; Location=2144..2815; Strand=-; Gene=SeqID_81362
tcatttaatctccatttattccaatccattttttcccattttttttaaaaattgcataaagaaaatttgctcatttattagtaaattgtttttgatttaaatacataaatatttttgagacaattttaaacaaaactttttaacagtttttgtccaaaaatggttgaaaaatttaactattctcggcggtacgaaaagagtagtcgagataccttttttattctaatttgacaacttttttaaaattacgaaatggttaaatttggaacctttgatataaattttttgaaaattctattcgcaattggttcgattgtgccgatatgaactataatttttggcaaccttatgcaatttattagaaaattcttggcgctatatggaaagtcaccatttttgttcaatgggggtttttggggtccatgatctcgaattagatgtcagattcgtgatcagcaacctctaaaagcccggataacataattttcatggttttttatcacaaaaaaattttgcaaaacaaaaggcccccccctccctttactttttgataaaattcaaaagtggtgactttccatatagcgacaaattctttgtatggaaagaaatttttttaggaaaatttatttatttttttattaatgatctttttataggaaataaaaaaatatg

SEQ ID NO: 109092 - DNA, 56 bp, Heterodera glycines
  Promoter: Source sequence=SeqID_5439; Location=6792..6847; Strand=-; Gene=SeqID_58047
ccgaaatttatgaccccaaaaatgccatgagctgaataataacgaatattggaatg

SEQ ID NO: 109093 - DNA, 122 bp, Heterodera glycines
  Promoter: Source sequence=SeqID_2601; Location=650..771; Strand=-; Gene=SeqID_80663
ggtaaaacaaattgcaatcagtgatcagtccaatcaatcaatgctcatcataccgtaataatttcataccgtaccgtaccctaaccaatgaaagctgttaattccggctttagcaagtgatg

SEQ ID NO: 109094 - DNA, 301 bp, Heterodera glycines
  Promoter: Source sequence=SeqID_16221; Location=2245..2545; Strand=+; Gene=SeqID_80596
aattttgtgaaaataaatatttaagtataatgtaaatttagctccaaaagtgccgccggtgctcagagcgtttctctccaattgctcaacgtcgaccgtttcattttccaatcgccacgttccgccgaattagcccttctgatcaaccaaatgctgcatcatttacgccagaaatcgctgtacgccattgcgttgcaaaattcatgtcccgaaaacggtaattaccatattttacgaagtgcgaaagtctcccgcttgtggtttcgtgtcagtgtctttggccatttccccgctgacaatg

SEQ ID NO: 109095 - DNA, 847 bp, Heterodera glycines
  Promoter: Source sequence=SeqID_9633; Location=889..1735; Strand=+; Gene=SeqID_72140
atttttagttggtcatgattgttgatgacttttatagtttgaaaatttacaaaaatatttagtcgaaactctaaaaagtcattttttattcttttaaaatgcaactaaattttttcctaattttacataaaaagatttttttcgaaagttggttcttatgagcaacagattgtgaaaccaaattaaacaaaactatttataaaataaatcttgattaaatcaattgactcttttaaaacagtctatgtttgtggacaagttcatcacttttttagaaaaaactttggggaaaatgggaaaggtccagtggtgggggacgggacataatttcgccgccgaaatttcgccggccgaaatttcgccgggacaaaatttcgccgcaaaagatccaaattaataaaaaaaaaaaaaattcgttcgcttcccagcaacaatacagagaagattagcatggcccctgcgcaaggatgacacgcaaattcgtgaagcgttccaaattttttgggcgcgtcctgcgctttgttcataggtttaattacccaagtttgagatcgcattgagtttgagaacacaaattattcaatgtcgcagtcctctgattctctattccccagaacttcttcactcttaaccaacccaaataagcgccttgccaacatcaccccgccacagacaaaaaaacaacatctctctgataaactggcggcggcacaaacaatcatcggtggacttcaacttggacagtcggacggtgcacctcaatgggccaactccctccttggcttctgtgctgagatggtgggaatctgccgcgagcttctctccatggtcaaagagcagcagaatg

SEQ ID NO: 109096 - DNA, 407 bp, Heterodera glycines
  misc_feature (307)..(307): n is a, c, g, or t
  Promoter: Source sequence=SeqID_9511; Location=991..1397; Strand=-; Gene=SeqID_71701
tgtaaagaagccatacccaaattcataacacaaagataccaaaaatgaaaaaaagtcataataaaagattaaaaatttcaaaatattaattgtttctaaaactaaaaatttcgtccataattgtcgataattttttataccgcataatttttgggattttttagttcctgttacaattcattcccattttggacatggacgacaaactttttttttattacaaaatttaattaatttcgcaaatctcattttcttaataaattttattcatttatttttttagtgtatatttttttatctaaaagtntaaggaacatttcacaacaattagtgaagaagaattttttgaacatgtaaaaaagtgcaacgaaaagaaggaatattccgcagatatagcgcaaaaaatg

SEQ ID NO: 109097 - DNA, 1003 bp, Heterodera glycines
  Promoter: Source sequence=SeqID_21966; Location=300..1302; Strand=-; Gene=SeqID_52596
tttggtcttggtctcgattttcgtgactcgagaccgagactttttcacacccctaatgcttggcttttttgtaaatctaaaattaattttttgttaactttttgcttaacttttttaattcatatccgtgggctagtgggttatgctcctggttatgttcttcatttttgctttagatcagttccgcttcataagaaaattttttcgaaaaagtctcggggttttttggtctcggggctttgggtctcgctctcgagtctcggtctcgggaaattttaggtctcggacagcattagtttttatatagcgactcagcaccattccgacctctaaaattattaaattgttgaaagttagatttgttgttgattaataaattcacaaatggcaaaattattatgcgaatttatttgttttatctagggagtccaaaaatatggatataaaatcgcgaaatatggccataaaatggtaaaatatggacataatttttttcaaatagagggtataatttctctaaattttttcaaattcgtaaacgcaaagtaaacccttcaaaaatggcaaaatattgtattaaaatcattttagaagaaaaaaacacgatgcagcttaaaatttactaatttcagcggaaaatcaacctgaaaagcgaaattttcccttttttgcttatttttgacataaattaaccaatttttaagaaaatttaaatttaatcaatattttcgacaaattttgaaaaagtgtctttttcggaaatttcttcggtcttaagggttcaaaaaggccaatttacccgatgggggccgttctaatagggggtttttggaaaaataccaaaatatggacataacatatggacttaaatgccaaaatatggacataaatcgcgaaatttggaaaaatatggatatagaaatccatcctagaagcttcaaacaaagctaaaaacatgtttttcatgcgtttcaggcctcccacagtccaggaaaaaaatatg

SEQ ID NO: 109098 - DNA, 593 bp, Heterodera glycines
  misc_feature (4)..(4): n is a, c, g, or t
  Promoter: Source sequence=SeqID_13140; Location=1..593; Strand=+; Gene=SeqID_76944
cttnaaattttgcatagcgatagagaaaaattttctgcatcgaataatatagattttgcaaaaataaggctcactaaaaagttatccaaaaaaacaattttcgaacgctcttatctttttctaaatcgttaaaccgcttaacattgctttagaaaaagcttctcctcatcaagagctttcgaatgataccaagattgtccaatttggttggcgaaaaccttcaaaaataacaaatcttttttggtacaacagctcagtttccggacggtgtgcttagaaaatattttctcttcacgagtgacgagtctacgaatgacaccaacattgtctaatttagttgccaaaaattcaaaattttttttttattgcaaatcgctattttttgacgaaaaataaataaaaagttactgtcatgtgtcgaattcgaactccaactcccgcccttttccctttattatgtatcttataaaaaccaatgattgcgcgagccactcaatgcaaatccttaatattgatacaggagttcatttttgtcaaactagtaaaatatacctaaatttttcaggtaatgtattaaccaaagcttaaaaatg

SEQ ID NO: 109099 - DNA, 122 bp, Heterodera glycines
  Promoter: Source sequence=SeqID_7116; Location=1..122; Strand=+; Gene= SeqID_63883
gagattttgaaaattgattttcaaaatatttttagtagagatcgacattttgaaaaaagcctggacctggatttcctgaataaaaatccaggtccaggaaaaatccaggttgccgaaaaatg

SEQ ID NO: 109100 - DNA, 130 bp, Heterodera glycines
  Promoter: Source sequence=SeqID_8000; Location=2739..2868; Strand=-; Gene=SeqID_46524
atttttcaaaaaatactctaatttcatcccattcaaacaaaaaatttaaaattgtcaaattaacaaatcatttaataaatgtttaaatatatctttaaatataatttaggtgttggccaagcctggcatg

SEQ ID NO: 109101 - DNA, 587 bp, Heterodera glycines
  Promoter: Source sequence=SeqID_32157; Location=1..587; Strand=+; Gene=SeqID_62489
aacgacatgtcgggggtcgggtcgggggattggtccaaaaaacgtctcgggtcgggtcgggggccggggggctcggggtcggggcttaaccctaatacaaagaaccaaattttgtaaattttcaaggaaaaaaatgatttatatggtcgagcagcgccgacaggcgccgctggggaaaaattggaaaatttggccatatttcttaacatatttccacaaaaattgccaattattgggtcaaattttgtaaattttaagcaattttgtaccaaactaaaagaaataagcaaaaaataagaacccatgttgcgcaataaaatggaattttataaaataaatttttgaaatatataaattttggaaaaatagttcggttcttttacaattttactagaaatttttctttaataaaaattcttctcaagtgatgatatttatactttaattggtaggccgtcccatttttgaaaaaaaaatttcaaatttcttctgacggcgcctaccgatactccggtccaaaaaatcatttatttatttttttaaatgttaacaacgaaaaatctttcgtgagaatttccttaatcatg

SEQ ID NO: 109102 - DNA, 776 bp, Heterodera glycines
  Promoter: Source sequence=SeqID_1371; Location=2390..3165; Strand=+; Gene=SeqID_73091
gtcaacaataacaacagataataataggacagctaataaaagacaactcggactggctatgtgctttggcgagagtccggctagctatcctttgaggataggccgcagtgaattaagccttatgaaagcatgagatatgaaaatgttgagaaaatgcaaaaacatatgacaattcagcgtcccgggccaaccgaactccataggcacaggagtccggctagctatcctttgaggataggccgcggtgaattaagccatatgaatacatgagatatgaaaaggtttgagaaaaatgcaaaaacatgtgccaattcagcttcccgggccaaccgaactccataggcacaggagtccggctagctatcctttgaggataggccgcggtgaattaagccatatgaatgcatgagatatgaaaatgttaagaaaatgcaaaaacatatgacaattcagcgttccgggccaaccgaactccatagacacaggagtccggctagctatcctttgaggataggccgcataaaaaagcaccaaaagaaatgagaaattttagaattgatcgagactgatgaataataataataataataaattgactcaataaaatgagaaattacgaggcaaaaacgccccatcatccgctgtcgacagaggcggattaatttgcctttggaaaattacataaaaaagaatgaattcatatataaaaaataaagaattcattcaattattatctaaataaataaattcaattataataataatttagcattatg

SEQ ID NO: 109103 - DNA, 421 bp, Heterodera glycines
  Promoter: Source sequence=SeqID_23395; Location=1600..2020; Strand=-; Gene=SeqID_54099
ttttcaaaatggttaagctttcaaacatttggaaaaattttcgtgggggacatcagaaattatttctgtcaatttgttatggtgtgtttgcttgagcaattctgtgccatttatgaaaagagtatttcttgcttttggccttatggacaaatgttccatttttgcaagtttcatttgtaatatttgatcatttccaatatctcccagcatttgtctctttcacgcttttgtccatgttttgaacacagacgatgcctttcactcactcagaattaaatttttaataaatcagattctcgacttacaattagctgtttagaaagtttgacaacacactcattatgggattttaaatttgctaatttaacacatattttcgcaattttgttcctttcggaaatgtcgtctgggggcgaccatg

SEQ ID NO: 109104 - DNA, 1003 bp, Heterodera glycines
  Promoter: Source sequence=SeqID_3149; Location=2419..3421; Strand=-; Gene=SeqID_83421
agccaaaatccgatgcatttttgtgtatacgccgcccccaccctcccaccacacacttttccatccgatgcatccgtctgatgcggaaaagcaatcatttggctttatctatctatgtgctcaacatttattgatcaaaactgaggggggaagggggcggggcgttgcaaaaacattaagagaaatgccgaacttaaattactaattttaaatcaaaattgttattttccattttttttcgtactttcagcttgaattttgtttttctttctattttatttacacagcggcccaattttgggctccaagtacaattatgctggatttttcgtcttagtggtctgtgagttagtcaccaaaaggggggtcccaggttcaagtcctccctatgttgtgtgttaatttcaatttcttcttttaaagtcaatttcttcttttaaagaagaaggcagaattattttttcattaataaaagttttcgtggcaataaaaaatcatattcaaaaagcgttggttacgtacaacatcgacaattttatgaaatttttttagcttataacttggtgaatactagagcaaataaaaccattttatgctcattttgaagggaaaattctggagaatattgtaaattttatttggtttggccttaaattgtggacttggctaaaaaagaattaaaattattgaaatttttgccctgggaaaaaattttttcctgtgggtaacttttttttgaaattttgtataggcccatattttggccccctctagcgaatcacagtttattttttagctgtctagtttttaactcgagatcggctcttctatttttacaagggaaaatccccaaaaaattttaagttttgcaaagttttggcgttctgattactaaataaataataaacctatatgcactgagagcacaaaattgggccgctgtgtttaataattcattttaggataataattattcaaaatccatttccgtttataatccatg

SEQ ID NO: 109105 - DNA, 108 bp, Heterodera glycines
  misc_feature (25)..(25): n is a, c, g, or t
  misc_feature (64)..(64): n is a, c, g, or t
  Promoter: Source sequence=SeqID_695; Location=3068..3175; Strand=-; Gene=SeqID_59129
aaattgcttggcatcgcggctcttncaggctttttgataatggcagtcatttttccgctctctntcatctcttccttttttactcgcacttggctgaccacacaaatg

SEQ ID NO: 109106 - DNA, 62 bp, Heterodera glycines
  Promoter: Source sequence=SeqID_11595; Location=2526..2587; Strand=+; Gene=SeqID_75045
ttttacaatataattaactaattgaatttcaaaaaataaaattaaatttttattaaaaaatg

SEQ ID NO: 109107 - DNA, 81 bp, Heterodera glycines
  Promoter: Source sequence=SeqID_13453; Location=1394..1474; Strand=-; Gene=SeqID_77340
atctttaatgtccagataattattgatattatgatcgatgacagggaagggactgataaatcgacggaatgtggtcccatg

SEQ ID NO: 109108 - DNA, 351 bp, Heterodera glycines
  Promoter: Source sequence=SeqID_40064; Location=1..351; Strand=+; Gene=SeqID_68505
aaagatgctgttttgaacgaataaagggtatagttattttgaaaaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaaccctcaattattggtatgaacgatactttccaaacatg

SEQ ID NO: 109109 - DNA, 646 bp, Heterodera glycines
  Promoter: Source sequence=SeqID_1155; Location=2141..2786; Strand=+; Gene=SeqID_68977
tttttttggtagtactataatttttaggggaacgggtcgttttggcgccgccgttttggcgccagccttagtttttttattataactttttttcttgttgaccaaatctaacaattttggtatcattcgaaagcccttcacaagctctattagccttacaaaaaaaaaaaaaaaaaaattagcttgtaaaaaagttattaggaaaaaacttccaaaattttggtttttttgttatttcatgttataacttttttggtaacctaatcgctaagcaatatattataaaaagcttctaaacatataaagctttcaaatgataccaagattattagatttggtcaacaatgaaaaaagttgtagtccaaaacttggactggcaccgaaacggcgggcaccgaaccgtcccctatcgcaattagtgcaataagaaatacaaaaactgacccgataactctctttgttgaaaaaattgtccatgacctaaacaacttttgaaactgacatatgtgtaatttcaatgttgagtttttaaagcactaacttctggcttatcattgatctagtttttccacggaccaatgaatgcattttctgtttcttattctatgtaagtatcaacaacatccttcctaaaatcaacaaaatg

SEQ ID NO: 109110 - DNA, 347 bp, Heterodera glycines
  Promoter: Source sequence=SeqID_715; Location=6909..7255; Strand=-; Gene=SeqID_59672
accattcattcattgatttttcgttaaaatgagtaactctttctttgtaattttgcccagcaatacgccgggatttgtcggcaataaaacgaataaattcaaagtacacttgccaaagaaattagtgtttgatgggccgggatggatggtgggcatgtctggcataatatatcccaacaggtgggtgggtttgtacagttctcattgcccttgtacagtttagctgggcgactgtagggaccctggagaggcaatacgtagtggtgcacctgcgcggtggtcgcaagttccggttcagagtgccaaggggcagcttcctttcgcctcagcagcttgaacggggaatg

SEQ ID NO: 109111 - DNA, 168 bp, Heterodera glycines
  Promoter: Source sequence=SeqID_18008; Location=523..690; Strand=+; Gene=SeqID_82582
ttgacaaaattcaattatgaatcgcaggcccgtagccagaaaaaatttcagaggtggaggggggggggaggaatctgtgcatctcttaatgtcttacgtctgtctgctcattggcttaagataatgacttagaaataattttataattattttacagcgactaagatg

SEQ ID NO: 109112 - DNA, 1003 bp, Heterodera glycines
  Promoter: Source sequence=SeqID_12902; Location=1361..2363; Strand=-; Gene=SeqID_76642
atagcatttttatgtaaaatcttttgatttattgaaggtttttggtccatatacacagcgtccgggaaatgagctcctgtgccagaaaagatttgcatgtgtggctcagtggtttttgtaagatagtaaagggacaaagggtggtggttcgagtccgttgtgcaacatgaatattttcatttatttttgtcaaaatattaaaaaatcacgatatttgggaattatttttgaaggtttttgtcagccaaattggataagcttggtatctttcgaaagctcttgataaggagaagctttttctaagcaaatgctaagcgatttggtgtaccagagaaaagttatgaggctttaaaattttgtttttcttataacttttgaaatagagcattaacaaaaataaattcagcattaatcgatgcagaatttttttctctaacgatatgcaaaatttcctatggatctaacatatagaaaagaagctaaacatagcgaagtaaatgttgtttttcctagtaataaaaatattagatagtacgccaaaaggagacaaaaaattagaggaaaaaagataatgtttttctctggcactctctatttattggtacacatctcgttttttcggacggtgtgtttatccgttattaaatgtgtcttttgtttctgttagactccaacaaaagcttcgaggccgtccatcccacaagaggacaaattcgatcgccgccagaccggcgacagtagctcagccccggcgctgattcttcagagtttctaccgtaaacatggcgtaaatacgaccagtactcagcccgtacgcctcggtgacttacacaaggcattcgcctccattcagccgagtttcggtgaataagcagagagagggattaaccaatcgatcgctccaattgatcatatcatttattgattaatcatagattttttactgtttacgactcattcccccattgaagtgatcacttcgctgcacaacgcaatcacaatg

SEQ ID NO: 109113 - DNA, 194 bp, Heterodera glycines
  Promoter: Source sequence=SeqID_18232; Location=1207..1400; Strand=+; Gene=SeqID_82833
tttgagcaattggaacagttttcgtctgtcaaaacgagttaaaatttatacatttttggttcctttgcccttccacctttttctttttttcctttttgggtggatttagccaatgcggcggcacaatcggatgcgggtcgggcaatcccaactcccgcgccttcagttgctcttgcattccttcaggccaaatg

SEQ ID NO: 109114 - DNA, 842 bp, Heterodera glycines
  Promoter: Source sequence=SeqID_17047; Location=275..1116; Strand=-; Gene=SeqID_47410
gttcaatcatcgaaatcactcctcataatttataaatagcatttgaaggggaaagaaacgacatcgactcgaaaaaatcaagctcataatgtcaaagaattgacattacttttctcaatgcgttagaaaatgtttttttcctccgaatgcggccaaatgccataatattttttgtatataataggacttttaatttagttacataatttcgacattgatattatcatgaataaacccatgacaaatcatctatcattttgaggagctcattcgggttggggcatacaagcgggtaaataaactggatgggatgtttattctacaaaggtaataaggaaagtaataaaggaattgatcatttaaaagcaatacaaacaggaggacgaaatttacagaacgttctacgactttttcaaattcctaggggctggaaaaatccaataggctcattaaaaagagcacaaaattcttcatatacttttgtacctactgtacatggactacctttcctactattttgaatttacgcaataatttaataataacgccaaatagcgcactaatttaaaaaattattattgtcgaggccgagtgagcatattgtgtctatttttgatcaaatcatgttcatcgtacccaaaactattatagggaatgaaatctttttgatcggctgtaagaagctctatagctttattgcactttgtgtacatttagttacgttttacttgaaagtatctttgactccttaatgttagaagttttcgacataattgtcatttgacagagttttcgattaacgacaaaaaattattttcagtttttgatttgctttcaaaatg

SEQ ID NO: 109115 - DNA, 1003 bp, Heterodera glycines
  Promoter: Source sequence=SeqID_43653; Location=74..1076; Strand=+; Gene=SeqID_71284
acattaaatttgcaattttactgtaaaaaatttattcagttaatggaaccacacacacacacacacacacatcatacacaggaccctacaacatgaacgaaaaaatgaaacgtaatatgttaaaaaagccgaattgtaaaaaaaaaaactcataagttctgtcataattgaaattattttcaaaaattacttaacaatggttaaaaaaacaaaaaaatataaaatttaataaaattaatggtttttgaaaattttatgcaaattataaaaatatatattttaaaaaccaaatatttttccaaataaaaatttatctattacgacagaacttaataaaatttgatattgggcactttttatttttaattttctttgaataaaaataatccctctgaaataattgtttccatttataagtttttttttttatatttaatttttaaaatatgttctaatttttttttgtcttgataatttaaaatgaatgaattattaagcatgtggctattttacctatttacataaattgaaaatttggaaaaatcatcctagaatttatttataagttaaaattttatttttagcacactaaattctggaagttatttagtctacaattaaaataaaaaaaaggtgcatttttttcacaaaaatctaaaaaattcatttattcacatttaatttcaattaattagagattttctggtttttagtgtttaaatatctacagggtgatcttgcacctttaaattgagcatatcttttgatcaacttctcttttattatgtttaaatactcatttgaaagcttattttatttgcaataatacccagtaacagtcaattaataatcgccctgcaccaaagcggaatgacgccttcaaaaattgcaccactttttgacaccactaaaagcactgttagctgaattataaaaaaagatttcctttaaaaaaaagcgatgaaaaaatttaaatcatacagggaacatggcacaacccatg

SEQ ID NO: 109116 - DNA, 464 bp, Heterodera glycines
  Promoter: Source sequence=SeqID_10700; Location=3195..3658; Strand=+; Gene=SeqID_73954
ttttttgttatatatcttcctaagtttttttccttttcaatttctttaaaatactttgctacacccaagtctaagtttcatatctctgagcaaacatatttatattttttcctatatcccgtcctggacaatttttttttttggtcaaaattgtgataaagacaaaatttctaaaaaattttccaaggtggtgcctataggcaacgccggtgctaaaaaaatatggaagaaaattcattttggagaaaaacaactgaattgaataaaaatgttaccctttttattcttttgataactcagtagatacaatcctggttttactttaaaatagaaaaaaaagcttttttgagtgaataagtgcataaatttgtttaataattattttgtacctatttagccctattattataataagtttccaataaatttaatataatttttcctatagaaaccaaaaaaaaatg

SEQ ID NO: 109117 - DNA, 117 bp, Heterodera glycines
  Promoter: Source sequence=SeqID_16817; Location=786..902; Strand=-; Gene=SeqID_81231
gttaattaattaaattatcgtttataaagagctattcaaaaatgaatttattttattgcactgaaaccggaattttccatttcaaacggtgactcaatttcaatttatgacgccatg

SEQ ID NO: 109118 - DNA, 209 bp, Heterodera glycines
  Promoter: Source sequence=SeqID_8331; Location=1..209; Strand=+; Gene= SeqID_67714
tacttaaatgccgacccagcagtaaaagtgtcgtcatcattttatttcgccattgttttgctccaaacactaatcacattacaacaacagatcgtctcaaacgcagcaaggcaaaattattgaaaatttaaaaactttttaaaagatatattttaagtacatccatcgatgatggaacaaaaagcgccgaatatccgctggaacaaatg

SEQ ID NO: 109119 - DNA, 551 bp, Heterodera glycines
  Promoter: Source sequence=SeqID_11127; Location=1..551; Strand=+; Gene=SeqID_74467
aattccgaacctctgacccggattcgaacaaaagtcgaaaattaatttttcaccaaaatccacctttatgttcccaaaattaatttaaatctgctaataaaaatgcaacaatccataaattcaagttcgcacgtaacatataaaagattagcagatttaaatcaattttggaacataaaagtggatttggtgaaaaattaattttcgacttttggttgaatccgggcccggggttcggaatcagtcgaaatggatgtcatattcgtgatcagcgatcccaaaaacctcatggttacattttatatgtcttgtaaaaaaaaaaaaaattatgtggcctaaactgtataagtaccgcttggctaaaaactcgccacaattttcgcatggattgccccccccctttgcctttggccaattgtcacttttctctttcttttctcaattttcggtctttttctgattctcaacatttcctttcccttttgcttattatttttcttcattacctcacttttcttcccctcacttttctcttttcattcttcccaatg

SEQ ID NO: 109120 - DNA, 490 bp, Heterodera glycines
  Promoter: Source sequence=SeqID_7257; Location=468..957; Strand=-; Gene=SeqID_46392
tttccgcgtcagtgtcttttcgaattttgattggtctccaaattaccaatttgcttttgccatcgaaatgtttgtccactaaaacatcaaaacgtggcgaaagcaatgccaatttgaggccgagttcggcatggtcaaaaaagggaacatatccatccaaacacccgtaaaatccaactgaaatgcggggaaaataactagggcaccgatttatagtgaaaaaactctggcccacaaaaaaggaatttaccagtgtaaattttaaattagtgcgcaaaaaattacgtcagttacgctatttggcgaaatgataattttgtctaacactgcactggacttgacccatagtgaaaacggaaataatgtatataaaaggagcgcatttgcattgttccatcacataattcattgcccacatattattgttattatatattgctcatcgtctgcaactttaatcccacgaagcgacgtgcccggcgcaacaatg

SEQ ID NO: 109121 - DNA, 1003 bp, Heterodera glycines
  Promoter: Source sequence=SeqID_11822; Location=1518..2520; Strand=-; Gene=SeqID_75323
ttcatcatttaaacgcattacagtatcgatacagaaggactctgtttcctcttcctaattttattttttgtttttatttgcgaatattattttttataattaataacttttattcaacccatttaagtcaaatgatctaccgtatcctcctgcaacctttattttcctctttatttttaatttattattagtttgtccatttcaaataaactgtcctaccgtaaactccccaccatttctcttaattatagtattttttatttttttgtatgggtattaatttctttttttaaaatataacttttattcgatttcatatttctcgtccaccatatcctaaagattcttagtggttttaatgtctaatctttaatcgaccatatcttacattttttcctttatttaatatttccttcctttttttgcattttagtcattgaattttcatgttttttatttttatatgatttttttggactttttaatccgataattaataatccaaaataataaattaacggtaataaaatgttaaaaagaaaatgaataatcgatcgacctaccgtatccttcatctttccttgcattttcatcagatttttatttatttttcatggttattatttcccatttttatgtgtttttttaattttttaattccattttaaacaattttaattatttaaataaataatattactctaaataggctcaaaatgcaaaaacaattaggattaatttaccgtatgctccaccattttcttttcttatttttgtattttataagatttttttgaactttcatgttaattttttcttgttttattattatttccttgattttacatttcatttgaaatggataacaaatcaaaataaataataattatctctaataaaatgataaataagaaaactgctattcggttaatctaccttatcactatttcctatagtctttcttatttctaatgcattaatttagtgtgtttttgtagaaatg

SEQ ID NO: 109122 - DNA, 82 bp, Heterodera glycines
  Promoter: Source sequence=SeqID_21119; Location=1414..1495; Strand=-; Gene=SeqID_51711
ggtgagtcgaaaaagagggattatcgattgatcagaaaagcctgatcggcacaaattgtttagcctgcgggatgccaagatg

SEQ ID NO: 109123 - DNA, 489 bp, Heterodera glycines
  Promoter: Source sequence=SeqID_334; Location=4475..4963; Strand=+; Gene=SeqID_82941
aactcacatgacgtcctgcgggtctcacttctctccttttcttcaatcagcacggtatgtctttcggtcattttttttattattaattagttgggtaattttcctttttgacccctatcatttaagcactttattttctttcattttctctgcactcacaagctttttgatttcacccctccttagcttccgatgttcgcaccatttacactgtgatacaatcagtaaggacactttcccaccgcattacggttttaatagatttccgctattttttctcaaagcgatttttttttacactagttccgataacaaaatattgtaacactggaatgccagccacgcccattatcaagggcctttaatctaagcatttcacattcattcattcattcttccattctctcgttttactatcctctattttagatattcttgcacaattccactgctaattctcatctcacattcccattccctctcattatg

SEQ ID NO: 109124 - DNA, 263 bp, Heterodera glycines
  Promoter: Source sequence=SeqID_33296; Location=1..263; Strand=+; Gene=SeqID_63401
ttagtccattaattgtcctctacgaattaatgtgtctgaaaatgaaccgttttcactttttgtcgaccaatttaaaggcactgaaagagacaatttaatggtatgaatttatttttatcccaattttattttttcgaatatttagttctttaacattgatgagcaaagaacgaacaatggacgcttaattggaaggcaattctttaattttaattattattatctaattattaattattattttataatttagcggtcaaatg

SEQ ID NO: 109125 - DNA, 676 bp, Heterodera glycines
  Promoter: Source sequence=SeqID_35129; Location=1..676; Strand=+; Gene=SeqID_64760
actttgcttttttgtccatttattccaatcgactagtgctttaaggttttgtctttgactttgcttttttgtccatttattccaatcgaccacgttaattcattctctatacatttagtgtcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgagtgtggtggttggaccgtttttgcgatattgtggctggaaaaaagatgcgatttcgctatggggagcgcggccgtctgggttcaagtgcttgcttgcgcttgtgctcggcattgaacggtgatggctgctgctggggtgccacctttgtcgtggcctcagtttccccagcgattggcagctgtcgaaatgaataaaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatg

SEQ ID NO: 109126 - DNA, 111 bp, Heterodera glycines
  Promoter: Source sequence=SeqID_20869; Location=1..111; Strand=+; Gene=SeqID_51453
gactatgatcaatattttcctaaatcgtgaaagcccgcttccggatcaggaaaacgaattttgcataacgttttcacttaaattaataaattttctcgcttttagaaaatg

SEQ ID NO: 109127 - DNA, 559 bp, Heterodera glycines
  Promoter: Source sequence=SeqID_6067; Location=841..1399; Strand=+; Gene=SeqID_60202
ttttgtataaaatatagctgaaattattgcataaaattttaatattattaatgatatatgcaaaaaaatatgctggcggatttataaaacgcactagcaccaattgttggaaggtaaaaatgttttgtcaaaaagctttaggcttaaatatgaccccatgagtagcttttatttttcagtgaaaattttggattttccaaaaaatgtgatcgtgtcaaaaaaaaatcttttttaattgcaattttgttcaataatttgtgaattttataagaaaaattttaaaaatcgcgaaataaaggcgaacataaggatgaaacgccaaaatatgggcaaaaacttattttaagggcgaacatctaaaatatggatttttaagggcgaatacccaatataaggaattctaaggtcgaataagggcgataaaacgcaaaattttcgaacaaaatatgtgtttttcgtacatttctcttcgagttaaagccacagaaaaaataagtaaaaacttagaaatccgatccctacttattactgactagccaaaaggtcgggtgccgtgatg

SEQ ID NO: 109128 - DNA, 353 bp, Heterodera glycines
  Promoter: Source sequence=SeqID_13570; Location=1548..1900; Strand=-; Gene=SeqID_77471
tgtgtcgcaccaatatgattcgctgacaggtccttcggggcatttgtcgcaccaaaaatggtcgctggacctaccccttcgggggattgtggttcgcaccaaaaatagtggctggtcctgcccttttgggttatggaccggacatttttgcatctgcattcttaatgggatgtgtgagccctgactgatggatttcagcacaggaagactacactccacggcgaagaatgatgacagaataacctttttgcgcaattttaaataaatatttttattttctgtgcatcatatggttattttcctcatactttgtgccacatttgtaacactttctgatttattatttcagaatg

SEQ ID NO: 109129 - DNA, 68 bp, Heterodera glycines; identical to SEQ ID NO: 99057
  Promoter: Source sequence=SeqID_44554; Location=781..848; Strand=+; Gene=SeqID_72038

SEQ ID NO: 109130 - DNA, 60 bp, Heterodera glycines
  Promoter: Source sequence=SeqID_28565; Location=1033..1092; Strand=-; Gene=SeqID_59166
ggtttttttaaaatatggttaattttgtttatttaaataattcaggtaactccgaaaatg

SEQ ID NO: 109131 - DNA, 68 bp, Heterodera glycines
  Promoter: Source sequence=SeqID_29850; Location=1..68; Strand=+; Gene= SeqID_60312
aaatctttgaaatacaggatgaagcccaagtggcgacgaaggaattgcaaaaaatgttaagaaaaatg

SEQ ID NO: 109132 - DNA, 121 bp, Heterodera glycines
  Promoter: Source sequence=SeqID_6602; Location=94..214; Strand=+; Gene=SeqID_62161
agtgagtgaaaaagggaaaacgtgaaatattttaaattaattttattttaatttctctattaaaaattgactaaaattgggttttcaacacgttcagagtggacatggtctgcaacaaatg

SEQ ID NO: 109133 - DNA, 69 bp, Heterodera glycines
  Promoter: Source sequence=SeqID_44792; Location=676..744; Strand=-; Gene=SeqID_72214
ggtacaagtttacggaaaatttaaaattttcgcgttttttgatttggttttttcagttggtttgtgatg

SEQ ID NO: 109134 - DNA, 557 bp, Heterodera glycines
  Promoter: Source sequence=SeqID_15310; Location=1..557; Strand=+; Gene=SeqID_79543
ggaatgacagccggtaattcttcaattaggctcttttggccaagatattttgcgggcactttttaaaaaaccttttgggaacagaaaagcgtccgccgaaaggctcacaatcaatcagccggataatgaaattcagttagggttttttttatgaaaataagaagtttatagtctgtcgaaccaatataaatcacgcgggaaaattgctaatttaacgaatttcttagaaaatctgttctaaatttaactattttcccattcccccctttttcacgtgtgatttgttatccaaaaggacgagtgcttgaacccttttttatgcttacaatagtttttgtgttttttttctcgaaatttagaaaaaaggccgatgcattattattagtaattagtattaattgattgggttttcatttagtgatccacgaccatcaaagccaaacttacaaagaaccgtcaaataaaaaatgtaagcatttgttggtgaaaatgaaagaattaaccataaaaatttagcaaaagaaaagttaaacgcttcgattgcattgacaaaaatg

SEQ ID NO: 109135 - DNA, 162 bp, Heterodera glycines
  Promoter: Source sequence=SeqID_21311; Location=1314..1475; Strand=-; Gene=SeqID_45634
gtttttatctttctttattccaaattcaatcattcaataaatgttgtcacaatgctaaacaaatttttgaaatatgtttttatcattggggatatttccttttaaatatttaaaaaagtttgttacctttttgtgccaaattctatttgtacaagaaaaatg

SEQ ID NO: 109136 - DNA, 369 bp, Heterodera glycines
  Promoter: Source sequence=SeqID_27741; Location=1..369; Strand=+; Gene=SeqID_58409
aaagaggctgaggagatcatgctcagaaggatgccgaggctaaagccaagaaagacgcattagagaaggctaaaaaggatgccgaggctaaagccaagaaagacgcagaagagaaggctaaaaaggatgccgaggctaaagccaataaagacgcagaagcaaagaaaaaggaggaagaaatgaagcaaaaggctaagcccgaagaaaagcctgaggcacctgccgaaggcgtggccgtagtgccggaagcgaagaaggcggaagagacaaaggaaaagctgaaacaggaagagaaaccaatggaagtgccaccatctccagcagaaaagaagagaaaagaggctgaggagaagaaggctcagaagtatg

SEQ ID NO: 109137 - DNA, 330 bp, Heterodera glycines
  Promoter: Source sequence=SeqID_18451; Location=682..1011; Strand=-; Gene=SeqID_83048
attttaatttttttaagttttgaatatcgcacggcatttcaaaaagaatttgcatttttgttcaaattaatttgcgttcataattcttcagcggttgtgccattgcagtgaaggaaaaaaaatctaaattaatttgtgattaataatcaaattttagatttgtcatattttatttatccaatttgcaattttattcattttcaaactgaatgaacaaatggccaaatttttagaaaataacaaactttatgctatttaaataatactagcggggtcagcgccttcggcgcatccccccgctaggcagtacgattgtgttatagaattatg

SEQ ID NO: 109138 - DNA, 210 bp, Heterodera glycines
  Promoter: Source sequence=SeqID_4288; Location=3690..3899; Strand=-; Gene=SeqID_53896
tgtgattcattattttgcaccagttcctcactctctcggtgcaaaggcgtaaggatggactaaaaatagttttattttcaaaagaaatgaaatttattaaggttttaattaattaattaactttcgatatattttatttttaaattgaattatttgattcttttttcaaatatttgtaatataatcaatcagctgcccggatgatcaatg

SEQ ID NO: 109139 - DNA, 133 bp, Heterodera glycines
  Promoter: Source sequence=SeqID_8594; Location=1421..1553; Strand=-; Gene=SeqID_68634
atcatcaaaaattctcaataaactttcataaaacaaaaaattaacaatttaaaatttagttgcttttgagcaaagatttgtggtgaatattttataatacccatttcaggactttgcataattcattgcaatg

SEQ ID NO: 109140 - DNA, 223 bp, Heterodera glycines
  Promoter: Source sequence=SeqID_26878; Location=843..1065; Strand=-; Gene=SeqID_57622
ttttaaaggaactttttatcattaatatttttcttttaaattattatcacatttttgtgaatgtccattttttttctaataattcattattatttttgttttaatcgttttttgatataatttttttgaatttcataattttttaaggtgtttttaatcttttatgaaatgctctcaatagctataaaaatatattcaaaaattattttttagatttgcaatg

SEQ ID NO: 109141 - DNA, 53 bp, Heterodera glycines
  Promoter: Source sequence=SeqID_37407; Location=949..1001; Strand=-; Gene=SeqID_66487
ttcggactcgaaaaacttgaaatttttgctttccaaaatacctcccaaaaatg

SEQ ID NO: 109142 - DNA, 133 bp, Heterodera glycines
  Promoter: Source sequence=SeqID_13226; Location=1..133; Strand=+; Gene=SeqID_77054
cttggggcaatgaaagttaaaatgataggctcacggaggaggttgaggaagaggcggagcaggtcgcctcgatgcgctcccaactgcccccggcgctgctcaactcgcccgccgaggaggaggaagagtgatg

SEQ ID NO: 109143 - DNA, 732 bp, Heterodera glycines
  Promoter: Source sequence=SeqID_43105; Location=63..794; Strand=+; Gene=SeqID_70864
atcagtttaagtgggatttccattcttcatttcataataatcatttaatttgctcattttttgttcatcggtgaatcgaattggacctacgaatataataaaatttaattgttaaattactttgaaaaattaaaattaaaatttatcgatttcaatgccaaattcttttttccattttcggaatgtttttatgcgaatgcctttcacaaaatgtttctgttttccatttttggacattcttttaaactcatcaattcgttcaacaaattcttgttttttcatttgataataatgttttagtccattgtttttcggaaataaatccatcatatttcgccattttgtgggtttagagttggttatttttggcaaaaaaactcattgtaaaaaaattaaaaataaacgaaaagtttttagcatttaaaaaataatcaagaaaaaacttcaaaaattttgacttatttaatgggtcgtaattacgaaatatcatgtgaaattatgatgaaattcatggctttcaattctttaatcttatttactaatattttataaattctacttacatatgttcagatacatttattgatcgcatttttgccaatgcttctctatattcattaaaatttaaataaaaattattttctgatgaattaacttagtttttaatataaatatatttaataaaatattaaaaaataattaattaattatttataactttttttagtgatg

SEQ ID NO: 109144 - DNA, 1003 bp, Heterodera glycines
  misc_feature (585)..(585): n is a, c, g, or t
  Promoter: Source sequence=SeqID_11195; Location=1312..2314; Strand=-; Gene=SeqID_74547
tcgggtcgggattcgaatcgtgggacaattgacaaatcccacccccctcccgactccttcatgggataaacacaaagccggattagtcattgcctaaaagcatgccatgatccattgaaatcccaacacaaggtgggacaagacatcaggaaactgccattttggttcagcgagtaagcggagtgattaatggggctaaataaaacggaagtgacttgcccagggaagaagaagcacccgctaacagtgatgggatggatgactcatcggcggttaagagccttggccaaaataaccaccaaggcgggggggggggggaggggcacggtggtggttagacgagagcaaccttgcacgctcgctataagagctccatttttaaaaaattgaaatggcatgtgattttttaaaagttgagaatttaaaaaaaaattttttttttttctttgtgcactaacaaataagttccaccgagtttttgaaaaattttccagcggtttttttaaaaattttataaaggattactgttttctcgaaaatttttccaaaatttttttttctaattctttattcggtacttatgtnatatgttatctgtgtacagattttcaaaaatgtttatgttttggcaataacttatttctttggcatccaaatccaacattttgttgttatcattcgaaagcttaacatgtttagaaactatttctaagttatcgcttcgcgatcagacaattaccaaaaaagttatatgtacatgaaaattgcgaaaagatcgaaattagtcgaattttgatgccaaagaaaaaagttagccaaaaaacctaactcgtacgtccccgactagtaccttttcgacaaaaaaaaatatcatagctttggtggcatttaagtccatatcccggcccggtcccgctctactatagtttaaaggaatctcagttttgctaagccaattttaaatctgtcgagaattgtcataattatttggctcaacaaaatg

SEQ ID NO: 109145 - DNA, 1003 bp, Heterodera glycines
  Promoter: Source sequence=SeqID_26; Location=5427..6429; Strand=+; Gene=SeqID_82131
gtagcgggtggtgattgatgggttgcggtttctttgaaggtgccgccgtgattaatgagtgcgggaatgagtctatgcctatggggggggggtaattaattagcgtgggtgcctgagggggtagtttttgcgggaaaatttcccgcatttgtgggggagaaaacttttttttgtgaatttttttaaacgtttattaattatgtggtaattaagggtgtgcctgtgggggtagttttttgcgggaaaatttcgcgcatttgtgagaggtgtcatttggggggggggacgaaattaatatgcattgtgaaggggagggcgccgcagcatgtgtgagagaaaagtcagagagaatataaatcaaagagaatgtgagatagttagagaaaattatgagagagaaggggggggagtaaaaatgtgtccttttcgtgtcatacgccgggggggggggtgaaaaagtaaaaaggtatggagcaaaactttttggccaattacatagatcagataaatattttgtttatgtttttgatcaagaggatgtgtgtttattgggaatggaaaatgaatgaaaaagaaattatgcatgaagttggagggggggggatggtgaagttaggttatcctgtgggccattttcatttctcatcaacaacaaaaaatggagtggctcaactatagctgtacttcttacccggggggggtgctttgcaaccgcccccggggctacacaaaacccgttctctgtgtgcattggtccattggcaatttcacgcaatttctgcgtgagtgcgttcaagtggcggcagcgccaaatgccacggaggcaacgacgacgacgacgacaaattgcccaaatttgtcaaatttgatcatcgccagcgccgctctgattttggtgctcttcattgtccaggtgtgtttttttttattttttgttttatttcaaaaatgcaacccccccttcccatacagatggtgcttttggcgctgaaattgcgccatg

SEQ ID NO: 109146 - DNA, 337 bp, Heterodera glycines
  Promoter: Source sequence=SeqID_21054; Location=689..1025; Strand=-; Gene=SeqID_51641
caggcaaagcaatttgtgcgcaaaggttcttcagtgattcatcatttttatgggaatattattcaattttccttaattatttcgtgcgtttaaatgaataaaaaaattgcgggccgataataaacaaattcaaaaattttaaaattattttcaaaacactcaaatggattaacaaaaaatggaaaattatacagtagaatgactgttcattcgttctgttcccgtccaatttaaggtcggcggagactccgtctcctttattgaagaggcaccgcctgaatttgctcacctcgtggccgacgagttgcgcgtggtccacgagttgcgcttgagcatg

SEQ ID NO: 109147 - DNA, 199 bp, Heterodera glycines
  misc_feature (108)..(108): n is a, c, g, or t
  Promoter: Source sequence=SeqID_44938; Location=1..199; Strand=+; Gene=SeqID_72344
aaaatgatttcagaaattgctattgaactattcattaatcccaaaaaaatgctcttgtaaattttgattaagtataattttagtgcttatatgtggaaaatttgtttnaaaaaataaaaatcaataaagttaaattttatgggagattttatgaggaggcgcacgcggccaaattgtatatggcgtagcaagaggaatg

SEQ ID NO: 109148 - DNA, 413 bp, Heterodera glycines
  Promoter: Source sequence=SeqID_27845; Location=1..413; Strand=+; Gene=SeqID_58521
tgtcataattttttctgaacttttagaccagggtgacatcatactgcccattacaccaattacgtcaaacgtcgtggacgccgttttcaaccagtttgtaaaagtggagcagagcaaatcgaaacacgtcaacttatatggcgctccctttataattaccgtcactgtcctaaacaccaatggactaccgcgacaacggacaacaaagggaaaagggcgaccgcctgtctcctcacaatcgcacattttcaaagtcaacaacaacgacaactactgtcttttttacgcgctggaactgatgcgctactactcattatatatcaggggagtaatttcaaggaaacaatttagatggctcaaagataaccaaacaacggttttacgacaaaaggtgctgcaactactccgcgatg

SEQ ID NO: 109149 - DNA, 217 bp, Heterodera glycines
  Promoter: Source sequence=SeqID_5675; Location=4008..4224; Strand=-; Gene=SeqID_46092
acctcaattgcatattcttatttgacttaaaattacatatatgtatttcgtgttgtttatgtaaatgcatcataaatcataagcagtaaacactcaaattctaagatttcttgcgaattaagccacaaacttattttgtttctccttattccccttctctcttctttccatggcttcagaatgttgtatacaggtcgttccttcgtttatttaaatg

SEQ ID NO: 109150 - DNA, 108 bp, Heterodera glycines
  misc_feature (37)..(37): n is a, c, g, or t
  Promoter: Source sequence=SeqID_38374; Location=1225..1332; Strand=-; Gene=SeqID_67205
ttgatcagatttgctaataaagctcataaaacagctntaaagaatctgaagcaattgttttgaaaaaaaaattatgcttgtatgaaataggcaaaaaacgaaataatg

SEQ ID NO: 109151 - DNA, 131 bp, Heterodera glycines
  Promoter: Source sequence=SeqID_14903; Location=1..131; Strand=+; Gene=SeqID_47246
gcgaaatgtatgttttaacattagtaggcgaaatgtcgagtaggcgaaatgtcatgtagccagggcaatcgcatcataatttccaaagacagcgttttgatcaaacaccgccctccgctattcatccaatg

SEQ ID NO: 109152 - DNA, 631 bp, Heterodera glycines
  Promoter: Source sequence=SeqID_15463; Location=1..631; Strand=+; Gene=SeqID_79734
aatttctggtaaatgaagggaccaatggtaccttgagtttacaatttggaaagcattattttttttcatcctaaaaattaaaaaaaaaatttttttttgctcttttcagcgtgcattcgcttcttcgcctatctgtgcaccaccgatgacaacgcattgaccaaatttcccaaattcacggccgatgttttcgacgcggtgttcaggtggaaaggcgaccgatcacacaatttgtttttttcccaaaaacctccaccaatcgtttggtagtctttctttttaaataattagccatccaaaacgattcataaataattagccatccaaaacgattcactctgtcggctggtccgaacccatgacaaattaaaattagggcgcaaaagtccatcattaactaaaaagggaatcaaattttattttcttggccacagatttgatgcattcgacgtcacgcgtcgtcagttggccttcgaaacgttggcagtgatcagttcgaccagcggggccaagcagatattctcgcagaacgaaagtccgttttttggatcaattggactttttcttctagctcactactaatggtttcggtccttttatacttcccaaactttcagctctctacaacatg

SEQ ID NO: 109153 - DNA, 684 bp, Heterodera glycines
  Promoter: Source sequence=SeqID_22318; Location=279..962; Strand=+; Gene=SeqID_52997
ttctattaattttcaaatattttgtttagcctccgggggcgtgtgtttgaggagcatgaactgcccgcatatttcatggcacaaagtcgttgttttcgcctggaggcgccttcaaatcagcaggactcgggcctctaccgcgtgcatgagttcaacaaagtgtgttttgcaagggaaaatatttcgaaattttcggcccaaaaaattcacaaatgaatggccccaggtgtccgtgggatttccaaatgaaatttggtggtggatagagcatcaccgtttacaagtgtgcaatggtatagtggtagtgcgttaggcgaaaattttttgcgtcccaggttcaaatcctctacatgcaaatccattttagaattttatttttgcttttttatacaaaagtcaattataaaaaattttttataaaacaaatcttttatttttaattttatttcattaacaaaaaatttattaaagataataatgtaataaatatctttaagttcataaaatctaatttttgtctaatactttttgagtaacttatgtgtcaaaatgggttaaaaataagaattttatatcaaaacattttttggataaaattgactttgatatgtataaaaaacaaaaaaataattaaaaaatgaatttacatgtaggggacccgaacctagtgtttaaaaaacgatg

SEQ ID NO: 109154 - DNA, 184 bp, Heterodera glycines
  Promoter: Source sequence=SeqID_24831; Location=2091..2274; Strand=-; Gene=SeqID_55583
cattttttacgaaacaacccagccactaattaaaagttccttgttcatttaattcggttaccctttttaaaatttgacaaaagaagatcataatttgttcttttcccatttcagcgacaaagggaaagcgcgcaaatcgttgccgaaatttgagcccggacagtcctccgtaggacaacaaatg

SEQ ID NO: 109155 - DNA, 901 bp, Heterodera glycines
  Promoter: Source sequence=SeqID_9313; Location=1..901; Strand=+; Gene= SeqID_70963
aaatttgtaagaaaattggagttagccataacacagttagaagatggaagaaacaattgggcattctctgtaaaataataacaaaggaacaaagaatggaaaaaatgaaaatatattgggaaataaaaagagaaaatccaaaaatgagtgaaaaggaaattgcaaaaactatgaaaattcaccaaaatagcattagaaaatggaaaaacaatttggaaaagatgaaataatggaagattaattagtaaaaacttaaattttttttaaaaagctatgtatgatgatggattttattgattcgaaaagattaatgtattttttaaattctttttaaaatgtaagggtatatatttccgctaaatttactcatgtttacaatttatatatgtcgatttgttagttgcttctagctagataatatttggccattttttcattatatttattaagaataattcgctttttatatttttattttttcgataattcaaaaacagaagcttaaaaaacatggacaacaaaaaccaaaaaataaaaaattttgaatttagtaattattgtcataatgtcacttttacgagaattttttaatccaggaaaaaacgcaccaatttatataaaaatttagaaaatatttatttttgcaaaattacaataacgatggatttaagcgttatctatagcctgcaaaatttcaaaaaattatattaggttaaaacaaaacacatggtttgcgacgccaaaatggctaaaaaattcaacattgagtttctaggccataagtttaaaattttttgaaattttgtatactaatagggattatcaagcgcttttaaatcataccatgtttatttaatttgggtgacaaatagaaaatgctatagcatttggcgccaaaatg

SEQ ID NO: 109156 - DNA, 111 bp, Heterodera glycines
  Promoter: Source sequence=SeqID_43248; Location=977..1087; Strand=-; Gene=SeqID_70970
gttgacgaaaatcagctaaaacagcagcagcagcaacattgcccctcaccattagccacaacagaagcggcaaaagtgccaaattcgatggcaccaacaacgacgacaatg

SEQ ID NO: 109157 - DNA, 369 bp, Heterodera glycines
  Promoter: Source sequence=SeqID_22588; Location=998..1366; Strand=-; Gene=SeqID_53256
gaaataattgatcaaagaattgtaaagttcgccatcgagaaaatggtatttgtcgttaactttaattaaattcggtatatgtagatcaatgcgtttttggtgaagcatatttctaagttttagaaaattttttggtttaaactctctaatataaattttgtcttttttggtgatcgaaaagctcccattaattttaaattcaatcatgtggtgatctgatgttgaaaaactttctgtaacattcgtgtcataaactaattgcttaggatttgaaagcactaaatctaaaatgttgttaccacgtgttatttgttttacatgttgaaccaattgtttttgtgctataaaatcaataaataatttcgaatg

SEQ ID NO: 109158 - DNA, 619 bp, Heterodera glycines
  Promoter: Source sequence=SeqID_20603; Location=1..619; Strand=+; Gene=SeqID_51154
tgttgacaaatctaacaatcttggtattattcgaaaggcattcacaagctctattagccttgcaaaaaacaaacaaaaattttagcttctaaaaaagttattaggaaaaaacctcaaaattttcgacttttttgcaatttcatgttataacttttttggtaattgtctaatcgcgaagcaatagcttagaaatatcttctaaccatgttaagctttcgaatgataccaagattgttagatttggtcaacaagaaaaaaaagttataacccaaaaacttgggctggcgccaaaacggcggcgccaaaacgatacagactcctatttagcctatcttataggttcatggctcctccaaaacataaatataaatttcatgctgattacgagcgtgaatttcaaggcataaaaagaagtaaaaagggcgatgaatatgcgaattgtgtgtcgtgcagtgtgggcgtaccatatctgcaagcacgcacaatccttcaagtccgcggactgtgtatcctctgacggactgttcaggacgatgttttctgattaagcggttgcaagaaaatagtgaaaagtctggtgcaagtgaaagtgaattttgatcaaaaatgttcggaaatg

SEQ ID NO: 109159 - DNA, 1003 bp, Heterodera glycines
  Promoter: Source sequence=SeqID_830; Location=1821..2823; Strand=-; Gene=SeqID_62334
ccataataaaacaaagctaaaatttctagtaaataatgaagcaaaaatttaactgagattttattaaatttatttttattcaaataaggttgaaacacttaaaagcaaacattttctatttaatgcctgatcaaaatgcttcatgatatgcagagcaagatctgaaaaaaaatgtggaatggcatcagcaaaaaatacaaagcaatttagtttaatacaagcttcatgacttggttgacacttctttctgtttttgtagttgtctaataattagcaattaattttttatgtttttttctctttgccctgaagacaagtcttaggtatggtacttggttgattagagactgtatttttttaagcaaattttaggttatctttaaatgggtaaaaatattttttataacattcttttttaaaagcttaaaatgaaattattttttagaatgacgaataaaaactaataattaatatttaatttatttttaaacaaatgggttttttgaaaataaaatatgagtaatattttcttataatatttttttaaattgttattttaattttatggattcatcgatatatttgcatacaaaaatttatctgttcgcattatttcaaattttagagttttaattatttaatatattttaatttctctttttttggttattttcatgaagttcattttatagctttttctcgggaaccacatgaaactgcattcaaggatatttcctttcggtatcacagtcatcttcatttgttattttaatttttggattcaacgagaatatttgcatattaaaaatttatctgttcgcattatttcaaatatttagaatattttattttatataattaccaatgagatcgatgttattcttagaataaataaaaatttatttttatttctctgcaacttttattatttattatattttaatttctgttttttgttattttcatgaattttattttatagctttttcatggaaaccaaatg

SEQ ID NO: 109160 - DNA, 1003 bp, Heterodera glycines
  Promoter: Source sequence=SeqID_15688; Location=172..1174; Strand=+; Gene=SeqID_79997
tatgagttacttaaaaccaccataaaattaaaaaatttgagtttttatttaaattttccgacaaataaacatttgatatcgaagaaatataaatgagtgttctattagcaaatattaaagtaattttaaattttattaatttcatagatatttaaagaaaaaattacccaattaatttggttttttaatccgtttcatttatgtttagcgtgtcgtgctgcttgagcttgggcggcatgcaatcagtgccggcgtattgacacaaaagccatcattaccgtacagctttttccccacactttgcgcggttggcaacagcagcaaaaatggcacacaaaaagtggtgacttgtggtgccaatgcatttaatgagcatcaaacgcatgggtggcaattgaagaggccaattgaggcataattataataaatgaagaatttaacattgtaaaatcccatttgaatcaaattgggccgtggtgagccgaagtgacaaaagtatcaatgttcataatatttaaatttaattaataattttaatctatttgctaaataataaatcttaacttatcttaaacttagccaaattaaaaaaaaacttgagctagctctacatagtctcaatatattatatatatatatatatattttttttaattagaaaaatttaacaaaaaatttgtaaccaaaacttccaaaaaatttagatttctgaacaatcttgaccctaacttttttagaactcattaagatttttgaaatttcatataataataggtaaatttttgggctatctaatcatataagggtgttatgaatgatgtttgaacaattttcatgcatataaacaatcttatatttttatataaccataaaaatttgacacatttaattctttctaactttttttcggatattatattaaattttaaaaatcttattgagttttaaaaaagttagcgtcaaaaatgttcagtctaaaatttaactattacgcacattgatg

SEQ ID NO: 109161 - DNA, 99 bp, Heterodera glycines
  Promoter: Source sequence=SeqID_39275; Location=642..740; Strand=+; Gene=SeqID_67883
tttttgcttgtcgacgacagcacacacagccgaaaagcgcttcttctcatcgccttcgccttcaaaacttagaagcaccaatcccaaccagaaaaaatg

SEQ ID NO: 109162 - DNA, 293 bp, Heterodera glycines
  Promoter: Source sequence=SeqID_11792; Location=1250..1542; Strand=+; Gene=SeqID_46986
tgatgaagtgatgagttgtcgcgacgaaatgtgtagatgagcttggcgcgcactggtgttgatgttgcgttgagttgaaggctggctggcactggtgaaaagtgaagaaaaccgtcgccttttatacacttttttttgctgcatgaatttttgcacccgaattttgtatataaggaggtggattttgcacattctcctcactcagcagcagcaacacttcaagcaacgctctcaacgatcacacatcaagcacccacaaagccagcccgacaacagcgacaacaacagcaatg

SEQ ID NO: 109163 - DNA, 673 bp, Heterodera glycines
  Promoter: Source sequence=SeqID_24163; Location=344..1016; Strand=-; Gene=SeqID_54869
ttttttggcatgtttccggcccttttgaatcaaaaagatatttaacaggatggacaaaatttttaaaatcatcatctgttgtgttcaaatacccccctttgtgccatgcataacggagaaactggataaattttggtgaagagatttgtcgatgaaccaaaccagctgaacaacagaccgaaaggacatagatttttaatccaacgcttgaacagggaaaaagaaattttaaaattcttcccacatctaaaccaatcgcagcagtccggagagggagttaagagacgtagagccaagaataaaaatttcttagcccttgttcgcacccctataaaaacaccgggactacacagaacagcctatgccgataaactaaatgcaaaatcttctccaaaacaacaacaacagcaaaaatttacgtttaagccagcaatatgggcaaaactgtagagaaactgctagagcaaatctattatgaccttcgctccacggcaagctacgcaggagttcttaaggtctggcaagaagcaaaaaagtataacaaaacaattggtattggtgatgtttaaaaatttttgcatgatcagcgaacatacactctgtttaaaccgcgtcggaataagttcccgcgtctaaagactattccaagcggtcttcacactgactggcaatg

SEQ ID NO: 109164 - DNA, 453 bp, Heterodera glycines
  Promoter: Source sequence=SeqID_22984; Location=1958..2410; Strand=-; Gene=SeqID_53687
cggtccgcggtcccaggtagaataacagggagctcgggaaaatttgccattattaggttaaaatttaaattttgactaaaaaccctaaaaaaagcttttctgacaataaacaccaaaatgcgtatttatccagttcgttttttctgattaaccccttttccactgatgaaagtttttgctaccggtcttggtattggttttcctaaccctcttttgcacaaaactttttttaaatttctaaactctcaccaaaattaaggaattttcggacaagttgaaaatctaagtaaattatcagttttttgaaccaaggtaccgaaaaaggtcgggaattggggatgagagctcggggtcagggatttctatcgaaaattaagtggatttaaatttagtaatattttatttaataatgttttctcctttatttttataattattttagccctttggatg

SEQ ID NO: 109165 - DNA, 960 bp, Heterodera glycines
  Promoter: Source sequence=SeqID_12862; Location=886..1845; Strand=-; Gene=SeqID_76590
tttgcggacggtcggagtcgttgtggtcgtcggcacagtgaacacaacacaaaaagcgggtggtacagaacagcagcacagagaggtgagtttcagcaaaggcgctgaaagagaatggaagtggaacggaacagcatcaacagcaaatgaagaaaagagagtaatgtgaaatggcgtccattttgacaaatttcgaacttccgggccggaattcgaacagaaagtgaaatttcaaatttttcgagtttcgcatttttggttgaaaatcggtttggattttctgaaacaaactgaatcatcatagacaaaaatgcgaaactcgagaaatttgaattctcgacttttggttcgaatcttggcccaaggtgcggaattggttgaaatggatgcctgtttcgtgatcagtatgatcagcgtccccaaatgttgaataaacttacaatgaaaaggaagtgacgaaacagtgaatggaaatgcaatgattgtcagccaaaattgtccccttttatacccctgtaaattcaggcaaaatgatcgaaaagttaaaaattgaaaagcaaacgattgccaaattctctataaaagggaccattttttaaaaaattctctcattttaatttctcccaacaacgcctctctctatttttgaattctcttcagctgctgctccattctattttttaattcttaggctaagcgtcgttttctgttgttcattgttcagaaaatgtcttaaacttttgtttttcattctccaaaaaatccttttatgtttttcaaaatccggcaaaatccatttgaaaaatttggacactgactcagcgtttcttgatccggcagaggttacaaaaaccggactcggccaaccctacttcaaatctccccctgtcctttttcctaacaaaaatttcaaataaaaattaatttaattcatttgctttctctttttaagcgaaaatg

SEQ ID NO: 109166 - DNA, 1003 bp, Heterodera glycines
  Promoter: Source sequence=SeqID_28160; Location=606..1608; Strand=-; Gene=SeqID_58809
attttcataatgatggttttttaaataacgccctttatgatgtttttttaaataacgactccgccccggtcattacgcccaaatgcctattttgtctcaaaactcataatcaaaactgcattaaaaatattttaaaaaataataaaaaagcacagaactcgcaaaacttgtctaaaattcttaaccaaaacgcaataatatcctaagcgtcagagatcgtaaatgtctttcgtgttttaattattttgtgtatttattgtattttatgtttttggtgaataacattccattctttctaattactactaaattttgaacatcgctctctctctttttttttgtattcgttttaattagctgcgtgtgtgtgaagttttccgtgtacaataaatatttccatttaacaactttagggaaaattacgacttaaaatattatcatcgtgatattttcatttttacatattttaaggtttttgcgaattttgaattttctgaaaatttacccctactaaaaacgattctttcgaaaattttgaattcaaaaaacaatgtttaaaaacactaaaacctctatgactaattatctctattttgacatttgttccctctttcatccttttctatgaatttaatttcatattatataaaatcgtttgcatgaatgttagaaaacaaaaaacaaatatctatctcaattttaacaattcaacaattattcgaaattaattatttttctaatttttttttatatcaaaaatagataaattgtaaagttttctagaattccaattttggtgagatctgttttcgccactttatttttccaaattttttttgctgaatagaagatgtcgtaggtgctttaaggcgtcgtcgggaaaaaggataaatcgatgaaagactggaggtttaaccaatagtctaaatgttttttgtgatttaaaaaggatagctcaaattcttatttaaatatttaattttcaaattattattaaacaatg

SEQ ID NO: 109167 - DNA, 695 bp, Heterodera glycines
  Promoter: Source sequence=SeqID_11656; Location=1840..2534; Strand=-; Gene=SeqID_75116
taaaatgatgaaatttcttttctttgtttttaattacaaaaaatgaaagtttttaaaaaaatatttgcattagtaattaattatttacttacttatttatacatttagcatgcgaattcggtgaattgcatgaacctctctgaggttgttaaattattaaatgaattgacgaccaacaaaatgttgctgctaataaatgggaaaattttaccggaaattttagaaaaaagagaaaattttcggcattttttgtgtcacgaaataaaagaagaaaaaaactttatcaaagtgaaaatatttttgaatgggatggtcaaaagtgaatgttttgtcaatttggagaacaaattccccgagattttacgcgttggtaagcttaagaaaattaaaaaaatgaaataaatttattaaattaaatcatcaaaatttatttaaaaatagaaacaaaataagaaagtttataataataaattaaaattaatattgaagcaattttatttatataatataattagtgtagtttttcgaccatcggggagagattaaatgccggggatcgggggcaaaaatcctaccaaatttgtcgggaatggctgtgaaatttcattaaaaaacgagaatttcatacgcacaaaaatcttggaaacctcattttaaagaaagaaaattgcaaaatttaatttccagaattaatg

SEQ ID NO: 109168 - DNA, 204 bp, Heterodera glycines
  Promoter: Source sequence=SeqID_8558; Location=3989..4192; Strand=-; Gene=SeqID_68522
attagttaggatttgaggacatcaatgattaaattggctcaaaaatcgcaactctgcggattaaacatttatccaaaataattcttttttaaatttgtttatattcacagacaaatgatttaaaaattaaaatgaacataaaaaagatttaattgttaaaaaaaaggttttttttctatttatttttttatttaggattatatg

SEQ ID NO: 109169 - DNA, 441 bp, Heterodera glycines
  Promoter: Source sequence=SeqID_15967; Location=1474..1914; Strand=-; Gene=SeqID_80322
tgttttctctttatttctctttctatctctctctcgtgcattactctttctctgattgctccatcccaaaatgttgctattgtccccgcccccgcccctttccccaatcgctctaatcagatttaaggggagtgatgttgggatttgagtcagttgttgatcactcggccattttgatcattcaccatttcccttgccttttgctacacattctggtcaataaaccttttgttattggcttgacattttggggagcagcattttgggggagggatgcgctctcccacatttcaggttctgcctgaaatgctgggagggcccaacatccctcgcgtatttccccgcttattatggcgctcctgggtggatgtggaccattacaccgtaccattcccatatatagaaaataatattaatattttacaatttatcagaaatatg

SEQ ID NO: 109170 - DNA, 91 bp, Heterodera glycines
  Promoter: Source sequence=SeqID_35717; Location=1262..1352; Strand=-; Gene=SeqID_65201
agtaagtaaatattatttttttttttttgaaaattttacatttatttttcccacttttttcagttacaacgaaagtttccaattcaaaatg

SEQ ID NO: 109171 - DNA, 148 bp, Heterodera glycines
  Promoter: Source sequence=SeqID_1339; Location=804..951; Strand=-; Gene=SeqID_72883
tttttaaattgaaaaattttaaaataatttggttttaatagcggggaaacaaaggcgcttgttttggcgcaatttgggcggggcttaacacaaagataatgagttcacccgtcgttttacgacaatcatttgcaattttttaaaaatg

SEQ ID NO: 109172 - DNA, 172 bp, Heterodera glycines
  misc_feature (22)..(22): n is a, c, g, or t
  Promoter: Source sequence=SeqID_10008; Location=1..172; Strand=+; Gene=SeqID_73057
gtgatttccttttgcataatgncgcttctttcttcattcgctgtctccctttttgctctttttcctcctttgtcctccttttctcccaccgtttgtccattctttcgccggtttcttttttttctttttccattttattcctttcttttacatttttcctttttcagcgatg

SEQ ID NO: 109173 - DNA, 193 bp, Heterodera glycines
  Promoter: Source sequence=SeqID_31930; Location=1795..1987; Strand=-; Gene=SeqID_62247
aatcagaatcataactaatgattaaaccctttattgatttattcaattttttcgtaatcttactattaacttaaaatactttttatcataaatatctttcactatatcaaaaaatcatcaaaattttatttatttatcgcttatatattactacgtttcttatagtataattattataatcttcttgcagatg

SEQ ID NO: 109174 - DNA, 569 bp, Heterodera glycines; identical to SEQ ID NO: 102598
  Promoter: Source sequence=SeqID_44321; Location=131..699; Strand=+; Gene=SeqID_71818

SEQ ID NO: 109175 - DNA, 55 bp, Heterodera glycines
  Promoter: Source sequence=SeqID_29127; Location=1..55; Strand=+; Gene= SeqID_59677
agcatactgtaaaaatgatacggtttttagctgtgacaatgagacacagaaaatg

SEQ ID NO: 109176 - DNA, 107 bp, Heterodera glycines
  Promoter: Source sequence=SeqID_23632; Location=443..549; Strand=-; Gene=SeqID_54329
tattttcgttaaattgtttttgttttaccaattttgtttagacatttcgccgtgccaccacttctgtcagttacaatattcaactttttttttgggtggaaccaatg

SEQ ID NO: 109177 - DNA, 91 bp, Heterodera glycines
  Promoter: Source sequence=SeqID_45354; Location=1..91; Strand=+; Gene= SeqID_72663
tggggcaattatgccgggatgtgttacttgtttttaaataagctgaagaaattaattatttaattaaattaagaatgagaagaagggaatg

SEQ ID NO: 109178 - DNA, 630 bp, Heterodera glycines
  Promoter: Source sequence=SeqID_17413; Location=2272..2901; Strand=-; Gene=SeqID_81896
cgtcattttccagtacagtaccattgactaccgtatctgtctggccactctcacgggcgctaccatagcctcgtacgcctcaataatcggcaatgtttctgatttccgtggagcgattgctcgatcattctcgtacccgatcaggtgactctttatatatcgtatagttggaatatataaattttatcgtattattgtagaatgaattcgatcaaaaaaacgacagtttgccaatgttcgtttgcttctgccattctatgtactcttttttgcttggtcatgaatttggaagtgttcaatgtttggacaattatcaacatctcttacgataggcgattaacatttgaaataaattaaaattagttttgaaatttttcaattttattacgatattcagatgggtttactgtaacagtgggctttattcggatgttctgaactccgtccccgcttttgtcgtcctttcactgtgctccttaaattacgcggcaatttttggcctaattttgtggcgcaattttcaaacgaaaagaaagaatcaaacgaattcacaaagtttggcaattttttaaatttcaattttactctcattttggtcatttagctgctgatcagtcagtgcgcaggatg

SEQ ID NO: 109179 - DNA, 1003 bp, Heterodera glycines
  Promoter: Source sequence=SeqID_31853; Location=537..1539; Strand=+; Gene=SeqID_62165
tttactaaaactataagccatcgacaaaaataactaattgaaaattcgaaaaaattactagtcataaagattgacattcaattttttaaccattaaaatcttaacattgaataggttcatcaaagatatgaaaaaatgattaagaatacaaactaacaaaaaactgaaaaaaagaattttctgtagaaaccccattatttttttgcttcgaaaaaagaatgaaattcaattcctttgtaattaattttctcaataagttattttcatcgattttaatttaatttcattgaaaaaacgcactgattttcaattttcgctcctattttaccatttttcgcattatttcgcaatttttatgcccttatttatttacctatttttttcgcttaaaatccgccgcttaatgatcaggcaatacgaaggcttgttatcgcatatggtcccaatgaaaaccaaaatgatcaagatttgatcaatcattacgtgcacttcaatatggaattgacatgaaaggcttcgaaaaaggaattaataatgaatatctatcaattcttattctataaagcacataaatttattttaatcagagcgcaaatgtcttttttcgctgtacggcgcaaatgtcgcggcgcaaatgtcgtttttgttaggcggcgcaagtgtcgcggcgcaaatggcacggcgcaaatgtccgcggcgcaagagtcttttttgctgagcggcgcaagtgtcgcggcgcaaatggcgcggcgcaaatgtctgcggcgcaaaagtcggctaaccatttagacctcattttgtgtggccaccgcagcccaagaagcaatcgcaactgaggcaaaagcgccgctcactttcaccgcgggggttttagtgactgtttgcgcttcgatgcttatcagtttctttgagatcatgtgagcgataattatcatttgtgatttatcggattcacattaaggctttctctcttctgatcactcacaatttgaaacttttcatg

SEQ ID NO: 109180 - DNA, 135 bp, Heterodera glycines
  Promoter: Source sequence=SeqID_9704; Location=1397..1531; Strand=+; Gene=SeqID_72424
aataaaattattaaaatttaattattaatctgagtaaattacctaatccaaacattggaatcattaaaatcttttcgcaaaacgatactcaatgaaattttgtcccgaaaatgctgtataaacaaacaaaaaatg

SEQ ID NO: 109181 - DNA, 117 bp, Heterodera glycines
  Promoter: Source sequence=SeqID_10553; Location=202..318; Strand=+; Gene=SeqID_73790
acgaacttactcccgtccttgactggtaaattgacaatctcacaaattgtttactatttattgttctttaattgtttaataggttcgtcatgaactacacgggtcgtcttaagcatg

SEQ ID NO: 109182 - DNA, 768 bp, Heterodera glycines
  misc_feature (67)..(67): n is a, c, g, or t
  misc_feature (112)..(112): n is a, c, g, or t
  misc_feature (126)..(126): n is a, c, g, or t
  Promoter: Source sequence=SeqID_25295; Location=1..768; Strand=+; Gene=SeqID_56043
attaatagtacattttttaaactataattatcaacactttaaaacaaaaaaaaaatttgcaaaagtntaggtatcattttctttgtacaaaaaaatttctttgacaataatntattactagggtgngagaaagtatggatttctatatttttctgagtgtttattttaggctaataagcatataatagtatttgtagtttagtttgaaggttctaggacatattttttatttccatattccatatttttgtccatatttcacagttttgtccatattttatccatatttcaacatttttttcggaaagtatctaaaaaaattcccaacttaatcaattttttcaattttcaaaatgcataatttcttaataatgccaaaaaaacgtcaaaataacactaaaacctcgagatgtatttgatctgtcaacaagagaaggaaaattattgattttttgattcaaaataaatgtttttatgtaattttacccatgaattttacataaatattttggcaatttcgtccatatttttagagttcttcgtccatataatccatatttttaatcgtttttgtaatccaggaaaagtttgagatgctttgatctgtctataagagaagaaaaaaagttaattattttattgaaataaatatttaaaatgagtctacttgtccatatttcctagaactctatttattacttatattaatgcataaaaaaatttttgatctaaatataattttaggataaacagcactttccccatatg

SEQ ID NO: 109183 - DNA, 362 bp, Heterodera glycines
  misc_feature (46)..(47): n is a, c, g, or t
  misc_feature (116)..(116): n is a, c, g, or t
  Promoter: Source sequence=SeqID_29299; Location=1..362; Strand=+; Gene=SeqID_59813
cagttagcaagtgcttttctatcgcaaaaccttctccgatttctcnnttccttccaatcactcgcctttctctgctgatcactctcaaatgccgcctttccctttccttttgcttntcctttgatcaattttccccccccccccccctttccttcgattgatccgtccatgggttttcctcgcttttccatgctttgatcgccaactgtttgtccttatcatagcgtgccatggctcgatggaattattccaaaactaatgaaagcatcaaaagcctccaagttgaagagcatcaccggcagaatgactttggtactgtccctccttcctcttttcctcgtcttcttccatccctgccaatg

SEQ ID NO: 109184 - DNA, 1003 bp, Heterodera glycines
  Promoter: Source sequence=SeqID_2572; Location=2419..3421; Strand=-; Gene=SeqID_80463
ttgtcgaaacaataaaaggggtcgcaataatcttgcttatattgtatttttttttatgttttttttaaaaatttatttccataaatttataactgtttcattaaacttcgaagacaacctttttttacatatttgggagtttttatacatattaaaatataaccctttaaaataaaggagcgcgtccgtgcgcggtggggcgtgctggcattgggacactggggtttccaaattggggagggataggacactcataaactcccgaaggaaaggccccatggggtgatcaagcccagcagggatcccatcccgcctttgatggaaacacttactgggataagtggcattattccggagtgactggagtgattacagagaaaaatggcgaacattaaatacaaatgaaagtgaaatgtgattgatcaattatcgtcgggaaggggcggtacattaagcaaaaaggaaattaaatgtgagataaattaaatgtgtaaatgttaaatcctagcgcttcggcagttaaacgaataatccaaatctcttacaaatccagactcttacaataattttatttacatattttgagtttttgtacatatttcatgattttttttacatattcatgtatatattttgaccactagaacgaggcggtggagcctggtaaaaatgagttaaagtcgtatggtggtaatttggaacaaggaagtgaagagcaacccagcggtttaatccgccacttttaaattatttttcagaatttttaataaatataaaaaaattaaaagtggcaaaacaattacacgattttgtcgattatgtcggaggaaatcagaaaaatatatgaaaattaataataacatcaacaaatcggaaaccaatttgttttccaacgagacaagcaaaagagagcaaatgtatataaatactgtccatatgttaactgaaaatcatccaaatcaacgcggcacagtaataaaatattaaaagatccgaaaaaatg

SEQ ID NO: 109185 - DNA, 335 bp, Heterodera glycines
  Promoter: Source sequence=SeqID_131; Location=4128..4462; Strand=+; Gene=SeqID_46900
gctgaaattttacgggagtccagggcgggagcgagagttaattaaagactaacaaaaatatttttaatgcacaaatttgaaggacaatcctttattaaagaaaaaatagacagaaaaatttagtaagcagaaatttgaaattaaaaaaatcatatttttgtgtcgaaaatcagaaatttttcaaatttcttcaaataaaattttttaataatttatttgttgactcccttcaatagagccaaaaaataatcaaaccaatataatttttaccaacaaacggtaaaaaataaaccagatttaagatttaccaaatttctaattcgcataaaataatg

SEQ ID NO: 109186 - DNA, 313 bp, Heterodera glycines
  Promoter: Source sequence=SeqID_11392; Location=632..944; Strand=-; Gene=SeqID_74784
aattttatccgtcaaatcggcttttgaaattttaatgagtaaatcaggaaccgtaaagacattctatgcttctcttgtggatacacgggaagaaataatagttagtccttttgttgaatttttagaaattttatccgtcaaatcggctttgggaattttaatgagtaaatcaggaaccgtaaatgacattctatgcttctcttgttggatacacgggaagaaataatagttagtccttttgttgaatttttagaaattttatccgtcaaatcggcttttggaattttaatgagtaaatcagtaaccgtaaatg

SEQ ID NO: 109187 - DNA, 373 bp, Heterodera glycines
  Promoter: Source sequence=SeqID_27371; Location=650..1022; Strand=+; Gene=SeqID_58063
tcaattccttaattgcccataatcgattaataaggaataaaattaaatggccaactcacggcaaaagtaataaaattagggaaaccccaccagctgtttttattgttaaaaatatggtcacaaaaagtcccagtggaattatccgccgctttcttttgcgagacaattcgaaaagtggccgaacgaacacagcagcgccaaattgagtcttaatgccattaattgtcgctgttcattagcactaatgagcagttaattagcaccttcttctgaagcatcgcacaaaaggtaaaagcccaagcatttctcattgtcagtgcttcccatctttgtatttattttggcatatattctccatggaagtccatttatg

SEQ ID NO: 109188 - DNA, 697 bp, Heterodera glycines
  Promoter: Source sequence=SeqID_4972; Location=2596..3292; Strand=+; Gene=SeqID_56408
atcgctgcgatggtggcaatgcccattcagaagagagaggcggaatagaaaaatgaaattaggttatgatggcagcattgttggatttttgtttatttctgtaatgtatggttttcgataaaagtctggacagcgacttcctttgtctaaaaataaagggccagaattgttccttaaattgtttgagttttttatgttcctttttattcacttcaatcaggagcttacttatgctcactcatcggaaataccgtctcttgcaatttgcatccgtttctggtcgggcactaacaataagtccggaattcaggcagctcagttctgtttcgtccatcccatctaattcgcataaaacctcaaagtcagatggaaaggcgcccaaatcgagcactctttgggtcagtcatttgttgtcgtgctttccagcagatcttttgttgtaatttcagcttaatttgccctccaatgctgaagaggatgtgcgaacacgtgttcggagctctttcttcggcacttacgtcgctttggtacattttcgttcctacttttttcatataaaactagtgttggtatcctaccttttttcgatttaataattgtgtttcattcatcggcaactggcatttttcgtccattaatttgcataatttccccagttattcccagccgccacttttgctttgggttgttggcaatg

SEQ ID NO: 109189 - DNA, 412 bp, Heterodera glycines
  misc_feature (241)..(241): n is a, c, g, or t
  Promoter: Source sequence=SeqID_20144; Location=1575..1986; Strand=-; Gene=SeqID_84930
ttctgctgtacctaattaattctgtgacaaatgttttgctgatcactgtgtttggaatttgattggggaatgtccacatttaaaaatgggtaaacattaagcgaaatgaacacgcagcataagcaataaattgagcgaatttcatccattaaacaaaatttattgaaaaatcaaatcgaatcaaaacaattagcgacgattaataaatgcgattagcaattaatagaatctctcaccaatntacacaatttttgccttttcccctctttttatttgtgcaattatttgttattttgtcggctttttatttttcccaattttccatttcttccttcattttgccaaataaacattttattccatctttctttcgcttttttcgaagttttcactgttttttgtccacaaaatg

SEQ ID NO: 109190 - DNA, 99 bp, Heterodera glycines
  misc_feature (48)..(48): n is a, c, g, or t
  Promoter: Source sequence=SeqID_16337; Location=76..174; Strand=+; Gene=SeqID_80725
ggtaattgagttaattatttttcaccattattataaaatgggcaattntaaggctgcacgtggcatgggtgcaaaaagtgctacccaaacgacaacatg

SEQ ID NO: 109191 - DNA, 328 bp, Heterodera glycines
  Promoter: Source sequence=SeqID_42525; Location=1..328; Strand=+; Gene=SeqID_70398
ggggacctctagagtccttcaccacacccctttgcatgtatctcctagcagccatccccacggttcaatttgcttatatctaatttttggagattttctattttaaatttttcaaaattaaaaaagcgagattttgcgggatttatccctgcgggtcccgtcccgcaaaaattttgacttctattgaaatttccggtctctatcacagacgtcgcaaatacaatttttggttgcccttttagcgccgctcgtcgtcccaaagtttcacttcgatgactctgtgctcaatgaacacattttggttaatgtgatcaacagtttgagcatg

SEQ ID NO: 109192 - DNA, 825 bp, Heterodera glycines
  Promoter: Source sequence=SeqID_35964; Location=275..1099; Strand=-; Gene=SeqID_65414
taaagttgagtgtctgtatgtatgtacggatttttgaatttgtgtggcgttttgttattattttgcgttaaaaaatgatttgaaaatgaaaatgtttttgttttgttttgcgttaaaaaagcatttgaaaaatgaaaatgtttggttttgatttttcaatttgttttgcaataaacattcttaaaattatacctatttatttgcttttttatgtatgttcatagtttattaagttatttgtcatataaatttgttttttgtaaacgaaaaaatttatcagtatattgtttgagtttgatttagtggttgttgtttgtttgtttgtttgtttgtttattttgtttttgtgttctttacgtgaaataattatgcttatgcttaatgttatttgaacttttaatgaatagaaatgcatatctttggtttgttctgtgactttagtgtgagacactaatgtgtgtcatgcttttgataaaacattagtggtttgttctgtgaccttagtgtgagacactaatgtgtgtcatgcttttgaaaaaacattagtggtttgtgtgaccttagtgtgagacactaatgtgtgtcgtgttgtgccataaggaaatgccaaaaaacaagaagagatgatgaaaatgcaaagaatgttgtgccataaggaaatgccacaagaaacaagaagagatgatgaaaatgccaagaatgttgtgccataaggaaatgccacaagaaataagaaaagataagaacaagaagagatgatgaaaatgccaagaatgttgtgccataaggaaatgccacaagaaataagaaaagacgaggaaaatg

SEQ ID NO: 109193 - DNA, 124 bp, Heterodera glycines
  Promoter: Source sequence=SeqID_9658; Location=1479..1602; Strand=-; Gene=SeqID_72220
aaacgaattgctaaaaacaaaaggtgtttatttaatgggctttaattgaaattaaattaaatcaattaattaagaatttgatgatgaaaatttcatttttggagtgtataaaaaatattttatg

SEQ ID NO: 109194 - DNA, 712 bp, Heterodera glycines
  Promoter: Source sequence=SeqID_39108; Location=1..712; Strand=+; Gene=SeqID_67751
gaaaatggcaccgaattaggcaaatggcgaacaaaatgggtccatcgaattcaacctgtacaattattggataaaaaaattggttgatgaacaacatgaagaaattgaaagaattcaaagtaatttcaattattatacagtttgacatggcggcctttaaaaaatttttgaattcaccagggattttatgtgaatattttttcgggaattttcaccccgatccgagacttttatatcctcgaataacggtgatgaaacaagattaaaaaaattaaaaaattaatgccaggattgattttgtgtgaatgttgtgaatgttttgtcgggaaaatttatcaccgatccatgacttttctctcccaatgtcggggatgaaatctaagttaaaaaaattaatacccggatttatgtgaatattttgtcgggatttttctccccaatccgtgacttttatctccccgaataacggggaagaaccctaaaaaaaaattgttatgaaaattctataaaaaaatttataaaataaagtagtttgttattcaaaactcgaaaatagggacagtcatagaaattttaggcatttgggaagctctgctcttaaatttttaaaattaatttacaattaaaaacaaattatttaaaaatagtttttttatgcattgaaaaagatgatttaaaaatcgcaaaagcgcaacaaattggaataaaaatg

SEQ ID NO: 109195 - DNA, 192 bp, Heterodera glycines
  Promoter: Source sequence=SeqID_40838; Location=1..192; Strand=+; Gene=SeqID_69084
tagagaccaatatttgagaagtgagttagaaatgataatcttcacgattcctttacaagttcgatgctctaattaaccgcgataaaaacatcctaatcaattaaatagcttctgagataataaggtttatcataaaatttcttttaaaaataaaccctcaattattggaatgaacgctactttccaaacatg

SEQ ID NO: 109196 - DNA, 285 bp, Heterodera glycines
  Promoter: Source sequence=SeqID_15665; Location=1361..1645; Strand=-; Gene=SeqID_79967
tcttagaagtcaatggatttatttagtgaaaataaaaaaggttttcatcattcaaatcttacgtatatccccaggcgttacctaccagcaccgccaagataccattatttagccattcaaatttcgaccgaaatcgtgaaacaaccaccattaataaattatcaatttttttaaaaagatgaatattttagtagcgaaaaaaacccaaattgaattagcagttagaataaatatatttatgttttaaataggtatatttatattagataactaaaatatttaatg

SEQ ID NO: 109197 - DNA, 102 bp, Heterodera glycines
  Promoter: Source sequence=SeqID_8023; Location=1165..1266; Strand=+; Gene=SeqID_66729
actaaaagggtaaaaaagggaatgaaacaacggaattgctgaaccaatggagtagccgctgagggcaaaagagtacgacacggggtgaaagtgcaaaaaatg

SEQ ID NO: 109198 - DNA, 444 bp, Heterodera glycines
  Promoter: Source sequence=SeqID_18137; Location=2875..3318; Strand=-; Gene=SeqID_82721
atttagaacaacaattatgatgaaacgcttgacatgaaaaatgctattcaggctaatgaatgttcaattgcccttgagacattcaatagtgaaaaagaaacaatgaaattacatgacgattatcaagtttaattaccaattaataattgtctaattaattaattgttaatgaaccttttagcatatttttcacaatgattgtatcatcaaatggtaatacatacataattaaagttgtttaaaaacaaatgcatatgaattttagggttaaacaacaacaactaattcgatgccctctttgtaacagagaagcaaaattcataaaggtacaataaaatatggaaaaatttaattagtcgcgtaattaaagcgaattttttttttttacaaaaatgcaaataaaaatttaatatcaatttgttacctttcatcctttttagaatg

SEQ ID NO: 109199 - DNA, 68 bp, Heterodera glycines
  Promoter: Source sequence=SeqID_23408; Location=336..403; Strand=+; Gene=SeqID_54114
ggtacggtacaatcgacacagcacacggtgcctttttggttacggtaataccgtagtgtgttcagatg

SEQ ID NO: 109200 - DNA, 974 bp, Heterodera glycines
  Promoter: Source sequence=SeqID_7887; Location=2774..3747; Strand=+; Gene=SeqID_66287
ttattaccgtatcacactttgataaggaatgaaaacctggaaaattttatattttataaaataattccgcgtgaatttttcaataattttatttaaaacttagaggattattagattctgctggattatcccaggcgaatgggatttaacaaatcccaatcgtctcatttgtccgccaatttttgtggttttcattcacaaatgtcaaatttaattttgtaaaaatgggcgaagaacggcagcgacagacaaaaagtgctgaatcaccaaatggattattttagggcgaaattgactaaaattgccttaattgagtctaattgacatttaatttgcgttttgcaatgatcaaaatttgagtgtcctcccttttgccccaatttagtccgttttatttatttagtggttaaatttaactaattaacaataattaatcaatgcaagggtgattaaaaagaagtaatatgatgttgctcaaattgttggatcatctgcaacgcagcaggtagcagcagcagaatgaccaaatttggcaacgggttatttttaaagatttttatagtcaattaagtaaatggtttttggtctaattaaaactggaattgctgcccgcaggcaagagggggagaggggcaattttccggtcccaaaacaaaaacaataaatagagaaaaatcggcaattttcgagaacctttcattatttcttgttggaaacaatttttataatttttaaaagaaaaatctatgggaatgaaaattgtgcatttaattaattgaatttattttttgaaaaatgcatttttggctttttggaaattgaattctttttttaaatacgaataaatgaatggataatttaacgattaaaatgattttgtttatttcaattatataatttttaaaaaaaaatatatttttgagaaataaaaataaataaaatgatgtttccaaaaaataaattgtctcaaaatg

SEQ ID NO: 109201 - DNA, 677 bp, Heterodera glycines
  Promoter: Source sequence=SeqID_4782; Location=409..1085; Strand=+; Gene=SeqID_55693
ttttttgacaaaaatcggtgctttactgtaatctgtgcggagattcacaaaaaaaaattaattaagaattgtcttggggtttttagggtcgggaaaaccttctggtatctaatttgtcccaattcgaaccccgaaccagattcaaaccaaaagtagtaaattcaaatttttcagatttcgaatttttgttcaagtccggttggctgtacttttgttgacaaatgaattttctacttttttcgagttttgttcgaaactgggttcggggggtatatgaggaggaggggggggggctttaatagagcaaatacgatacggttttttacaattgccggccagcgacagcgccatgaacaacggcatgggcaaaagcaacaactgctggcccacacgcacaccaccaatggcacccgacttggcagtcggcttcccggtcggaggcgctggtgttttagcaggatcaaaaaaggcactgcacttccaactgttgtcgaacagagccatcagcaaaaacaccacaattaaagggcacacaaaacggggaaacattttaagtataactaaattaggtatagtttgattatttatttgtacacggacgggggtggctgtatttgaaaaaaatgtattaggtactttatttttaaaaaaatgccaacaaatgggggagcaaaatg

SEQ ID NO: 109202 - DNA, 293 bp, Heterodera glycines
  Promoter: Source sequence=SeqID_1232; Location=1808..2100; Strand=+; Gene=SeqID_70317
gcaagcaaataaaacagaaaaacaaatttaatttacaaaaaaatgtcaatcaaaaagtaataattattcctaatttgtgccaagtctcgttttgtaaaactgccataagaaacaaaaacaatttaatcaaaagaaattcagattttgattcaaattcaagcaaagtttttatggcttaaactttatatgtcttaaaaaaataaaataaattttcctcttttaaatataattcaaatttaagaattgactttttaaataaaatttaatttaagaaatcgccaatttcgttaatg

SEQ ID NO: 109203 - DNA, 218 bp, Heterodera glycines
  Promoter: Source sequence=SeqID_6982; Location=5054..5271; Strand=-; Gene=SeqID_63479
tctcattttttgccgggccgaatggcaataattccgtccgggctgtaccccgaggccacaatgcgttccaccagcttttccaacgatcgtcgcgtcagtgccgatggatgcaacatcagccgcttctgtcggtgatcgtctacagcatcttcaaaggcaattaaattcttttaaattttttaaaattttattactctgcaaattcctcggcacggatg

SEQ ID NO: 109204 - DNA, 1003 bp, Heterodera glycines
  Promoter: Source sequence=SeqID_40075; Location=10..1012; Strand=+; Gene=SeqID_68514
aatttttacaattaaaagcaatgaatgcttcctgaatcatctaagtgtactccgttaagataacattgctgtgataaacggacaattttcgccaaatgttggggatcactttgttaagataaaataagaaaaaaataatccattgataaattaaattcaataaattatcgggtctaaaatagtcctaacaaattcataaaagcggcaaagtccaatgagttttactctgttgacaacttcacgaacaatttaatgccactgaaagtaatcatttattatgcgattgcgatacatttgatgtcatctctgttgtcttcataatccaaagttcagaacataaaaatccgaaatatccaaatttcgtagcaaataatccggattttctggagagttgaggtctgacgacaatgctatgcgtttccgaagaatagaatccgttttcggtttacatatagttataggcataatttatctatgtcaaaatggtcaataaatttctaaattacttttaacttttttgagccgatcccatcatccctaaagcaaatcccctccccccccccccaccaccacaaaaactcataatattttttggctgtgccgcatgacaattctccgtttcaatataaaatatttagtcagttgtactgcaccaatttcttgttgatcggttccaatttcgaacctgcgaagcttttgataggcgccaagtaaaatgctttttttctctctttttgtatgctcaattccgtttgtttcacgaggaaaattaaattattatgaaattaatttaccaaagaaaaaaagcattaacgagaaaaagagacaaacaaaagcttaattaattggatgtttgaccaggcgatggcaggcaaaaagttaagcaaaaaaggcgaagcgctcaaaaattggaacgcataaaaggcgagcgaaaattgtgaaaagacaaataattcattaaagtaaaatcctattgtgaattggcatttctctgtttaaaatg

SEQ ID NO: 109205 - DNA, 863 bp, Heterodera glycines
  Promoter: Source sequence=SeqID_6459; Location=825..1687; Strand=-; Gene=SeqID_61665
tttctgcgggtattagtgtcttgatcatgccggtgccgaaagagtagcgagtactagtgattagtgacgctacggaatccgacttccggtttcggatatttttagggtcggaattccgatttccccgaacaattcccatttcggaaatttttgataaaaaagtcagaaaattttaaaacctttaaaaaaaaatttttttaccatttcaaaatcagggacatcaactgaaaattttcaaaatcagtattggcctaaaaaataatcattaggggtcaaaagccagcatttagaaaaattttatttcaaatgaaaaaaaccaataaaaatgttttttagcagcaagttttttttccaaaaaaactattttcaaacagggggcaggtggataagaattgttccccatggatttgggttttcatcaaaaatgtgaaattttttctctcatcggtggacatgttttgaacgaatttcttaatgtccaaagggctcgcgtaatttaaattattattttttattggactattccatatatttaaattaatcttcaaattttcaacataaattcttgcactatgggtcaactccactgtgcagagaaaagcctagtactatctcgtcgttactctttttctttgtaatttctctcactttggcgtactatctcttcaattttaatggtgtaaaaacaacatttacttttctatgtctagctttttttctctatgttaaatccgcaccaaattttgcatagcgatagagaaaaaaattacgaacatttttaacgctcgaattattttttttacgctcagatctaaaattataagccaaaaacaagtaataatttatttttctaaatttagatg

SEQ ID NO: 109206 - DNA, 445 bp, Heterodera glycines
  Promoter: Source sequence=SeqID_27437; Location=1..445; Strand=+; Gene=SeqID_58133
cagttaaatagtaatttttgtctttcggcctcgtatgggtctgggttttcagtaccggtctcaggtctcgagaaattcggtctcgagcatcacattacggcattcatttcccaatacccaaaatgcttaagtggtccaaatttggattcaatcgccttagattaatttcgaatccaccgaaaaatttgtttctcagctcaacggtttattttatgtttggccaacgctttttttgcatcgagaattgagataagggggaaattgtgtgagaacgaagcggagacggcttgtggagggtgaatcgaatgaaagaatgaataaatggaagtgaatcatcgccaacgccaaagcggggaggggggggggggaaggcttatcgatggaaaatatttttaaaagaatttccaattttgtattgattttaggatttaaaaaaaaaattatg

SEQ ID NO: 109207 - DNA, 173 bp, Heterodera glycines
  Promoter: Source sequence=SeqID_1446; Location=4060..4232; Strand=-; Gene=SeqID_73583
cgtaatttttgcaacttttttttaaatttatgacctttgaaatcaaacttttgaccatgggaaggcaatcggttataaattactttcaatttcagcagaaggcattccaagaagaccacgagaaaaaattgatggaacaaattgtgaatttgcagacgaaagttgacaaaatg

SEQ ID NO: 109208 - DNA, 112 bp, Heterodera glycines
  Promoter: Source sequence=SeqID_33135; Location=548..659; Strand=-; Gene=SeqID_63293
tctttgtatttattttggcatatattctccatggaagtccatttatgtacaaagttttgctgtatcgactgctctcaacttcctctcgtgaaatttggacacttttccaatg

SEQ ID NO: 109209 - DNA, 463 bp, Heterodera glycines
  misc_feature (10)..(11): n is a, c, g, or t
  Promoter: Source sequence=SeqID_37103; Location=1..463; Strand=+; Gene=SeqID_66264
cttttcacannttctttttgaatttaaaaaaagcattggctaataaggaaatgttatttttcatgctttttgaaataaaaaatttgtcattctgatacatttcctcgtgaattatttaatgaattatcgtgttttaaaatttcaattttaattgataaatattattatttaagcggttttaaaaaaagaaattcctttttcggtgaaaaagtccattttacgtaaggctatttttaggagcacaatttcgagaaatcctaactgcttttgttaggttacttttcgagttcaaatctaccactaaaaatttttatataaaagttttttttacaaataatttagaatttttcaataaaaacagccaaaaaaatgttcagaatattaaaccaattagttcatccttgtaaatattaatcattttcactaaattagttcatatttttgtatttttagactttaaatg

SEQ ID NO: 109210 - DNA, 64 bp, Heterodera glycines
  Promoter: Source sequence=SeqID_24415; Location=1249..1312; Strand=-; Gene=SeqID_55141
cctaaaaaggaaaggaaaaatggcacacattcggagaaggcacttcacgtacatataagggatg

SEQ ID NO: 109211 - DNA, 385 bp, Heterodera glycines
  Promoter: Source sequence=SeqID_30581; Location=1176..1560; Strand=-; Gene=SeqID_60987
tatttttcaaaattctccagaaaaaataattgtttaaattttttgagttttttataatgataataaataattaaaattaaacatttgttgtttcctattaaacatttttttaattttaggagacaacggtaattttttatcaacatttcaaattccggtgtaatacggtgtttttttatttttttaaattgaattaattaactccacaaaaaaagccgccgccccgccaattgactgagctcgctgaatgcgaaagtgcgaggcagaaatgcccttatcgtgaatacgcttgtcttccggaaattggcgctgccgggcaatcgtgctgtggggccggccataagttcacatgcatggaggtgggcaaaaatacagtaaaaaaatg

SEQ ID NO: 109212 - DNA, 662 bp, Heterodera glycines
  Promoter: Source sequence=SeqID_5649; Location=1825..2486; Strand=+; Gene=SeqID_58776
aacagctgagcccattgactccaccggcagcaaaaattgtgccatcaaatgatcagaaacaaaaggagccggttgtcattattattgatgatgatgccaataccaataatcatcagaaacggatgaaccgcggaatggccgtggcaacaaataaggggaagaagccggccgaatcaccatttagtaattaggcgttgatctaatcacgacaaaaaacgccaaatctttccaacaaagacgggaccgaattctgaaatctctgcttgcttatcaattcattcagttccggtctctctaattaatttctcttgcgtttagttggtcgcagcgatgccattgtgccatcgtcgaaactcactcccattgtgccatcgccgcaacttcgttccgccgctggcatcggagtaccaccagcaaaactcgatttgtccacgttgccgcgcacactcccacccgtgtcacccatgaaaggaatatcgccgcgcaccgccgccgcttttccgattgcgcggaaacgacgcccgccgctgccaccgattcgggtgcccagccagacgaatcagtcccacggccaatccatcgtcgcaccgctgaatttcaggcaaatcatttccgaatcagaccgattttatttaagagctttttttgcatatgtcataatg

SEQ ID NO: 109213 - DNA, 477 bp, Heterodera glycines
  misc_feature (19)..(19): n is a, c, g, or t
  Promoter: Source sequence=SeqID_11844; Location=1..477; Strand=+; Gene=SeqID_75347
caatcaaaattaaatttanttttgctcataatatatagctttttttttaaagaatcggttttttaaatattaaaaatgattttatagccccggaattctgaggcaccgctggtgaaattttttttgaaaaactaggctcaatttgataacacattttctcaaaaattaccaaatcttgtgtaaacttaaaaaaattatgaagaatcatggggccggcggtgtagtaaattaatttactagtaattgatttgttcaatatagaaaaattatatttacttaaaaattacattatgtaaaagaaatttaattattgttgaggaaatgaaacagtgcgaaagtatttgaaaagccagaagctttgccactaggccatttgaaaaaaaagttgtaaatttacaggagaatataattttttttcagcgttgtctaaatctaactacacaaaaaaattaaaaagaataaatagccccaaaaatg

SEQ ID NO: 109214 - DNA, 614 bp, Heterodera glycines
  Promoter: Source sequence=SeqID_30266; Location=1..614; Strand=+; Gene=SeqID_60686
ttgcttttctacatttctattctggcaattatggcatcattaaaattttttaattgaaatttaaaaaattaataaatttaatttttatcctgagttatgaatattgttaaatttaaaatctttttttttctattacgcttttgaattttccattttaattccaataaaattatccacgtataatttcagtggatttggtgagcgattttgacataatgaaaaaaaattcgcctaaaattttgctgagcaaataaaattccgttgaacttttaaatttcggagtgagtttaacaaatgtttgaactatatccacgtaaatttcaataaatcgaacgatgtgaatagataaatcacaaaaattcgctcagaaaattttactgatcaaataaattttgaaaatttgtggggcacctgaaaaaactgtacaaataatgcatttgaatatgccgacggaagtcaactttcaacattgcactactgttcaaagcatataaaagggcttagtgaatttggagtgtaagcatttaatttaattttaaaatttaattattatttcgaaaaatttatttaaatttccaaaaaaagtttggggttttcagtaatttcaaaaaatg

SEQ ID NO: 109215 - DNA, 732 bp, Heterodera glycines
  Promoter: Source sequence=SeqID_1617; Location=6317..7048; Strand=-; Gene=SeqID_74863
ttttggcatgtaaactatttgtttttgttcatatatatttgttcgaaggcggatctcttccggagtctctgggtgcatgtccaccaaaaggtagccaaaaattttcgcgcatgcgtcccggtaggcctcaataaaatgggcagtccttgacgggaagaggtggttggcgattggcatatctgcaaagcccccgcagggtttcgcattaacactagatagtgcgaatttgtgcgcgccacacgcagctctttgttgaacaggtgttgagtcaccaaaattacgctgacgccccaattgtgtgagccacgggtgaagagtgcgtctaaatattgctgactcatccccaccaccaaatcatccagcaccagtaaggttttttcttttttggcgcactcccgcacttgttccgctcgtgggacgccgctgtgtacagtgactggcacattgccaactttgccggcgcgctgtaaattcactacatttgtgttcagctcgccatagctataaataacgcgttcaatgggggtagagatcattttgtccacatttcgcaacagacgcattatccactctgacttcccactgcctgtgctcccagacacaatcattgtgaatggatgacgaaattgtccatcctcccttttaaattgttggaaggcgtccattttatttttttttaatggaattttctttttatttatagttttacattttaatagatttaaaaaaatg

SEQ ID NO: 109216 - DNA, 212 bp, Heterodera glycines
  Promoter: Source sequence=SeqID_7237; Location=601..812; Strand=+; Gene=SeqID_64225
aacaatttatttttgaatctcttatatggatcttcataatgttgttttttgtctagatttatctcgattttattttttaaattattttattttgatttttaatcgcatttttacaagtttcccccatttgtcatagtattcatttgatattccaatcattttaacttttttttccatgccgtcatttttaacaaatttatcgaataacgatg

SEQ ID NO: 109217 - DNA, 382 bp, Heterodera glycines
  Promoter: Source sequence=SeqID_3985; Location=78..459; Strand=-; Gene=SeqID_52699
tttttttcttcagttgtgcctttgttgcgaatgttgagagcggatttgtgaagcgaccgttagaagtaaaaaattttggtatttaaaaaaatctaaaattacacaaaaaaggtgaaagatgctcatatttttgagcaaaagccaacatttgtccgacacgacagaaatataatcaggtaggcccgacataaataaatactgaaaagtacaaatttgtcactgaaaatttattaaataaatgatgtttttaaacatttattcgttttttttttttgtctttttacatcgaaattcattttttcaatgtttattttttgaagttttcggtgtgaatcctcaaaaataaaatgaattttggtgcaacttagaattgaacgagatg

SEQ ID NO: 109218 - DNA, 111 bp, Heterodera glycines
  Promoter: Source sequence=SeqID_45121; Location=1..111; Strand=+; Gene=SeqID_72486
aacccgctttacacggtagacaacgagacatatctccacctttttcgagaaaatttgctcgaaataatccatcaagcccaagaaaattcaaaagttaacagggaaaagatg

SEQ ID NO: 109219 - DNA, 421 bp, Heterodera glycines
  Promoter: Source sequence=SeqID_11246; Location=3181..3601; Strand=-; Gene=SeqID_74610
tttttctggttgggggaacaaattttcgaaaatttttcaatttgcagagaacccttgtgcacctcgggaaaatccaaaaattttcaaaagtcccttttttcttctttctcaaactaaattatgaaatttaggccagagcccattgtcaccgaatgacctggatgagctagaggagcgtgtcaacgattttaaatcttttttgtctgcccaggagcgaatgcgcgtgtttctctcaaagaagcccaaggcacatcttttgttgagccattttgttcccttcgctcgcgagcacaaatttcttggccttttagatgaacagggttgtggtgaaaaatgttttctatcccattaatctgaatttaaaggtgacgaggcgctccattcagtttggcgccgacttgagcaactgtggaagtgtatg

SEQ ID NO: 109220 - DNA, 277 bp, Heterodera glycines
  Promoter: Source sequence=SeqID_20882; Location=832..1108; Strand=-; Gene=SeqID_51464
ggtaattagtgctaattagtgtgctaattaattaattaataggaatagcaaattattataccatttgttgaaattttacccccgtccctccataccattttacttgattttttacacacataatttttattgcctctgggttttcgagttttgggttgctttttgatttggctcgtaacagaaagccaaaaatatttttaaatttaaaaattggaaattttaaatgtgaaaggggcaattttttaaaaataagtagagatcggaattctcaaaaatg

SEQ ID NO: 109221 - DNA, 982 bp, Heterodera glycines
  Promoter: Source sequence=SeqID_9535; Location=1805..2786; Strand=-; Gene=SeqID_71788
agaaggttcaataaaattaaatttagtgaaaaaacttaaaatgctggcaatcgtgaagaatgggagtcccaaatttgaatttattatttttaaaccaaaaaacgaatcttggggtttttgataattgataaaaatttgattttttgccagaatgctctcatttcaattggaattcaattttagtaactcggaattttcgtttgtgtctgtttgggtattttaaaatttctttgcttaatttccatttaaattgtttaggctgggcccactgaactggtccaacttcacgaatcaagtgcacaattttttgaccaattttgaagccatggaggaggagtggcgacaacgacagcaagaagtgaattattgtgggacggggaatgtgtgtgtcctgttaaccacgcttaaatcggcccacggttttgctaaagttcccgagaattctccctgctgttcgaggcactgaagcagtattctcatttataagttcctcggaagattttcaaagatggcataaaatctcacaaatcttcaaaaattttcgaatttcttaccgggaacgattgggctgacaatgacaagggaaccactcgaactgtaaatcggaaaatgggtatgaaaatgcacgattggcaaatcgactctgtcctatgcaaccgtaccatttgcatgcctttttccaacttacagttcgatgcttcccttgtgaacactaatttgtgagtaaagtggcctggctaatctatcgtttttccttttattttttggaaatgtcattatttgttgcgtcttctttaagctcaaccaacagatcaaacagtacagtcaggacagaccagcgtgggaacaacactacgaaacgtacaaaaacaatgcggtaagaagtttatacgccaaattcattgtaaataaaagcatttttggccgatagacaatcgaccaggacaaaaggagcaacattgagcatttgtacaagcaaatg

SEQ ID NO: 109222 - DNA, 90 bp, Heterodera glycines
  Promoter: Source sequence=SeqID_34274; Location=847..936; Strand=-; Gene=SeqID_64107
tgcaacagaaattgaagacgttcaaacgacaaaactaagaggcggtgagaaggaaaagggcggagagaaaaagaaaagggaaaggaaatg

SEQ ID NO: 109223 - DNA, 408 bp, Heterodera glycines
  Promoter: Source sequence=SeqID_29861; Location=2148..2555; Strand=-; Gene=SeqID_60325
tggtttacttatcttaaccgcggttaagaacttaaccctttgacgggaataaggcccccgatgtttgccttcttctcaatattttttatttgacgaaatttatttttctccaattttgcaagcaaaccctaacaaattgcaaaaccgcttaatccaataatgctttagcttaatgcatcgagctggagcagtacatacttagttaacagaacacagctttaatgaaatgttcggcaaaacatatttttgaatgtgaaatgtatataatggaaattttatgcaatgaatgaaaaaacggcaaaaaaataggaaaatggacacaaacatttttatgaaaatatttgaaataaagaattatgatacatctttagctaatttatcttaaaattttttaagcatttgaaaatg

SEQ ID NO: 109224 - DNA, 117 bp, Heterodera glycines
  Promoter: Source sequence=SeqID_12110; Location=545..661; Strand=+; Gene=SeqID_75670
cgtacgtttatttaatgacatgcttgttctattagacggttttatgcttttttaggtgagggcagaatatccgatgcattagttgaggcatttttagaattggacgagcaaatgatg

SEQ ID NO: 109225 - DNA, 123 bp, Heterodera glycines
  misc_feature (8)..(8): n is a, c, g, or t
  Promoter: Source sequence=SeqID_10112; Location=1202..1324; Strand=-; Gene=SeqID_73196
gatagttntataaattaaattttcacttactagtactattaacttataagcttattccaaaatatctagagcttttgatacccgctataaactaactaatccttcaaaaaaaaacaggtaatg

SEQ ID NO: 109226 - DNA, 995 bp, Heterodera glycines
  Promoter: Source sequence=SeqID_21323; Location=1..995; Strand=+; Gene=SeqID_51916
gctataaaatggcgccaaatttaggcattatatatatttttaatttttctaaaaattttaatggttctgccaatataaaatcaaattaaatatgcttacgaggcgattttttaataatgagatttttacagaaaattttaaagctgttcgttaatttcaattaaatttttttttttaatttttattcgtaatttaatttattttaaatatatttgatttaaaataattttcttttaaaatttattgttaaaagtttctaactaattaatcagtcccttttatttttaattaatgcgtcaccaacaattttttacggcggcgcttttttatgtaaaaggcggtgattgttaattgactggatggagtcatccaactggttaactatataaaatggcttttatgagacagatgaggataaaacatgaattaattattcattttttattttttaattgaaattcaattttttctaattaaattttttcctaattaaaattataattaatttttaagccattctttgtttagctgtatttggttaagaattatatttaatcgtctactaccttttttaataaataaacaatgtaatttataaatgatttttttaaatttaaataaattaaaaatcaaaatgttgggtattttacaattcatattttttgatgttaaaaaatcaattattttacctttgccgttctttattcttaatgacataagcaacaaaggcagctgacttactaaatattttgttaaaaatttttattccgtaaacttgaaatttaatatttcattacttaaatcaataataggaaattcaatctttaaaatttgtgttcaaattttttttgatcaaaaatttaatgttttaattctaaatttattaacaaaataatttaattgggttttaatataaattttcacaaataaataaataataactgttatttctaaattctcaaaataatttagaatttttacagttatttataatg

SEQ ID NO: 109227 - DNA, 119 bp, Heterodera glycines
  Promoter: Source sequence=SeqID_25576; Location=2119..2237; Strand=-; Gene=SeqID_56318
cgtagcttttttccaaggaatgccgtagaagttccagaggaggaaatccgaccattcaggccagacgacttttacgacgcaaggatgttatggccaggtggctaaacgaagacacgatg

SEQ ID NO: 109228 - DNA, 561 bp, Heterodera glycines
  Promoter: Source sequence=SeqID_18465; Location=1..561; Strand=+; Gene=SeqID_83065
gtttgttttgctatttcagacacatcaaatatgttcgtcgtcatcaactccattctgctgccgggcgtattgatgcattcagttggagatacaattgaggcgaacttcgaaccaaattagcaattgcctaaaccatgaacaaatcatactaagatcggaattaaatttcacaattgtaatttttcaagaaaatccaaacattggataaattctttattggcaaatgcagttcgccttttctttattaaaaaaacatcgaaatttcgatgctttctatctttgctagcgaattttagatttatgagtaaattttttcaaaataaagaaggcttttatggtccggctaatcgaaaattttatacgttaaaccgtccttggttctgtaaagtaataacacacagtactgtacaatttttgtggcaactttctcaaaatttctaaaacaggactaaagtggcccattttatatgctgatcagtgtcaataatgtacaccaattttcgggttcgcctaatcatgcataagacaatcaaatatcagcttgataaagagtgattgatg

SEQ ID NO: 109229 - DNA, 217 bp, Heterodera glycines
  Promoter: Source sequence=SeqID_6004; Location=2639..2855; Strand=-; Gene=SeqID_59984
aaggaggcggtggagacgacgacggagaagatggaggaggaggcggcgaactgaggagagtgaaaggaagagggaaaagtgggagagaagggagaaatgagtaattttccattttgttcatcgtaattccctccccccctgtccaccgcagggtcgaaaaagccgaaggaggctggaccgccaccgccacagccaggcgagtattgtaagtggtatg

SEQ ID NO: 109230 - DNA, 410 bp, Heterodera glycines
  Promoter: Source sequence=SeqID_2069; Location=973..1382; Strand=-; Gene=SeqID_77666
ttgtcgaaatgaaatgaattataaaaaataaaaattttgttaatttgaaaaatgaccaaaattcaaaattaaaacggatcgaaaagagttagaaacaaataataattatgatccaaagagggagagaactgatcagaaaagtgggggggggggcagagaaggaagtgatcaacgacggatcagtggcgaatgagagcaaattgatcggactttgctgagcatttaatattattatattacgcacaaaaagagttttatgaattgggagactctgcccctttaactaacgatttgtttattcataaaattcgacaacaaaacaaaccgttgatggcctcgcatttttgtttgggcaattgtataaacgaaactgagaaaagcaaaaatgataaaaaaggggaagaaaaatg

SEQ ID NO: 109231 - DNA, 364 bp, Heterodera glycines
  Promoter: Source sequence=SeqID_5858; Location=4547..4910; Strand=-; Gene=SeqID_59463
tttttaaaatattctcaaatattttgattatttaatgggacaaacaaattttagtttgatttcaagcataaatattataatattagacatctttcatttttcaatataatatctggtaaaaaattaattatttttatacttatttacaagcttgctcatgtgcttcggccactttcgtagacagaaattatctaatattttaattttggcttttctttttataaaaataaaaattacatttaatttatatacataacataaaaaaagctaaatttaaaaaatcggaaaaatgtttaaatttttagaatgatatcacataaataaaaagtaaaagtgaaaatgtgtgtaaatgttgaagaaaatg

SEQ ID NO: 109232 - DNA, 107 bp, Heterodera glycines
  Promoter: Source sequence=SeqID_634; Location=1..107; Strand=+; Gene =SeqID_57826
ttttgtgatttttgtttttccatcaaattgtttaccattttctccgtgccaatgccatttcttccgtcagttacgaaattcatttttatgtgcaagtgtcgtcaatg

SEQ ID NO: 109233 - DNA, 116 bp, Heterodera glycines
  Promoter: Source sequence=SeqID_19780; Location=1423..1538; Strand=-; Gene=SeqID_84518
ggtttttcatctggaatcatatcccggaatccgatcccgattttttcaaaattctcggctctaagaccaactgaacatttaatttttttaaatttctaatttaaggtgacagaatg

SEQ ID NO: 109234 - DNA, 233 bp, Heterodera glycines
  Promoter: Source sequence=SeqID_14918; Location=1..233; Strand=+; Gene=SeqID_79081
tgtttggccaaattgtcaagcttttgcgcaaaccctcatacaactacagagtgcttgctacggcatccaccggctgtgcagctattttgctgccatatgggaaaacggcccattccaccttccgtctgggcagagacgtgtctctcgaaaaacttccaagcattccgctggagagtttcttcgccagacggattcgtgaagcacaactgatcattattgatgagattacgatg

SEQ ID NO: 109235 - DNA, 306 bp, Heterodera glycines
  Promoter: Source sequence=SeqID_7868; Location=3017..3322; Strand=-; Gene=SeqID_66229
atcattgggaaaagcattttttgtttaaccttagatgggccaactccgtctcagccaagtttaagaagccataactcttggccatctaacaagatggcatcatttgcaatattatcatctatcagtttctcgaataaattatggatcaaatctcaaaaaaattgagctatttgacactgattttgattttccaaacaaatctcaaaattttggcattctaggttttcggcactttaattcggacggcatttctatcattgtttgatcatttttgattacagttgttgtccgatcggtgccgaaatg

SEQ ID NO: 109236 - DNA, 63 bp, Heterodera glycines
  Promoter: Source sequence=SeqID_5297; Location=1338..1400; Strand=-; Gene=SeqID_57592
agtaagtttcaaaaataatttaattaattaatttagatttatttttatttaatattctagatg

SEQ ID NO: 109237 - DNA, 313 bp, Heterodera glycines
  Promoter: Source sequence=SeqID_25721; Location=1..313; Strand=+; Gene=SeqID_56464
cttcccccaaaagcatttaaatgacatcaatttaatagagttattttatttttttaaagtttacaaaaattaattttaaaaaaggatatacccataaaaacgaaaaaaatgaactaaaaagccaaaaatattcatgaaaaaaccgaaattaagcaccataaaggcaaataatatgcataaaatgcaaaaaaaaatcaaaaaaatttgccaagaattgcattatacataaatcacttgacatccttatttactaatttttaaaataattattttaaaattataacggattaagcaaaatttatttgttaaaatg

SEQ ID NO: 109238 - DNA, 106 bp, Heterodera glycines
  Promoter: Source sequence=SeqID_18647; Location=820..925; Strand=-; Gene=SeqID_47531
ggtgggaaatggggagattacaacaaaatcattcacttggatcctctaatcacaggtccaagaacatcgtacgggtggcgatgccgtggctgtctcccgcgacatg

SEQ ID NO: 109239 - DNA, 588 bp, Heterodera glycines
  Promoter: Source sequence=SeqID_24842; Location=1..588; Strand=+; Gene=SeqID_55592
ctggagaagttaattggggggcaaattactgaatatgctttggaagaccaatgaagccccagcaaagttcatggatgagaattgtaagttaacgaaacgggaagaaataatatgccgtatttataatgagtggctccgaatttcggaatcccgatttttttttgggaggggggggggggggggggaaatgccggagttttatgtaaattacttaatttttatttaagttatgcttgatgaaattttttttcgaaatttcaaaaatcccacaatcccgcgcatgatcccataaattttaaatatgggatttgtaagctttatccacgggatcccgtcccgcaaaaaatattctgagttccaatcccgtagcgggattcgcaaatttcaaatttccggttctaattagtacagctttggaaaataatacagtatttgatatgacatactgaacggcttagctacagtatgtgattggcatactgtgtgtgtcaacagcaataaaataattataaatttttttcatttttcttcgacaaaaaccgactcgtggatcattacaccagcgctctgctggtgagtgccaacatg

SEQ ID NO: 109240 - DNA, 137 bp, Heterodera glycines
  Promoter: Source sequence=SeqID_37561; Location=977..1113; Strand=-; Gene=SeqID_66604
aaattgggcacacttttttcctggttgttgtcatttcgggcacaaattttgtcagtttgctcactgctgacttaattatgacggtatattttgaatttttcaaatttaattttaaatgttccaatttttagccaatg

SEQ ID NO: 109241 - DNA, 91 bp, Heterodera glycines; identical to SEQ ID NO: 100405
  Promoter: Source sequence=SeqID_44017; Location=1591..1681; Strand=+; Gene=SeqID_71570

SEQ ID NO: 109242 - DNA, 397 bp, Heterodera glycines
  Promoter: Source sequence=SeqID_10505; Location=1198..1594; Strand=-; Gene=SeqID_73729
agtcccttttcattcgccccgcctttgaccacaaaacaattgacgaagtgctgtcggatttactagtggacggagaaaacaatcagtaaaattgagcgtaatttgaagaataattagaattttattaaattaaattgtttgtctaatctttcccccttttgtcccacgcaatttaaaaccgccatttggcttatttacgttttttggttaatgctttattatcagttgaaattgaattatgcgaagaataaacggaatgttttattttatttctctgtgaattttcaaacgccaattgcatttggcgaatgaatttccttctcccatcgatcggtcctttaatcatttcaccaacaacaacgttcttttgacaaaatttcttttattttcataaatg

SEQ ID NO: 109243 - DNA, 496 bp, Heterodera glycines
  Promoter: Source sequence=SeqID_34589; Location=1..496; Strand=+; Gene=SeqID_64341
atataattatatttcttagggcttaattttttaggtagtaactataaaacacaaggtttaaaatgctgttttaggtaagggaaattatattaaaatcccgaaatattaaataaatttttacgaaaaaatgccgaaatattggaaaaaatttaagaaattgaaaaattttgtgatgtaaaaaaataattaactgctcataacactaaaaaaaatttcttcattgattacaattgctaataattatatttttgaggtttttaatgcatttttccaaaataattaaaattaaaaaaacaaaaattttggtcaagaaagaaaaaaaaattacaaaaatcaaaattttgtcaagaaaaaaaaacaaactaccaaaaatggaaaaaaatttttaaaaaacgcctatgtatttacaaaagttcaagcaaaaaatttatttttaaaactgtaactaataattacatttctttttgaattttagcaaatctggaaaaagcaaatg

SEQ ID NO: 109244 - DNA, 377 bp, Heterodera glycines
  Promoter: Source sequence=SeqID_31617; Location=1..377; Strand=+; Gene=SeqID_61937
aaatgaattttcttaaatttataaatgcagcagtgtggtgcatttctttaattgaactgataaacttatattttttaattaaattagaacgtaagttttgtttgtcaaacaaaacttcttcttatgttttgacagattgagccttaaaatgatcaattatataataaaatcaattctctatcttgaaaaccttttagttcttaaactaattaaacaataaaaggaaaaagtgcgcttgtttttctcccatttgattcagtcgattagtctcgtttttatttaatgcattttcatacggaattttattcaaaaattttgagacctgtgaaaattatattcaagagattaaattaaattaaaaattttcagaaatcatg

SEQ ID NO: 109245 - DNA, 236 bp, Heterodera glycines
  Promoter: Source sequence=SeqID_30682; Location=434..669; Strand=-; Gene=SeqID_61090
ttccggatttataaaacatttaattgtttgtaaatgcttttattcaataaattcctctctcttaaaatggtgccgccatttgcattttctaaaaaatgttttccatatttttgaaggtttttacattttaaataccataaaagttttgaaaaatttgttttgttttaaaattttttttctatattcaaagttaattgaattcataaaattcgttttaaagttaaagtaattcaatg

SEQ ID NO: 109246 - DNA, 375 bp, Heterodera glycines
  Promoter: Source sequence=SeqID_44226; Location=789..1163; Strand=-; Gene=SeqID_71741
attgtagggctttttaaatggtatagaatggtgtaatacatattggaaaattttcaagggttttcgagataggcaacctagaaaatttaagaaatttttttttgggttaaaaaaggggggtgaagaattttttttctgtggtattttgaaatgctgaatacgaatatgacctttgtttttcgtatcataattgttagaattttttaagaattcgaaaatattttgcaatttattggccctcagaaatttggtcgcatattcaaaaattcatatctagcctaagggttgaacaattttcgaggaataaaacctttaaaatagagaaaaatcaggagaattttatgggttttatttggattttcttccataaatatg

SEQ ID NO: 109247 - DNA, 1003 bp, Heterodera glycines
  Promoter: Source sequence=SeqID_11812; Location=705..1707; Strand=+; Gene=SeqID_75314
gaccatgcacaggaaacaatggtgtgaactaaaaaattaaaaactaagtttgttttatttgcttatcttgatccgtattttgaaaaaataccctctcgatacataaaattaattttattggattacttttgtcaaaaattaaatcattaaaaaattaattgctttaccattttggttagaagacacatttgattagctttcgctcacaaaacggctggtcactgaagtgtccaaattgtcaaaattaattactggcattccgtccagcaggtcacgtggcctagcccaaagaatcaatggacattattttattttgaactaattaaatgacgaggcttattttatgaaaataagtgccaaaaattttatatgccaatttggataatgtcatacgtgttaaaccggtatttctttaaaatacggtttagaataatcaggcactaaaattcgggaaaaataagattttgattaagtatttatcatttcttttattagcaaatggcaagatttcgtcaattaagcattttcataaaaaaacaaaattaattctaatggaaataatatagttaaaaatgtcttgaggagggtacgtaccccgcgtatgccctcccccctcccctctggctggggccgtccttgtccttggcctgagacaacctctgtttatggatgatttaaaaatttctattttaaaaaaaatattttttctgaaaaggattgatgaatacgaatttccaaaattttttcgtaaatatgagtgaacgcccatttaaaaaacgggttttatttttattttttaaaaaatgtcatttaaatattggacgtttttaattttttaaagtatttgcttaatgattaaattaattaatcataattgaaaaataacgcttttatattgaaaaacttaaataatttgttgtactattaaattaaatcaattcgttaattaaatttataaaattcgccttttataaaaaatggtaaacaaacaacaatcaaaatg

SEQ ID NO: 109248 - DNA, 422 bp, Heterodera glycines
  Promoter: Source sequence=SeqID_33450; Location=135..556; Strand=-; Gene=SeqID_63514
ttttttgatttaatccgtctattccataataaaaattctcaaaaatttcaaataaaatctgttttctcctcagatttttctcgatttggaagattcaatttgcgcggacattgctttggttaaaaaatatttttaaatttattccatttaatttataaaactttggtcaccataagcaaacgatgtttttataaatttaatttaatttaaatatttttcagatttttttgcccccaaaagtgactggaatttttggcactgccaaattcacaaaattcacagagagcgaatggtccaataaaagtgactccgacagtaaaatttacgcacttggctatggaataactgaacgtttgtcaaaacactcttcttgggtccattaaattgcataatttctgtttatttgttaagttcaccgtatg

SEQ ID NO: 109249 - DNA, 145 bp, Heterodera glycines
  Promoter: Source sequence=SeqID_35556; Location=1..145; Strand=+; Gene=SeqID_65097
attcagtcccaaaaagtgccaccatttccactgcaccagcgcaggggttcatcaaaaaatgaatattgcttattttttcccttaattacaaatttctccgcacagttccgccgccgcttccacctcatcgctcatcactcttatg

SEQ ID NO: 109250 - DNA, 251 bp, Heterodera glycines
  Promoter: Source sequence=SeqID_141; Location=1..251; Strand=+; Gene =SeqID_74200
tttccatataatccatatttccatatttcgctatgttgaaacttctaggacaacttttttttgtccatattttccatataatccatatttccatatttcgccatgtttgaaacttctaggacaacttttttttgtccatattttccatataatccatatttttccatatttcactttttcgtccatatttgttccatattcgcaatttttagggaaacaaaatttatccaaatatttttagcaatataatg

SEQ ID NO: 109251 - DNA, 147 bp, Heterodera glycines
  Promoter: Source sequence=SeqID_1182; Location=981..1127; Strand=-; Gene=SeqID_69405
tttgggaaattatggataggaaatcttaagacttttttttattcgccccaatttgttaaagttaatttttttttaaacaaattgcgaaatttacagaaaaaatttttacttaaatgtttttcatttaaatgaaagcctctataaatg

SEQ ID NO: 109252 - DNA, 565 bp, Heterodera glycines
  Promoter: Source sequence=SeqID_30616; Location=408..972; Strand=+; Gene=SeqID_61014
ttcgaatgttttgtgttcaaggtttctgcagttcgcactaattatcgcagttggctgcgttcttcatcgatccacgagccgagtgatccaccgataagactagaattcattcttcaacagaagtgtaaaaaaataatgaaaaaaagaaaaagctggcggtgcccgagctgacactcattgagtcttaagccacgtgctaggccaagcacgggccctaccgcgtcgtctcatcacggccacggacgtagcagcaagcacaaacacaccgctagttacggcacgtaagaccgggaacgaaaccaccatccccagtcagtgtgttatgtgcctgccacaacaaccgctcaacgacgcacagacgccagcacagccgttaggtcgccccacgagcgtgcatcccacattggcgcagcgaaccaaccaagcgaggcggcccgccaccgacacattgccacgcagcagccatacacaggctttcacatgtgcagcactgagcggtataccacagctccaacgtatggaagcaccccaaaagcatggctcgtgaggcagctgccccgtaatg

SEQ ID NO: 109253 - DNA, 480 bp, Heterodera glycines
  Promoter: Source sequence=SeqID_1584; Location=4625..5104; Strand=-; Gene=SeqID_74628
gttgttgtataacattaatcagttgcgcctcaattccattcaaaaattcgccaaattcgttgagaattatcaatctcaaagacaaaaaaaaaaagaccatttcttttttgaaattaaaataaattaatttctgtcagttttgttcccccaatttgtcgaagaaaaaaataaataaattgaaaacctgttcgttaaatttcgcagctgactttgttttaatggaacacccaaacacacaatataaaaaaggtcaaatttcctaacgacagacaattccaaatcactttataaatttaatttttgatttgtcattggccaaaaatgaaatttaatgccttcaaaaacactaaaaaaattttactaaatttaatttctttaaaataattttttaacttttactataatttgttttaattttcagattaattttgtaaattaaaaacaaaaaccatagccttgcccaaattaaatcacaaaatg

SEQ ID NO: 109254 - DNA, 494 bp, Heterodera glycines
  Promoter: Source sequence=SeqID_3354; Location=3553..4046; Strand=-; Gene=SeqID_84338
ttgtcagcagcggaaaaggtggacacagcgccaacaaatgagaattaataattattaattttaaagaagcaattgtcagcggaggtcagcattcaccgaatggcaacctttatgaacgagacaaataacgaacaggaatggtcatttctaaaaaagttattaggaaaaaacctcaaaattttcgacttttttgcaatttcatgttataacttttttggtaattgtctaatcgcgaagcaatagcttagaaatatcttctaaacatgttaagctttcgaataataccaagattattggatttggttaacaaataaaaaagttatagtccgaaaacttgggctggcgccaaaacggcggcgccaaaacgatacagacccgaagcggagtccaaaattgacttgctgtgaaaagggaaaaaaatttaattctcaaaagcctttttttacatcggcagcctacaaatgtattccggcggtgggagacgttcgtcaatg

SEQ ID NO: 109255 - DNA, 773 bp, Heterodera glycines
  Promoter: Source sequence=SeqID_6129; Location=1..773; Strand=+; Gene= SeqID_60453
aaaaaaaatattaaaagtcgatttatctttaaaaaactcatttaattacatgttttattgcccatttttgtgaatgttgaaaattcaaacaataaattgtatttcctttcttaaaagcaattatttattcaatagcgcacttcgttaagtccaaacgaggccacaacaagcttgtttatcaaggttttgtctattagcatcatcttacgcacaatgatgcgagctattggttttgcgagctgaagaagacggccacaaactgtccagggcgcgcaatttaccgtgatggaattgtcactgtttctgccgcacacaaagatcacgcaccgtcagccataaatgtacaggttcaaaacgtacggtcgaatatgcgggcaaataacacgcgtgacgctccgcgcacggtggtaaatgaatgcctggcgggtgctagcaatgaagtaattgctaatttgccgaaaatcgcaacattggagcaggcaattagtagaaagcgtaagaggcaggggtccagttgaacataccgcacacacttgccgatgttttctttcccgaagaacttcgctacacccgaacgcatttggcagaaaattatgttcttgccgacaccggagcagaagaccaacaaagaattattctttttggctctgcgacggatgttgaacgcctcacacgatgtgacacttggcttgccgacggaagtttccgctgcgcgccggaaattatttttcaggtttcgagaatattttttcagagaatatatagcaaaaatg

SEQ ID NO: 109256 - DNA, 423 bp, Heterodera glycines
  Promoter: Source sequence=SeqID_8583; Location=4497..4919; Strand=-; Gene=SeqID_68606
tgaattcaccgcaacagccattaacaggtcagcaaattgacagcctttattatgttgggacgccaagcactgaattccttggctcggctagcttcaatcacaacgcgcgacgagaagaagtaaaaactattaattttaatccattaatatggcattatggtagggtatttactaaaagcatccaattgtaatcaaaaagtttgaagagattaaaaaataaaggaagttaaagtaattttttgactttttccgagggttttagagtcagaaatgtcttttttcccataattcacattttcgaggcttttcaactttcctctcatgtgtaaaatgtatattgaataattttagccacaaaaaacggtagctgattggtcgaatccatcaaactacaattatgatttaattatgcaccaacaaatg

SEQ ID NO: 109257 - DNA, 102 bp, Heterodera glycines
  Promoter: Source sequence=SeqID_6527; Location=1..102; Strand=+; Gene= SeqID_61899
aattcccccccccctcatttgtcagggttttctgcgatgcattcctttggcattttgtccaatcctttccccaattataaatggcactgaccatccaaaatg

SEQ ID NO: 109258 - DNA, 263 bp, Heterodera glycines
  Promoter: Source sequence=SeqID_17193; Location=1..263; Strand=+; Gene=SeqID_81653
agaggtacaaccagtgattaaaataggtataacagtgatcagaagaggtacaaccgtgattaaaataggtataacagtgatcagaagaggtacaacggtgattagaagaggtacaaagtcattagaagaggtacaatggtgattaaaagtgctacaacagtgatcagaagaggtacaacagtgattagaagaggtacaacagagattagaagaggtacaacagtgattagaagaggtacaaagtcattagaagaggtacaatg

SEQ ID NO: 109259 - DNA, 164 bp, Heterodera glycines
  Promoter: Source sequence=SeqID_31760; Location=633..796; Strand=-; Gene=SeqID_62065
ccttaaacaatcgttgaattctttcgattgcaatcaaactcaccgaactgtccttcaccacgatgcgtttgtgctgaaccaaaagtgcctccaacggacgaattattctccgcaaataactttcgtctttgtgctggtcgtacaaatactgtgcgtccataatg

SEQ ID NO: 109260 - DNA, 281 bp, Heterodera glycines
  Promoter: Source sequence=SeqID_36523; Location=1..281; Strand=+; Gene=SeqID_65810
ctctgggactcaaacctccggcattccaaacactgggaactcaacacaccagtatttcaatctctgggactcaattctccggcatttcaatctctgggactcaaatctccggcattccaaacactgggactcaacccaccaactttcaatgacattccaatctctgggactcaatccaccagcatttcaatctctgagactcaattctccggcattccaaacaatgggactcaaatctcccgcattccaaacactgggactcaacccaccaactttcaatg

SEQ ID NO: 109261 - DNA, 65 bp, Heterodera glycines
  Promoter: Source sequence=SeqID_1313; Location=2112..2176; Strand=+; Gene=SeqID_72329
cctttaaattacaaaatttttaaatgcattttgcttttgcattgtttgctcacaaaagttaaatg

SEQ ID NO: 109262 - DNA, 824 bp, Heterodera glycines
  Promoter: Source sequence=SeqID_14135; Location=815..1638; Strand=-; Gene=SeqID_78129
tccctggtctcatggtattatagttgtcctaataactaagagaaaactattttttttgtcaggtatttagtaaagtttttaactataaatttcgttgttaaacctaaggttatcatgacaacttatacacaggcaactcgaacaatggcttattgttagactaggcctaagcttaggcttttgtaaatttttttcttatattagttgaatttctgttgacatcattaagtgtgcttagaattgcttttgcacatttcgatgatcaaagtatacaaacaagaacaattagactattcggaaggtataaagtttccgattgacggttcgaaaaacattttttgacgcgtaaattatgatgggacgcgtaaagtgttgttgggacgcgtaaagtgtgatgggacgcgtaaattatgatgggacgcgtaaagtgttgttgggacgcgtaaagtgtgatgggacgcgtaaattatgatgggacgcgtaaagtgttgttgggacgcgtaaagtgtcatgggacgcgtaaaatgtcatgggacgcgtaaagtgttgttgggacgcgtaaagtgtgatgggacgcgtaaaatgtcatgggacgcgtaaagtgttgttgggacgcgtaaagtgtgatgggacgcgtaaaatgtcatgggacgcgtaaagtgttgttgggacgcgtaaagtgtgatgggacgcgtaaaatgtcatgggacgcgtaaagtgtgatgggacgcgtaaaatgtcatgggacgcgtaaaaccgactagaaccattaactttttgtttaaggataaaaggacatatatttcctttttgtcttctcaatg

SEQ ID NO: 109263 - DNA, 103 bp, Heterodera glycines
  Promoter: Source sequence=SeqID_12175; Location=2051..2153; Strand=-; Gene=SeqID_75751
ggtggtcttgggtttgaatggacacagagttttggcatttttaatgtaaagtttgttaaaaaaaatagggcatggtgtgatcatcacgacggcacaaaaaatg

SEQ ID NO: 109264 - DNA, 134 bp, Heterodera glycines
  misc_feature (44)..(44): n is a, c, g, or t
  misc_feature (58)..(58): n is a, c, g, or t
  misc_feature (65)..(66): n is a, c, g, or t
  misc_feature (96)..(96): n is a, c, g, or t
  Promoter: Source sequence=SeqID_42393; Location=763..896; Strand=-; Gene=SeqID_70293
taaaggactaatttacactgaaatgagcgccgagctatctcctnaggaaaaaagtttngaaaagnngagagaggaattatttttttatttttttanaaaattaattaataagtatttttatagaaattgatatg

SEQ ID NO: 109265 - DNA, 256 bp, Heterodera glycines
  Promoter: Source sequence=SeqID_44541; Location=1..256; Strand=+; Gene=SeqID_72021
aatggctatctatttttttgagaaattttctatgcaacaaacgctctcgaacatgaaacgaagtgcggtgcgccgtggccattttatttttcaaataatttttaaatttaatacatattccagaaaaatggctatctatttttttgagaaattttctatgcaacaaacgctctcgaacatgaaacgaagtgcggtgcgccgtggccattttatttttcaaataatttttaaatttaatacatattccagaaaaatg

SEQ ID NO: 109266 - DNA, 234 bp, Heterodera glycines
  Promoter: Source sequence=SeqID_37980; Location=1263..1496; Strand=-; Gene=SeqID_66940
cgatttgaatgtgtcaatttgacggcacattctcgcgtacaacacaaaaagcaatttcggtggagaagagcgtgcaggagagaacaatttatttttccgtctaaaacaacaaaatgaatgattgattggtgtgggatgtgtgtgccatgttttgcacaatgcggcaaaaaggcaacggataatttgagaattgaaggaaaagcaatggacattgaggctgtgatttttaaaatg

SEQ ID NO: 109267 - DNA, 69 bp, Heterodera glycines
  Promoter: Source sequence=SeqID_6883; Location=2836..2904; Strand=-; Gene=SeqID_63201
cagctgctgctgcagcgattacatcttcaatgacattattgcctgttctatactctacaagcaacaatg

SEQ ID NO: 109268 - DNA, 218 bp, Heterodera glycines
  Promoter: Source sequence=SeqID_10667; Location=1366..1583; Strand=-; Gene=SeqID_73913
tttcatataaatttttttggaaaattttttgttaaaaatcttagtgaaaaattgattgcattgctcagaattacgcgacaatttaatgttggaaaagatttattatgagaaaataaataataaaataaatattgatatttaaaagcaaataaaacactaaacatattcatttactgcaatatctttaaattttataaatattctaaacactaaacatg

SEQ ID NO: 109269 - DNA, 376 bp, Heterodera glycines
  misc_feature (266)..(266): n is a, c, g, or t
  Promoter: Source sequence=SeqID_17164; Location=1..376; Strand=+; Gene=SeqID_81603
ctgaaatgtccattttaactgagactcagttgtcccagtgctcatatggcttcgtatcgacttcattgcaagatttttaggcttaactcatcaagagctttcgaatgataccaaatttgtctgggtttgacccttttaaaaggtcaggaaccccctttttccctcaatttcgagttttgatccggttcaaaaaccggtttaatgcttttctgctcccaattttaagctgttctatcgttctcagcgcctaagaaaaccctcttaanagggtttttatgcgattttgtgttggtaccgtattcggcaattttacccattttttgtatggggcctaaaactgttcaacttctacatcgtaaaaattaaggaaataatg

SEQ ID NO: 109270 - DNA, 937 bp, Heterodera glycines
  misc_feature (29)..(29): n is a, c, g, or t
  Promoter: Source sequence=SeqID_3106; Location=1..937; Strand=+; Gene= SeqID_83217
tgattagacagtgagtgattttgacagtnaactatttagcttttttcattgtctacgcgtaattttgacaatgaatgaatttgacaaataatgatttggacagtatcaaattgtgatttcgacagtaccgataagtttttttttaagacgaatatattaaaaagtgtatcgaaaaataaaggtgaatgaccacgcccaaaaaaatattgtaaatcaaagaattacggttttcaaaatcttcgacgaggacttgcaaattattatctaggcgaaagtttttacaattagcaatattcttgtggccgaaagtacggtgttcgttaaggttccaaaaagttacggcaaaaatttttcgaaatctgattttttgtattcttcgggccataattttttcgaaccttaacgagatttttcgaaattttgcaggctaatagagaacacttagggctttcaaatgataccaacaatgttaggtttggttggcaaagaaaaaagtatagtccaaaaactgggctggcgcccaaacgagcggcgcccaaacgaggtggacccatttaagaaacacgccagcacggtttgcaagttttacatctggggcctattcaaattagcatcgtatcaacgatgcgatgatacgatgatcatatgcgtgttcaaattaaagactttcgccatatgatgagctgtcgtttgcagctcatcatacgctgaactttgaaaaaattctacccaaaaagataacttaattcttggacgaagattatatttgattgtctgtcaatcttcatatactttcatattcatttaattttttaaaatttatcggtactgtcgaaaatcaatcattgtcgaattcaaataaatttttgataactgtcgaaatcgctcgttgtcgaaatgctcctgtcaaccacgatgccctctctaacttcaaatg

SEQ ID NO: 109271 - DNA, 835 bp, Heterodera glycines
  Promoter: Source sequence=SeqID_18777; Location=685..1519; Strand=-; Gene=SeqID_83455
taatttcaaaaaatttgatcaattttgaacaaagttatggccaaaagtacacatgtggcctggttttttgaattcttctagtcataatttttttgagcattaacgaaattttttgaaacttagcaggctaatagagaacacttagggctttcgaatgataccaataatgttagatttggttgacaaagaaaaaagttatagtccaaaaactgggcaggcgccgaaacgagcggcgccgaaacgagggtgtcccgtgtcggagagtggtcgacggtcaattgataatgggaagaaatagaagattggcctctgcggtgccgataggtgcgccgggtaaatttttaaaaaatttccccgatttcttagcaaactgcaaaaaaattactaaatttttatataaaaaaatatgcaatcctgaaattttcaattttatccagtgtaaattattcacggcggaaaacccgtgagttgaccccgtgaatcgtgaccgtgacggaaaaaaacgtgaaattcacggtaaccgtgaccgtgagtcacgccgcacctctaacaattaccatgagttcttatggaagtttccatcttttcaatttaaatccaaattacgatttttttaaataattatttatatacatatttaaatttatttctctaaattaatcaatttttgtaatatttgcaatataattgtttctttattttccattgtcaattcccttacatgcgtgtgatttgtcatgccacaaataacgtggaattatacccttttttattaatatttatttgctaaatatgtcacccattaattcatatcccaccattttccaattccatg

SEQ ID NO: 109272 - DNA, 305 bp, Heterodera glycines
  Promoter: Source sequence=SeqID_22151; Location=1..305; Strand=+; Gene=SeqID_52805
tttttgttggcaagaaattgattcaattcccgtgccggggtacacccgaagagtttatttaaaaaaaattttttttttttgttgctccgactcaaaaattttctgtccggtgtaattttcctaactttttggtttaatatgaaaaaacgggaatttttagtcattttcaacgaattgacgtcggaggaacattttacggtaatttttcaaaatgccgagtgaatcttaaatttgttagtgggtattaaatttttcaaaaatttgcatttttggaaaaaacatcaataactctttggcaaaccatg

SEQ ID NO: 109273 - DNA, 1003 bp, Heterodera glycines
  Promoter: Source sequence=SeqID_3614; Location=5668..6670; Strand=+; Gene=SeqID_51127
gacaattctgcaaaatttttggtatttaattcattgattagaatgtacattttcgattttattaattctgcgacctcaaaacatgttttgattttggtcgtttcatgctctccctgctgctcactccccctctttaaaattgtacaaacatcggcggacggatggtgatgactcatcctccctccgctccagccaattatttacgactttttacatttatttgatccatttcaaaagcaaattcgcttcaaaattttctgtttacacagctcttcccctcccccccccccaccttattcgccctattcatttgatttccttgctattactaataggggcaattaacaattaattgcctggcattgcttaataccgcccgcctccttcgatcttttcggtcgaaaaccactcattcgtcgatgttctccgactgaataacaatttatttattctatccccccataagataatttctccccaaaatagatgatgctgatgatcggatgagtttattgatccatccgcctgctgtcatcccttttttccgtttatcccaattttattccaaataaatttaattcaaaaattttctatttaagccttttttttagcaagaatatacaaaaccgaaaaataaacctccaaattatcctctcacttctatttttttctttttaaaaaatgaataaaataactgaattttagctaaaacccataatcacttgacccttttatatcctatggtcattgggatcctcccttcccgatcaatgatcactttttaagcctgttgtttcccctccacaattgttcatcccacgattcatcattcctgagcattcaattatccagagacgatcaggaagaagttcttccaaagtcgacttttttatatttacatttctcggcgattaatttttacatatttttgcgtttattgcctttttaaatttttttgtccatttaggcctaatcttaaaaacctgctcattggtaaaaaatg

SEQ ID NO: 109274 - DNA, 85 bp, Heterodera glycines
  Promoter: Source sequence=SeqID_5019; Location=1128..1212; Strand=+; Gene=SeqID_56594
cctaataagaaaaaaagaattttattccataaacggattttaattaggttttgaacccgctgaaaaagaaaatgaccaaatcatg

SEQ ID NO: 109275 - DNA, 603 bp, Heterodera glycines
  Promoter: Source sequence=SeqID_8685; Location=603..1205; Strand=+; Gene=SeqID_68849
ttatcagttttatagatgataacttttttctttctaaattaataaattatttaaaatattaattatcatgtaactaaactaattcggtctcgagatttgggactttattttcgagaatcgtgacaaaaagtattcgtttttttgaaaatctttacataaataaaaaccttggctgactttggcactaagacaaaacaaaattaaagccaatgggaattttttttgatattattatgtaatgcttccaaacaggaaaaaagactaattgatggttacatttcgtcattaattataagaaattgaatttttacgcctaatttaaatagtcattttccgttaattaatgggcatgcctttcatatgaattaaagctaattactgcattttcttcttctatttttatgctttacatcgtaattaattgatggactggttccgttgtgtgattatatttacgttttgttgaagaaaaaattataaaaaatgatttaataggcgaataaaatttcgttgaattacttaagcatattcattttttgttaattaatgtgtttttcatgtgaattacatttgatgattacacgcactaattaacaaagtatg

SEQ ID NO: 109276 - DNA, 177 bp, Heterodera glycines
  Promoter: Source sequence=SeqID_5001; Location=4193..4369; Strand=-; Gene=SeqID_56507
ggtttcgcccgattcatagctgttgtgtcagactgtaaccacgcttaattgttttcaacaactcccggtccggggttagaattcgagcaaaaatgaggtcatattcagggtcatggcctaggaatttttaccctaaatcatttttaaaaattaaaaaaaaatttttcgggaccaatg

SEQ ID NO: 109277 - DNA, 232 bp, Heterodera glycines
  Promoter: Source sequence=SeqID_30277; Location=1118..1349; Strand=-; Gene=SeqID_60697
gcattccaaacactgggactcaaccccaccaactttcaaaggcattccaatctctgggactcaacccaccagcatttcaatctctgggactcaacccaccagcatttcaatctctgagactcaattctcaggctttccaatcgctggggactcaacccaccagcatttcaatctctgggactcaaatctcctgcattccagacactgggactcaacccaccaactttcaatg

SEQ ID NO: 109278 - DNA, 1003 bp, Heterodera glycines
  Promoter: Source sequence=SeqID_7656; Location=2711..3713; Strand=-; Gene=SeqID_65528
ctctccctcccgccgcccgttccgtcgccccgcgcgatggtcattaatcgttacatgttaatgacgcataattaaaattaaaaaaaagacaaatagaaggaaacttgtgaaaaatttataaatttaaaaacaattttaaatatgcaattaatataggaaatttaaatatttataaacatatttaccccccctccccaacccctcccccgcgtgaaggtcaaatgtttgtgagtgaaaactaccgaatttttagtagtgcatttggaatgtaatttaagtacatgttataaggtcataataaaagaattttacctaacaatttcgtaattctttttgttttgacgattgcgaaatatttttttgcatgactctttttttttgcccatttaaaataaatggtcaaagctgtcaaaaaaaaaatgattgatgactcaagaaataaggcattaaattatgcataaaaaatttcgccaggcgattttttttgcaccgttttgaataaaactgtcaataaaaaatgattgattggttccttatttcgcaatttccaccctttattttgtaatgtgcacgtgacttttagtttttggaccaactatttcacaatatgcgcattatttgggtcaactgtcacaaaaaaaatgattgacgactttcgaaataaagaatatccagacgatttttttgcagtttttgaataaaatgtgacagttgtctactaaaatgattgatgaccctctaaattaaggtagacccagacagtcacgtgactagacccctcccctttcccccaattcgtacacccggcccaaatcgtaaatcattcaactaaatagttggatttcattaaactctctttgcgctctaatttattttactccgctctattttttctacattttatttccaatctactattatttttctgccgtctattttctttaaatctctctgctcttttctattactcttcttcaatttcgcgttttggtttttaaaaatg

SEQ ID NO: 109279 - DNA, 385 bp, Heterodera glycines
  Promoter: Source sequence=SeqID_24358; Location=638..1022; Strand=+; Gene=SeqID_55078
tccttgttataaaaaatggattaaataaaaatagttgacacctgcaacaaaacgtttgaagccatgccaagggctttttgttgttcacaaaaagactttcggaaattggcactccggttaaattcttattgttttgcagttaaaatcattaaattatttagaataactcaatactatcttcgttcatctattttttgattgaaattaattggatattcaaatttttaatattattattgaaatcgagtttaaaaatataaaaatgatataatagaaactaaatttactcaactggaatatagaaaaattaataaaatttcttaattgacatgtaaaaatgctaataattacaataaaaaattaattgtagttcatcatcagaatg

SEQ ID NO: 109280 - DNA, 204 bp, Heterodera glycines
  Promoter: Source sequence=SeqID_42536; Location=1..204; Strand=+; Gene=SeqID_70407
ctttagtgagaattgcggctactattgcatttattttcccccccttatgtgctcattaggaggaagaaattatgagagtaactttgaaaaaataacaaaaaagttgataggagaagataatccagatttgtttgtcgtgaattttgttaagaaactgataaaaagtatttaaaagaatttatcattaactcatttataaaaatg

SEQ ID NO: 109281 - DNA, 96 bp, Heterodera glycines
  Promoter: Source sequence=SeqID_35975; Location=1..96; Strand=+; Gene= SeqID_65424
ataacactgtgcccgcaacgccgaccatggtttcgtgaaagcgatcacatacaatcggaggaaacaacaacagttgccacaacaacagtcggcatg

SEQ ID NO: 109282 - DNA, 220 bp, Heterodera glycines
  misc_feature (67)..(67): n is a, c, g, or t
  Promoter: Source sequence=SeqID_44398; Location=1..220; Strand=+; Gene=SeqID_71887
aagcgctttgtgaggtataaatttctcaaaaaaagagatagccattttctgggatagagtataaatntaaaaattccctcaaaaataaaaggtctattgcgcaccgccctcccctatcatgctcgagagcatttgtatgtgtataaaatttatcaaaaaaagagatagccatttttctgggataacctctaaatataaaaatcctctgtgaaataaaatg

SEQ ID NO: 109283 - DNA, 1003 bp, Heterodera glycines
  Promoter: Source sequence=SeqID_11263; Location=1240..2242; Strand=-; Gene=SeqID_74632
cttattcctggggcttttctaggtcgctgatcatgaatctgacatttatttcaaccaattcctaacccgaactcgaaaggtcgaattttcgggttttgttcaatcatcatgaaatgtaaatcaaaaaattttagaggtattaaaagtcatttagtacaatttttcccatttttaaacttatttttgggattttaatcgacatttctatcgaaattatcctcatctcgatgaggatagtgattttaatctgcagataggtagctgctaccctatctttagcattgtgcatatgtagcctagctgcagctgacgctaaggattatttgtaaaagaaactctcattgtgcatgcggattttaatccttagcattgtgcatacggatttatctgcggataacgatttatctgcagatagttagcattgtgcataccagcatgagactaaaagccataacttttttctatgttgaccaaatcaaaaatattggtatcattcggaagctcttaataagctctatcagctaacaaaaattcgtaatgattcgtaaagaactaaaacagtttaaaataaaaatatacaaaaattcggagttttttgcaattttcaagctttaactgtttatgcgtagcttaatcgcttagaaaatgcttataaatatcttctaaacatatagagctttcgaatgaaaccaagtttgtttgatttggccaacaacgaaaaaagttatggcttcttaaacttgtctcagacgcagttggccagaagcaagttgacccctaccgcgcctagctcagtcggttagaggattttcaccatacggtatggaaaggccgtgggttcaattcccaccgggggcgcgtgcaatgcaaccttttatgtttcaaacatcatttcttaacaattatttgtgtatgtatgcacacgtaggtgttcgaagtgtactactccaacatcggtgcacgttttatgaacaaatttagcaaagccattgttaacttaatg

SEQ ID NO: 109284 - DNA, 494 bp, Heterodera glycines
  Promoter: Source sequence=SeqID_5581; Location=1..494; Strand=+; Gene= SeqID_58549
cggctgtcgttaatccgttccacccccgttctatcccgtctaattgagctttttttgagaacgcacagctgcatttgagcagctccgtgttctcgctctagacgagcacaaatcaattaattaattaataattagtacactaattgatcacctgcagttttaatgaccgtgcaaaaaatcgaatgtttccgtttaccgacggcaacaatttttattttaatgattagcattgacctttccttgaaaaacattgattcctccttgaaaagattctcctccgtaattgatcagaaaaaaaaactcattgatcacctgatgaaaaagccctcggctaaaaatgatcagattagcccattctaggtcccgatcaattcgaagaaatatattattattttaattaccaataataacaaaaatattacttttataaatatttataaaaagataaatactaaaattttgtctttttttgagaattttctaaattattaatg

SEQ ID NO: 109285 - DNA, 85 bp, Heterodera glycines
  Promoter: Source sequence=SeqID_9021; Location=4709..4793; Strand=-; Gene=SeqID_70024
taacgaaggtagcggatataagaaagtccaatacgagttcctttattcaattgcaactaagcaataaagccgtgcccttcacatg

SEQ ID NO: 109286 - DNA, 174 bp, Heterodera glycines
  Promoter: Source sequence=SeqID_2246; Location=1..174; Strand=+; Gene= SeqID_78688
gtttaaatgctaacctatatagctggggttgtcagttaaccaaacaaaaaaaggaattttaaaaaacttttttttttcaaactccacaaaaaagtgtccattgataattccctgcttaaaattataagttaacaaatagaccacacctttcatattgatcgatttccagacatg

SEQ ID NO: 109287 - DNA, 87 bp, Heterodera glycines
  Promoter: Source sequence=SeqID_40849; Location=560..646; Strand=-; Gene=SeqID_69093
tgtgtgttccatatctttttttgtgttcttaattccatgcttaagaaatcaatgtaaaacgaatacatttataggcatttaaaaatg

SEQ ID NO: 109288 - DNA, 515 bp, Heterodera glycines
  Promoter: Source sequence=SeqID_9557; Location=2801..3315; Strand=+; Gene=SeqID_71882
gaaaaagttatggtgcattaaagttttacaattatttatagtcgtaatagagccggtcaaactgcctaaatttttgggtctctagtaccgtggaagaatgctgttcccccttttcttatcactcaccagccaaacattttccgccataaaagaggtgctttgaaaaaaaattttattaccacaatcatcatcattaacaaattgtctcttcgcaacgaccaattaatcaatgataggaaatgcaaaaagtgatcaaaatgataacagcgaatatacaaaacatttctttgtctctccttgttccacactgccttttgcccgaggcaacgagttgtctgtgattgatcactttgcattttgtttaaggcaaaaacacgagcacttattattttttccctaaaaaacgatcggattggctgatattattattcattgcctgaggcaattatcaataatatacggatcaattaataaccgagagaaaacgataggaaaattcggaaatttttcatatg

SEQ ID NO: 109289 - DNA, 272 bp, Heterodera glycines
  misc_feature (73)..(73): n is a, c, g, or t
  misc_feature (93)..(93): n is a, c, g, or t
  Promoter: Source sequence=SeqID_42708; Location=1..272; Strand=+; Gene=SeqID_70534
ttttaatatttaaaaattacaaaatttatgaattattaattcaagaatataattaaaaatatgaataatcatnttccaaaaattcctaaaatntaaggaacctattgaaatgaaaaaaaaaatttgtaataccgaaaaaaattgcttagccatttcggaccaaaattttttgaatctcttcaagattgtctataaaacacatcattctcgaaataaatgtttgatcagtttaattttagcatacataataatatttggaataatcttcaatg

SEQ ID NO: 109290 - DNA, 169 bp, Heterodera glycines
  Promoter: Source sequence=SeqID_23421; Location=245..413; Strand=+; Gene=SeqID_54125
atgcgctgaactgagtgtgtcagcagcgggtctttgcatggaacggtcggtcatttacaagcaaacaaaatcattcaattcatgcattcattcatttaattaatcatttaataattaattaattagcaactaattaagatgccctaaatgcaattgtgctgttgagatg

SEQ ID NO: 109291 - DNA, 738 bp, Heterodera glycines
  Promoter: Source sequence=SeqID_6033; Location=680..1417; Strand=+; Gene=SeqID_60077
tcgcttttccgagttcttcccatccctaacaaaaacaaatgcacaggcagacgccctctcattgatcacttgcattgagcagtgcggagcgatcggtggcacgcgggcaaatgaaaaagttggggaaaggaaatccgggagggggggggggaaggaagtgggagggggcgcaccccaaaatgtcgccggaagattccaaatctaaaaaatttctttaaattaaaaaaaaattatggcgccgaaggaactcaaaaacccagcttttcgaatttttgccatgatttcaaaatttgcagattaatagagtttttcaagtctttcgaacataccaagaatttttaattttttgaaaaaaaagttacagtccaaaaattcttccggacattttgtcctgctaccggctgggggggggggggaggttggtccaaaccccaaagcccaagcccatcaatgggcttgtattaatttccatgacaccccaatccaaatccatcgacttcgctgaaaggaatttcaaaaagccttttcctctgatcattccaatccgatcactaaccttcaaaggaaggcaatgacattgcgcatttgttgaacattcttcgcgcccgcggtgccatcgacggcggactccgttacgcgcccaccaatggcatgatcagtgccatggcagctgatcaaatttcttctcaaatgcgctccattgagccggttggcatttaagcagattggcacacaatg

SEQ ID NO: 109292 - DNA, 282 bp, Heterodera glycines
  Promoter: Source sequence=SeqID_64; Location=1474..1755; Strand=+; Gene=SeqID_59395
gaaagaacggacggacggataataaaaggatgccttaggcaccaatttcttataattatgtagaaatttgaaaattattttaataataatgtattagaaaagaaaagctccaatttcttttacacaacaatattttttactgttcaatcggcatgtatctgaattcaagctgcaattattattattatttcatgaatgtttagggccctaaaggcacaaaaaagcgtcaactgtccgtttttgtttacgttcacaggaaaaaatttttctgctggagcgatg

SEQ ID NO: 109293 - DNA, 1003 bp, Heterodera glycines
  Promoter: Source sequence=SeqID_20925; Location=620..1622; Strand=+; Gene=SeqID_51510
cggtagcaattaattaattatgagttatttaaaaaatttcgattacaaaaaactaaattatagcaaaaatactcaaaaaaaaagttctttagtttttaggtctatattttttttaaattaaggaatttgttgaaaaattttttatttgattgttttgaataaaatattgattttcttaatttttggtgtaattataaattttacatcctggagtttttcaataatatgcccaaacatcactcgaacactatataagcaaatttctcaaaattaataacacaaaaaatcataaaataaataaaaattcacttggattccatttataagaatttaaaatgcttttaagaacctttagaattaaaaaaattcaaaaaataaatttaaaaaacaagaaaaaatttttaaatttatattttatgggataaatatatgaataaataaaatataaaataatatttggaataatatggtaggttttaagaaccaaacttattttctcctataatatgattgaacaaaaaaattgagaatttcttctataacctcaataaattggaatggaaaattagtaaaaattaattaattaaaaataataaaaaaatcaacaatttttttaatataaaattcatataaaatatatataataactcatatattagtagtttattacttatttgaaacgcggttaaaaaaataataaaaattattccatgaaaatctaaatagctccaaaccatttgcgtgtcatgtttttaaatggcataaattccatgttttatataaaaagcaatcaatcaatgtctacccgcaaatgccacactatgggtcaattacattaatgtatctttgacgcataatttctattttgttgaaaattgagtcttcaaattttacgtcgcgcaaatttattttttgaagaaaattgaatttagagtggagatttccgacgagcggtagggcaggaggcacaaaagttagtggtggttaggactgtgcgcaaatg

SEQ ID NO: 109294 - DNA, 219 bp, Heterodera glycines
  Promoter: Source sequence=SeqID_18039; Location=2088..2306; Strand=-; Gene=SeqID_82623
agtgcttgctgaatttgatgcatccgatgtccgatttggacagcctttctgttcagttccttctgtccatgctcaaatgggcttattctgtcacagtaactttcttttcatttttcttttgtttttgtgttttgtggtcatttttcttttttgttaatggatttttaaaacatttattttttgtctttagcaaatccggaagtggcgcccgcttcgatg

SEQ ID NO: 109295 - DNA, 380 bp, Heterodera glycines
  Promoter: Source sequence=SeqID_19467; Location=2396..2775; Strand=-; Gene=SeqID_84186
aaatcctttggtggcttgtattcatatttggacttttgcggtttaggccccccgaaaaaccataaaggggactcttttggctttcaatagagctcggtattttggaaaaagcctgtacctgtatttcccaattggcctgtacctgtattttttggaacttcttttaaaaatcaaacaaaggtttgaaaaaatcaattaattgcttaggaacatcttaaaatatctaatttactataattatgtctctttaaatatatttgatcatttttgaaaaattgaaaaaaacatcgatcacttgaaataataaattctaaaattttgtacaggaaaatccaggttttttcgtatttagcctgtacctgtactaaattccaaaaatg

SEQ ID NO: 109296 - DNA, 330 bp, Heterodera glycines
  Promoter: Source sequence=SeqID_21696; Location=1152..1481; Strand=-; Gene=SeqID_52308
aaagggtctaactgattttacaaggaaacaccgctttgtccctactgcaatgcacttctcttgccatctgagtcgacaggcccaaaggcttattctaaatgttgtgccaaaggacgggtcaatctcctacaacgctttaaaaaattgcaagagcggcctggagagcttgaaaacatcctccggaacccagctgagcagtacaaaagctggagggcttcgttatttcaacacacactggcctacaacagccagttagcttttggacacgtcaacatcaacagaacgaccgagaagatcgacattcatcgaattatcaagtgcaacaacatg

SEQ ID NO: 109297 - DNA, 161 bp, Heterodera glycines
  Promoter: Source sequence=SeqID_16850; Location=1..161; Strand=+; Gene=SeqID_81274
aggaaaagggtaaataccgtaataaatatttcaaatactctttattagtgccaccaccctctaataaagcccccacaaatagcatggggttgaaaatcgggtacattatcatttatctcccgcgacaaataatttatcaaaaaaaaacatttttagaaatg

SEQ ID NO: 109298 - DNA, 536 bp, Heterodera glycines
  Promoter: Source sequence=SeqID_6088; Location=939..1474; Strand=-; Gene=SeqID_60290
ataagaacacagtcttttaaaggggaaggtgttcgggatgggcctgattatttgatttatttattatgttggcattccgtcccatttagttttatgccccatcccttctttgaccactcagtcttttgcataaatagcctccccgtcctccctcagttcgttcttctccattcattcatttattttgttcccttattttcccaatcaatatttgaccctgttcgcccttgtccttttcttttgaataaatattattttattcctcttcggactttggggcgtaacaattggcgacgcctcgacaaaatcgaactttgtgcagccaaaacaattttgatttgtggcttgcggattcttttgaaatcagagcattttttgcgctgctgtttatagtatctaggcgatacttattcagctcatccacgcgcacccacttgattagtagcttggcgctgctaacaataagtggtgaacgacacttcacttaaaacgagtactctagctgaggggaaagtccacgagctgtggttaatatg

SEQ ID NO: 109299 - DNA, 278 bp, Heterodera glycines
  Promoter: Source sequence=SeqID_11866; Location=1678..1955; Strand=-; Gene=SeqID_75362
ttatgactagggcttatatttatttgaatattttaacagttttcatttttgtgagaatatccacaataactcgtttttggtcggaacaatcttctttttaacgttaatattcgtaaatacaaaaattttttgtacttttataaataaaatgttgtagaaaatacagcgttaagaaaaactgttgaaaaaattcgaaactggtagaaaatttttaaaatttaaaattaaaattaaaaaagattttaaaatagccatatttacattttacgcgccaaatg

SEQ ID NO: 109300 - DNA, 210 bp, Heterodera glycines
  Promoter: Source sequence=SeqID_9827; Location=1..210; Strand=+; Gene= SeqID_72840
ttggcgctatactaaaagtgggcctttttgaaaatttttaaaaaaagtcatgaaaatacatttccgggggttttcggggccgctgatcacgaatatgacattcatttcgaccaatttcgaacccaggacccggattcgaacaaaaagtcgaaaatcgtaaattttcactttttataaatgataattattttaattcctttttagcaaatg

SEQ ID NO: 109301 - DNA, 944 bp, Heterodera glycines
  Promoter: Source sequence=SeqID_4395; Location=153..1096; Strand=+; Gene=SeqID_54294
aaatgcccttagatttttgatgccataacttaacaaaattaattgaaagatgcttaatctgagaaaattaattaatcaattggaggaattatgaaataaatttcattgaaaactttcaattttgtcttgatccaaaatcaataaaaggaaggataaaaactaaatattaaaaaaacaatgctgaatccgactgtaagacttggacagaatgtaaaaacgagaaaaaattaattaatttttattaaaattttttaatttcctctaattaattttgtgctttttgttgtactgttttccgattttaaattgtcaatatagccatttatggcatttttcaataaaaaattttaagggccctccattcgacttgcaacattttgatcgcaatttatgccttttccatctcatttattctgatcggaaattcggtcacatttttcattttccttttcggcatcaatttcatcagtctccaattgtgcttttacatccaaattattccactcctttttacctcattcgctattctattacaattatgcatcggaattgaccgtctgtttggtgttagcttcccaatttggtaaattttccaattaaaaaacgaattgcttaattaaataattgctttttaattaggtatcaaatgggtggccgcttcaaacttttcaaaatttttattgccatctgttgtgcaagaactgtatttatcaacatttattattatcattatggcagctcaaagcattggggaaagtttgtgtgaaattaaatatgccaattataaataaaattaaagtaattttaaaaaagttatttccctaattttgaggtctattaaatgtataaatttgcccccttaaaattaaaaataattttggtatcttaattaaggtcattataatttaagataaattttatgcccctaattaagaccagtgatg

SEQ ID NO: 109302 - DNA, 430 bp, Heterodera glycines
  Promoter: Source sequence=SeqID_44642; Location=1..430; Strand=+; Gene=SeqID_72106
tgcgaataaaatcatttaacgtgcttcaacattaacattttgagctgggggctttttatgggtgaatgatcagaatctctttttccgatcattctttcccattttccccatttctcatccactttacagctctaaaaccctccatcagactatgttctgatcaaaggcatggatcagtttaagccttagaaaaaataactgaaccagacaagcctcaaaatgcactcactgtccggcttttttgacccaaaacaaccgacttcatatagaaggggaattgaaagtttataccaccgctaaaaatggtggataaatcataaattgaatttttcctaatttaattttttgttaaaaattgctgcgagtgccaataattttttccctaaaaataaataaataaaaatgtattcaattgtaaattacttagatg

SEQ ID NO: 109303 - DNA, 1003 bp, Heterodera glycines
  Promoter: Source sequence=SeqID_167; Location=4842..5844; Strand=-; Gene=SeqID_75822
aatcacatctgacaacgactctgccggccaattgcccaacatcaacaactgacaaaacactccaacacattgacaacatcaacagcagatcgtcagcaaacaaacgacaaccttggggcacaaaaatcagtgagaaaagaaaaattatttaattttaaacatttatttcttggacaaatttaaatatattttgactttattagctccaagactttggtcagtacaacattgactactaaatacaaatcgttcatctgctgtggacaagcgtgccatataaacgccaaccacacaacagacagcggtgaggtagaaagaataagggaaaattttaaatttttaaacaaattttactatacataaaaaccctacatctaaaatgttttttaatttttaaaatttctttaaaatttcatttaaatatttgaatttttaaattaatttaagttctttttcggattttttttcacttttggtcatttttaattcccccaaaaggctgaaattatgccaatattcgtcaatattttgtcgttttacatccccaaaaggctgaaattatgccaatatttccccataatttcgaaattttttctaatatttgtcactttgacacccaaaaggctgaaattatgccaatattcgtcaatattttaaacctattgcaagggtgcagaccatctgagcgcctgaccaacgattttttttttgcttcattttttattttacactacctaaggctgaaattatgccaatatttgacattatttttgtcattttaaaccccaaaaggttgaaattataccaatattcgtaccattacgaaaaaatttttttttctatatgtcttttaacacgccctaaacgttgaaattatgccaatattcgtcatcatttgaactttttgttaatatttgttcttttgaaccccctaaagcctgattgtctttttatttttaatccatattttagacatttcttttgcatcaaatttaaaagcatg

SEQ ID NO: 109304 - DNA, 845 bp, Heterodera glycines
  Promoter: Source sequence=SeqID_20344; Location=1493..2337; Strand=-; Gene=SeqID_50859
tcagcacctgatcagggcgcaaaatttaaaatatgaaaaattcgaaaattttccttaaagaaaacccgaaaattctgaaaatgagggcataaaggcccttaccaagccgtggaagagtccccagatggcaaccagtgagatggttttgacgaacacgagcgggatgtaattctgaagcaaatttccgcttttcgagatttatcgaaacaagcaccctctctctgattgtaagaaacaaattgaattaccaactaataaaaaatttaaaaataccatccaatttctgtgggattttgtgccaaattcaatcactacgtaatgtaccctatttgttggagatgccagaaattggatgttagaaattcatatggcctagggttgctcgagaaatgcttttttcgggacttgagataaatttgcgaaacagggacagaaatgcgatgggataagtgccgacgaaacggccaaaaatgcggaacattgtgcacagtgtgaactgctccaaaaagctgagaaatttggccgtctttgggcctaaagaaatgaaatttgagccaaatatttgggaatagaaagagccctcagacttaaatttaaaagaaaaggaaactaaaaatttaaggcattttctttaaatttcactaatatttccaaacaatttccccaacaagcattaaatttcttagatttttttcaaattttgccctcaaaatccataaatttgccatttaagcaaattattttcaagcctgtgttacattgttacatctgaaaaattgcacggttggaaaaactaaggattgatcagtcgctgggccaaaaagtgatcagcaatagaagatatg

SEQ ID NO: 109305 - DNA, 371 bp, Heterodera glycines
  Promoter: Source sequence=SeqID_3196; Location=716..1086; Strand=-; Gene=SeqID_83619
tttgcgatccgccacttcaaattgcaaacaaaatccgtttcgcccaccgaaaccgtgtaaaacagtattccgataatgcacgttaattacatattctttctttgtccaataaaacgaatcaccttcagttggaatgttgagttctgttcgttgtcaagcgaaagaggctcgttaaaaccttctctgtatctcaatgaaaaatttttagacgtcttttgccaccctacatatactttgatttggcttaatgttgtaagttcctgtcgcgcgcatcaaactttcaacgttattcgtggcttccttccactttaatggcgtactcttcgccgttgtaagctattctaaatttaatatcaatcttttcagcaatg

SEQ ID NO: 109306 - DNA, 1003 bp, Heterodera glycines
  Promoter: Source sequence=SeqID_3442; Location=1366..2368; Strand=-; Gene=SeqID_84708
gattcaggtttttagcgaaaaagagtaaaaacaatgggatacaacaaaatgaaaattaaccccaagagacgacatatttataaggtttttttggttcagaggtgtgctctatgggtcaactccgctgtgcagagaaaagcctagcacatactatctcgtagttgctttttttctttgtaatttctctcactttggtgtactatctctttgttttaattatgtaaaaataaaatttttttttttttctgcttgttacataaatccacaacaaattttgcatataggtaatagagaaaaaaaattctgaattatttatttatttactatccaattttaaagttatggggtgatgaataaataagatacatgtgtatttttccaaaaaatttttatgtggggtctaccattttcaccagaaaaatcagcttctctgtacattggcaaggataattttaaagttccctgccaatttaatggaaaaattattaaagagacccaaacaatccgagatcttggaatcctaattgacagcaaactgagcctctctctgataattttgataaatgataataaatgttccccccacaaagcgaaaaatgacggggggggggacgattgaggcactatgattagttacaaaataagaaaaaaaaatttgtcaaatttttttttgaaattttactggcctagcaggggctatttgatatttcaggaattataaaatgaaattcagaattgacccagcaggatttttacgaaaaatttcagctccaacggtcccgccaattttctcaccaaattcgatagagaattactttttaatctttaagaaaaatacgtaatacatatctatctttattttatttttctaggacttttgaaaatgtttctatcgcccatcattttgtttttccaataatttttttaccttgataatggtggtggtagttaagaaactgaaaaagtgccgaaaactgtcttaataatttgctgcaacaaaatg

SEQ ID NO: 109307 - DNA, 163 bp, Heterodera glycines
  Promoter: Source sequence=SeqID_13608; Location=354..516; Strand=+; Gene=SeqID_77514
ggtaaaataacattgaaattccagtgttgaaatttatttttattatttttttggtgcaggtgttttcaatcagtcgttgaatgctacggcgcccactgccgcagttgtgtcacacaacacggactcgtccgactgcgggtccagctccggactgggcggaatg

SEQ ID NO: 109308 - DNA, 274 bp, Heterodera glycines
  Promoter: Source sequence=SeqID_42955; Location=157..430; Strand=+; Gene=SeqID_70745
ttttttacgccggcgtgctccttaccacttcccctttctcaaatttcagccgttctttacgattagtgcccaaaatagctgcttctcctccctcgtcgtcgttttgtgcgtttttttcccgtccatttcaaaaactgctgactttttcgtttgctttttcggctcgacaacctttcccccccccccccccgcttattttatgcttttgctgtcgtcattcatccgcttccttctcagcatcttcgtgtctccctcctattcgctgtccccaatg

SEQ ID NO: 109309 - DNA, 244 bp, Heterodera glycines
  Promoter: Source sequence=SeqID_16061; Location=1802..2045; Strand=-; Gene=SeqID_80417
tacgaattgcctttcttcaacattgtgcaagtttctcttctggaggagttgccattgcttatagggtttataatgagttaatggtttttcgaaaactttccaaaaaacgctcaaaaaaattttgcatttttttacaaaaaaaaatttttaaattttctggggaggggggagttgctcccgggggaggcaggtctccaaaaaatttaaacaaaattaaaacatttccacaacgtatattcagatg

SEQ ID NO: 109310 - DNA, 178 bp, Heterodera glycines
  Promoter: Source sequence=SeqID_6664; Location=1967..2144; Strand=+; Gene=SeqID_62386
ggtgttacacccgccgtgacgaagaatttgcgtagcggactaatcgcagtgcggtcggcacgggaccaaatcgaaagagcagcgggcactcttgccgcgcgaatcgtcgaagcgcgggagctgatggacgacgattacacaagggggcgaagcgctcgaccacgccgctcggatgatg

SEQ ID NO: 109311 - DNA, 63 bp, Heterodera glycines
  Promoter: Source sequence=SeqID_3245; Location=5139..5201; Strand=-; Gene=SeqID_83885
aaaatcgatttaagccaaataaaattttggatctctcaaaaatttcatcaaattaaaaaaatg

SEQ ID NO: 109312 - DNA, 220 bp, Heterodera glycines
  Promoter: Source sequence=SeqID_14698; Location=1..220; Strand=+; Gene=SeqID_78813
ttaaaaaacattaataatttgtcgaaattttcttctaaattttcttttttttttttgaaatttctgtgattgaaaattacaggggcatggctcttcccactccactctgaaaaaaaactataaaagttgaagcagagtaatctcctttttcacacacattcatcccacctcacgcacagcatgtggacaacacggacctggtgcgggacatgaacaaatg

SEQ ID NO: 109313 - DNA, 368 bp, Heterodera glycines
  Promoter: Source sequence=SeqID_7559; Location=1828..2195; Strand=+; Gene=SeqID_65215
tgtaagaaaaataattaacaaaccaattaattgttttgactgaccagcaccaaaattaattgattgtcgaaactttgatgggatgccaattcaatagttctttatgacctctctattttgtcaatgtttggcatttcggaaatgtttgaattggcatagtgaaaataaacatttcgcttcagtcgccggcccttcgttgttctcctcgcccagcaacaaggccgacttcgaggtggagttggacgtgcaccaattcgcgcccaacgaaattgacgtgaaagtgtccggtgatgacgtggtcgtccattgtgcgcacgagtcaaagggtactgtaaccatatgcctgggcattacagtcaacacaaatg

SEQ ID NO: 109314 - DNA, 68 bp, Heterodera glycines
  misc_feature (47)..(47): n is a, c, g, or t
  Promoter: Source sequence=SeqID_12126; Location=1..68; Strand=+; Gene= SeqID_75696
tttcttacaggaaaaagctagcgtaaccattgaacatttttatatantttttgagcaaaataaaaatg

SEQ ID NO: 109315 - DNA, 972 bp, Heterodera glycines
  Promoter: Source sequence=SeqID_21338; Location=1166..2137; Strand=-; Gene=SeqID_51938
tgacgaactgaatagtgacgaaacaatcggtgctaggactcttcacaaaaagtgcaaaaatccgaaatctggtttttcctatgattttttatcaatcaacattttatggtaatcccatctttaattaacaaataaatagctataacataatggaatatttattatctaataaaaaaattgttaatattgaatggaattgattttagtattgataacaatttagctttgcccacgaatttattccctagatttatccaaagaatattattttatggaaatatttatttgtattatataatatgtaaaaaatatttctaaaaatattttattctttcatttttttaatcagaaatttcaatttattacaaaatgaagacttttgaaacaatgttttacgctcaagcatttatttatttattattttctttattcttcatatttataacttcaactagatacgaacaatttgttgaaaatgctgaagtaatgacttggtaaaaaaaaatataagcacaaagaaatcaaaacaattcctgatctgcactctcgataaaaaagataaaggaatcaatttgagcttgagaacccttaaaacatattttgtaaaatattaatagtaatttcacaaaaaatgaacctatttagggttcatctgatccaataattgaattaaaacttgaagcatgctattcggttaagcttaaagaatccatttatataattggataaatgatacttggctaaatatgtgaaaacaaatcagtaccaaaatgccatttatctttcatgtgataaatgccattctataaaatataaaaataaaatccttgatttcaaagttccaagcgttatacttagagatggaaaacctgacatggcaaagaaaccgaacatcattctgaatgtaaaccagaagagattgaagaaattcgcgcagaacagattgatagaaagcaaagagactaaataatg

SEQ ID NO: 109316 - DNA, 511 bp, Heterodera glycines
  Promoter: Source sequence=SeqID_19563; Location=1..511; Strand=+; Gene=SeqID_84297
ttaaaaaattttattttttaaatttaattttaattttataatttcttaattctttgcgtaaattacgcaacaaatctcaggtttttcgtaacaacattaacgcattcgcgttcaagctttttcaagaggagcctttccgagcagcatttcggggtatttttaaaagaaaaattataattaggaaattaatttatcgaaagaaaaaggtgaaaagatattaatttcgttataatttattctttcaatttaatatcaaaatgatttaatatagcaaaaaaaaaaacggtgaaaaacttataagcattttttatcgaaaaaaatataaatattcaaaaaattttgaactattgaaaaaatatttattgtaaaaatccaacacaaaaacaataaatattaaatgaatttcttttttccaattagcgcaccgatgccgaactaatttatcaaaaacatcggccaaaagtgagcttgcccgctttggctatgaggtcaaattcgacacagcaaaatg

SEQ ID NO: 109317 - DNA, 145 bp, Heterodera glycines
  Promoter: Source sequence=SeqID_25587; Location=1..145; Strand=+; Gene=SeqID_56325
tatgacataaatattaatattttattgttttagttccgattgtaaattcaaaaaatggcgaaaacgaatcggcgaattgggggaacggcagaagcaaaatcattgtgattaaatatatttaattaaatgagttaattaagcaatg

SEQ ID NO: 109318 - DNA, 495 bp, Heterodera glycines
  Promoter: Source sequence=SeqID_28272; Location=1..495; Strand=+; Gene=SeqID_58904
caacaggaacagcaacaaaagactgctgcaaccgaacaaattgcacttgagcctggcacgttgtacagggtgagccgtaatgatttactaaccagtcaattatggtcttataatcgttcaatgaaaattcaatatttgataggtgttatgtggtgataccctccttcaccttagattttttgtaatttttttctgctgtattgtaaaaaaaaatgaaaatttgaaccttcattatcatcgtcttaaatatcgaagaaaaaaaataggggagccgggtcacaaaagaagcaagagcaagtatgaaaattaaaaaaaaaattttgctttatctcgaaatagaaaaaaattacggggttgctgacctaataaattttcttaaaagatcaattaatgtattcatttggctaaattggccaaatgtgtacggctcggcctttacattttttaaaattagattcgtgttcgggcaatcaattcggtgggctgcagtgcatg

SEQ ID NO: 109319 - DNA, 1003 bp, Heterodera glycines
  Promoter: Source sequence=SeqID_10881; Location=1926..2928; Strand=-; Gene=SeqID_74163
gtacgtttcaagaatgatagtgatggtgtccaaaatggcacaaaaagaggacaaaaaaatgcaatcgccgggaaaaggcaatttgaagcagcgaattgaaagggttcgggggacaaaacaacgattattaaagcggaggattaagcaagaaaaattttaaaagcatttgaatattcattcattcctttgtcaatttattttcttttaaatttttctaagttcaactaattacttttttatttcggaaattcgaaaatggcaccatttaaatggcgcttgtcttgtgaaagcgatttgcatttgaatggatataaacgaaaacacaaaagaaagatggccaacaaagataataaatgaatgaatggccaaatgggacttcccttccaaagtcagaagagtccgtctttcttcaattccttcccattttgatcacttctgctgctgtttggtaagaaacaatgaatgaggggggtgggaatgaaggatttccatacaaatggcataaataaaaataataaataaaaaaaataaaaatgtgtgggaaaaggcagcggaaaaaggggacaaataaaaatagaaatgattggacaaatgtgaagtgattgtgatcagcaacaacagaagcgaagatggaggaggaagaaggaaaaggaaagtttattttgagaaacactaaaacggaggaacaaaaaataaataaggattaaattaaaaataacttaaatacctttttgatttaaatggaactgaaatgcaaattatttatcgtaccgtaatcggacgaccgttcgtccattacaataattaattacccgttcttcttcctctgcttttccaccaattttcccacactttttaattcgatagttttcagaattaaattgttgcagccttttaatccggcattttcttcctgcccacacctttgcattggcatttcccaattaattgctcattgtctgctaatatgtgttagcttcttccgcttctctccttccccatg

SEQ ID NO: 109320 - DNA, 525 bp, Heterodera glycines
  misc_feature (30)..(30): n is a, c, g, or t
  Promoter: Source sequence=SeqID_31313; Location=1..525; Strand=+; Gene=SeqID_61683
tcaggatccaaaaaacgaatttgaaatttnaactaaatataatctactgaaagaggaattgcgaaaagaaaatgtttataaaaatatgacttgggttaaatttgaatgtgaaattgcaaaaaaattgggcacaaagcgaaaaaatatttatgaaatgaaaagaaaattaggacaaatacgaaagagaaaaacagtggttgttgaagatagggacacaaaaatggaactgatcaaaaaatttgatcaattgagaaatcaaaaaatttccggatttaattatgacgcgaaaaaacgggaaaaaattgcaaaagaaattgcgaataatttgggataaatgttgagataattcgcgaatggaaaaaggaattaggtaagatataaaccgtgacaaaatcaattattattactaattattatttatttttaggcataataaagaatttttcaaaaaagcaaaaaattaagaaaattaaacaatttgaaagattaaaagaagagtttattaaaaagtttaatttgaaaatg

SEQ ID NO: 109321 - DNA, 818 bp, Heterodera glycines
  Promoter: Source sequence=SeqID_26900; Location=983..1800; Strand=-; Gene=SeqID_57638
agtattacaaaaaatggtactttccaattgaaaatttttttgacattttttgatttactatttttccaaaaaaattgctgaatttttttatttaaatgcttttccgtttgtttctttaaagaaaagagaaaaccaaaataatcattagtgtgggagttctctcgacaccacagggtccaaaattcaaaaaattgacaaaaaaaatcctagaaaatcaccgacttcggcctgtccaaacgctatggccaactgcgcacaatgttcggcacaccaaccttcatggcaacgtaatttttttctttaaaattggaaatgcggtacgcccaaaacgacttaaaatttttttttgtatagcctagtccaaaatttccctaccattggaaaaatttttggcaatgctaaagaattgtggtccctaatttaacttttttattttcggctcaagatcagtttcccggggttttcgagggtgttgattacgcatttgaacttggatttgcccaattccgaaccccggacccgaattcgaacaaaaagttggaaatttttttttcaaaatataagttaaaactggtcaaattttaaatcttgataaaatttaacgctttaatttattttcattagggaccaaattctttaccattgcccaatgaaaaaatcgcaacaatgcactgcaaattataattagtgcagtcttgaattttacgataattaatgaaattcactgaaataaaaaataacaatttttttttataaaaaagcaaattttgaaaattgcactcatttttcttaattcataaatccacaaattctcgatg

SEQ ID NO: 109322 - DNA, 827 bp, Heterodera glycines
  misc_feature (66)..(66): n is a, c, g, or t
  Promoter: Source sequence=SeqID_33461; Location=1..827; Strand=+; Gene=SeqID_63522
attttttaaaaattcaaaaatatttggcaattttttgaccctcaggattttgggctaaaattgaanaattcataactcaatggaggaccggtcaatttaagtgaattaaagctttaaaaatagcaaaaaatcgggagaattttataggatttatttgggatttctatcttctaaagaaaaaaagttattccagaaattctggaaattttagatttttcagaaaaaaattcagaactcggttctgaaaagtcactcttgaaaagtaaaatactacaaaaatccgcattttttttctctattaaataaactttgttttacatttttatctcttttttgcgaattgttataaaaataaaagtgatttttggtttcgggaccataggggggtgaccaggatttttgggtggaaaaattttttcaccgaaaatattccaaaaacatgtctttaggggttatttgggccgctgatcacgaatatgcaatcagattttacttttgagatcattaagccctcagaatccctgtgtgattggggattctgagtcatcttctgggggggggggggggcggcaggttcgaatccggccggtgtacattatttttctatgcatttttgggttattttgactttttttaattaatttgaagatttcttttaaattatttaaatttattttttttaaattaaagaatttcattattttttttgaatttgtaaaaaaattaatttaatttcaaattaaataaatattcaattaataatttccaacgttgtttttaattaataaaagagtattttattataaaaaaatttttaaattaaaatg

SEQ ID NO: 109323 - DNA, 772 bp, Heterodera glycines
  Promoter: Source sequence=SeqID_5471; Location=1246..2017; Strand=-; Gene=SeqID_58181
atcaaaaaataaattgtgataatatttgttaattctatttaattgtgataataacttgatatttaacctgtgataaactaataattcacctgtaatcaattgaatttcaagttaaatttacaacaatagttcacttaattattttaaattcgcttttctaagcaaaatttcaaactgtgtcctaaaaatataatcgatttaaattcaattgactcgttaaatcaacccgatcagttaaatccgatcgagaattttgaaatattaccagaatttgaagaaccaataataattgagaacgaaaatcaaaatatcgaaatctttgaacctaacgaaactgaagaaataataaaccaagacgatttaatctttgaaaatttctacggggctttaatcactgaaccattgtcaaattattttaccattaatcaagattttattattaaagtcaaaaaatttaaacttaatccttctaaatatacatttaaaattactattgccctcacagtacattcacacagaaatttgtctcaccgtaatataaaaaatttttgtcagacaatttctgaagaaataactagcagtattttatcagattttttacataaccaatcttaattggctcaatcgaaacagaccaaagaaaaattaaattaacaaaatttctcaagagaatagaaattcgaacatctaaccagattaaaaaacagtggggtccatattgctatcatccaattcttgtactttcaactcataagtatattttttaaatatg

SEQ ID NO: 109324 - DNA, 376 bp, Heterodera glycines
  Promoter: Source sequence=SeqID_43922; Location=1..376; Strand=+; Gene=SeqID_71489
aaaacgagagatgaaccaataaatagagagtgcagagaaagaaacatctctctttttggcgtactatttctttatctctgttaatagagaaaacccgaatttacttcatcctgtttaacgttttttttctgcttgttagacctacaccaaattttgcataccgattgagaaaaattttgcgcatagaataatacgtttttattttttgtttatacgttagttcaaatgttataagaaaaacaaattttcgaagactcatatcttttttctaactcaccaattgtttagcatttgcttagaaaaagattctcctcatcagcagctttcgaatgataccaagattgtccagtttggttggcaaaaactctcaaaaatg

SEQ ID NO: 109325 - DNA, 293 bp, Heterodera glycines
  Promoter: Source sequence=SeqID_11238; Location=1522..1814; Strand=+; Gene=SeqID_46940
tgatgaagtgatgagttgtcgcgacgaaatgtgtagacgagcttggcgcgcactggtgttgatgttgcgttgagttgaaggctggctggcactggtgaaaagtgaagaaaaccgtcgccttttatacacttttttttgatgcatgaatttttgcacccgaattttgtatataaggaggtggattttgcacattctcctcactcagcagcagcaacacttcaagcaacgctctcaacgatcacacatcaagcacccacaaagccagcccgacaacagcgacaacaacagcaatg

SEQ ID NO: 109326 - DNA, 158 bp, Heterodera glycines
  misc_feature (72)..(72): n is a, c, g, or t
  misc_feature (91)..(91): n is a, c, g, or t
  misc_feature (119)..(120): n is a, c, g, or t
  Promoter: Source sequence=SeqID_29554; Location=1..158; Strand=+; Gene=SeqID_60039
cgcaaagcgatggttgatcaataccttaaaaagaaataaaacaaggagagagttgtggaaaaactagaaganaatggtgtcgacctaagcntaagggcgttagatagacacctttcaannaataagaagtagaatcggaaggaattcaagaggacatg

SEQ ID NO: 109327 - DNA, 1003 bp, Heterodera glycines
  Promoter: Source sequence=SeqID_416; Location=5987..6989; Strand=-; Gene=SeqID_51902
gctaattgtgctcagaaaattaattatatcttgtcaaaataattttttttttattaattttacttagaaagtaataatataattttaatgataattcttaagcaaagagtaatatgaatatattataatatttttaataaaaatgtgaaattattatttgctattgccggagaaataaaatattataaatcgataaacaatacgttttaattgattttccaatcatcattgttcatcgtttttggatttctttatttattcatagctagtagtagatgtttattacatgcacataaaatcgtaaaatttcccataaaaccgtaaaaaatatgcaaatatctttatgaaaataaatgggtaatttctcagagtgcaaaaaataaaaagttggaagaacctcctttattttattactaaaggagttattcctaaaacttgttagatcatcaatagaattatgcaaatcttataaaattggaaaatttaattaaaaataatgtatttaaaaataatttaaaaaatctttaataaaaaaatactttttttaaataaaattgatctaaacaaacctaaaaacccataaaatgcccaaatatgcactaaatttgccataaaaatcgccaaaaatgtcatttaccgatcaaaaattgtgtaacaattcacaattgactctcaaaacgtcaaatgccaatttaatttgaactagaaaatgtgcagacataataaaagaaggaatgaaaattaattgaaaaaatagttaggacaacagggatacgataggaagttcgtttcccggccgttgtgtcgcaactcgcacctcctttcctttcactttggaaccgaataatgggacaaacgcgaattgaaatgattgtttttccccagattttttctttcctgttcttcccttccaaatttgaacttcctttattactcaaattcaaccaagagaataacacaacaactttatttgacgatttgcttctcgataagggcgaagatg

SEQ ID NO: 109328 - DNA, 856 bp, Heterodera glycines
  Promoter: Source sequence=SeqID_26580; Location=1..856; Strand=+; Gene=SeqID_57317
atttttatataaaatattttgtgccattttcccaccaaattgcgcacccccctccccatttggtgccgcgcgcgaaaatggctttttcccaccgagacaccaccgtccccattttttgttttacaccccttcgttttgtgaaaaacctcactttatatgttttcccaagctttaaccgtttggcatttccacttatgtgcgcatgaggccctaaatttggagaaaaaaaaactaaggcattgagcagcagaaagcacagtatatgtaggggtaatatataaatttcccccaagcctattggcttaatcactcagaagccattaaaattaaacccaccggcaccactctctccaccgtaattaaatcccaacaaaatcccctccttttcgtttttatacaataattccgccttttgccgctttttgtcccaaaaactgtgctacagtatttttccgaagctggcacaactcggcatagctgctgaactgcttgcatttgtggccaagaaaccaccctccaaacaaattattcaactttttaaaacgcaccaaaagcgagtcctgcattggtcaccgaacaaatccgaaaggattatgaagcggataaacatcattctcacataaaggaaaggatgatgttccatgaagaaagggcaatgagtcggcggggtcatgacggaagtaatcatcatggatggcaacaaaagcacaactgctgtccacgacgccgccattctccagcagagaatgatgccatcatctacctccactcagaaataaagcgacaaaccggcaccgacaaaatgccaccaacagaaagaaggcaactgaagctaaagagcgcaccgggcaaaatg

SEQ ID NO: 109329 - DNA, 1003 bp, Heterodera glycines
  Promoter: Source sequence=SeqID_12709; Location=787..1789; Strand=+; Gene=SeqID_76398
tggctgtgaagcgtggaccaccgacgcctcccccttcccccccccttcccccacgcctttcactcaattcaaatcattatccgttcactccctctcattacctcacaaatcattggattcaaaaaacattccattttctctcactcaactcatcattccgtgttcgttgagtgaccgttcatttttgtctcatttttgactgggattttccgggaccattttttatttctgttttgtacttcatattcctggttttagaattcattttctaacctgttaacatcagcaccgtataggtaatggatgaacaccagcagcagcaggtaaaccacccgttatttaattaaattccttgaatttttggtcgggttttcaagaccaacagtaaaatttggttgtatgcaaatatgagtcccgaataggcctaatcaacaagccaaatgccgaaaataaatgttcggtgttgaagtctttaaattgaaaaattcacaattttctccttttggcataatgcacgtgttccgtttcccaccattctcgaactcattcccatgcataaattgtcccctgccaatatcctttggccaaatccataaaaagtgccaaaaaattattccctaaaatggccccgacgaccaaaaaaaaatgtaaacgcctgccactagagcttttgtatgagacggttctttacgtatatcccaagccggatttgtcgaatcttttcaattcttcttcgatactcagaaaatttatgagtttccgagtccaaagatgggaggaaatacggaaattagtatgttaattcaaatttggaaatgtttaattgtccggcaatttccctactatttccattaagaaacgagcaattcttgaagcactttatgagtgttttcgagaacgtaggccatggagaaccttcgaatcgtacacagcaaacgaccaaaatgcccaaagtttccttgtttcgctcacagaatttttggtgagcacaatttaagaaatg

SEQ ID NO: 109330 - DNA, 516 bp, Heterodera glycines
  Promoter: Source sequence=SeqID_15136; Location=1438..1953; Strand=-; Gene=SeqID_79327
ggcgataatatttcacaaaatttcagaaaatcaaaattagattttcgttaatttgcagtttaggtcctttttagagcaatttgactttgtttcagggtctttagaaaagttatctttatcaaaacaaagtaaaacgtaatggtagaaggagtaaaaaaaggtcgctaaatacgataatggtgaagactcagaagagaaacagtgaaatttttgggtacaataagaagtttttcaaaaaatacgagaaccttttcgcaccctgtatatattatgtattttatagtttgtgggggcatccgttatgttattgtatgtatatgtataatttaattattatatgaatatgcaatacccatgcttaatattctatacaatgtattgattatgcttatacgtttattacacgtggacaaatttcagaaaagagaatatgaaggaattattagcagctacttatctattttcttattactttttttttataaaaaaaatattctctttattttagctaaaatg

SEQ ID NO: 109331 - DNA, 247 bp, Heterodera glycines
  Promoter: Source sequence=SeqID_27867; Location=715..961; Strand=+; Gene=SeqID_58537
atggttggggaattggcggcacttggaggaattgatggtccagcaaaattttttagttgtctttgtcattgatgattttttttttgaaaaatttaataaaagttgaaaaagggtgatttctgcaaatcaatggcttcttttcctgattgaatttttttttgacattttttcctacatttatgtatttcatttccatttattgtatcatttttgcaaggtgccaatccctcccctcccaaaaagaatg

SEQ ID NO: 109332 - DNA, 237 bp, Heterodera glycines
  Promoter: Source sequence=SeqID_1803; Location=1707..1943; Strand=+; Gene=SeqID_76068
attcatcaaatttttcgcattatttggataattttgactaccaataaacatttttaaatttgaagtgcagaagcagatgtggggagtgggagggttcatgatcgcgcgcctcctcttccattggtcacgccattccgcataaactgctcatttcaattatattcccaaatccacaaaaatgtccccatgccgtcgttttaaatctcgcccccagaaaaaaaattccgaatataaatg

SEQ ID NO: 109333 - DNA, 322 bp, Heterodera glycines
  Promoter: Source sequence=SeqID_20420; Location=1516..1837; Strand=-; Gene=SeqID_50955
ttaaaaaatcaaatacttagggtggaacataatttttgatacccaaattttttccaatttttaaaaattcataattccgttatttctgagcctatttaaatgattctttttttattttgttcttcatggtgtcctcttttatatcttactatcgtttcactttttattcgattgatagatttttctgccttttttcccgaccatgccaaaattgaaaattggtccactaatttttctcgaattttttatggtcaaaaaccaaagctgatataacaaaatcttagtttttctatacaatttagaccagtagaatccgaatatg

SEQ ID NO: 109334 - DNA, 244 bp, Heterodera glycines
  Promoter: Source sequence=SeqID_1914; Location=1..244; Strand=+; Gene= SeqID_76756
acatgtgggccgctgcattcttaagacgttttttgatttgtgatcatgccctaactcatattttagtgatcagatttgatacattgtttgcatagttaccttttaactactttgttatcaatattatctttttacatattacaactacttatcaaaatatccacatccttgtagagacacatgatactttataatgttgcctgcctccttttctcttcaaaagtgtttaatttagtaaaaaatg

SEQ ID NO: 109335 - DNA, 1003 bp, Heterodera glycines
  Promoter: Source sequence=SeqID_3272; Location=1201..2203; Strand=-; Gene=SeqID_84005
ctttcggcggaaccgcatttcctttatctgacagctgatcagcgcattatctttcggcggaaccgcgtttagagtatataaaagcaaaaacattttttgattaaaaacatatttttacttaaactattattagaatcatatcttttttcattttcattttaaagttcgtttatttaagcctatacaatatgtagtttttaagatgaagctaataaccatactaattttcattatttttctttctgttgaaatcattgctagagttcatatcccacggccaaatttaaatttgggaagactcttccgtgaagttcggctattaaaaaaatctgagctcttaattggcggagctggggcattagtcggtttaatagtggacgatttatttgatgttttaaacgaaggtcttattttttattaaaaagaaatacatttcgccttaagaatcatctataactgccacgtttttcccactcaaattctctgtaacggatacagaattttttgtaagccaagacgaatttcgcgttgaagatttgttcaaaaaaatcgcttcttatatggaccgtgagtcacttaaggaaatatgttttttcggtaataattgtataggaaatataaatatagaatagctattaagggaccgatggacaaataaaaagagcaaaatctgacaagcatggactgacaacattgtttttatatgccattcaaaatgacaaaaaacttgacctacttgagtgtctctgattatatttaaattgccagttgggcctttggcaagccattaataaatttaaaatattaattaatcaaaaaatttatttgctttgcttttttttgtttgtttgtgtgcgctttttaagttagtgtgtctacggttgggccgaaacacacgtaattagttgctttttaaccggaagagaccgtactgacaaggcccactcttccaaaaaattttcttaaaaaataattttttttattcagaaaccgtccgcaaatg

SEQ ID NO: 109336 - DNA, 332 bp, Heterodera glycines
  Promoter: Source sequence=SeqID_22613; Location=148..479; Strand=+; Gene=SeqID_53284
ttccaaaatatgtcttccttaattgtatttcccttatcagctgatcaatctgacggaatttatctgctattgttgcatttatgcctcctcattagtgttacgcgcgcgcgccttgccttgtttattttgcgcgtcctttttgttgatttaaatttttgggtgtggcctaaaaacaggaaagtacccaaaataggactttccgtcaagaaccctgaacaaaatgttcatgtcggaaatccaggggcctcgcccaggttttatttcaaaattcaggtcccctctattttatttttgaattcaatccgtccgccaccgattgccttggccaaatg

SEQ ID NO: 109337 - DNA, 328 bp, Heterodera glycines
  Promoter: Source sequence=SeqID_16111; Location=831..1158; Strand=+; Gene=SeqID_80469
tttggtcagtttttaaactgataataataattgttttaattgtcataataaagaaatattaattatcttatttacttaatttgttttaggtatagaaaaagaaatgccaaattttattctgccgttctcttgattctttctgtgctttatccgttatacacaatctatttgttgtacacaaatctactggcgcaaccaaacgagtaattacctaattaattaatttcttaattaattaacaatattaaatttattttcaactttttaatgcaatattaaaaatcattgattattttatttcatttctttcatttttagtaaaacaatg

SEQ ID NO: 109338 - DNA, 129 bp, Heterodera glycines
  Promoter: Source sequence=SeqID_34600; Location=1..129; Strand=+; Gene=SeqID_46396
cccccgttgaatatcctatgaagccacaagattttctccttttgtatattttgtaggattatgttttataattttatttttagcatcacggtcataattttttaaaagtctccaattatctgcaacatg

SEQ ID NO: 109339 - DNA, 863 bp, Heterodera glycines
  Promoter: Source sequence=SeqID_10100; Location=1..863; Strand=+; Gene=SeqID_73180
gaaaggcgtcgtctttgagttgcgcccgcgtctccccttgtttctctccttgtttattctccaagtgcatttttcgctggtaaaattgtaattttaataaaaaagcgcaaataaatttaatttttgtttcggcagctttgtccgatgagtattttatggagaaaagcggtatatgcgccgaattttgttgggtccgtagtctgtgcagcttttttagggttttgccaaatccgcgtttattattttccactcattaaaattgaaaaacatttcgccagaaattaaaaaacacgaattagaatttcgggacctaaaattttggcaaaaccgggaccggtacttgctggtaaaaaaagcgggaccgggaaccgggaccaaaatcagaaaatttcaaaaactttaatcattcgagatttagaaatcaaatgaaaaaaacaaacataactttaaaaaaaattttttactattttttcttaaaattttctaaaagtctaggaaatatttggttttttttggtggcaccttatttgttaaggtttttttttgatacttaaaactttcgaataaacaaattaaacctaaaactttttatcaagaaaaaaaatgaaattttgattcttaggggtgtattttctgaaattttttcaagtcatttcttaggggtatattttcccgattttatttgttatttatgcttaatatatcggaactagtgcgcagaaaaaaggcatatgcctcaaaagtcggtctctctctatttattggcgattagactaattttttatctacatatttattggtttttattggtttttattatttaaattgcaatccctcctaattattttcaaaatttagacatg

SEQ ID NO: 109340 - DNA, 1003 bp, Heterodera glycines
  Promoter: Source sequence=SeqID_5797; Location=1283..2285; Strand=+; Gene=SeqID_59261
atggcctaaaaatatgtaaagaaatgtggggggggggggagtgtgtgccgggcccgagaaatgatgcaaattgtccgaattttggaaccgtctggaatttccgaaatttgttcctaatttgcccagcccacttaattattccaaaattcactttaagtgccctcctcccctctcgattgcttccgtgcagtgcccttccccattttattctcatttcattttctctttttcctttaaataaatttattgttgggctgtatggcagggcttccatcgaaaatttttcaaactcagaacatcgggccctaaaaaatcagattttggggtcgaaacccagaacaattcgcgaaattgcttcaaaacaattattttttatcctatcaaaaatgtattaattattatatttttcgcttccaattatcgattttaacaattttaggggaggaaataagtaaatcgtatatttaagtgctatcaggctcaaaacatcagattgatttttaagaattttttgcggcgtttatttccaaaaaaaaaaattttgggggaatgggcggcgggggtgtgggtccggcgcggtgcagataggcgccgccgggcaaattttggaaaatttgagtgcaatttgttaacagattttgaccaaaaaactgcctaaatttttgcaattttaagccatgtgacgactttttttgtttctaaaaaacggtttttttacggcgcggggttttttttgtgatttttctaattgtttttccccacagctttgccccaatttggaccgtccaccgccgtgccggcgcattatgtccaatcgtgcccatttgttccgacatacccctcctacccaccgcagcatcaatattccgaaccgattatggtcataaaaaagcattattgtattactgtatgagtgccttcgttacccctccccatgcatcagaaaaatggaaatttcgtgttttttcctaaattttttaaagatttttctagtgaaaaaatg

SEQ ID NO: 109341 - DNA, 148 bp, Heterodera glycines
  Promoter: Source sequence=SeqID_2525; Location=978..1125; Strand=-; Gene=SeqID_80200
ggaggtacggcggcgagagggtacagtagggacaagtcccgggatttcggtttggaaatggtaccgaaaagaaaaaataaaggtttttttaaaattcttttgttccttcgccccctcctttgtttcagggactggcattgcttgtatg

SEQ ID NO: 109342 - DNA, 63 bp, Heterodera glycines
  Promoter: Source sequence=SeqID_26725; Location=1..63; Strand=+; Gene= SeqID_57500
atttatttgttgtatcgctcgcttacacccacaatgatgcctccttttttgtttcagccgatg

SEQ ID NO: 109343 - DNA, 509 bp, Heterodera glycines
  Promoter: Source sequence=SeqID_30693; Location=1133..1641; Strand=-; Gene=SeqID_61099
tctagagtcccaaacaaaaataattaaaacaatggtgtgtaaaacaagacttttactttttaataacggtttttatgttcactatcaattcaaaacctaaacccggacccagttggtgtcgctggcggttagaatctgttgttaaaatgaagcccacagatgatcccaaaacacggactatcacatgagccaaattaactaagagtttaaaaaaagcagaacttaaattaaacataattttttatttaaataaattttggcattacattttaaatattattcaaaattttaaatttaatgcactcaaattccaaatgatgattttcaaattttaatttgtttttctcttaatccttgaattttttattcattaccaaattaaattatcaataccaatctaaattagtcttgccttaatgaaaaagatgatttaaaaaaccaaattttgtcatttgatgatcataaaaccaaggagaacaaataattttttttacttttgctctaagatg

SEQ ID NO: 109344 - DNA, 101 bp, Heterodera glycines
  Promoter: Source sequence=SeqID_34285; Location=880..980; Strand=-; Gene=SeqID_64113
gtctccccataaatctgggcgcatcggttcggggggactgccccgaaaacaaaaaaaatcgattttttcaagtgtccgtttggggtactcaaacaattatg

SEQ ID NO: 109345 - DNA, 676 bp, Heterodera glycines
  Promoter: Source sequence=SeqID_25836; Location=1..676; Strand=+; Gene=SeqID_56605
aataaggaacgcaaaaaaggaacggtccggccaaaaattagggtcacagaaacgcgtcctatggacttttaagtgtcccatcaaaattttgcgagtccatgcgattttagctaattgtatgtaagaacatcagatccaatacaatttcctgggttttttttggactgttgtaaattcatttgtcaaaagacagagtctgtaaagagaaaaatatcacaaatttttctgcaatttgaaaaaaatgccgacaaatttttcattttttttcgcttaattttttattcaaatgatagtcaaaattattttgttcattgaaacttatgaaatgttatggtccaggaaacccaaaggaatgccaattttattgggttttttcaacaaaattgccatttgagcgaaaacaaaattaaaattgtgaaaaattaattttttttttcaatttttaccctccgttttttaaggcgactttcgcttgtccaccagcttcgcaaggacgacaacggaggctattccaaacacattctcaaggtttcatcaaaaaaaaagaagcaatttctgtagattttctaacttttgcgggtccaaactgaaaaaatgcccggcctttgtatatgaaaaactgccccccccctttgaagttggcactgcactcggactatcgcaaggacgtcgcatg

SEQ ID NO: 109346 - DNA, 311 bp, Heterodera glycines
  Promoter: Source sequence=SeqID_18487; Location=1561..1871; Strand=-; Gene=SeqID_83104
attaaatgcctaattaattagcatttaattgatcatatttttttaggtttcggtgatatttctttgttgaaagaattaaagcaaagcgtcgcttttgctttgcttttcgtggcaaaacgtcgccgaattcagctgaataaatacggagagaagaaacaatttgatttaagcaaagaaagcgtaaaatatttaatggaagaattaattggattttcggacaaagtaattaattcaaatttaggaagttaattaaaatattttctaatttattataattattattacctagccaaaaaatcgttaccgaaatg

SEQ ID NO: 109347 - DNA, 338 bp, Heterodera glycines
  Promoter: Source sequence=SeqID_35567; Location=1..338; Strand=+; Gene=SeqID_65105
gcaaatgtcttgacacgattcatattgtgtcagttgtttcaacaataaaaattttatgtccttttgcaaaaaaaaatcgaggacttgaatcatgtgataacgaaattgacttgggaacaagaaacaaaaacgaccgagacacaaaagccaatgttttggcacggcacaaattctcgagcagcatgaaacttgagccaaatcgaatcaaaatcttgtttgaataatttagatttgataaggtacataaaattcagaataataaaatttagctaatatttgaaattttacttttatttttgttcctcaaaggcacttttgcttgcatggccggcaatatg

SEQ ID NO: 109348 - DNA, 422 bp, Heterodera glycines
  misc_feature (19)..(19): n is a, c, g, or t
  Promoter: Source sequence=SeqID_9677; Location=1..422; Strand=+; Gene= SeqID_72298
aaaattggtgcgtaaattncaattggtttgagaaaataaacttttgttttttggaaagacaataaaaatttttttctaaatgtgtcactaaaatcaaagaaaatttttaaagaaaatttgaatttaaaaaaaagtcatgttattttttgagacataaatttctaagttaagagagtacaatgcaaattttttttcaaaaaacatagtaatcatcataaaattttaaaaaatatagaaaatttttttccaaaaatattttttctaagaatttttttttaatttctaagtattgaaaatttatgaactcgttctttaatagatttctaatgcacaataaagaaatattacactttcaattttttaagccttcgacagcgtgcggacgcggcggaagcggaatttcccggcatgcgtgagcaatg

SEQ ID NO: 109349 - DNA, 138 bp, Heterodera glycines
  Promoter: Source sequence=SeqID_38224; Location=1..138; Strand=+; Gene=SeqID_67114
ttgggtctagaattttcctcttccatttttttcttaactccccatgtttttctcccaacagaaaaacggtccccctcctccttctccacggcacttaactccggcgatttgatgtcagacaacaacgaagcggcaatg

SEQ ID NO: 109350 - DNA, 60 bp, Heterodera glycines
  misc_feature (29)..(29): n is a, c, g, or t
  misc_feature (53)..(53): n is a, c, g, or t
  Promoter: Source sequence=SeqID_32357; Location=2137..2196; Strand=-; Gene=SeqID_62671
attgatttgcactgtcaataacaccgtcngactgttcgagtgacgcccgagangggaatg

SEQ ID NO: 109351 - DNA, 90 bp, Heterodera glycines
  Promoter: Source sequence=SeqID_20170; Location=1328..1417; Strand=-; Gene=SeqID_84956
ttttaaaggtatcccaacaaagaccaattaggcatggtgccggaccaattcaacgaatgttattttggcgcacagacagtgccacggatg

SEQ ID NO: 109352 - DNA, 220 bp, Heterodera glycines
  Promoter: Source sequence=SeqID_21811; Location=1..220; Strand=+; Gene=SeqID_52439
aaaaacgaaatgataataaaataatgatttttagtttacaatctttcagaaaatttgtaaaacatatttgaaaaaaacattttttgactaaaatttatttaaaaataaattaatatttattaaaaaagttttgaattgtagaaggaaattgttttaagcagagttttgaacaaattttggcattttttttttgtttttagcacataacaaaactgaaatg

SEQ ID NO: 109353 - DNA, 56 bp, Heterodera glycines
  Promoter: Source sequence=SeqID_369; Location=1980..2035; Strand=-; Gene=SeqID_84701
ttccttttctgcttattgaccttacatttttataattaaatttaagaataaaaatg

SEQ ID NO: 109354 - DNA, 152 bp, Heterodera glycines
  Promoter: Source sequence=SeqID_8615; Location=962..1113; Strand=-; Gene=SeqID_68683
atcatctcgacgaccaaagcgcctgctgcgatgggctacaggtggagcaaacaatggatgcgcatcataagcaaaaaatttttgtttttttttacagccaggcggtgctcgtcagcaaccagacgctgtacgtgagtggccagatcggaatg

SEQ ID NO: 109355 - DNA, 145 bp, Heterodera glycines
  Promoter: Source sequence=SeqID_44409; Location=852..996; Strand=-; Gene=SeqID_71892
aaattatcagagtgccgaaaatcgcatgtgatctaagcctagaaaaaaatggtcaagtaaaaatcgtaattacgctcaaaaagcttctcaaacaattttagcgcttccaattccttctacaatcgcctttatacatcccattatg

SEQ ID NO: 109356 - DNA, 903 bp, Heterodera glycines
  Promoter: Source sequence=SeqID_6553; Location=2467..3369; Strand=-; Gene=SeqID_61988
gctgaaaattatgtcactattttggcactttttcctcactattttagttgttgtttgttagatctatcaccagtaaaaatgtgacattggataatgtgttaaaaagtaatatttgataataaaaaaaaatataaacgaaaaacttaatatatataaaatccgagctcagattcgggatcaacgcattttctctcacaaaaaatgtgtttcttcgtagaaatcacaaaactgcacaattaccatcaaaattgtaaaaagttaaataagtgtcattggtttaattgcttagaaatggatatttttggacgtctgagtcacgaaacaataaatgaaaaccactagggagatatgaacttctggaaaaactaaaaaacaattttctttgggtgaaaagttatcttttctaataattttgttttctttctttatctttatacgaaatagcaaagcaatagggtggaaatattgactattaaagaagttttaataattttttattactttttgaaatttgttttagaaacgctttttcggcccttcacagcgttggcttccgctttggatgggctttttgcgtctgtccacctatgtgaactattacaaagcgtggaaggctggctttgccggcaacaccgagggagaaggccgactgttagggggttggaaaaataataatttattaaattaaaattggtttaaaaactaagaagcctagatgaaaccgcggtagaaaattagaacattgcctatggtatctaccattttttctgaatttttttgtattttcaaaaacaacattaactaatttaggacttttcggggttgctaaagtatgaatttggcatccatttagccaaattcttagcttttacgaattgatgacgaaaagtagtgctcaaaatg

SEQ ID NO: 109357 - DNA, 1003 bp, Heterodera glycines
  Promoter: Source sequence=SeqID_17207; Location=336..1338; Strand=+; Gene=SeqID_81675
gacgaatgacgtcaaaaagggagcgaaaatggcccaaaaaatacaataggtgctaaaaatttcaacaattctcagaaatttgacagggaaaaaaaaatttggtcggggatttttgtccccgacatttttctgtcccccgaaggtcgcgggggaacggaccttaattaaaaatccaattccctttttccattcccgaaattcattttgatatttaatccttaaacccccgcggcgtttgtttgttttatgtgcacagactttgcgctcgaaatgtttaccgccgccggcgccgcttcgcttcgcttcgcggcgggggcgaatcaaagggaaggcgccgcccgaggcaaataggcgtcaaaaaacagactaattaagtgctcgaagccgttaatcggattgccctttaattgggacgcgcaacgaatgagtgaccttttaagcgtaatcccatcacagaatgccaatgtttgttttttaattacttcctaatcggatttgcatgagaagaaaaagaaaggcacttttataatattttaaatttgaaaaacggaaaatgccgataaaaatggaattgatcaaaacgcagaacaatggaaaataagatgatcaaacacaagaatggaaaactgaacaaaataatgaagaaacaaattaaaattgactatccgactgatcactagcggaatgattaagccaaaacgaagtgccgatgaatcaaataaacggagcgactgatttgtaagtaactctgcttttggcgtcgttttatctctttataatatttaaatggagcaggaaaaaacttcaggtcgaaacagtccaaaaaattaccaaaataaaataaaaactgatttttctgactatcatttccatatacttttgtatctttttgaaattttgcagaataatattaaatagagctaccgaacaaaacaatattaacaacatttggcacagttcgtcccattttcccgcattttttggctgtaattacgaaaaaatg

SEQ ID NO: 109358 - DNA, 312 bp, Heterodera glycines
  Promoter: Source sequence=SeqID_30908; Location=1..312; Strand=+; Gene=SeqID_61279
gtgagaaccacttactttgacgactattcaggtaaataatgtgtcgtagagtaagttacaaaatatatggatgatcacaggaattaaaaaaagacaaaaatgtgaaaataattaaattaataaattgaggtcaaagtcaaatgaggtcgaaatataaaaataccaaatcacttaggaatttgttataattttagcttttccggtcttacatatttaattcttactcctgatggcaaagcatcaggaagatcgttaatatagatcaaaaataataaagggcccaggacagagccctggggaacgccaaagatg

SEQ ID NO: 109359 - DNA, 242 bp, Heterodera glycines
  Promoter: Source sequence=SeqID_18113; Location=1..242; Strand=+; Gene=SeqID_82695
cgccaacggtcttttccccggcggaattccttttccggtgttcggcataaacatcgaccaggtcaaaaagcaccttaggcgcatattcattccgttttttggcattttgctttgttcacaattaccatttaaattagccttttccacttaattcgacacttcattttcagattctcaaaacctgcaaacagcttgaagattcgaaaaattatgaccaattggcccactttctcaacaaaatg

SEQ ID NO: 109360 - DNA, 121 bp, Heterodera glycines
  misc_feature (48)..(48): n is a, c, g, or t
  Promoter: Source sequence=SeqID_22886; Location=1533..1653; Strand=-; Gene=SeqID_53594
caaaagcctgctgctgatctgctgataacccctcccccctctgttccncctcctcctccctctccctctcatttccattgcattccttcaacttttctcgtcctttgcccctttcgctatg

SEQ ID NO: 109361 - DNA, 244 bp, Heterodera glycines
  Promoter: Source sequence=SeqID_29149; Location=680..923; Strand=-; Gene=SeqID_59694
ttagcagcagttttaaattttattactattattatgatttaattgggcttttcagccaatatttaaacgccataatcattaatccacaggttaagcgttggcaaaatgcattgacgcgcgcggccgaatggatttgctcatcttcctcctcaaaaaaaaaatttgcttgcttacccaataggaaaagcctctattctctaaagatatacatcgtatcatattggcatttttcatggcaaaaatg

SEQ ID NO: 109362 - DNA, 1003 bp, Heterodera glycines
  Promoter: Source sequence=SeqID_1161; Location=2090..3092; Strand=-; Gene=SeqID_69069
gacacccatcctctgcctccctttccttctctaatacgatttagccttgggttttatccttcagatgttttttcaattatttacctcttctgggattggatatatttattataggtgttttttaaaggtttaaatttggtactgaaacgtccctttccactgggactgaaatggcggggctgaaatacaaccccgaaaatctggtggagtaactactgttatcaaaagaataaaaagggtaacatttttattcaattcagttgtttttctccaaaatgaattttcttccatatttttagcaccggcgttgcctataggcaccaccttggaaaattttttagaaattttgtctttatcacaattttgaccaaaaaatcttttcatttagcgatttttgacaatattttttcagtatttttgcagattttggacataaatttaaaaggcattttggtccggatgcgacgacaggcgtcgtcaggaaaaaattggagttttttctgtgaaattgttaaaaattggttaaaaatagtaaagttctttaaggaacacctaaatagaattccaaaaaattcaaaaatctcatggaagggaattattaatatttaggcaaactgctgatttttaagcacgtcctttcaaattaggactgatacggtttaggtacaagtgcgatttttaaagacatccttcacaaataaagaccttgaagaaaacgtaataaatgcaaaacaagaaagtatttttgaaaaaacaatgaaaaaacatacgttcaggtatttgaattttagaaggtggagtattttgaaaattttatttattttcacggtgttgaagtttttttttggtaagaaaattcggaataaaaaattgtccaggacgggatataggaaaaaatataaatatgtttgctcagagatacgaaacttagacttgggtgtagcaaagtattttaaagaaattgaaaaggaaaaaaacttaagaagatatataacaaaaaatg

SEQ ID NO: 109363 - DNA, 659 bp, Heterodera glycines
  Promoter: Source sequence=SeqID_13445; Location=1..659; Strand=+; Gene=SeqID_77335
caaataatggaaaaggtgagcaaatttttgttaacaaaaaaagttgttttagcttatcaaaaaaatgcatttgataaaatttgtgtataaatcttaacaagtaaatttttttattattttcatattcgtaaaatattaatagttaatcctttaattatttaaattttttattactttttcatattcgtaaagtagattttttattaaatttgttttataaaaaaattaaacgagtcgataaaacaccatttttacattttttttttgaaataaaatcaaaaaaccgattgaaaacatgtgaatgcgcctattttcattgtttgaagtatccaaattaatatttttccattaatattacttttttaatattcacaaagtaggttttttaaataaatttgctaagaaaaaaaaatcaatgagtcacaaaaaatattaaaaatttttttttttgcttttaaggcctgtaaagccaacaaattctcattttacgataatcttattgggagtgttaaaaatgattattgctaatttgacatttcttatcacagtcatttggacccactccttcccaaccgtttttagcggcaaaagtgacgccaaaaaatggtaaaattaaaaaaataataatttataaatctaatttttttttatattttatg

SEQ ID NO: 109364 - DNA, 216 bp, Heterodera glycines
  Promoter: Source sequence=SeqID_34847; Location=864..1079; Strand=-; Gene=SeqID_64544
taaagatttttaggctgttcgtgtgggtggctaaacaacccccccccccccaaaaaaaaaattaaattttcaacaaaaaaacattttgttaattttcagcgattttgaaaatattccgaagtgattttaattaaagtattctgagcggttcaaaactgattatttatttgttttttaaaatttctttgagatttttctagtaaaattttcaaaatg

SEQ ID NO: 109365 - DNA, 906 bp, Heterodera glycines
  Promoter: Source sequence=SeqID_15214; Location=485..1390; Strand=+; Gene=SeqID_79416
aaccatttgatcagtgattttatttgatcatgattttgatgaattatataaggataatttgaaaatttacaaaaatttatggttataaaaatcagccaaaaaaagataaaaagcccaaataaaatttataaaatagagaaaaatctctctccgctatcaaatagtaggggggggggggggtcgacccgactccatacgaacgaagtccaggggggagtcgacgggagtcggagaccaaaattttcgaagtactccagtcatgtaaatcaactttttttttttttgcttttcaaaacggctttttttggggcgcgctttttccaaaaaaaacttttggggaactggaggggggagtccggtggtgccgatagacgacgccgggaaaatttttaaaaattcgagtgcgatttgttaacagatttatgccaaaaaattatcaaattttgcaatttcaagctaaatttttgaattaaaaaacgaaattctatttcgtataaaattacgatatgttactcaatttcgtaaattttttgaattttttataagcaatgattaaattttaaaagattttgttaaattgtttaaattctttttgcctttacaaagtcgcctctctcttaccccttcgtctccgacctttcccaacatttttcacatttttgtcccaaccaatatgaagtcccctcctcttttgggcccctcatatgaacgaagtcaggggggtcgacccccatgatttctctattttgccttggctttcgccattccttcggtcgccgccttggccatttttttcgttgcctcaataaataataatttttaatttctaatcaattaatttagtcaaagcaatatattctgaaataaaaattattttcccatacaaataattcctaatttgaaatg

SEQ ID NO: 109366 - DNA, 157 bp, Heterodera glycines
  Promoter: Source sequence=SeqID_8301; Location=3164..3320; Strand=-; Gene=SeqID_67629
gtttttgcgattataagctcaattgtaggattttcattaaaaaatgataaaatatgtatcatttaaaaaaaaactatgagggatcatatttctttataggaaccccacgagttatcaaaaaaaaaattaaaaataatctaatttctgtagagggatg

SEQ ID NO: 109367 - DNA, 558 bp, Heterodera glycines
  misc_feature (10)..(10): n is a, c, g, or t
  misc_feature (29)..(29): n is a, c, g, or t
  misc_feature (272)..(272): n is a, c, g, or t
  Promoter: Source sequence=SeqID_19232; Location=1..558; Strand=+; Gene=SeqID_83970
ttccttttcncctcccttttctggtcccncattatcccatcaatttccgttctgtgcatgcgatcagcgccaaacgggccaactgggcaatgtgaagccgctgctccttcgcattcacaagtgggtgaattgacgaatttggcccattttaatgcaaggtagagagtgtcggtgcacctaaaacgttgccgttgaaataaagtttttaagagaaagttctaaagttttctacaaaattcaacaaattaacctctatttgacaaaaatctatntaagcaaaatttttttaacaaaagaagaagtatagtatttccggtactagttgcgtttgtatccacatttttggtcaaatttttttttcaatttttttttcttttttattatcagaaatgatttaaataacaaataaaaggtgatttatgtgcttattgggtacaattccgcgatttgggtccacaaattataaaaaatttccggtcctccaaattgcttacgccacaaaaaatcagaaatgtatgtggaaaaaagtgatctgtgtgtgccaaatctcgtcttatg

SEQ ID NO: 109368 - DNA, 590 bp, Heterodera glycines
  Promoter: Source sequence=SeqID_11961; Location=1648..2237; Strand=-; Gene=SeqID_75480
tccctggcctgcacccttgcaataggtttgggaccaagccaataccttttggcttgggtgacgtcactactgtaatccggtgtaattgtatgctataataataacaaattatttaagtaaaaaatagatttgggtaatcctactgatgatcataatttcaaaacaattttttgctccgtttataaggctgtgttactttccatttttcattttcataattacgttattcattaagcaatcccctttttattaaaaactaactatatcgaataaaaaatatttttaaataattttttatctaaataagttgaaactaaaaattaaatcgttttaatttttattttttaagggaaaacataatgttcttttctttttttgtaataccttttcttattatttattaattattttttaattcatatttcaaatgctatgccagcagtgagttaataaattagagtaattagtttgtctaatcattttaattacggagacgacaaaatgctaattgcatttctcaaaggagagataaagaaatccaaatcagtgaatattcaatgcaaaaatatgaggcataccttggcataatg

SEQ ID NO: 109369 - DNA, 347 bp, Heterodera glycines
  Promoter: Source sequence=SeqID_8100; Location=4924..5270; Strand=+; Gene=SeqID_66972
ttttttcaaacactaaaaattaaaaaaatatataaatcaaaatatttaatgaatttatttgagaaaatttgtcaaatttatatgcaaaattcatacagaaatttgtttaaattacatcagactaattcaacttccgttctttattataatatgaaaaacataaaaacaaaataaattcacgtgaatttttttatcaatttcatttcatttccgtaaggaaatgaatagaaaattgagtaagtttaaattcatgttggcatttttcagtcatattttgccattttctgtttttgccggaattaaccaaagtgttgtcctctgtgagctgagattatggttggaaaatg

SEQ ID NO: 109370 - DNA, 443 bp, Heterodera glycines
  Promoter: Source sequence=SeqID_19962; Location=1..443; Strand=+; Gene=SeqID_84725
agtcagcaatcgttgcttacttgccagatcggacgggtgcgcatgattccactgttccaagcaccccaccaaaagcaaaacgatataaccaaaatataaggaaaaatttttttaaaaaaatttttctccatctccctttttgatagaaaaagcatcagagtgcctaaactaacatgtaaataaaatttggtgcgctttagagcactttctgaaaaaatatttatgaaataaaaaaatcgatttattcaagtgtccgtttggggtactcaaacaattatggggagcaaaaatccaacgcagaattaaagtacagactatagggaagctaatcccgaaggattcggtctccccataaatctgggcgcatcggttcggggggactgccccgaaaacaaaaaaatcgattttttcaagtgtccgtttggggtactcaaacaattatg

SEQ ID NO: 109371 - DNA, 273 bp, Heterodera glycines
  Promoter: Source sequence=SeqID_23079; Location=1..273; Strand=+; Gene=SeqID_53784
gcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 109372 - DNA, 1003 bp, Heterodera glycines
  Promoter: Source sequence=SeqID_406; Location=407..1409; Strand=+; Gene=SeqID_51619
gcctcaaaaaatgctgcaaattaattttgtgacatttttcttcatatttctaatcctattaagcatacaccgttaaggatcgactttttaggaattagtcatcggggtctaccttaatagtgtatatttttactttaatagaatagctttctacctttatatagttctatttttctttttttttctagaatgtgtttttgcaaatcataccgatgaacagggcagggcgcacatttaagagctagtttttagcacataaataaagaattttttagggtttgcatatatatatatatatatatatattgaaatccgtgaaaaaatgaaaataattagcaagtactcagttttttaatgcattaataatatctaattgccgatagtaaattaaccaaatttatataatgaatattaggacctaggaatgatttactgataaatagagaaatcgtgaaaaggttatttgccgaatttcttaatcaatctatagttttaagactatttttttaatttttcaacaattttttcgtttatccaacaattggtttcctttttcatttttaatattaaaatttttggctttatgtctcccattccctaagattattttgttgtaagaattgttattcaccatttttctttgtataattattctcgccactgtttttaaaagttgaaagaaataaatcaatttaaaaaatcatacgcagaaacagaagatgtcaaaatagaaaaaataattatataggcataatttttgctaaaatcaaattgattttggctttttttaataaatatttattattaaagaattttattgtataaattacatttttacgtttttacgaaatttttgctcaataattttatggaatatagaggcttttgcgcaaaagtgtgaagtttttggcaaaataatcttcattttgacaattctctttagattttggcaaaattaattttataactttttctttaattgatttataatttttagaaaatg

SEQ ID NO: 109373 - DNA, 53 bp, Heterodera glycines
  Promoter: Source sequence=SeqID_5215; Location=1..53; Strand=+; Gene =SeqID_57293
atttttggacaaattaattggttgccaaaaatgaaattttatccaaaaatatg

SEQ ID NO: 109374 - DNA, 485 bp, Heterodera glycines
  misc_feature (399)..(399): n is a, c, g, or t
  Promoter: Source sequence=SeqID_3918; Location=1315..1799; Strand=+; Gene=SeqID_52446
aatttgtatctttttcatgccttttctaaatgaataattttaggataaaatggtaaaaaaaatttaatctttggttaatatttttttttactaaaagcattggtcacattcacaaaaaaaaattgacaaataaaaaaagcttttgcttctgtggcttcatctcctacgcttgcttctgaatgttaagtgttgttttggcggccgatcagtgcctccccgttgatcaatccccgagtgcgtcacgaaccgcctaccatcatggtaaaaaaaccatgttaaatgactacgtggtcgggaggggtcggtttagtctggccgttttagtcagagggttggtttagtctggccgttttagtcagggggtcgttttagtctggttagctgttttcacccacaaanttaattactttttataaatttcttttgtttgtcaatcatatacataaacataactttaaaatgtctgtttagctacaaatcaaatg

SEQ ID NO: 109375 - DNA, 434 bp, Heterodera glycines
  Promoter: Source sequence=SeqID_11362; Location=388..821; Strand=-; Gene=SeqID_74753
atggcattttacaaaaaataaattaattaattaattaaaggcttttacgctgtgagcaggaagtaatcgtttttcgttatgcccccgacaatttctctgctgcttttgctggattggtaagcaaaaacttcgcctgacttttgttctcggcttctcccatcgaattatttaattaatttgccaaattttgaaaataaatttattattttggacaatttgccaacacacagaaagacggtagcattttggcatgggatttgcttgccgacgagcgaagtccgcagcgaatgatcctcggcaagggggcaacggcaacgccaccatcggaatcaggcaagcacactctcgagacgaaaaaattaaagggacaaaaatgccgaaatcagtcgagattaaacaacggagaatatttaccgtgagatggtggcacaatg

SEQ ID NO: 109376 - DNA, 223 bp, Heterodera glycines
  Promoter: Source sequence=SeqID_22164; Location=1..223; Strand=+; Gene=SeqID_52820
gtccatgaggggcaatttggcactcttttttccgatttttttccttcccaaatatggcagggtgggatccgcaactgacggaataaattaaaaaatatcatttccggatattttgccgtcagcagtgttgaccggtattgttgatgccataaatctgacggtccaacacgatggaaatagctgcgggtacttcgtgtgcctgtatgccgaatcctggcttatg

SEQ ID NO: 109377 - DNA, 1003 bp, Heterodera glycines
  Promoter: Source sequence=SeqID_10959; Location=552..1554; Strand=+; Gene=SeqID_74264
tttactaattttgcttccttcaataaactcggatatttttttcatgccaacttttctggagccgatgttcgttggaattgcaaaagaatcaacgaaaacactgggattgttcaacgacttcgtgaacagaacggtcctcaaatgagcgcggatctatattccaaaagacataaaaataaacattttacgaaatgattattttcaatattatccaaacaaatagatttaggtgaattgcatcgcgatttgctcttctctctgcgtcggcttgggcaatggggcgggacggaccaatcgcaagagacatttcccccctccaatggtcctcttttgtcagtctctttgactgcccttttccctctctttcgttagatgcctttgctcacttcgttttggtaaaaaaacatttgacttcgatggcgcctataatcccccgagaacaagctcaatgtctgcaaaatgtcttcaaacatttcgcacactttgaaattaatagcgcaaccaaagattggactcaggaaggtggacattactgtagtataattataattacagtccattcactgtaaacattactgtcattttcagaattgcgtctttacaaacgcttgtttctcggcctgcggctttgcactttgacttttcctcctcaattgttacgcaatttgcaaattcttttcaaatgcatccgccaattttgtttcaatgccaaattaatgcgagaaaattgttggtcagcaaatttaaggatctcaaatgaggagaattcactctcaatctgtgaaattaatgaccagcgcattgagagagttcgagaataagtattgtgtttaaacctaaactttaaattaaggttcttcgagaattattcgttttattttttccgcaaaaaaatttggaatgtccaaaatcattttcgctgtttaaacttttggtggaacatgttacgccgtgtcttatccaaacgccaaaatggttggccgatgaagtgcaaaaagaaatg

SEQ ID NO: 109378 - DNA, 68 bp, Heterodera glycines
  Promoter: Source sequence=SeqID_18792; Location=590..657; Strand=+; Gene=SeqID_83472
tctacaatataattaattttggtgtattaaatttatttcttttttaggtgctcacccgacggcgaatg

SEQ ID NO: 109379 - DNA, 1003 bp, Heterodera glycines
  Promoter: Source sequence=SeqID_6112; Location=410..1412; Strand=-; Gene=SeqID_60405
cagctcagaatagtgaaaaatatatgataacaacatttggggtttttatttatttagcttttataattctgataattttcctatgtgtgagggtattatttttgcgataatttgattaaatatttagaacaactctttttcatttacaaattgttttttcataaaaaatatttttctcatgtattccttaatttttatttaaacagcatgtcaaaagacaaattatgggaggaggtgatacgtgtttacgatgagcgtcggaaatttagacaaaattggtttgtagaattcgaaaaaaagtagaccagacaacaaatagaggataaggcgaagaaacttagacgaaaaattttgaagactaataaataaatacaccaaataaatctttgtattgttttttttgttatttcctcgtgctaatgggctatttacccggaaaactactgagatttttcttgaaatttatcttaaatagcgtatattttttaaattcattattcgggtattaaatgtcggataccctgttaaaatattttcaaaacgaatttaggaaggtatagataatttatccattatttctaatcttactatttaggaaccttggaaggaaatagagaaagcctgaaaaagcgcctagccaaattggaaaacaattttttaggagtttatattgacactgaggatgcctacccctatatggaatgggtcgatcgtttggggttattttatgttttttcgtttctgatttatgaaagaaatgtacgaatgtgttgttgtaatgttaaggacactatagggagttataatctatatcttaacggtgttgtatatattgacgacgtatcagttaccatttacttttttcgagaaggtgaacatctttataataagttgcagttctatctaagccctctgtaccgtgttaaactacggtccaaaacgattgtaaatttgttcagtattcgtgaatggctagtttcgccggtcagcctaattgtagatg

SEQ ID NO: 109380 - DNA, 320 bp, Heterodera glycines
  Promoter: Source sequence=SeqID_1535; Location=7872..8191; Strand=-; Gene=SeqID_74316
agcatgttttaatagtcctattctttaccctgaacgcccacctaatgtaggaatgacagacatttattataaaattgcttcttttgatcattcgtatttaaataaaatgaatcaaagtcaactattctcaatgattgatgaaattattgataaatttcaactttgtaatattgaagagacaaagtcattgtcaagatgggtttattgcgtattattagttttattatggatagctgttgtaatgacaggcatttttttctattttaattctttaatcagaaatttgtgtaaaattatgcgaatatgtagagaagaaaatg

SEQ ID NO: 109381 - DNA, 179 bp, Heterodera glycines
  Promoter: Source sequence=SeqID_30288; Location=1..179; Strand=+; Gene=SeqID_60707
gcaacctttcgaattgtttcgaaatttttcaacgtggaaaattctactggggaacttttcggcaaaatttttaatcacacaacggatcaagcaggatttcctgatttcatttcatttgcggtgagtgattgattgcttattccttaattgatcaattatggctaactaaggaattgatg

SEQ ID NO: 109382 - DNA, 588 bp, Heterodera glycines
  Promoter: Source sequence=SeqID_18703; Location=1625..2212; Strand=-; Gene=SeqID_83378
tcgatttgctctttttctcaatatcccccgccccttcggcaaaattaatgacatcatttccaacaacttttctctcccccgcccccttttctgctgccattaaaaattaatgaacatttccattggatgggagcacaacaaattgcttctttgttgtgtcagaaacacataaatcgttccgtccgatgtctcttttttacgaaatggaaattcgcaaaattttaatacgcaaaaacttccgcgttaagaacattgctgctatgtgagtgagtgaatatatgcatcgttatccttatcatcctccaatttgtccattctttgccctcctttttctcccaatttttcctttggctttcgccgttggaccgcaaaatgaggacactttcatagaaagggacgaggtcatcttccccaagcaacagaaccaccaccaccataatcataatcagcatagggtatgtgtgcgttgtgacaatttgaaaccaaaggacaaacaaacgtatttaattggccccaaaatgggcgaagaattccaaaattttatagcattttcctgaggggatgtttgaaattgatctattgacgatg

SEQ ID NO: 109383 - DNA, 116 bp, Heterodera glycines
  misc_feature (44)..(45): n is a, c, g, or t
  Promoter: Source sequence=SeqID_7679; Location=1..116; Strand=+; Gene= SeqID_65610
ctgactttggatatgagtaattcgagtattagtcgagatcaagnngctggcaagaattgaaagacacagattgttttatttgtgatgaagcgcctatgataaataagcgcgcaatg

SEQ ID NO: 109384 - DNA, 204 bp, Heterodera glycines
  Promoter: Source sequence=SeqID_40817; Location=989..1192; Strand=-; Gene=SeqID_69052
aatcccagtcctactcatttgcaactgcaaatagtgaataataaaaattatttttgctcaatttttggctgaaaattatgcactattcgtcactattttggcatttttactcactattttagttaactatttcgagatttttcgtcaataaaagttgcggccctactactaataataatttttatcaaaaaattgtcagcaatg

SEQ ID NO: 109385 - DNA, 121 bp, Heterodera glycines
  Promoter: Source sequence=SeqID_1329; Location=5485..5605; Strand=+; Gene=SeqID_46818
ttttgaacagactgctgctttgctccaattgtcggtggcatttgctgcgtaaaattgcctatgatacactgagtaacatcgcaagaaatgtttgtttgtttgttccccgctaataaaaatg

SEQ ID NO: 109386 - DNA, 340 bp, Heterodera glycines
  Promoter: Source sequence=SeqID_27316; Location=609..948; Strand=-; Gene=SeqID_57997
gttcttacgccaataaaatattgtttaagtggattttcatgttttattgccgggccaggacgttttcgcgtggccgttttcgcgtggccattttcgcgtggccattttcgcgtggccgttttcgcgtggccgttttcgcgtgagggccgttttcgcgtggccgttttcgcgtggggtacgttttcgcgtggccgttttcgcgtggttgcatataaaagagaattcataactcacattatattttaccaaaatttgtttcactcttttttctaacgagtttttattttataatttaatgagtttataaactaaattaaggctatttaaattatataatatg

SEQ ID NO: 109387 - DNA, 75 bp, Heterodera glycines
  Promoter: Source sequence=SeqID_5611; Location=25..99; Strand=+; Gene= SeqID_58650
ggttttttgttaaatttgaaataagtttttcaaagtttaccgtcatagactggcagcggtaaaacattcaccatg

SEQ ID NO: 109388 - DNA, 826 bp, Heterodera glycines
  Promoter: Source sequence=SeqID_14585; Location=1730..2555; Strand=-; Gene=SeqID_78655
ttttttggtttacaatctaaagaaacacagcaagactcgacaagatcggtccacttctgcagctcgatagtcttggtctcgaaacagagatttttacatcccgaccttttgactagagttgagcgggaccgggaaatttgggcaagaccgggaccgggactttttgggaggaaaaccgggactttttggctgggaaaaccgggaaaaaagccgggaatttcccggtcccggtcaaaactggtcaaaaccgggaccttggtactcagttgtacttagttgtccgtgtccatgtcccggtcccgctcaactctacttttgacccaaaaaatatgtacataatgcatattaagcttttaaaattctaaattccacctggggaaccaaaaaaaaaaaatgcatatggccagattttcaaatcatattttccaaattatttggctgtttgtccgttgattacccaagttttcaactgcaattggtgaatttatttttatccccctctccttcactcatttttctgccatgctttccatctttcccatctctatgtgtattcgtgcttggaaatagttttgctcatcagtcgcatcacatcaatcactttccacactctaatctctttagtccttcctccataatcaatcaatattctttctttgtctccgtttcctcccccgcatttttggagattcctttgcgttttttatagtcccttttcttatcgtaataataaacatgaaaaatgtttaattttatttcagtgtttttctgtgaatgtttgttttatgattttctgctggtgctatttgaatgaggtgccatcatg

SEQ ID NO: 109389 - DNA, 1003 bp, Heterodera glycines
  Promoter: Source sequence=SeqID_17816; Location=594..1596; Strand=+; Gene=SeqID_82348
agtcctggaaaccacttaggaagaattattccgatttttcgaaaccataaagttatcgaaagaaaagcattattgacgggcttttccaattataatgccatttcggcatcggtctaacaaagatgtgcatggctttgggaaattcctcaggaattaattttcgttttctaaagaaatgcactaggtcgggcattttgacattaaaatgccattaaggcatcgttgtagcaatgatgcacgtgatcctgggaaattcctcatgaattaatccctgaatttcttctattttcttatcactcacaaataactgggagaaaattaagaagattcctgatcattagcgttcttgttctatttttgcgctattatgatatttattcccgttcatggacggtaaaaaagaaaaaaaagcgacaataaatctttttatggataattatgggaaaaaattggcgttctgtcacatttactttttatctttatttctctcacttttatgtactatctcttcattgttaataatgtaaagaacaacatttacttcgctctatagaacttttttttcgccttacagaatttcttcatattttgcatatcgatagagaaaaaaatataggatttttcaatcgcttttttaaagaaaacaatcgcttttatttaactttaatttttattttaaggcaaatttattcttttcctctccttttggcgtactattttcatgtctctaacacattaaaaatcatgaaattcgcaaattctaataattttggttataagggtacaaaatcactttgaacatttagaatcaatagaaaaaagaataaatttagcattttggttaaaaagagctggctaggacttgagttataacatgataaaagtttgaaattccgacaacttttttctgagatgtcaaattgcttagcattcacttagaaaaagattctccttttcaaaatctttttttagataccaaatttgttcatttttgttgggaatg

SEQ ID NO: 109390 - DNA, 556 bp, Heterodera glycines
  Promoter: Source sequence=SeqID_890; Location=1..556; Strand=+; Gene =SeqID_46333
aatttttattctaatttcattttaaaaaaagtacctcttaattaattcctttgcaattgaattcacagaaatgtttccatcggttttaattatttctcatggaaaaaaaattcccattttatcattttctccattttttaattatgtaattattttgggttttcactaaatattccactcatatgtagtcaatcacttgttttttaatgacaatccgtcgaatttcttatcccttccgttttttatgcgaaccgaattttttacattctttttccattaattattcattctttttttcacccctctatccaaaactaaagggcgtcgtgacaaccgctgaacaaaatgtgatcagcttgcgaaaattccacgtttttaacatttcctaccaaaattgtccaaacaaaaagggcgactgaatccataccgtgccccattttcctttttctcctttgaaacgtttcattccgtcaaaaaaaaccaagtcccaactatgttaagtggactcctcaaacggttggaagaggattgtattgagtcagccccggcagcaatg

SEQ ID NO: 109391 - DNA, 114 bp, Heterodera glycines
  misc_feature (40)..(40): n is a, c, g, or t
  misc_feature (92)..(92): n is a, c, g, or t
  Promoter: Source sequence=SeqID_32190; Location=1..114; Strand=+; Gene=SeqID_62512
ttttgagaattttctatgcaacaaacgctctcgaacatgnaacgaagtgcggtgcgccatggccattttatttttcaaataatttttatatntaatagatattccagaaaaatg

SEQ ID NO: 109392 - DNA, 1003 bp, Heterodera glycines
  Promoter: Source sequence=SeqID_4272; Location=1846..2848; Strand=+; Gene=SeqID_53839
ctcattagaagaccatcattaatgttaaggataatttggtgttaatagacaacaattaattaggcgcctcattataagattatcaattagtgccaagaataattgggtgttaatagacgtaaaattaattaggcttcattaaaagaccatcaattagggccacgcataattggaccatatcaatagcagattaatttaaacaaaaaaattttcctggctgcgcccattggcaccgccggacattggtaattatgaaaaatgtttatttgtaaacccgctggtactaattaatgattatccttttgattataacagagacgctcgaatcgaaaattcttagactcctaaaaattgaaaaaaaccgaatctttctctacgttgaaacgagacgagaatttgtttagttcttatttttacggaaaaatgatcggaccggaacttttaaaatttataaaataaatcgttttcctttaaattaaaaaaagaaaaaaatttaattgtttttatttttggttttattttttatggtaggaaattttcgtaataaaattttaagaataattgtactttttacttactttaagtattctatactgtgtggcgtcgaacaaagcagaaattaaataatttttttggaaattttgacacagtttgctaaaaaaattaaattgaaaattttaatttttagaaaacaaaaaaattggatttctcaacccttataaaattattgattttgtaatttattttttattcaatacataatcattattttacaaaacaaatttttattaaaaaaaaaatttcttattttatattataatacgaaaaatattaaaagcatgttttatttttcacatttgttgttgtttatttgtcggcttcacaggaaatacagttttttaaatcaatttttccacgtattttcgttgggaaatcttataaaaattatttaaaaagataattttatgttttatttaaaaaaaaaagatttttttacaaaatg

SEQ ID NO: 109393 - DNA, 608 bp, Heterodera glycines
  Promoter: Source sequence=SeqID_23433; Location=1317..1924; Strand=-; Gene=SeqID_54140
tccccctcgcccggctacgaccctactaaattggcattgttaaacgaatgattggcggagagtaaccgcgatggcacgcagtttttgctttaattttatttaaaaagccacaaaatatgaaacaagattcagccgtaattcttaacaatgaagattaagaaacgaacaaaaataatatgaatccaattcatttacaaattgtccttcaaattgcacacctgctcaaagttattcattttaaacgccaatttttgtttttataaattatagcgatttatagcaaattaaaaaaacttccaaaaaagtaaattaattttggccctaaataaaaagctctattattagaaattcaattccttaattatgaaaaggaatgaatggatgacttttgtttgtttagcttatttttggcattatttaagcgcacagcaaaatcgtaatgcatatcatttactcaaattaaagtttttaaaataaaattctaagctaattattaagaattaaattccaatttgtatatttattatttaaaattatcgtcataataatattataaattcttttttttccggcaaaattatttaaaaatatcattttaaagtgaaatg

SEQ ID NO: 109394 - DNA, 426 bp, Heterodera glycines
  Promoter: Source sequence=SeqID_20289; Location=911..1336; Strand=-; Gene=SeqID_85091
gacccaacttatccatgcataaaaatgccacgaccaagaccgcataatcaaaaataccacgacgatgactcgcagtgttatggatgagttgggggtgactccacaaaaataaagaataaaaaaaccagaaaaaaacacgttttaagggctatttggtgcgctgatcacgaatatgacatccatttcgaaccaggtccgaattcaaaaagattgaaaattttttgaggtaatgctttcattttatcagaatcattacaactttgaaacataatacataggcaaaaagcgaatcaaaacaatgcaatcaaaaaacaaaaaagatggttttattgttttgaaaaatctatttctgcaaaatattgaataaaattattcataggaaaggagacaaataccaacaaattaattaaataatatgcagtgatg

SEQ ID NO: 109395 - DNA, 756 bp, Heterodera glycines
  Promoter: Source sequence=SeqID_30431; Location=1..756; Strand=+; Gene=SeqID_60837
gtccaaaagattttttcagcatcaaaagttagcttacaattagaggaatttttttctttcataaatagattttggttaatttaagaaaatttgaaaattttcttaataaatagtaaaaataaaattttccttggagtttttccaaaagctctaatttcctcaaaaaatgccaaaatcgtaacttagtcatttttggaaaagtcgccgcaaaaaaagcggtttatatgttttggtttctttaaaacattttttgtgaatttttcccgcgattaaattccgttttttaaataaatttaaataaaaaatcattagaaaatttttttttataatcacggatcacggaaatcacggggattttggggtgccgtgatcacggttcacggattttttttaaagccccgtgatcacggctcacggatttccgtgattggaaattcaatcacggccagccctggtccggacagacatttttcaaaaaaaaaaacttgaaataaatttgtataagaaaattttaaaacaaaattttttttttcaaaacgggagtcacgggatcggttctcggtccattttccaagtcccggtcccggttatttcaaattccgggcctatttaattttttataactattaattcaattcaattaggtgactggccaatactgtgaccaatgtttgcctgaacactatgggtttggcaaattttttaaattaatatttttattttatttatgtaaatatcatttaagtctgtccaatg

SEQ ID NO: 109396 - DNA, 101 bp, Heterodera glycines
  misc_feature (34)..(34): n is a, c, g, or t
  Promoter: Source sequence=SeqID_28283; Location=858..958; Strand=-; Gene=SeqID_46094
aagaaaacatgcaccaagtcaccatacaataatntggccgaacaatcagtaaaccagcaagaaaacgtgttcgatccgacgcatttggactttactaaatg

SEQ ID NO: 109397 - DNA, 857 bp, Heterodera glycines
  Promoter: Source sequence=SeqID_12; Location=821..1677; Strand=+; Gene=SeqID_69062
tttctaccacctgggtcgccttcaaacccaggaaagtctccgccacctggtccacgatttatcaaatgtgaaaaaaacgaggaacccaaaccgcggaaaacatggttgcacgctgcgtgcagtcgctctcatcaatatcttgcagaacaactcgtaggtaaatgttcttgattggcctatcaactttttgcccgccacaagattaacaaatgtggttttcgggtagctttcggcgacagggaaagccccgcattcgcagagggcatgactaatgggccaaaaatgaatgaaacgaaaaaaggggaaaagatgtgcctacatcgtacacttggtactgtaaatcagcaactattgccccaatgtaaaaagtgccagcgcctgcgaagcgaataacttctcgcaaatttttggcactttccagctcctcttcctcgggcgcggggcgtttggcagggattgaaagcgggagagagacatttattttaataataataataataaaatatttatttgaagtgacaaaatttgctgaatgcctgttcttttatacactcccccccccccccccccgatcgtagaattagtctttgatttttgcgaataaaaaaccaaaaactaaaggctaaaactttatgcagcactttgtatccatctatccccccccgcaaaagtgagaataaagaacaaaaactagactataaaagctttacgcggcggaggattttgtgttcactctacgcctgcggagcctgcgtaggggtctgtacgcggcggaggacttttgtcttcactctacgacagcggagaaacttgttcactctacgcggcggaggagacttcactctacgaggcggatg

SEQ ID NO: 109398 - DNA, 411 bp, Heterodera glycines
  Promoter: Source sequence=SeqID_2846; Location=4818..5228; Strand=+; Gene=SeqID_81908
tttcgccaacttgacatctcgccaactgacatctcgccaactgacatttcgccaactcagccaaaaacattcatttcgccaactcaaccaaaaacattcatttcgccaactcagccaaaaacattcatttcgcctactaagccaaaatctgacatttcgccaactgacatttcgccaaatagttaaaaaaattaaagaaaaaagtaaaaagagtaaaaaaatgctgtgttaatatcaaatacagccctattccagtttacacgtccaatcagtgaccatcatcatttcttatgtcctaacttttttcatatttgttcattccaaccatttttggatcaatcaaagcttaagaattcctttcacttttttataatttcgtttctagcgtaattcagattctagcaagaaatg

SEQ ID NO: 109399 - DNA, 347 bp, Heterodera glycines
  Promoter: Source sequence=SeqID_36129; Location=1..347; Strand=+; Gene=SeqID_65532
tatctacaaatatattaataaatttacaaaaaattttgaacaaattcactctattaattacgagaaccgaactattttttgatgattacttaaaagcagaaatttttgcaaaaattttccaagaatccttttcaaattcagatgttccacaaattagcagttgtccttccaatcccaatggaccatttattacttatgttgaatttaatgccaatgaaatctctaacattctaaaaagcctaccaaatcgagaatccacatcccccgatgaaatttcctttaaaatcttatgtaattgccaccttacgctttcacctgtaatttccgaacttttcagaatctcaatg

SEQ ID NO: 109400 - DNA, 73 bp, Heterodera glycines
  Promoter: Source sequence=SeqID_40097; Location=1..73; Strand=+; Gene= SeqID_68529
aagttgcgggcggcgtcgctgcggaacggtcgatgattccgccggggacaatgctcagtgagtgggacacatg

SEQ ID NO: 109401 - DNA, 1003 bp, Heterodera glycines
  Promoter: Source sequence=SeqID_4621; Location=176..1178; Strand=-; Gene=SeqID_55126
ttaagagtcacacactgaaaaagagaaaaattttaaaaatggcgaataaatttttcgctttggaattttaagcaattgtcaattcttagagccttgaattattgagaatttgaatttcaatttaaactagagttcaaaattcttggccaactgattattgttttccatttatttttgaaattttattttaattccttcattattgcttgaattttaaatataaaataatatttttatgtgtcaaaaaataagggttttggttaattctacttatgatcaatcaacattttaaataataacattattatttagatattaaatgagtaagggatttggataattctacgtcaccattataaattgaatcataatatttttatttttttataattgcgtcattcagtagataaaataataaatgacataaataaataagagaatttttttttttataattctacggatgtcactaattcaagtctttataaggctgtgtgattttccatttttcattttaataggtaaatatttccggaagtcgtaattatgggtccaaaaatttttaggtctgagtgaaaattttcaaagttccgaaaatttcttatatgaaattgtgaatttaattttcctttaaatgttaaacttttaccaaaacccttaattttggaggagctgttaaaaactttctaaaaggattttttaccgcaattcaatttctttaaaaattttaatttattatgcattcaaaaattcacatttttatatttaaacaaagatttttttgcataaactggttatattgcaacaataggtaataaaaatgtaataatgcgttccattctttttggattatgaaattgaggatggctgagaataatctttttttttatattttatgtaattttaatggaatcaatcatccattttataaaagttcacgacttactctttttcatttttattgataatttatattttattcaagaagaaaaacttaataatg

SEQ ID NO: 109402 - DNA, 1003 bp, Heterodera glycines
  Promoter: Source sequence=SeqID_16865; Location=884..1886; Strand=+; Gene=SeqID_81292
ctatcatttcgtcactgagaaaattaaaaaattgtttggtagattgtcttttaaagtcatctcttctccaaaattgtttttctccaaatctgtcgtaaggccagccgaaaaattttttacaataatgttttttttttttgcaaaattttgtgataaaaattgcttgaaaatggagaacatttgttcaaaaggcagtgccgcgaagagacgatgtgcggggtagtgctaagactctctagtctcgctcgagaaaattctcgggtctttttggtctcgagcagcaaccaaatccaacgatcttgaatcattcgagagcccttcatatgctctattagcctgcaaaattctggtcataacttttttgaaccttaacaaaattttttgaaatttttaagctaatagagaacacatagggctatcgaatgatatgaacaatgttggatttggttgtaaaaaagttatagccaaaaacttgtactcgtacgaaaacgacccggacccgaccccttgtacaattatgctcttaatgtattatggcgaaaaaataaataaattttagaaataagcacccttggaagtggaattaactgagaagctaaattggtctcttttatttcagagctttttgctagcacgtttgtttttcagcgacgaaacgattagtgacgaaatgattggccacccttattttaactacttagggtgtaacataagtttccgcacaatttttttttgacaaattcaaaaattcataactccgtaatttctgcagttattttaataattctttttttattttgttcgtcagaaagtcttctttcatttcatgccattgtttcattttttatttgcttattcaatttttttagtattttttcccgaccatgcaaaaattgaaaattggcccactaaattttctcgaatttttatggtcaaaaaagtaacctgatataacaaaaaagaaggttttctgtacaaattagaccagtagaatccgaatatg

SEQ ID NO: 109403 - DNA, 453 bp, Heterodera glycines
  Promoter: Source sequence=SeqID_5704; Location=3098..3550; Strand=-; Gene=SeqID_58976
atatagtaaggggaatcggagtgcttttttcgttctgcgtaatataatgctttataactgaattacatatacattaatatcataaaataaatatttatttagcctttatttttttataatttttaggaaatttctcaaattatcccgagaccgttcgtgtgtgtcgcgattactcggacattccgccgttacctatgccgttgatactcatcataaaaaaaggcgtcaaatgcatacgcgtacactgactaatttatccaagagctaatgatcattttggcgcctaattgatcaaaatacctcagccatatctgtgaacatttgccagcttttaattggacaattctttcttccgaatgctctgaccccgctagtttacgacaaaattttgataaaaaatgtcttttatggaaaaattttccggttttttgggtcaaaacggccaaaaaaatg

SEQ ID NO: 109404 - DNA, 95 bp, Heterodera glycines
  Promoter: Source sequence=SeqID_2410; Location=1197..1291; Strand=+; Gene=SeqID_79593
tcctgaattataagaaggtattattgaagtattatttttctaaatggattaaataatactattgatatatttagtccaattaagattatacaatg

SEQ ID NO: 109405 - DNA, 255 bp, Heterodera glycines
  Promoter: Source sequence=SeqID_13320; Location=1000..1254; Strand=-; Gene=SeqID_77184
ccgccgctctgtcagcgttggccaaagtcgcaccgagccgattccacagaacagggtcctggcgaaagaacacaaatggcaatttacaaatggaatttgcgaaagattaataaaatttgactcaaaaattggccctaaaaccaatggaaaacgacctcaggacgaaaggacaacgcggaacggacgcagtcgacggcgcggtcgaaatttctggccaaattgtagagcacacccctgagccaaagaaacactatg

SEQ ID NO: 109406 - DNA, 459 bp, Heterodera glycines
  Promoter: Source sequence=SeqID_19375; Location=736..1194; Strand=-; Gene=SeqID_84101
aaaacaaataagcgttggaatattttcagggtaagttagtcctgtaccggggagtatctctattaaatttggagtgattgtgatcatttttttatgtttatttttgtgttcaattttccttaccccattaatggttaaataaaatccataatcaacctggaataaaatttttcaaaatttctaaaacctaggaatttgtcgtgaattcaattttctaaattcttagcccaatttttgaaaaattatcgaaaaactagcattttaaaaagaaaattgtttaagctcgcgctggaaatttgactgaaacatcgtcagaactcttcttctctcttctgcttggcattgccgcggttggcaaaaaaaaatttgttattttttctaaatcaaactttgttaacacttgattacgattaaaaaagtcagtccgctaattgccgatttttcaaaaaaaaaaaaatg

SEQ ID NO: 109407 - DNA, 199 bp, Heterodera glycines
  Promoter: Source sequence=SeqID_7156; Location=93..291; Strand=-; Gene=SeqID_64001
tttatttatgttggaaagagtctcggagctgacgaataaatatttaaaatgggcaaggcgaattcgggataaatattcatccactctcaatcaatggcaccctaaattttggagagagcgttttccttttatccgtcgaggcccgacatcaaatttatataattttatttaattttttaaattttttagctgacaaatg

SEQ ID NO: 109408 - DNA, 235 bp, Heterodera glycines
  misc_feature (75)..(75): n is a, c, g, or t
  Promoter: Source sequence=SeqID_7768; Location=835..1069; Strand=+; Gene=SeqID_65879
tgtttctaaaattggaaatataagaaaacattgaagatattggggataactgcagaaaatttctccgcttttttnaaattgtccacttttttattgtcactattaatttttagtcacgttattttcaaaaattttgaaagggttcggccattagttgtaaggccccatatatttttattaggtattgcgtaaaatttcgaaaatttaaaataaagacggtatgtagagtttaatg

SEQ ID NO: 109409 - DNA, 395 bp, Heterodera glycines
  Promoter: Source sequence=SeqID_33014; Location=1..395; Strand=+; Gene=SeqID_63206
tttttaaataaattatatcataagttcttttttaaattttacttcgacaaattcaacacaaaatagaacaaaagttctcttttcgtttttgtgtcttttgttctttccttccattcgccgccacttttattttcccccgagggaaaagcacaaaacacaaactctaaaataaaataaaataaaagcggagagtatttaagtgacaaattcattgggtgatgacaacatttttccttctgaattattttcaatttgtcctccttttttgatcatttaatctctctttttttaatttagcatttcatcgcttttcctaaaatatttttcatttttaaatttgcccaatttccttccaaaacgccaatttatttctgctcctccccaccctcaaaatg

SEQ ID NO: 109410 - DNA, 805 bp, Heterodera glycines
  misc_feature (388)..(388): n is a, c, g, or t
  Promoter: Source sequence=SeqID_37268; Location=539..1343; Strand=-; Gene=SeqID_66373
tccaacagaaaattgtcaaaaaatcatcattctcgacaaaaaaatcagctttgaccccctgaaatcagcaaaattctgataaatcagcagagttgggagccctggtttaaccttagtttgaagctaaaaatattttttacttcatccaaattgccatattaattttggcaattttgatattctcattttaaaataaaataaaattttttttcttaaatgaagtaagtataaaatctttaaaaatataaaaaacattttctcacccactaaaaaaatgagttttttgagtttttaaaaatgggttttcagaacaaggacaaattgattttgagggatttttgaaatacttccgtttttaatcatattcgaaccattgttactaacctgngatttcaatataaaaatgtttattctataatttttttcatcgttaaacatatccataatcaattcaatccaaattataacgatggattattgcagaaattttcgcagaatagcatatgaattggcataatatagtaactaggcatcttaatcttcatcatcatcattatcatcatgggaagtcaattaaaaatatttgacaaatattattaatatttattcaatggcttctgaaatttttattttagtaatgtgaagccttcaattcatattttttacaaattgaggaatgatacaaaatttggatttattttagaggtgggctgataaaaaaaaaccgcccaaaacatgttcaaattattctcctattacctctaatcggtaaaaatctttttttagcattttaataataaaaatg

SEQ ID NO: 109411 - DNA, 158 bp, Heterodera glycines
  Promoter: Source sequence=SeqID_5028; Location=4675..4832; Strand=-; Gene=SeqID_56626
aatcgaagaaaaatgattcgctatgtccgcctgcaagccaaaataaacccaaaatcatttcatcgagactagtcaaaattggcatcaacacactaaacggtgaaatcgaatacgtaacattacagactgtggaaaaaattactgatgttactaaaatg

SEQ ID NO: 109412 - DNA, 68 bp, Heterodera glycines
  Promoter: Source sequence=SeqID_22268; Location=1786..1853; Strand=-; Gene=SeqID_52940
ggtacacagaaaatggctgaatttaagcttaattatcccaagcatttaattttgaaggcaaccaaatg

SEQ ID NO: 109413 - DNA, 479 bp, Heterodera glycines
  Promoter: Source sequence=SeqID_28598; Location=853..1331; Strand=-; Gene=SeqID_46119
gttcacgcaacaaagaaacgcggattttgccaagtaatgcaagagcaatagaacaaccaatacatttgtttttacgaattctttgctttttgacttgacttacaattaaaagggattttcaaacaaattttcgaaattcaaaatcaaaaataactgtacatgcaaaactctatacaatttcaccgagcaaataataaattaaagtatttttaatattttttagactcgagaagtacgacaaatttgtgaaatagagcgtttcatccaatggaatgattgattttaagttacggggcagcagaagaaggatcctcctataaataaatttatttcattttctgttgcttattaggatttttgggattaaacctatataaaaaaattcgtttttttctcaatcaacggaatgactttgtcggatcggatattatttgttttaatttgacaaatttaatatttttcctaagccaccaaaaatg

SEQ ID NO: 109414 - DNA, 110 bp, Heterodera glycines
  Promoter: Source sequence=SeqID_21351; Location=1162..1271; Strand=-; Gene=SeqID_51953
ttactcgttttttatatgacaggaagatgtggcggacgtggatttgatcaagcctctgaccgctccgacgttgaagaacgtcaacgccgacacgcgcccatgagatcatg

SEQ ID NO: 109415 - DNA, 187 bp, Heterodera glycines
  Promoter: Source sequence=SeqID_6062; Location=201..387; Strand=-; Gene=SeqID_60182
tattcagaagcaattcatggaagcacaaatgaccttaatgcatcggcaaggaaattgccaaacgtttcggcatacttaacaaggataattaacaagaagtcggccattgtcctaccttcccatgtgagtacagcacataaatgccagtgcaaagcaaagctgaacgaacgttgtgattgaaaggatg

SEQ ID NO: 109416 - DNA, 977 bp, Heterodera glycines
  Promoter: Source sequence=SeqID_10906; Location=450..1426; Strand=-; Gene=SeqID_74187
aaagtttattaggcaaacaaaaaaagaatatccgaaaatgactgtcaaagaaattgcgaaaattatgaaaattaatcactttaacgtttatcgatggaagcagataattggagaaggaataaatgagtaatgcaagaacaacgatatggagactttacgacattcagtattttatttttcagtcctccttatttttattattaattttcgttttttatcagtaataaaaactaaatttttaagagttgttttaaaattttgcatattttttcctttatcgccgcctttttaaatatatatatatatttttcttttttgcattaactaggagttagaaatttaaatttaattttaatcatttccggtgaccactctaaaaaattttaaatacctatcaatgaaaaaaaaagaggcaaatttgcattttattcaccaatttttatattagaaatattaatttgttaatttttgatgttcaatcattgataaaaagtaggttgattagaaataaaaataacaccgtgctgggtcggtcgtctcgcaaaaactgtcaaatttacgcattttccgaaaaaaaatccgtcataacttttcttaaatacatcctaaaaaaatagtcttggtatcatacgatagctcttagattgcttcttcatcatgaaacatttcagaatatttaattaagttttcaaaaagttatgtctatttttttttaacatttttggtcagaactatgaaattttctgaatcttatagagcaagccaagtgctatcgcgagataccaagatcttttaatttggttatgtttaagaaaagttttgatggatttttctcgaaaaatctgtaaatatggcagttttacgaaacgaccttgccccctttggaaccacatctgtggcttttgatcataaaatacaataaatatttgctgtttttgattctgctaacaattaattcattcacaggcagtgacatg

SEQ ID NO: 109417 - DNA, 396 bp, Heterodera glycines
  Promoter: Source sequence=SeqID_5510; Location=2837..3232; Strand=-; Gene=SeqID_58282
aaccgagatggcacaccacgatataaggacgatctcattttgaagaatttatacttgttgatcaaatgacaaactctttctttgtaattttgccgagcaatacgccaggctttgttggaaataaaacaaacaaattcaaagtgcacttgccaaagaagttggtgttcgatggggccgggtggatggttggactgtcaggcataatttacccaaacaggtgggcaaaaatcatggctattgggtccgatttttggcttaagttgggcaaagctgggtacatcagaccgacaatatgtgattgttcacctgcacgacggccgaaaataccgtttccgtgtgccaaagggaagttttctctcgccacagcagcttgagaggggcattcatcatggcatg

SEQ ID NO: 109418 - DNA, 140 bp, Heterodera glycines
  Promoter: Source sequence=SeqID_15255; Location=1074..1213; Strand=-; Gene=SeqID_79468
ggtgaccttttcccagcattttttttcatacgattaatttatttgaaggtccggctcccttcaatcatcgccttctccatgattgtatcacccgactgaaggagcaggaattgatcatcgaaaaagcgaacaaaaacatg

SEQ ID NO: 109419 - DNA, 76 bp, Heterodera glycines
  Promoter: Source sequence=SeqID_2151; Location=1..76; Strand=+; Gene =SeqID_78114
taaagagctttcgaatgataccaacaatcgttaggatttaggttggcaaagaaaattgttatagtccaaaaacatg

SEQ ID NO: 109420 - DNA, 204 bp, Heterodera glycines
  Promoter: Source sequence=SeqID_16829; Location=932..1135; Strand=-; Gene=SeqID_81248
acatgaaacgaagtgcggtgcgccatgcccattttatttttcaaataatttttatatttaatagatattccagaaaaatggctatctctttttttgagaaattttctatgcaacaaagctctcgaacatgaaacgaagtgcggtgcgccatggccattttatttttcaataatttttatatttaatagatattccagaaaaatg

SEQ ID NO: 109421 - DNA, 1003 bp, Heterodera glycines
  Promoter: Source sequence=SeqID_8980; Location=544..1546; Strand=-; Gene=SeqID_69901
ttcggcgtttttttaaatcacatcgaaaatttcatgtcagccatttcgcgattttttaactgaatttgacggatttcaagacatttcactcaatatttgcaattttatggccacattttgcaatttatacccatatttttcatccctatcgatcagggacagcagcgagacacaagagacatcaatcattgagccgaacaaagaaaataaacaataaaaatgaatatggaatggaataatctgatcttaaattaattcgttagcattttttgtggtgtgttcagtcaaacgcgcaaaaacatgaaaaactcgcgcacattctgcgaccaaatcaatcgcgcccaaattggttagccaatgcacgaaggcgccgctggaaggtggcccgttcggtgttcagctggtccacctggtcctgcagctgctgcacatgagcacacatttccaatgtacaaagacagagggaaatgaatgaaaactatcgatcagagcggtttccggacccggtcctcaaaatccggccaatccctatttttccaaaaaaccgtcggaccggttcccggatccagtaaaacccggcaccgggtccggtctgactcggtctctactattaaattttttttttaatttttaattaaaaatttttatcatgaaaaaataattaaattgtggggatcaatttctttgaaaaattttttcattttttaggggtgtattttttgagatttttcttgtcggttcttagggggtgtatttttcatttttattgcatgttaaggatttttccgagaattctgaaaaaggcgccaaaaatggcgaaataggcacaaaaatttggacactcatttttcccaatttccgcccttttatacccatttttcaatttttttgcctttgccttcaagcggcatcagatgtgtataaaaggaatgtgtttctcccaggttcgcttcatttttccctccaaccaacgaaccgcttcagtgtgcaacgcaacgctatg

SEQ ID NO: 109422 - DNA, 131 bp, Heterodera glycines
  Promoter: Source sequence=SeqID_724; Location=2026..2156; Strand=-; Gene=SeqID_59827
ggtggaaaagggggggggggggaggtgaatataaaaaagaaagaaatacacagttgaccgatttcaaagtgcacgaaagtacgctggaggaagtgcatttcatcgccacggtgggcacggacagagacatg

SEQ ID NO: 109423 - DNA, 348 bp, Heterodera glycines
  misc_feature (108)..(108): n is a, c, g, or t
  misc_feature (115)..(115): n is a, c, g, or t
  Promoter: Source sequence=SeqID_28741; Location=1523..1870; Strand=-; Gene=SeqID_59318
ctttctgtgctgcccacaaaatgatttgcagcagtttcttgtcgataagaatattatcagattgtgttgtgatgtccatcctaaaaatgatgattgaccgcttaattntactttncataattatcgcctggggcattaaaaaatagttagaggttagtaccgctgtcgatccgtacgcgcctaaccggataaatttgcttggactttacctaccgaagtttccgaaattaccgggaagttttttcggggtttagaaaaatttgttgctctttttttgttgcgttttgcttgatcacaaggcccacatcgttcactcaaccaatttttcagtgaccagcagaagatatg

SEQ ID NO: 109424 - DNA, 616 bp, Heterodera glycines
  Promoter: Source sequence=SeqID_26591; Location=1..616; Strand=+; Gene=SeqID_57326
gatcccaaaagaggcatcgatgggcacgggacgctttgaggatcggtacggtatttaaattttttgattctcaggccaaatccaattgtgccaaaataaaaaataaaaacatagcttaaaaataaataaattaattacatccatattcttcggcattcagatgaaatttgatgcataaattatacatcgagaaactgtggcacaaagtttcaaaatataaaagctacacttttggaggaaatcccacactcgcagcataattttaaattattttggcattaaaaataaattcttcgccgacggggggtgggactttatagcaattggctaattatggcattaaaataaatctcgcggccaatgggggaaaaaactttattgctaagatgcaccaaaactttgactaaattttttttcacaaaatttcatcgtttacttgacaaccgaaaagatactagtttaaatcattgtttaaaaatgattgtatatttatttgataaccgaaattggatttttttttctttttgtaaaaaagttcgctttttgtctgagtcatcgtatactgtaaaagtggttacggtttagctgtgacaatgggacacagacattgaccatg

SEQ ID NO: 109425 - DNA, 1003 bp, Heterodera glycines
  Promoter: Source sequence=SeqID_7918; Location=170..1172; Strand=-; Gene=SeqID_66374
aaaagtaaattaaatagaaaacgtcaaccagcatcaaactcataacaaagaatactgttagaatggaagcactaaccactactccacaaatatattaaaaacaaaagcaaaacttactttattccataaaaatttgtcaaaatggtaaaaaaaaattcaaaattgtacaaattttttgccttttgtcccagaatatgccattcttaggggttgtattttcaccccgcgcccccgcgggggctggggatgcggggatctgagtcacgggggcggggtgaggccaaaaaacctgtcccgtccccggggacgggggcggggctcgaaccctaggtaaaacaaataagcaaataattaaataaaaaatacataatttttttttctaaaaaattttcctttcccaccaatttccttcacaaatgtttactcagacccccattcttaccagtgtacggttgaacataaatatcattttgaattttgccacaaactgccacctctaattgtttgatctcacaatctgcaggtgtcagtcaatcccattcatttttagacatcatttttatttggtatttaccgtatatgctctaattatagcccagtctctattaatcccgcagtctccaattatcccccagtctacgaggtgttttgaaaaataatccctctatcataatcccccagtcactaattatccccccttttctgaggaggttgaaaaataatcccccatgggctataattagagcatatacggtatttctttatccaattagtgattgtttccatttcagtaattcttaaaattctcgaattaatttgtcaaaagggtaaactgatagtgatctcatgttgcaaaattatttattacttcgcgtattttccccattttttatcagatcatttcttaattgctttccgcggcacttccccccccccccccaccgtttttaccttacatatttaaacacataaaaatttccagcttaaattttacttacaaatg

SEQ ID NO: 109426 - DNA, 117 bp, Heterodera glycines
  Promoter: Source sequence=SeqID_44105; Location=1..117; Strand=+; Gene=SeqID_71644
ttagatcaaaactgaatgttattgcctgtttgtaggtgacagaacgccgaaaaaaggcattacaacttctgcatgagattgcgccataatgaagacctttaatttggtgacattatg

SEQ ID NO: 109427 - DNA, 699 bp, Heterodera glycines
  Promoter: Source sequence=SeqID_1954; Location=710..1408; Strand=-; Gene=SeqID_77002
ggttgggattcgggattacaatttttatgaagaaaaaaatttactttcccaggtgctatgttgttataaaattaaaaactatcaaataaaatttcgacacaaaattacccataattttgttcaatgcaattaaatttaattctttttgatatcattcgatagtcttaagagttctctattagcctgtatgtacaatttcaaaaaacttcgttaaggttgaacaaatatggccaaaaatacacaatgaaccaggttttcaaatatttttggccaaaactttttttgaaacagcgaaattttttgtatttttaagagtattacaggggacaaataagtcttgcttttgataagaattaacaaataacttggtcattaaaaaggactacgcgtgataatgcatggattatgtttaggggggattaagattattttttatcacggacaaaaacctaaaaattgcccctgcttcaatcataaagttccaatcaaatttttgtttttcattcgctatcctttaaagagaatcagaatgtgtttcagtagctcttagaaatctctactagcttgaaaacttacaaaaaatttcgcagtttcaaaaaagttatggccaaaaatgcttgaaaacctggttccttgtatatttttggccataacttgttaaatcttaatgaatttttcaggatattaataggaaacatg

SEQ ID NO: 109428 - DNA, 138 bp, Heterodera glycines
  Promoter: Source sequence=SeqID_31467; Location=783..920; Strand=-; Gene=SeqID_61808
aaaagcgcgaggcggaattggcaaaactgcgccggggacttggaggagaacaacctgaaccatgagacgcagctgaatgcgttgcgtaagaagcacaacgacgcggtggccgagctgaccgaccagttggagcagatg

SEQ ID NO: 109429 - DNA, 125 bp, Heterodera glycines
  Promoter: Source sequence=SeqID_4053; Location=1..125; Strand=+; Gene= SeqID_52974
taaacgagcgttgtgccgaattgcaaagaatttttggtttgtctgtagactttaaaatcactgcattttaataatggattaattgcatcctttttaaagtagccgtggaaaagtgtcaaccaatg

SEQ ID NO: 109430 - DNA, 301 bp, Heterodera glycines
  Promoter: Source sequence=SeqID_43281; Location=1..301; Strand=+; Gene=SeqID_70989
actaattttccgagctgtttaggtgccctgtcgtcttgtgcttcatgggtggcagtgtgctgctcttcaggccaagattggtttaaaatgcttaccactttttaaaaatggtgacaaattaaattatatttttgtatagcagaggaattcgtctgctaaaataaatattatcgtatccatccctttctgtccctcacgcattgccatatttccgatccttccaacacttctcctctttatttcttattgattttttatcgttaccatatttttaatgtgctttcacccccctattaaaatg

SEQ ID NO: 109431 - DNA, 437 bp, Heterodera glycines
  Promoter: Source sequence=SeqID_22624; Location=1..437; Strand=+; Gene=SeqID_53297
aaaaatcgttttttcccaaaaactgaggcgtttgaatttttaaaccgaaagtttttccctttttccgattaactttgttttcaatgcgaaccgctttttactgattgcctttatccgatggcttttgtttcggcgaacggactgggaaattggtcgacgaatcgagcgaatgctcgacgaattgtacctcgtcgtttaccgatgtttcgaaattggtcggctatgttagggccgatttgatgatgccttaaaaaaaggctaccgtttctcaatcgggcgagagatgtggcccgattggccggagacggggagttgaaaaaagattaggttcttaaattctatgatatataatttattttccccgataggtctaattcgattttaaaatctaaattaatgtcgaatttattattattatgtatcaatttgtagtgatg

SEQ ID NO: 109432 - DNA, 809 bp, Heterodera glycines
  Promoter: Source sequence=SeqID_6163; Location=4004..4812; Strand=-; Gene=SeqID_60567
ataatgttattatcataaatgtgtctcataagttctgagtaccacatatgtctagagatttgaaattacaatgaaaatttactgatcataaatccgggtccggggttcgaaattggtcgaaatgaatgtcatattcgtgatcagcggccccgaaaaccccggaaatgtattttcatgacttttaaaaaaaattttcaaaaagggtaacttttacagtagcgccaaattctctatagtgtcgaaattactcaatgtcgaaatggtccagtgtcgaaaatgcaggaaaacagtgaaagttttagaaataattcagtgcgaaaatgtagtgtcgaaattacttagtgtcgaaaatacttagtgtcgaatttactcagtgtccaatttacccagtgtcgaaattaccagccgcggtttttttggtaccggtaccggttttttcaaaaatcaaagtaccggtaccggtttgtctagtaccggtaccgccggtaaaaatttgcactgttaagaataggagtttagcacaaaattgatgatgcaaaatttagggaaacggaaaattttataaaaatagaaaattttgccaaattttaggcattttaaacacaatctttcgtcatatttattcattgaagattaatatatttggagttaaaatttcttatcccttgttaatttattctacaagagaatcatgattttaattttggtaatcaaaatccaataaatgtctgccatttggaaatatttcgacaaatcatcgaatgataaagcattatgcaatgtttgcggtaaaaaaattctccgaaatg

SEQ ID NO: 109433 - DNA, 1003 bp, Heterodera glycines
  Promoter: Source sequence=SeqID_10543; Location=413..1415; Strand=+; Gene=SeqID_73777
ggcgcaccgcgcaaaaaaaaaaccgcggccgcgcattcaaattgccgcggccgcggatcgcgcaaaaaaaaaacgccgcgaatcgcggtcgcgctccagccctggtgtatttttcgtttttattgcgtttttgttaacaaattttgggcaaaacgccaaaataggcaaaaataggctctttcaaaattttttaggctttttaggctctaaaaataaaagcctagaaaataggcacttataactcgaaaagtagcttaacaacagcccaaaaaaacatgtttttcttgcgtttcaggccacggggagctcaggaaaaaaataggcttttgcctaaaaagtgcatccctagttaagagctttcgaatgataccaagattgttggatttggtcgacaaagaaaaaagttatgatactctaaacttggctcatactaaaccggacagactaaactgtcccagtccgtcactttttttccttttttcaaagatgataaaatttttctagaacattaagagctatcgaatgacatattaattaattaatttggttgactttgtttaaagttataacgattttttgtcaaaaacaatacgagttggggtatgtacgagggtaggtaatactttgatttgtccctcccactatttttctaaattttttttaaagttatgaaaacatatttccaagggtttttggggtttctgatcacgaatccggcagaaatggatgctgccggattcgtgatcagcgacccaaaaccgttggaaacatgttttcatgactttaaaaaaaaattgccttcataaaaatttttgaaaaataatatcactattttggcgttttgcccatttaattcttgacaagaattttggttttaaaaatttatatctcaatacttgatttggcttaattttgttactttttggatgacattttacgattttaaaccaaatttgaaagcttttagtttatctttatacattctttagacatacaaaaaatg

SEQ ID NO: 109434 - DNA, 753 bp, Heterodera glycines
  Promoter: Source sequence=SeqID_5829; Location=745..1497; Strand=-; Gene=SeqID_59359
atgaagatacttttattgttccaattatttatgatcaagtgacattggccattgatgtcagtgtgaaagaagcgaatattgaggagaattcataaatacccattatgatctggcaaaaatctcatcattgaattatcatcctatggacctgctgtgtttagcttctttcttattgtttatcttttggttttacaatattgatttatggattattaaagcggcttttttaagcattgaaatgaaattggcatatcccctgatgtgccttctattgtttaacaattaattggtcattaaattctgttcggtaatccgccacgccgctcttttttgaaacaattcgaaatgttcccaaacatttgcaactccaattttctgctcaaataaatttattaattaaaggttgttaatttttattaataaatatttaatttgatttaatttccacatcattgtaagcggaacccaaaaggaaaatgcccaaaaatttcgcattgtcagtgcttccatttttcggatttatttgtgccataatttttccacggcaatctttactcaaaatcgtgcaaattccgacgatttttcaatgtccataaaaagtgttccattggatttgctttgaaccaaaattaatttgtccttttttggtccatcaacagttgtgatatcaatggtcaatgtaattccttcagtttaatcttttaatttttttgggtcaccattttacttcgataaaaattatatgggaaaatg

SEQ ID NO: 109435 - DNA, 796 bp, Heterodera glycines
  misc_feature (111)..(111): n is a, c, g, or t
  Promoter: Source sequence=SeqID_25848; Location=1..796; Strand=+; Gene=SeqID_56618
atcgaacctggtcttttctaatctctttcaaatcgccccaaattttttttacagcttaactaggcccaattaagcttatttccagaaaatctcgcatgaattctcattttnaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggatttttttttggcttaacaaaacttcatcgaacctggttctttctattctctttcaaatcaccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 109436 - DNA, 221 bp, Heterodera glycines
  Promoter: Source sequence=SeqID_32434; Location=1..221; Strand=+; Gene=SeqID_62741
gcaggccgctgtaagacaatatatttgtgttcagtagagtcttaataattgtttaagaacattcctcctccggcagtttgtaacagatttgtcgaagggttttcaagcgtttatgtgtatgtgtgcagtttaatgcttttgagacaataaagttatttaggttcgaaacccgaccatcttcacatggcggtgcttttgcattccgctacgatgttgaaatg

SEQ ID NO: 109437 - DNA, 225 bp, Heterodera glycines
  Promoter: Source sequence=SeqID_38550; Location=1..225; Strand=+; Gene=SeqID_67330
aatatattaatgagtatttaaaatacaaatattttttttatatccttatttagcatttcataaacttaaagtataatcaataaacgaggagatgcacaatttccgcaccgacttcaacatggaggcggtgcacaacgaaactccatctggaatgccgactcacaaactgaccatcaaagtgaacaaaattttatttgattattgtttaaccaataaatccagatg

SEQ ID NO: 109438 - DNA, 364 bp, Heterodera glycines
  Promoter: Source sequence=SeqID_29017; Location=1..364; Strand=+; Gene=SeqID_59585
tttttatttgaatttaatgcgccgttaaaaataggcacatattttttatcgcgttttcacaattgataattcacaattaattccaacatcatatttaactttttattagtgttttgttatattatattaaaaagatttacatattacttattgcccttcaattaaaagtttaattaactcgtcttaagccaaaatgtttcactgttttctgattaaagcaatgtgcgaaaaggtgccaaaaatatattaattgaaattttcttaataacaaatttaagagaaagcctttaaaaaatcaaacaaaaatacaataaaataaagaaaattaacatgaaataagagttgatattctgcttcaaaaatg

SEQ ID NO: 109439 - DNA, 1003 bp, Heterodera glycines
  Promoter: Source sequence=SeqID_1736; Location=9716..10718; Strand=-; Gene=SeqID_75602
tactaattttctactgaaatttcactcaatattttcgtaaatttaagttcttcattcgtttccccataaatttcatacatttttcggttcgcccacactgagactattttcggttcgacctagcaccgaaaatacacaaactttttaaaaataggtcctagagtcaaaactataaaagatttctgccatatgtctcacatttaaattcataacatcttaataccgtatcatgttttaaaaagatactttatcataattgattttttattgacgaaatttccggtcacatcggaataaaagacaaaatgatgaatgattgattggtctattagcagtttgtggaaaaaagataacaaaattatgtcactttacccaaatcagaaacactttcaatttgcattttattattaattaattccaaattgagcatttgataaaagtgatgcatttgtattttgaagtgttcattctgaggggcaaagttgtcttttgtcatgtcacaatttgtcctttgttttttgatattttccattttaacattccaaaaataattgcattaatgttttatatatttttttcttttacatatatcaaaacttcttttacttatcaattataattacgctaattgctctatttaatgcatatttatttatccccatgccctaaccaattttgaatttggcgaactattttaagtaattggatgatttctcggcgattaccgcccaatcgcaaaagacactcaaataatttaggtaaagtgtaaaacaattggacgaagacgcaaaatgatcgaaggtcaaaaaaagagatgaatataaatggaaattggcgatgggttcaaaggcgaaggaatttctcttcccttttccaaatttacaattaaaaaactttaacatttgattttcatttattattaatattatttgttatataatttataataaatcaattaaaaaaaagcaaaacaaaattaagatttatttgattatccaaaatg

SEQ ID NO: 109440 - DNA, 70 bp, Heterodera glycines
  Promoter: Source sequence=SeqID_40590; Location=560..629; Strand=+; Gene=SeqID_68869
tggcggagaatggcactttagaagggtcggagcaatgtgccacgaaagagagggatgctggagcaaaatg

SEQ ID NO: 109441 - DNA, 102 bp, Heterodera glycines
  Promoter: Source sequence=SeqID_1930; Location=6090..6191; Strand=-; Gene=SeqID_76867
ccccccccccctctaaaggcgattgtcgtgacggacggtgagcgcgtcctcggcctgggcgacttgggctgttacggcattggcatccccgtgggcaaaatg

SEQ ID NO: 109442 - DNA, 228 bp, Heterodera glycines
  Promoter: Source sequence=SeqID_13888; Location=1..228; Strand=+; Gene=SeqID_77834
gtgaattgtcatggtaagggttctgcttcgaatgttcgtccgtccgcccctttcgttggctttcgccaaaattcggtcgccacggaatcccttcgctgtaaatcgtttgaaaatttccccatttcttcgcaacggaatgaacgaaaacaacaaaatcagcaaaaggattttgctgatcggcggcttggacttcgctggttttcccagcagcaaattgggcgagaaatg

SEQ ID NO: 109443 - DNA, 1003 bp, Heterodera glycines
  Promoter: Source sequence=SeqID_17221; Location=687..1689; Strand=-; Gene=SeqID_81686
aggttttagccgtacattcagtaattctttacattaacatattcaagtctccccccccctctctcctctttttccctctctctcccccttaccctcctctttcctttctttcccctccctctctctctctctcccctttcgccctctctctctatctctcgctcttctcttacacaacaacaattttaagcaaacacacgccacattttcctctaaatttaatgagttaaaatttaaaatttcataataattattacctatattacgtacatatatattgacctttcccccccccccccccatcattattaattttgaactttggttttcgagcatttgatggtttaaatagaacttaatgaagtggtagaggaataaattgttggtttaatttatgtaaattacaacttttagttgttcgcccttaaaataagtttttgcccttattttggcgttttgtccaaaatttatttaaaaaatgcaataaaaacgaaaaatacacccctaagaatcgactcaaaaaaatttcgaaaaatatacccctaagaatcaaccaaaaaattttcagaaaaatatacccctatgaatcgacactaaatttttcaaaaatagattgtttgccttagtctgaaattatttcatataaaaaagagcaatttaaaaaattacacccctaaatttggaacttttttaaccttattttcgcccttatttacggccttattttggacttttttttctcgtgactcattgctccgttatttttactgaaaaggtaattatgctaaatacagtgagcaataaataaatttcattcatcagtggctcttcgcacccctttcgtccttagtcctttccttttatttcccccctctctctccccctatttccctccgtcatttccaacgtgactttccttcgttgtatatatacctacttattaatttcattcttttctctttaaatccatcacagaagaaaaatgtaaacacacagacagatg

SEQ ID NO: 109444 - DNA, 372 bp, Heterodera glycines
  Promoter: Source sequence=SeqID_3779; Location=1..372; Strand=+; Gene= SeqID_51844
gataaaaaagcattgtacaagagtgttattgcggtggttgatctcattataaacatggtcgtcataattttgagcgggctccatactgtctgttccccgtttcattccgtttgaggaaaacggggcgttgacgcgcatgtaaaggaactgagattgaggtggacacaatggtcatcaaggagggaatcaccttatggtcacacgcatagaaaaagcgcagtttgtccatattgatgttgtctacgagcttcccggtcattgttttttcccgtgaagaataaggcaagggtgttcagcgttccgtacagcgaactgccgtcctcagacaggtgcgcccagcctctacccccaccaccaccacaaccaccaatg

SEQ ID NO: 109445 - DNA, 511 bp, Heterodera glycines
  misc_feature (56)..(56): n is a, c, g, or t
  Promoter: Source sequence=SeqID_5975; Location=2393..2903; Strand=-; Gene=SeqID_59883
aaataaataaaataaaatttattaatttgcaaatatatcaaatgtaataaatcatntggaggtaaataattattaattcaccaacaaaaattcacctattccccaaaccaaatcactggaacattaatattaggattcgctctccccaaatgccgcgcagtaagtaacaatagagatatgacaggtcaatgacaataacatttggcttcacaatattgccattgatgcttgttttcccaatagcaatttcaacaatagcaatttcaacaatatttttgcattttcctacatttttaatagataaacaattaagaaaattaattctcgatgatatttaagccccgaaatgctcggtttcattctcattctaaatttagccgttcaaatattacttcaaatgtcagtttccccgcttcttgactttatggatttaagtactgaatttaatttagttaaatgaattatattatattatttagacaattttgtagacaattttgtggatgaaatg

SEQ ID NO: 109446 - DNA, 367 bp, Heterodera glycines
  Promoter: Source sequence=SeqID_25185; Location=896..1262; Strand=-; Gene=SeqID_55912
agatgaagaagaaaagaagaagttgaagctgatttgttcttgaaatgccacggtgaaaagacaccgcacggcgcatgcaccaaacacaaaatggtggccagacagacagacaaatcgggcaatactatgtgaagaaacgtgtttttaattttgttaattataaatatttcaatttaggaattttttgtttttagaaaaataattcttcaattcctcaattttttatccagcggaagaaatcgcacaattcaataaaaaacattgatcatttgacaaaaaatgaaaaataattctttcatatgttaaattgttttcaggattattgatatattttaataattaattttaaaaaatgcttttttaaatg

SEQ ID NO: 109447 - DNA, 271 bp, Heterodera glycines
  Promoter: Source sequence=SeqID_19000; Location=742..1012; Strand=-; Gene=SeqID_83738
aaaaatttatgaagaaaaatcttcaaaaaattgattttttcagttttcatattatatttgtttaattgccaagcaatagcttagaaaaagcttctaaacccattaagctttcgaagaacaccaagattgttggatttggttgacaaagaaaaaagttacagccaaaaaacttggctggggcctaaccgtgcggggccgaactggaagggtagaccgcctgctagggttttttagacaaaaaattcaagcagggtgccaaagacgttgcatg

SEQ ID NO: 109448 - DNA, 1003 bp, Heterodera glycines
  Promoter: Source sequence=SeqID_24054; Location=1142..2144; Strand=-; Gene=SeqID_54749
gccaaaaattcccggtttttcaacccgaaaaggtcccggtcccggttttgcgcccaaaattcccgctcccgctcaactctagttttaagcatcatattccaatgagcaaaaattaaaaaagatgaaacaatattttgaaattaaagaagaaaatcaaaaattagtgacaaaattattgctaagaaattaggaactctgcgcagatggataaagaaatttgcatcaattgactaagtcgattataatggcattgatataattagtgcccggattttaatgtaatttttataatagccacttttctttatattttgttgtgcttatttgataacaaaatttttttttcatttaatatttctccggaaacttgtcaaaaattgataaaaattggtgtggcaagaatttcattgtcactctttatagtgaaaaaatcattggctggactcaagcctcggtttttcataggcattgattttccagggttttttctatgaaaattcatactaaattcggaaattaaacaaggcacagttaaatatgaaaaattcctaaaacatttcaaatatgaataaacaaaaaaataagcaaaagctcaagaattacacagtatatttattaaataaaatattcaaatgattattttcaatttcaacacatatttattcactgtattttaattgctaattatctgtaataacacgaaaaatcttttgcttactctttcacattaatccctatgaaaaacatttttgtttaaatataattccaattaaaatgaccattaatccattattaaaaaaagagattagtaacgaaaataaaaaaaaagagatttctgcccatattttaatgggcaaaatatgaccatattgaatcagttgaaaattttttttataacaaaatgatgaacaaaatttatgccaccattcatttcttattgcttttgactgtcattgctaacaaagtaacaaatattaatatctaattattaaaataaataatg

SEQ ID NO: 109449 - DNA, 529 bp, Heterodera glycines
  Promoter: Source sequence=SeqID_12357; Location=2745..3273; Strand=-; Gene=SeqID_75958
taatcagcaataagaaaaatccaaacgaattcagtagtcgtaccagtatttagcgcttttttaacataattgcaaaaattttttgggtttttttaattatggcggcgaaaaggacatttttctacgggcggcgaactggccgcggcgaaaaaaccccgcggcgaaccgaccccgacccgaattttcagtattttagtgtgacaaaatggcgcccctacaaagtgtccaagcctcgaaatgtccaagcctcgaaatgtccaagcctcgaaatgtccaagccacgaaatgttcaagcctcgaaatgtccataagggtaaaaaacacgaaatgtccaaaagtctaaaaagtacataaaaacccggaaaacggatctaatttagggtttttggagtcgctgagtacgaatatgacatttacattgccccttgtctatcccttgatccacccgaacatgaaataagttcaagaattattttaaatgtgtgctgtactgacgactttagatttttctattcatttggaccaaatg

SEQ ID NO: 109450 - DNA, 315 bp, Heterodera glycines
  Promoter: Source sequence=SeqID_42243; Location=744..1058; Strand=-; Gene=SeqID_70191
aaaaatgctataaatatagttatgtggcgttttattagtattttattatttttttttcattatataaatttgtctttatttttttttcatgaattttttttcttttaaaaggcctaatcttaaaaagtattaatttattttattttgaatgttaggtattttatgatttaagagaagaaaaaatattactaaattctttaaatttttcgaggggcgttaaaaatttaattgaaaggaaatgaatttatttaaaaatgccaaaaaaagttgaatttaaaagaataatttgaattatttttaggcccattaaaaatg

SEQ ID NO: 109451 - DNA, 282 bp, Heterodera glycines
  Promoter: Source sequence=SeqID_24864; Location=970..1251; Strand=-; Gene=SeqID_45889
ggcggcttttaacctacaaaaattcaaaatttttcgagaacctagggaattttttaaaacttaaaaattatagtataagaatttatgtgaaatttaaactttaaaaaactccgaatgtttgtaagaaattttgaattatgaaatttattaaacttttgcgaatagaaagccgtaatataaaggtattttatttgtaaaatttcagatgtgttgccaggaaacaaaaggactataaggcttcacaaattcattattttacacattttttttgttggaaaaatg

SEQ ID NO: 109452 - DNA, 1003 bp, Heterodera glycines
  Promoter: Source sequence=SeqID_6316; Location=826..1828; Strand=-; Gene=SeqID_61125
aattatattttaattgcacttttttaagtcatatggacaatccgtcagaaaatttatcaaaaacatttgggtggcttataattagagctcgcattttgagacatgccttttttgcgcactagtttcgataattaagcataaataacacattttccacttgatttgagacttctacgttgacttttattatgccttttttttttttgcctttttcgggattttcgtgccttaaatgccttttttgccatttttccattttggtgccttttttggcgttttttccgaaaaattccataaaaaatgcaataaaatcgcgaaaatacacccctaagaattaaaaaattttctcaaaaattgatcaccaaaatttatttatttttttcttgtaaaaaattttaggcttaaaaatttttccttattcgaaaaacattataaaacatttaataattatttaaatgaccaaaattaagttatttggttaagttttgcgtgttttgctccctaccaatcccttattaaaaaaattttaagtgttaagtattttctttttgctgaattgtctttctgctaatctctcggctatttttaagtgaatattttatcactaaaaatgactcttttttcgcttattttttacgatattttcagcaaatgtttttctatttatgccctgtgacataagctgctaattcattgtccgtaaaacacttcaattttaatttttgcataaatttttctgactcattttccatgagcactttttattgtttgtattatttggaaaatcatttaatagacaatgattatacgattatgaccttgattcatatgactggcttttttggcgagtgatttaattttcatcaaaacgaaatttgcagcaaaattaaacggaggcaatcaatcggagagagaaacggaggacgaataattaaccaatcagtcattcattagcacaactaattatttcaattaattaattaatttctgctttaaagtgatg

SEQ ID NO: 109453 - DNA, 331 bp, Heterodera glycines
  misc_feature (61)..(61): n is a, c, g, or t
  misc_feature (66)..(66): n is a, c, g, or t
  misc_feature (201)..(201): n is a, c, g, or t
  Promoter: Source sequence=SeqID_33573; Location=906..1236; Strand=-; Gene=SeqID_63595
gagcgctacatgaaaaaatcaaaaaaagtcttggagctgcttattttgtagcaaatcaaancaganatactggtgaaactttcatagttcggcaatgtacgaccaaaaaagataccgaaaaactttttttaattggaacagaagaagcaaataattggagaaaatttgttgtttcaactttatatcaaagaaaattttatntagaatgcttaaaatgcaaaaagatacaggaaaaagaaaattctctttttgaattttaaaaaattttcttaatttaattaattttaacagagtgcctaaaatagctcatactatcattgacgagaatatg

SEQ ID NO: 109454 - DNA, 512 bp, Heterodera glycines
  Promoter: Source sequence=SeqID_13463; Location=639..1150; Strand=-; Gene=SeqID_77355
aatgttccattcagttcaatgagcttccgcagagcgctaatgactcatttatgacaaacgcagcaaacagatgggccaaatgtggacggaaatttttgaaatttgggatcatttaagaaattattctaatgtttaaaaaatatccaaaaatcttcaaaatataaatgttacgatgccgaatgatgccgccaagaatttaatttaatgagtatatattaactatttgatttcttataaaaataaaagaagataaaaaattcatttgcattatccatttgcttctgttttttgtttttccaatacccgccgcatcggacatcgcccattttagtaggcctttgactgatcagtaaaaataaattattcattttgatcaaattattttataacagttattgttagagagaaaattccgtattcatttaaaaatatttttgcctttccctgttcatcgttattaagaaacatgcttaaaattaattaataaataattatttagtagaagaataatg

SEQ ID NO: 109455 - DNA, 94 bp, Heterodera glycines; identical to SEQ ID NO: 97954
  Promoter: Source sequence=SeqID_29918; Location=461..554; Strand=+; Gene=SeqID_60380

SEQ ID NO: 109456 - DNA, 662 bp, Heterodera glycines
  misc_feature (18)..(18): n is a, c, g, or t
  Promoter: Source sequence=SeqID_45387; Location=646..1307; Strand=-; Gene=SeqID_72686
agtatgcagccgattttntgattgttggcgattttgacgacattttggtgcccgacgatggcacatattatgacgaatttttacgacttaatgacccaaaagcagtggcatttgtgtacaatcggttgcacacggaaatcacaacaagttgcttattcgattaacagattttacctaaaaattagagcccggtaaaaaaaaaatttcggaaacgagaaaaacgattttgctggcctttttagaccaaattaaaaaaaaattaatgggaatttcgtgccgaaaaatgccaaagagcaaattttgagaattttatgcaatttatcaatatattttataccaaaaatagacaattttatgaattagggtcctaagaattttatatgtgagccctgcccttttgaaaatgcaaaaaatgaaatcttttataaatttaaaattttaagcaacaaatccggcaaatttttcgttgctcaacacattaatgtcggcaaatgtttcaccaaaaattccactcctgcaaaagtcggtggtgaacacttcgctcaccgaatcactttgggtgcatttgccgtacattataaagccatttgccgtgtttcgggaagtgccgacaaacagcggacgaatgtttcacattcgagaatggcactttgtgggggatg

SEQ ID NO: 109457 - DNA, 726 bp, Heterodera glycines
  Promoter: Source sequence=SeqID_17465; Location=1..726; Strand=+; Gene=SeqID_81953
cggtagggtgccaattttaaaaaattcaaaaaatgcgctgccagggcagaacgccaaatttgttgtcccgccaaagtgtttgctgcgcgttgctgttgtgcccgccgtctctttcatctccgtgctgttgctcatcaacaactcatgctccgccgccgcctctgcccatgcatttccgtccgcagcagcatttttggcacaacgacaacagcaacagcagcagcaaagtgagatcgatcgatcaattaattaattataaattaattggggaggggcaaagagtctcgcgcagatcaacaatcaattaattataaattaattgaggataggccgagagtctcggagcggatcaattaatattatttattaattggggatgggccgagaatctcggcgcggatcaattaattaggtaattggggataggccgagagtctcggcggatcaatctgtgctatgacggttttcaaaataaacattttttgccttttattctcgatataattcgcttgcactaagtgttttctattagccttcaaaattttaaaaaatttcgttaatgagcaacaattattcaatcaatcaattaactagttaattggtaatggtcgagagagtctcggcgggtcactcaatcaattaactagtcacacggctattaaaagtcattaatttttcaactcattaatagggcacaatgcaccgcttctcttccacctgttgatg

SEQ ID NO: 109458 - DNA, 1003 bp, Heterodera glycines
  Promoter: Source sequence=SeqID_26176; Location=1021..2023; Strand=-; Gene=SeqID_56924
acgattaatagtcgaacaaaatttaatataactttttaaataaataagtttttttttttaatttttattatttcttttcccaattttcctttgatatttaatgtgtttaattacaagcaaaaaagctagaaaaagtcatttttttggggatcaattcgcttcccgtgcccccccccctctcccgagattaacacttcgtagtttacatcagccattaattacatcactcttaaatcctatgtttatattcttttacttcttttgtcacgctaaactcgaaacattgccaacaaaaatgactaaatatccgaatttgcatatgaaacccaaaaatatttaaattatggataattttttaaactaaattttaatggcattatttttattccttttcttataattttaaaattgaaaaaaattccgaaagtaatacttcttgtcctttatcatcctttaatttttcgccttttagcatctcttcaaaacattcatatttctccttctttgcgcgtataataattcttggaaaaatggtcaattttttgtcattttattttgtgaaaatgatcttctgccaatttagtcaagtctaatttcaaaaaaacgacagtgtccaccctcttctgctgaacaccaccttgtgaaaaaagcaaaaaatatgtaatttattttaataatttaagtaattattgatcaattatatttaaagcgaacccgagcaatttgcgaatgggtgggtatataaaaaattaaaaatgtgtgtaaatttatattccaactttatagtggatttgacgcagacccttggttgtcagtaaatataaatattatatatattataaataaagaataaatagaataaatattatattagtgtatatgttttataataatgaatcccaatattaagcgatttcatcactgactataattggtaagtcacatatctataaagaaaatattaaaatatttttaaaaaaacatttcaatttaaggccagatg

SEQ ID NO: 109459 - DNA, 723 bp, Heterodera glycines
  Promoter: Source sequence=SeqID_36717; Location=1..723; Strand=+; Gene=SeqID_65969
aatgagacatttcaattgcatttttaatgaatggcacgacaattttttttgttagtgttaaaattgacgaaatttgccgacggaaaatggctgaaagtgccattattaatggtgcatggaatttgccttgtgggcacaaaaaataatagttgaaaagtgccgagacaaatggggagaaaaatagtgccaaaacaggaaacgcaatattaaaaaatagaaaaatggattcccgggggattttcgggattactgatcacaaattttactctgtttcttcaaccaaatcagaacccttaaatgagaaaattgtgttttaaaaatttaaattttcgactttttgttcgatgtcgggttagagatttgggaattggtgaaaatcaaaacaaaccactcatgatacagtctttgaagaaactcacaattttatggttaaaatcaaaaacttaattttcttatataggccaaaaaaatgttgccacaataaattgagaggaagcaaaaaaaaggcatttctgcgaaaaaaccccaagggaattggcggcggcgaatgccggcgcacttttcacgcttctcttttaattatttataaattagcggaaagggacaaaaaagaaaagaaaagcagcacccaatgtctgggcaatacaaagataaataaaataaataaaagataaaatttaaatttaaaaaaaaaacatattcttataggggagttctatcatg

SEQ ID NO: 109460 - DNA, 123 bp, Heterodera glycines
  Promoter: Source sequence=SeqID_31886; Location=1101..1223; Strand=-; Gene=SeqID_62196
agcataagatgaaaaatgtagtagtagaggagtaacaaagatcggtgattcatttttacgagtcaaaggaattttttcatttatttaaaaagcaaggaaagcgttgtatccttttatgagatg

SEQ ID NO: 109461 - DNA, 509 bp, Heterodera glycines
  Promoter: Source sequence=SeqID_9778; Location=733..1241; Strand=+; Gene=SeqID_72662
gtcttgtactggtaaacctgcttatatatatatatatatatatatatatatatgcaatttattttttagaggcagggtttcacagcgtcagcgtcgtaataattcttttggttgaagctgttttttcgcgtctttttttaccgaaacattgacaatcaactaaaaaaggcaaacagaattttttattatagatttcaattattgttattagtttaatatataattcttttttatcatacaggcaggggctttttgttttattggatgtattggatctactgtgcgtgatttagtgctaagaaatggtggacgaaggaaaattttcattttatggacattaaaccttcgttttatcattgttacacatttaaccttttcattaaaattttcattgttaactgattcgaccttattttgtttatcgaaccaacaaagcatattgaattcttgcttttcgtcggtaaagagagatattaatgttttctgttttcgtaaaaagaaaagcaatg

SEQ ID NO: 109462 - DNA, 132 bp, Heterodera glycines
  Promoter: Source sequence=SeqID_4201; Location=987..1118; Strand=-; Gene=SeqID_53570
cgtaattctatgctatcgtatttattctactatatcctctggaaaattaaatctaccctttttatgggttgaaaatatgatttttaattttttaaaatgaattcccaattttaagccaaaaatgtactgatg

SEQ ID NO: 109463 - DNA, 53 bp, Heterodera glycines
  Promoter: Source sequence=SeqID_16126; Location=2025..2077; Strand=-; Gene=SeqID_80489
agtcggacaaatgtgtcaattgttaaccaatttagaatttagagccaactatg

SEQ ID NO: 109464 - DNA, 619 bp, Heterodera glycines
  Promoter: Source sequence=SeqID_23091; Location=263..881; Strand=+; Gene=SeqID_53796
atcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 109465 - DNA, 55 bp, Heterodera glycines
  Promoter: Source sequence=SeqID_5245; Location=3350..3404; Strand=-; Gene=SeqID_57426
caaaagagattttgttaatttaatttaggaattccgtgaaaagtttgccaagatg

SEQ ID NO: 109466 - DNA, 827 bp, Heterodera glycines
  Promoter: Source sequence=SeqID_1813; Location=2784..3610; Strand=-; Gene=SeqID_76120
atcacggctttaagaaggagggacgaatgtggtgttgagagaccaatcaataagtggagtgaactttgttcactcctttcccttaggcacattccttcccacatataagcgatgccttccctccctccctcgttcattctgtcatttattccttccattgcacttcccttcgcttgaccatttatttattatatttgtgctccaaataaatatttgtcttttcttcatatctgttgttctcggacacaacaaaatttggcgcagtcagcagagcagaagcgaactgaagctgagcggcgaaagagctgagaagcagcaaaatttggattgctaattccgagttggaatagctgtttccaaaaccgtcaaaaaggagaggaagctaattccgagttggaatagctgttcacccaggtggtggcactctcaatttctggtgttaatccgggacggatatcagccagcgacgaatcgccgaatttggaggaattgaattgttaatccgggaaggataacaatttcaatcactgatcgaggccgaacagagcaagagaaaaatttgattggaaggcaagactggaaactgagtgccattgttaatccgagttggataacattggccttcatcgattttgattgttaatccgggacggataacaatttattctcactgttaattcgggttgaatagcagttgagcagcaccaattttcattgttaatccggtacggataacaattgaatcactgtaaatccaagtcggattacagttgatcagcatcttgaatttgatccgagtgggacaaattaagaaaagtccaactatg

SEQ ID NO: 109467 - DNA, 361 bp, Heterodera glycines
  Promoter: Source sequence=SeqID_10980; Location=1..361; Strand=+; Gene=SeqID_74290
ttctctttcatatagtcgttttctgtcctccttctctttctctctacttcctcttttatttcctttgtcttaatcatctataaatgtctaaccaattctatttcaatttattcttttcttctcttccctctgagaatgttttcagcataagaaagaggatgttgtttttgctcttcccgttttttgggtcaacattttgccgaaaaaacataaaaaatgtaaacagtgaaggatagagaatggtaatttacatatttttagttatcctattattcattggcatttgttcttcagaaacataaatatttccaaacgaaatttaaaattataacagtattttaagatagcaaactaaaaaatg

SEQ ID NO: 109468 - DNA, 77 bp, Heterodera glycines
  Promoter: Source sequence=SeqID_1899; Location=787..863; Strand=+; Gene=SeqID_76638
gagcgaaatattataaaaatattgttctttattttaacaactaaaaatatttacaggatgtccatccaaaccgtatg

SEQ ID NO: 109469 - DNA, 570 bp, Heterodera glycines
  Promoter: Source sequence=SeqID_351; Location=241..810; Strand=+; Gene=SeqID_83876
ttgtcgtgggccgagtgtgcgaccgtctcatcacaaaagcggcgttggttctgctcacatgcgtgtcacaggcaagaatcactgattgaactgttcatggcatttttgcggtcgctgatcacgaatcaccgacatttatttcgactaattccgagcccatgattcaaaatccgaacaaaaatgttgaattttttaattttgtctttttgctcaaatttgggttcgggattcagaattcggtaatcaaaattggttttgcctcgtgttgtcaccgacgccgaaaatatgttttcaacgaatagaaatcgtattaaaaatgttttcaaatcagggtcccctatggttttaataattttcaaatttaattattttatttcttgcgccgatataaagtgacaacatgcctcattaattatcaatttaatgtttaacctaattattcaccatatttgtacaatttaattcctccaatagaacaccccgctctctcaattagtgataaagaaagcttgcaaaattaattcggctttttaaaaatatttgaatttggcaccttttcagtacggcatg

SEQ ID NO: 109470 - DNA, 88 bp, Heterodera glycines
  Promoter: Source sequence=SeqID_3118; Location=1887..1974; Strand=-; Gene=SeqID_83281
tgttgttttgcggtcgtagatacattccaagagccatatagtaacgcttcttgaagaatttagaaagagttttactgccatcaaaatg

SEQ ID NO: 109471 - DNA, 359 bp, Heterodera glycines
  misc_feature (109)..(109): n is a, c, g, or t
  Promoter: Source sequence=SeqID_22326; Location=1..359; Strand=+; Gene=SeqID_53006
acacatttttaaatatactgccttttatttactctaaacaatgaaacatttataaaatatggcattttcagactgttacaaaagttataagtaaaacaaatatacagtntagtccaacaactcttaaagcaacaaacaaatgcgaatttttatgcacaaaatactgttttttacaaacaaattctctatcataaacgcatttctattatttttttaaaaaattgatacattcacattgttttttgtactatgagtgaattttgatattaaaattttgaaaaaaataagaaaatgccatatacgaatactttttgggcgatactatagatggtggatggtcaacctttttgaaaaaaatg

SEQ ID NO: 109472 - DNA, 77 bp, Heterodera glycines
  Promoter: Source sequence=SeqID_38969; Location=1260..1336; Strand=-; Gene=SeqID_67647
atgaatttattttaggcattggtaatcaattaattaaataggacaacaaaattgccaaagaatgctctgaaaaaatg

SEQ ID NO: 109473 - DNA, 702 bp, Heterodera glycines
  Promoter: Source sequence=SeqID_9230; Location=458..1159; Strand=-; Gene=SeqID_70693
aactattgtcctgtcctggtcgtcctgaccttgtttgtgtcgaaaagcggtcgttcgtcatcttcccccccccccctcacctcctaaaaatgggttgttctgcttgatgatggatggtaagtggtggcgcaatgcctttgttctgttttagtgattcacgcgttttgccgtcctcatctttcaaggcccgaaattgtatgcaatttatttttttggcatgtttggaaaggattttcccaaaatttgtaccgtatttggaagccccaactactgtatacccttattatgacaccacggctatattaatatgcgcaaggttccagttatgccagagctacgaagtttttccttttttcaaattcagcacaaatggccttggggcctaaaaactcagattttctggggaaggaagtgcccagtggtgccgaaaggcgccgcaaaaaatttaagattttctgaattaaatggccatcttaaaccagcgcacaaatttttaaaaaagcacacatggggactgccagttggtcccaaatacaaaaattcaactgttttacacattaaaaagaaaaaaaagaaaatttcggcgattctgttaatccactgccggtaccgtaatttcaacactgtatattccatcaactgttgtttcaattaatatacttaaataatcaaatttaatgcaatttcaggtgtataaaaatg

SEQ ID NO: 109474 - DNA, 1003 bp, Heterodera glycines
  Promoter: Source sequence=SeqID_1123; Location=268..1270; Strand=-; Gene=SeqID_68219
ttattttgttagttttttgttcctcctcttcaaacgtttcttttgtacaaattgttaatgcgcgaaagagttgcgcatcttcgggcccattttcaaagaaaacagatggaggttcctatttaaaaatataatttatatattaaggtccaagccggggggggggggggggcggggccggggatccccgtgattttcatcccgccggtcccctttcctcgtttttcctattactgaaaacggggatccccgcagcccatctccgcaggagaaaatacaccctaaagatagtctggtagacaacaatgaataaaaaattataaaaatcaccgaaacaaaaatatattctttgcttgtttttagcatttttccttattgtaaaacatcgtaacttaattttttgggaataagacagacttattaaaaaagatgaagacaaatttttatggatttaagaaatttatcttttaaaattctgctaaaggcagcttttcggtcaaaatctgttaacaaatcacatcaaaatctataaaaatttccccggcccgccgataatattttttcgaactaaaaataataaataaaattgcgcaagttcaaaaaaaaaatttttttttcttcagttaaatataaaatttcttcttctccgttcccattgaatgaaaataaatcatagtttaatgattaatttatggagtaaaaagaaaattatcggttttaatcagggcggccaagtgtccttatttgtaagatttgtccttatttggaggtgccaaatcttagaaattaaaaatgtccttatttgtaagatttgtccttattttggcacgacctccttgctttgtgcttattcatggatttgaaaataaaaatgcaaaaatttaatatttttttaattacatattgttttttattgaagcgaatatttgaattaattcgtttttgtaaaaaatttcatttttatttttctttagtgtaaattcgttaattttaaatgcccaaaatg

SEQ ID NO: 109475 - DNA, 300 bp, Heterodera glycines
  Promoter: Source sequence=SeqID_34712; Location=1..300; Strand=+; Gene=SeqID_64436
catgctaaaatagaagaatatttgtaatttttgttttacattagcttttccaaattttgaacaaaaggcgtgcgcccggccaaaattttgggccggaacagcgccgcgcggtaaaactggcttttttgcatcgggcggcacgggcgcggtcaattgtctatggccggtctcgggccgggtacttcaaaactccggtcttaaaaaattaatagaataattaattttgggctttgtcattaaaaatgaattaaaaaaacaactataatttgaaataaaatttaaagtcgttcttaataaatg

SEQ ID NO: 109476 - DNA, 419 bp, Heterodera glycines
  Promoter: Source sequence=SeqID_779; Location=2956..3374; Strand=+; Gene=SeqID_61024
ttcaacagcttatctacaaacatatacaatttttttattattttttaataaattttcggctgcataatgacataaagattaatcgattaaaaaatcattaggccatttaagcgtaggcgaaatatgaaatattgccaatgcttacgtgtagttttaatttctatttgtttaaaatgggaattaaattataggaccgatggtgaaatgccccaatagcctcggttttaatagccaaattactccgctctccggataaatgtgtgatgctaacattcttatagacggacgatatgagaaaagttaattaatgatcgcttgtacaatgaaataaaaatttggcggagatttatgttaaaatagaaaatatttttagtattatttaaaaatttttaaattaaaatcattttttagcaccaatg

SEQ ID NO: 109477 - DNA, 1003 bp, Heterodera glycines
  Promoter: Source sequence=SeqID_28122; Location=223..1225; Strand=+; Gene=SeqID_58777
taatttttatttcaaataaatttcaaattaacaaaaaaaaatttcatgacatcactatatgtaaaatttagtgctacaaatataaatttctcatggcgaatatcgattgtaatgcttcatgtattgatttatttattctttattattaattcaattataaattatttgtatttcattttggtcaaattttgtatcattctctcatagcattatttttcttgaacatgagtgtttcttataattttaaggcctaataaagaaatatttgattttttggaaaaaatattcttcgtaaagggtgagaaaaatttaattttcacaagaaatttcggtaaaactgttatatccgcaacattcaagtttccatatcttgtgataattacattgacctactttctcccggcccagtcccattataaacttgtctgtctgttcatctcatcccaagccaatcctccccctcatttccaaagttatcgtgccattgctatccctttcctttaataaatctctctctaaaaacagtaatttaaaatggctttaagccttaaatccggggacataacaacgggtccttttttcaaagcatggactcgtccaataatgagcagcagcttcaggaaattgaggccttggaggtgtagctgtgtgtattataatttgataactttgtttaaaccagttaaacattatttagattactacctatattaaagggcgaaccgtcaccgacaattacttggagtaaagatggggaaattttggtggagacaaatagggtgactatcaacaataaaacccaggtgagttcatcaggcattgattttagtacaacaagcagcagaacggttggaacttctgtcccaattagccatcaaacagcggagagtgctaaagggcggccatggcagtaaagtaaggggaagaggaggggataaacgtgggaaagggtaattgatccattaattcatccaagcattgatttcaaactaacctaattatg

SEQ ID NO: 109478 - DNA, 290 bp, Heterodera glycines
  Promoter: Source sequence=SeqID_39936; Location=300..589; Strand=-; Gene=SeqID_68388
aaaatatttgtagaattttgtataaataaaattttattaataattaaattacaggaaggattagctttgaatagcataagcaaattattgtgcttaattaaatgtttatgttatttaatatatattttttgtcaattaaaaaaatactaattgacaataattagcataatcaatcctgtaactctaattattccggattagcattgaacagcttaagcaaataattgcgcttattaaagcacaattatttcatcctcattactctaatagtccaattaagaaatcaaatg

SEQ ID NO: 109479 - DNA, 205 bp, Heterodera glycines
  Promoter: Source sequence=SeqID_3519; Location=143..347; Strand=+; Gene=SeqID_85000
tgtggtaaaggctttgtgcccaaaccaaatccatcaaatttgagctggtctttgttgtgtactaccagccgggctgtttgtgccaatcaccaaatttaaaggagctggtcaagtgtgttttccagccgagctgttgtgctgaaaaaaggactaagtgtcttcaaaaaaaagtgttttaaaaaaaaaaaagaaattttggaaaatg

SEQ ID NO: 109480 - DNA, 214 bp, Heterodera glycines
  Promoter: Source sequence=SeqID_7231; Location=1..214; Strand=+; Gene= SeqID_64204
agccaatggtgtcaaaggtgttgctgatgcgtggcgcctaccgcgaggcgctcgacattctgacgcgtgagactcgcttcgccgaactgttgtacgcacacgcggcacagcttgcgttggccgagccgcgtgcgctcgttgacgctttgttggcactacagcagcaacatgcgtcgttggacgtgttgcaattgttgcccgccttccaacaatg

SEQ ID NO: 109481 - DNA, 62 bp, Heterodera glycines
  Promoter: Source sequence=SeqID_9610; Location=1..62; Strand=+; Gene =SeqID_72079
tattagtttttaaataaaatatagtaaacatatattcattttaacaggccaaaatgagcatg

SEQ ID NO: 109482 - DNA, 416 bp, Heterodera glycines
  Promoter: Source sequence=SeqID_17830; Location=211..626; Strand=+; Gene=SeqID_47483
gaaacaatgaaaagcaattgaaattgaaatgggacaattgggtaaaaaggggggggggtaattaaattaagcgaagggtcattcattccgacaaaataaagacacataattaaactaataatggtaattaattaaggggatttgcccatcgacgagacgacaaaaacgaaaacagaagcagaggaggtgaatttgttaaatttaaataaataattattaatataaaatataatgattttgccaatttaaaaattcgttttccattttcgaacgaaacgacgccaattccaacggcagccgaagaaggcgaaaagggagggaatgaagtgaccgaaaaaagcattgagcaaacgacgggacaaagggaggacgaaacggcggagaaaaacggcaaaaacagcggaaaatggcaaatg

SEQ ID NO: 109483 - DNA, 514 bp, Heterodera glycines
  misc_feature (26)..(26): n is a, c, g, or t
  misc_feature (40)..(40): n is a, c, g, or t
  misc_feature (46)..(46): n is a, c, g, or t
  misc_feature (60)..(60): n is a, c, g, or t
  misc_feature (68)..(68): n is a, c, g, or t
  Promoter: Source sequence=SeqID_27012; Location=1564..2077; Strand=-; Gene=SeqID_57739
aaaaaatcagaatttgggactcaganaattacaagattcncacccncctgaagaaatttntacaaatnttcctcgaattcgtcccccaaaacgaaaatataaaattttatgggtacatttttgaatataggcaattttcataacaaagttcactcaaatttccaaatttttttcaaaaaattttctcttgggaaaattcccggttggtcccggtctcggcttttctctcgatcccggtcccggtcgaaaaacttggtcccggcttttcgggtcccggttttttgtcaaaattcccggtcccgaccagctctagatttaatcacaaaatgattgactcgttttgatgatctttaaggacaaaatcgaaatttgagaaatttattttgcagaaatgttatttttattttatttatgctaatcttaccaactggcactcgggtaagcaataatgataagcacgaatcttaaaaattgtaattggtattcaatttcccctacttacttgttgattatg

SEQ ID NO: 109484 - DNA, 309 bp, Heterodera glycines
  Promoter: Source sequence=SeqID_43525; Location=1..309; Strand=+; Gene=SeqID_71170
attgctgaaaacctaaaaaagggccaaaatatctagtcctcaacatagttccaaaattaaaatcaaattgatcaaaaataccccgaattttgcaaaaaaaaaatttaattaaaatatataaaaatcggatccttgataatttcgatggaatttttggaaatcggcgttaattttaatttgcattttattttaaaattttattttccccaagatgctcaaacaataattgttcccgatttggttatggaaatggcaaaaatgcttcagaactgggactggaattatgtccatttcaatattacaaaaatg

SEQ ID NO: 109485 - DNA, 392 bp, Heterodera glycines
  Promoter: Source sequence=SeqID_10763; Location=1..392; Strand=+; Gene=SeqID_74013
tttgcaggctaacaaatctctccttagttttaaaatcgtttgaataaatattttagcctattaaattttgggattatttttctaggtgaaattgaagaataaaattgacaaatttttagagagatttgtccgtattaaatttttatttattttaaaaaaatttttaagcatgcggacccgaacaaaactgcgccgtgtttttacaaattcacaaattttgtaaaagattggctttcttgtgttaatgcgaaattggtcaaacaattaagttaatttttaatatttttttaattttaatgctttaatttttagttgtttgcccacaaaattatatgttaaaataacatcgaatgatttcttggaaatattcgtaaaaagtgtcggcgaaaatg

SEQ ID NO: 109486 - DNA, 174 bp, Heterodera glycines
  Promoter: Source sequence=SeqID_379; Location=3442..3615; Strand=-; Gene=SeqID_50797
gctaaatgaaaacatatacattggcaccgaatgcttttggtcaccatgaattttgctggtcccatccgatgtccatcaaatagcgcgtcgctgtccatccaaaatgttctctcagctgcgcaatttcgaccgagtcgaaatagaacgcaaattgttgaagaggcatccaaaatg

SEQ ID NO: 109487 - DNA, 217 bp, Heterodera glycines
  misc_feature (107)..(107): n is a, c, g, or t
  misc_feature (176)..(176): n is a, c, g, or t
  Promoter: Source sequence=SeqID_13100; Location=2687..2903; Strand=-; Gene=SeqID_76892
taattttatttgcgtttgcgacgaaaaaagctaacaaaattagcttaaatgacagttgcaaaccaaatattccgtccgaatggcaatattttattttattttatatntagcttttgttagtgtttgaattttcctttaaacaaaattttcatgaaaatggttgaaacatctcaaancggcaccgaaatcagcggcactttcattttcgttgcttatg

SEQ ID NO: 109488 - DNA, 713 bp, Heterodera glycines
  Promoter: Source sequence=SeqID_5844; Location=192..904; Strand=+; Gene=SeqID_59424
tcaccctcacagacttcaccttccacctgcgcaattggtccttcgacacctcgtgctctcataacagggtgccggtggacatccataatttgttgtgagggcggtcattattgttgtaggcatttttcaattcccatcgccgaaggctccattgtgcaatatttatgggatctaatagcctgattctcccctgcagttttcatttgttataatcttctaggaatttcaaaaaaaaaactaacttttctttattaaggatattatagccttccctctcccccccccccaatccccacagtggtttttggcatttaacccattgtttgccattcttcccaggccatgtcggcagattcgcgtgtcattcgctgttcggcggtgccactgccgagttgcgtcctcagttttcttcgttggcaatttcagtggatgagattggcacttcggaagcgaaaatcagctggcgattattgggaaaaggcacaaaaaatggggagaaaaacgcgcaaaagcgacgacggttttatgggaataaagtgagaaaataattaaaaattaaaaagaaaagtattctcaatttatttgtcctgcattcttaaaagacttttaaatttcattttcagtcagaatttgcccaaaatcacaatgtttttgtcttggaaattcgggcaaaaagagagcgaagttggcgcactgtgaaggaattgcgaatg

SEQ ID NO: 109489 - DNA, 125 bp, Heterodera glycines
  Promoter: Source sequence=SeqID_36140; Location=982..1106; Strand=-; Gene=SeqID_65537
gaaataaacaaaaagccaatggaaatggtcagatttcctaattgagagggcaaagaccgaccgatcggataaacaacaaaaaacgatgggacaaaaaatgggacggacagacggggaaaggaatg

SEQ ID NO: 109490 - DNA, 409 bp, Heterodera glycines
  Promoter: Source sequence=SeqID_11578; Location=900..1308; Strand=-; Gene=SeqID_75016
ttgataagtgtgaataaacaatataagtaaaaagacttatttaatatttacaaatttaatgccaatttaaaagcaagtatttttaattacaaaaaacaaaatttttctttacgaatgcaaatgccattgtttttaataatcaaaatataaataaatatttagttgaaaataaaattcaaaacccacacaattcaatttgctatagcaaaatatgttgaacaattgatcgattcgaagcaagattataaaatgatcaatttaatcaaaacctaaaaaacaaagaaattttatttaataaaattatttacccaataaatcataaattatgagtctataaaatatattttcatcaaaattaacaaattgctttaaatataagaaattggaacaataaaattagctaaaaatg

SEQ ID NO: 109491 - DNA, 891 bp, Heterodera glycines
  Promoter: Source sequence=SeqID_20952; Location=828..1718; Strand=-; Gene=SeqID_51533
tggggggggaggtctgggtgaccgacccggtcgcttttctcaaatttggacaaatcgccaccgttcgtttggtccgactcgtcaccacccgtacaccaacgctcgtcttccctatcgcggccgtggcaatcctcggtttgcgaatgaagcaaacagtagccgacgctgatgcttcttcctgcgcgaaccccaccttttggagccgaataattgaccttttgcggcagagacgcctttttccataggggcggggtgtagtaattaagttgacttttgacctctcattatatatttaaattgtattggcattttgttgattaaattgttccctccctatttttcttttgttttcgttgttcgttgttaattttaattttgtggttttcatctccgatattatgaatttctcttaaagattggttgtctttgactttgttttgatttgagtttatttggtggcgacagtccagcaaattcagtgcttgtttaagttaatttggaatttcgtcctatttggcgctcctggtaaagcaggtaagaagcactcgaattttgttttctataagtgaagtactgggtgtaaaatcgaaaagtaagaacaaacgaaattttctggatatttatcagtctctgggcgagacgataatataatttggctaacggattgttggattacaaattttaaagaaaataaataaatctctcgccattgtcacctgggaggtgcagcaaagcggcatttatcggaacgatttgacacctgagcggttttcaacttgtttttgaagaaaacggaaattttgaactacgtaatttggttgaatttgcagacgacctgggcggtggaaattttgaattttggttataaattgattttctgggagaacaatg

SEQ ID NO: 109492 - DNA, 131 bp, Heterodera glycines
  Promoter: Source sequence=SeqID_19500; Location=2819..2949; Strand=+; Gene=SeqID_84218
tttagtacgggaatgaaatatttggagaatgaaaaaaaagaatgaaaaaaaacctaaagtgagacgtgacaatttttggttacaaccccatcagcagcaaaagtgcaaaaattgttggataaaaaaggatg

SEQ ID NO: 109493 - DNA, 1003 bp, Heterodera glycines
  Promoter: Source sequence=SeqID_1052; Location=433..1435; Strand=+; Gene=SeqID_66962
aattaaaaattatttatttataatatcaagttttggcataaattcttacaaaaagtgccagttaatcggctgagcgccattaaattacttaattatgctgttttcatctatttaaactagaaatcgaaggaaaattatatatttagctgagaattttaccctaaacaaattaatacaacatgaatctattcaacatttagctgcatccgtaagaacgagcgagtcgctctcatcatcacctgagcgagaagaacaatgagtaatatttattaaatattaattacctaatgatttaatctataaatacaaattttataggaattaattaaataaaattaatttttgctattttaattttctttgaatgcgcatgacaatgaatatggataaaaaaatatcaaaaacgaatattaaacatgaaattagaaaaaagagtaatttatttagtaatagcatagtagttagtcctacagattttggcccctaaagttcggaccctcttgactgcaactcaatttttatcattttttaattcaatgcgtatggaattaatctccataagcccttaccgtttaaaatttttttccccaaggaaacagataattgataataatttaacagaaaaaaaggataaaatatacaaaaagatcttaataattcaagtaaaaaagcaataagacaatagcaccaatggccactgtagtggttccccataaatttaaagaataactagcacagtgagaaagtaaattttaattgatttttatggtaaaaaatcattaaaaatgtaaaacaaaaaataacataaaatcaaattaaaaaaagagaaaaaacatcctataatagactttttttttgattggttcacgaaaactatatttttttggtaaaagacgttgaccgcccctcgtattgccgactctgcaagcaatttcatataaaagaagacgacgacgacgggatgaacccctgtacgaaatgtttcatccaaccattaaaaatg

SEQ ID NO: 109494 - DNA, 1003 bp, Heterodera glycines
  Promoter: Source sequence=SeqID_8434; Location=752..1754; Strand=-; Gene=SeqID_68055
attttatttttttgaataagacatcattttgataaatttggctatgtgaaaatattgtacaacagaaaaggaggggggattgggagaaagcacagcaaggtcagtgtgtgtggaggaaagtgttcactaatttataaaaatcaacagacaaatgaaagggagaggggggggggggaaatgggagttatgcaatgcaagcagtaaaagcgaaatttattttgtcttttttgtaccacaaacaaatagcaaatgggaattgggaatgatgggaaaggcaggacgcagaaagagaagcattgacgcagcaccaaaaaaaagagggggtgggtgggcgaagtaaacattttgaaggggggagaaatttccaaaaatacaaaacaaaaacgaaacgatcatccaaataataataaaaaagcgaaaaaacgacttttaaatgcattaaaatgcagcagcggagacgcaaaaagtaattagtgcttattttgatcgcaaaataacagaaaaatagacataaaagggccattattttttgatcatggctgtcatctcttttatgtattaatcaaaaatcgggtaatagttaatacacaacatgcctatattatgtacatatgtatacattgcccgtcccgttgccaattgtatagtacgtataataggtaattaattgaatgacattcattgttcacattatggcatgccaaaaacattaaaattcgtgaaaataatggagtttttctactgattatgagattcctctctttttcttattaattattaaattgttttatatttccccaataattttttctaatgtcaacaattaataatttctctgtcgcttcttggccattcgtttttcttccctccactttcttttttctttctttccttcctttgtatgtacgttgctcattattcattatcatttatttaattacccagtttctgtacaaatattaacattaactttccgcaattttaggatttcccaatcactatg

SEQ ID NO: 109495 - DNA, 68 bp, Heterodera glycines
  Promoter: Source sequence=SeqID_37684; Location=495..562; Strand=-; Gene=SeqID_66691
ttacccaagtgattcctattcaccacctacctgctgtcctgttgggctagcgttggcaccaccaaatg

SEQ ID NO: 109496 - DNA, 196 bp, Heterodera glycines
  misc_feature (10)..(10): n is a, c, g, or t
  misc_feature (65)..(65): n is a, c, g, or t
  Promoter: Source sequence=SeqID_2943; Location=1831..2026; Strand=-; Gene=SeqID_82463
cctcggtgcntgaatactgtacatttgaaaattcagagataaatttatacaaaaaaatttacaanccaacttatattaatttttattacaaaaaaatttaaatttgatttatattctaaaaatgaatggcagttattctagaaaattgataagtgtgttttttattgtcagattggttatttttattttatcgatg

SEQ ID NO: 109497 - DNA, 1003 bp, Heterodera glycines
  Promoter: Source sequence=SeqID_13342; Location=1487..2489; Strand=-; Gene=SeqID_77211
aaataaactttgtaaggtaatccaaatttttggcaaatatacataaataaattaaactattacgaaaacattcataatttgatttgcattaatgatttaaaatattattatttgaaaaataactaactaataattttatcaaaaattctaaaataaattttagccacagtgtttttatcgggtttatcttttaaattagaaacaataattctcttttatttaacatctaaattaaaagagacattgatggtcaagagttattattgactccaatattcatcatttttaagaagtaaaaaagttataattaaagaaaaacgacaaagaataatattattttgccaattcaataatgatgtaatccttgtaatggatggagtctcatgtgaaaattctaaatagatgttaaagcatagaaatgtgtaaatgtattaaaagcaaataaataaaaacgtttataatgacaaagcaaattcaaatgtggtttaaagtcatttgttccacggaatatgtatcattaatttaaaagaaactgacaaaatttgtaacttataagccaaattggcttttatttacagacaatgatcaatataaaaatttcaaccaaaaaaaaatatactttattaatcctaatactgattgaggctagagtataataatttcgaaaatatacatattccaatagcagtagatttatcaacctaataatatgcaataaagttagagcagaggtcgcatttgtacttatttttaagaaatgtactgatttggagggatcgaatcttaagaatataaaatgtacttatttttaataaatgtactgatttgagctcaatgtacttatttttgtcttatttttgagatttaagagaaaattcaattttgaatgtctattttgaaataaaataattttatgaagcgtttttattttaatttattgaaaattttcatccgaagacctatgtactatataactttttagcttagattattattattaatg

SEQ ID NO: 109498 - DNA, 184 bp, Heterodera glycines
  Promoter: Source sequence=SeqID_19389; Location=1258..1441; Strand=-; Gene=SeqID_84114
cctgaaaaaaattaaatataaatacaattgaataatgataagaaatatttttttgttaaaataaaaaatatataataacaaatataaataaataactccatatttttcttgaaacaattaggtaatatttaatggctacttattttctggctttctctgttggttttaatgccataatataatg

SEQ ID NO: 109499 - DNA, 81 bp, Heterodera glycines
  Promoter: Source sequence=SeqID_28437; Location=413..493; Strand=+; Gene=SeqID_59057
ggtgtgtgtgtgtgtgtgtgtttgccaattctttgaatggaacagagccaaaaacaaacaaaacaaaaaattttagccatg

SEQ ID NO: 109500 - DNA, 225 bp, Heterodera glycines
  Promoter: Source sequence=SeqID_34135; Location=1..225; Strand=+; Gene=SeqID_64011
agtgaatgaaagagagctttgtttgtgtggacgaatgccatttacggacaataaaattatttcttaaaatgtcgacaacccttaaaattaaaaacgtgcgattaatggtaaaagggggagaatatgctatcttgaaagcaatatttgtatttaataatataccatctgaaattgatggacctataatttatgcatcgcacagtctcgccgaaatttcgcaatatg

SEQ ID NO: 109501 - DNA, 140 bp, Heterodera glycines
  Promoter: Source sequence=SeqID_38103; Location=1..140; Strand=+; Gene=SeqID_67015
acgccctgccgacatcgaactcaatcagctcgacttttttttgttttggttttgaacaaaacaattttgattgttcaacctttcagttgttgttcatcaattgttaatcgtcgtgagcagtgagcatcaaaaaaaaaatg

SEQ ID NO: 109502 - DNA, 696 bp, Heterodera glycines
  Promoter: Source sequence=SeqID_7183; Location=1..696; Strand=+; Gene= SeqID_64071
atttagcggtcaattatgcgcacttatcgattggcaaacggtccattggggtaacccttgtgaatacattggccgtctgcttgcgctgaacacgacaaatgaagtggccgaatttatgggcggaaaggcaccatttacattgtgtagttgtacattcagtattcactttgatgcagatttgttgacacattattagtatttaagccatgttttgtagttttaaaagcagtcaacagagaaaagctcaaaccgtgaaaacttccgttgacccacaatttattaacgcattgccatttacaaattaaccctgccatttcatacgcagttggtgtttggtccaatttttaagagacaaattcactgttttaatcgtcaaaactttgaataggtatgtatacgtacgaattcccaatatttattgaattatgttttagtttcgcttttgtatggttggtccctttcttttagtcttgtgttcgttttcgaaagtcccattttgtcttatgtttcgttctttaacctcccccgccccctcctccccgccggtcctcctcacttttccttctcactttcctttgtcgtcatcattcgcgtgatgtcttctcctttttgtcaccacgtgcttttttaatttattttctttacagctgcttattctaggcaacgaattgttaaaccaaacaaacggctgaaatg

SEQ ID NO: 109503 - DNA, 67 bp, Heterodera glycines
  Promoter: Source sequence=SeqID_2505; Location=3783..3849; Strand=-; Gene=SeqID_80109
ggttcggccaatttgaatttactctctctctctctctcattatcggtgcttaattcagccctcaatg

SEQ ID NO: 109504 - DNA, 114 bp, Heterodera glycines
  Promoter: Source sequence=SeqID_18286; Location=546..659; Strand=+; Gene=SeqID_82874
ggtggcgaaatgacaactctctgatcagccaatgctttcaatgttttgatccatttgcaggaattggcggagctgaagcaggaaccgatcacgggttgcaccgcggcaccgatg

SEQ ID NO: 109505 - DNA, 1003 bp, Heterodera glycines
  Promoter: Source sequence=SeqID_10837; Location=445..1447; Strand=+; Gene=SeqID_74108
aaatatttggcattttcattcaataggtgaaatttccaatcggttcgttggcatgttcaacaaaattctctggcatttctaaatgctttggcatttccaatcaaattccttggaggacttttcaaatcaaatatttggcattttcattcaataggtgaaatttccaatcggttcgttggcatgttcaacaaaattctctggcatttctaaatgctttggcatttccaatcaaattccttggaggacttttcaaatcaaatatttggcattttcattcaataggtgaaatttccaatcggttcgttggcatgttcaacaaaattctctggcatttctaaatgctttggcatttccaatcaaattccttggaggacttttcaaatcaaatatttggcattttctgctctgctgattgaaccctccttctctctttccttaaataaacctttcattttattgccatttgccccaattttcgccatttgcttttggtagcccaatttctcgcgcataatttatgtgttaaatttgctattcctcccaaacatttcctcccgcatttttgccgctccgataatttcgtcgatcgtggcgaaatacattaaataatcgccaccaccgcgagttccaaaacaaattaattaattgtgaaaacttatttgctaattcccttttggccaaattgaaattatgggactgatttggcacatttggccataatggcataaacattcaaattccatgttttgtgtatgtggtttttctttatgcaaattagagtccggcgggatcgggactcccgcgggattttacaggagtcccgttcgggactcccgtcccggaaattttgaactcccgctcccgctcccggaaatttttttttaccggactctaatgcaaatcaatggcattttttatcgaaacgatttcctattttagctccatttctgtcctctcaaaaatccttttaatttcccccgctttttgttctgctgcccaaatg

SEQ ID NO: 109506 - DNA, 386 bp, Heterodera glycines
  Promoter: Source sequence=SeqID_25433; Location=664..1049; Strand=+; Gene=SeqID_56169
ggtggttttttttcgtttgttgatgtaaaagaatttaatttcagtgatttcagtcattattttttgaattttcttttccttatcaatgaatgcttcgttcttttcaggatttgattgttcatctggcctcatgatttgatttggtctttactcgatttatgacgaatttcgttgatttgtactgccttttttattttcagtaaatttttttatttcaaaatgatttattttgtggagcactagtccatttagaacagaaagaatgggaaaataaggggacaggctgatgagagcgtttttcttatcaatgaatcaaaaagttgacaatttgaatgaattttttcttttggtaaacatcaccatttttattttcatttcagaaaatg

SEQ ID NO: 109507 - DNA, 974 bp, Heterodera glycines
  misc_feature (148)..(148): n is a, c, g, or t
  Promoter: Source sequence=SeqID_10568; Location=1..974; Strand=+; Gene=SeqID_73808
ggggaagggacggacgagcccggtgaagcgaagccccgcaggagtgagagactcctgcgggggaagaccgacgctgggcggacgacgacgcagacgctgacaaatgagcagcagaagggggaggggaaaaccgtcccgatcaaatccnccggactcttttcacaaatatatatttattaagcagcagcagaaatgaatgaatggaaatgtggaagtgagcatatgtgagagaaaaatggtgccctttttataggccgaaaaatgcgagggggcggggcccagaggaaaaaacttaattggactatcactaggaaattcgtgggaaaaaatggctggcgatcgataagatctgtcgccgttggcgacaacttttatctttttaaaatgtttttgatataagattagagttgctacctttagaaattatcgtgtcggggatcggaaatcgatttgggaatagtcaaaagtttatttgatcaaagaaacattcttttttattaattagtagagtcaaacagctcgagcagagccggaccctgtagagctgttttaaagtgcgcgacaacccggcccagtgaaatagtcatttgtaggcgtgggctttggacaaattttttcaaaaaagttgacccgctgttcaaaaaatttatttgcttgttttaaacccttttaatttacatattttatataatttttaatatatttttttgttaatttgcttttaaaatatttccattcttctattatttttaaatttatcacagtaaaacgatgactctcataatgcgtcaactgttcgcctccttgttcttccttttgcttctcattttgctcatcactttttccgatgctcaattatttggcggatggggtcataataaaatttagaattatacctaattaattacaatatttttaacaatttacaaataatataaataaaatttaaataacaaatatttattgtcaggatg

SEQ ID NO: 109508 - DNA, 297 bp, Heterodera glycines
  Promoter: Source sequence=SeqID_41692; Location=831..1127; Strand=-; Gene=SeqID_69769
tgtagggaattttgtgctttaatgagcagattgtttttaccaggatattttttcagcccactagaaattttttcccaaaatttatgaattttcctaatttcaagtcattttgggcttttcagacccccatgaatgagtgatctgattaacttgtttaagtgacttttttgttctgcacaaaagctcggctagcagtaattatttcaagagtcaaatttcttagccttcgcttagaaaaagattcttctttttaatatctttcgaataataaaaaattattcgatttagttggaaatg

SEQ ID NO: 109509 - DNA, 420 bp, Heterodera glycines
  Promoter: Source sequence=SeqID_42977; Location=1..420; Strand=+; Gene=SeqID_70763
ttatcaaattgttaaccataaatatttttgaataaacacttatttcatttaaaataaatacaatatttcatttaaatttttttttgtaattgagtaatttgattaaaaagttatcaataacaaattaatgaatgcaaaaatgaaaatatataaaaattgacggcattaaatcgccggacggcgaaacggcaccaaaagttcaaggaaaaggaattgaaatgccaattccgtcatggaaattcccaaattttaatgaattgttgggcaaggacaaggacaataatggtggaacaatgaagagagaaaaacgtaaatgaaaataaataattaattaactgaggattaaattaaaattttgctgattttgatggacaagtcccatttatgccactgatgatgccagaatttaatccaatgatg

SEQ ID NO: 109510 - DNA, 94 bp, Heterodera glycines
  Promoter: Source sequence=SeqID_1576; Location=930..1023; Strand=-; Gene=SeqID_74559
ggtcggcaacagctgaaggtcgtcgaaaattcatttttcaatttaaatttttcaattttaatcataggaatttcgtgaaaaatttgtcaaaatg

SEQ ID NO: 109511 - DNA, 80 bp, Heterodera glycines
  Promoter: Source sequence=SeqID_36175; Location=688..767; Strand=-; Gene=SeqID_65565
cataatttgagtgtatataacagatatacaccaaaatattaccaatttttgtgaatataagccagtattttggaagcatg

SEQ ID NO: 109512 - DNA, 433 bp, Heterodera glycines
  Promoter: Source sequence=SeqID_34307; Location=794..1226; Strand=-; Gene=SeqID_64129
gactttggattcaaggaacaccagcggatagggtaagtgtttttaataaaataaattaaaatagaaaaaaaacttaaaataaaaaaaacaataaataaatttaaaataaatacattaaatttattaatgaagcaaaaattctttaaagaaaaaatgaaaaaaagcaacaaaaaacctaaaaataaattaaaaatattaaaaaataacaatttaatgagccaaaataaataaaaattaaattttaaaaatcaaaaaaatatatattaaaaaatattaaataaataaaaaataaaatttaaaaaatcaaaaaaaaattaaataataattaaagtaaagaaaaaaaagaaataattatttttaattaagcaaagcagcaaaaaaaacagaaaaaaaaatttaaaaaataaattaaataataaagaaaaaataaatg

SEQ ID NO: 109513 - DNA, 261 bp, Heterodera glycines
  Promoter: Source sequence=SeqID_4057; Location=2157..2417; Strand=+; Gene=SeqID_53004
ttacgattaggaaatagtttatgattataattgttaaaaaacataaaatggacctgcgaaagaacgcataattattgattgattgtgtgagtgtgttagcgcgcagcgacctccagacgggcagtcccttcttaatcgataggccacgcccatccagaaacacatggactatagagtagtggttagagaaagataccaaagggcactaagttaaacacacactgtaaccccaagccaacttattgatttttacagactatg

SEQ ID NO: 109514 - DNA, 113 bp, Heterodera glycines
  Promoter: Source sequence=SeqID_6103; Location=2745..2857; Strand=-; Gene=SeqID_60343
aattgattttgcatatatctgataggttttttgccgtgttcgaaaggcgtttcccgaatggcaccgtacagcgattgttgcacatattgacggacgagaattggcaacaaatg

SEQ ID NO: 109515 - DNA, 198 bp, Heterodera glycines
  Promoter: Source sequence=SeqID_3924; Location=462..659; Strand=+; Gene=SeqID_52460
tctgaagaggaaaagcacaatgaaatgagaaaacagaaaaagaatgagcgagggaaaaagggaagccatgggactgaattggccgtagcgaagtcaatcgaaaaaacgaacatttgctggtttttcctcatcagttttctgtacgagaaggaaagggcgtagtaagtgcatagccaacagacaaactcaggccaaatg

SEQ ID NO: 109516 - DNA, 71 bp, Heterodera glycines
  Promoter: Source sequence=SeqID_81; Location=1..71; Strand=+; Gene =SeqID_63761
aacgcaattacagccaaatcgagaaagaggctttggcactcgtttttgcagtgcaaaaatttcacaaaatg

SEQ ID NO: 109517 - DNA, 427 bp, Heterodera glycines
  Promoter: Source sequence=SeqID_4989; Location=1749..2175; Strand=-; Gene=SeqID_56458
agtggaaagcgatgatcagaattatgataccgatgaattggatactgatgatttggacgaaatatcttcagcaggtcaaacagagtaggggattcgcggattttaccgatgtccgtcgttttctcatcctcgggagcggggatcccggtccatacctatcccgcagaagatgtagaaaaatttatcccctaaaaagttgcaacaaaagtgagtcaatatccatatatgaaaattcgggtttcaaataaagtgttgatccacttgaaattccgattatttatttggtctcttaattaaaggagtttccttgttcttagcatgttttgtggtattttattaattctgatgtttctttttataaatgttgtttttggtttagccggagtccgaggaatacaaggcactccagcagctccacaaaaaaatg

SEQ ID NO: 109518 - DNA, 414 bp, Heterodera glycines
  Promoter: Source sequence=SeqID_26428; Location=544..957; Strand=-; Gene=SeqID_57157
ttagtttctcttttgtgccggttcagaaatgccgcacatccctttgttatttgaatttgaccccgttcgcatcggtcaccgcagcgtcggaccttggctacacagatggccacgatcccgtctcatatacaagggcacatgggaaagtcgccctctttttatttcttccattcactcgcccgcgcaccccaagaaaatgaactccgaaagacgtcgcaacgagcgtgagcaactgcgtgcacgcctcagcttattggttgacgaaattgataccgtcgtccaggggctgatccacaactaccaggacgacgggctggtggtcctcgctgtgagattttttttggtcttttttttttgattattatttgaattttaatcttgattgaacaggcgccggatgatgggcagctgatg

SEQ ID NO: 109519 - DNA, 144 bp, Heterodera glycines
  Promoter: Source sequence=SeqID_41049; Location=444..587; Strand=+; Gene=SeqID_69267
tgttgccattgttggttatattggaacattgtgtggcaatgagtgcctaaagatttatcaataaataattaataaggtgaatttaagtgtgttatcattaaaacttagatagaatagctgtttcttacagagctgtcacatatg

SEQ ID NO: 109520 - DNA, 609 bp, Heterodera glycines
  Promoter: Source sequence=SeqID_28294; Location=1..609; Strand=+; Gene=SeqID_58921
aatttttgagtctttcacatttttagccgcgatgcgcgatgtgcgatccgcgattcgcggcgttttttttttttgcgcgatccgcggtgcgcggccgcgggatttttctgtgcgcgctccacccctgttacttagagcgtttaattgaaaaacaaaaagaacgcttattgttagttttttcaaaaaaattttaaggcatagaagaacacagaatagggaaattgatgcataaatttccggatttttcgttttgtacactattttggatgcaaatctaagctaaaagtacatatgtctttagatattccccctgccctttaaatttcaatagaaaattgcttttaccgctttcactcttttcaaatcggctttatccctaattttaattgttgcaattaattttaggggttacacatttccctttctcctctttcctctctgttgcgctatcacaacacaattccaattcgtcaacagctttttcttccctcatcgacgagatgacttattcaaattcggtgatcctttctccccacccatttttatgtaatttttccgccatttcccccccccccctcgttcagcgatctcgtcataaaacttccgatg

SEQ ID NO: 109521 - DNA, 168 bp, Heterodera glycines
  Promoter: Source sequence=SeqID_2183; Location=4576..4743; Strand=-; Gene=SeqID_78340
tcttcaaagtcaacaacaacgacaactattgcctcttttatgctctggaattaatgcgcttctactctttgtataaacgcggaattatatctgaaaaaagatggagatggatgaacaataaccaaactactgttcttcgtcaaaaagtactacttttactccgcgatg

SEQ ID NO: 109522 - DNA, 570 bp, Heterodera glycines
  Promoter: Source sequence=SeqID_9011; Location=1..570; Strand=+; Gene= SeqID_69989
tagggcactggttcccctatagaaaaatttttaagatttttgaaaaattgatgtttatcattggatatatcatttattgacgcctgaagtgaaatagagcagaaatttaacacttgcccatttttggccaattatgttatgatttatttccaaaaaataagccttctccctaattaaaccaatttttattatttttatgcattttttaatttttaataatgttttcatctcaagttttttttgcccttttcccaaatctttcccccgcagttttgcccatttttgggtcaccgtttgcccaacactaaaaggcaacaatttgaataaataaaagagaaaaacggaagaaaattatgagttattcaaatatttattattcttatcttttgcccatcgcatttttctccaattttgggtcatcgttttgcccataaatttatttactttttggcctataaatatgtgcacaattacagcggctatagcagaatttagccttcatttgctcatgttttttctgaatgcattaaacaaattaaaattttaaatttagattttaaaattaaaatg

SEQ ID NO: 109523 - DNA, 490 bp, Heterodera glycines
  misc_feature (26)..(26): n is a, c, g, or t
  misc_feature (62)..(62): n is a, c, g, or t
  Promoter: Source sequence=SeqID_35274; Location=1..490; Strand=+; Gene=SeqID_46422
ttttttgcgttaaaaacccttacatnttgtttgtatttttttctctatcgatatgcaaaatntggagtggatctaacgtatagaaaaaaaattaaacgtagcgaagtaaattcggtttttctctattaacagagataaagaaatagtacgccaaaaagagaatgtttttttctctgcactctctatttattggttcatgtctcgttttttgaaacggtgtgttaagctatggagaatccaggaaaaaatatgtatttacataaaaaaagaatccctgataataatattttagctctcttctgtctctccatctttgtcttattctatcttgttccttctaataaaaattctttttcatcatatttcacttcaaacaaaatttaagtatcacaatcagtctcaaaaaacatcccaaatagcattgtcatcaaatttattaaaaataaaatttaagaagcctaattccttgaattaatcatctcatacaatg

SEQ ID NO: 109524 - DNA, 1003 bp, Heterodera glycines
  Promoter: Source sequence=SeqID_22440; Location=1192..2194; Strand=+; Gene=SeqID_53111
attcaattcgcttctccgtccgcccgtccgctgtttgccatgtccatttttaataaagatgggctgccctgtgcccaatttcatcctttcccttcccccctcccctcgtcatttcctgctgcaacagaagcaccagcgaaagcagcagaagcactgagagtgtcccctctccgtcagtcgcccgtccaaattaaattttacccgccaccgccggtgagaaaggaagggaatgaaatgggatatggacgaaggaaagaaaagggggaaagggaggggggggggggggagggaaatgccggtgccatcgaaaaagggagggcaaaaagagggccaaatctgtgcgactgatgcgaaaatggaaaatcaaacaaatacatttcaacagcttaataagagaattagcaaaggtttaattgtcaaattctgatcaaatttaggcgcccaccgccaaagccaaacagttaattattattggggataaacgaaattcatcaaaatcaaaattcatactaaatttataagtatatctgttatcaccaaaagcgaattattgatgaagtttgaaaattgttttgttttcagaaaataccgtataaatattcaattttgatttaaaaatcttagaaacattatgccattaataaattcaaaaaggaaaagcataaaaattaattaggttcaagcacaaacaagcaaaagcatcaattaataaatttcaaattttctctcttttaaaggatgttaattggttcattaataaacaacaaaaatcgacaaattttgcagttttcttccttttcttcaattttatttaataaaagccgcaaaaaacaactcaattttcttcatttaaattttttaaggaggtaaaagagttaatctacacttaagtatcaccatttacctcatttaattcgttaattttttgcttttcccataaaatagtacttctgcttcatcttcgtgcgtcgagtcttttcccgaatggcggcatcaaaatatg

SEQ ID NO: 109525 - DNA, 57 bp, Heterodera glycines
  Promoter: Source sequence=SeqID_19818; Location=2451..2507; Strand=-; Gene=SeqID_84557
aatggaggtgtttcatgtgtcaacatttcgcttcaggccttctcatacaggccaatg

SEQ ID NO: 109526 - DNA, 267 bp, Heterodera glycines
  Promoter: Source sequence=SeqID_26602; Location=1..267; Strand=+; Gene=SeqID_57342
gacatcatatttttgtttgttttttattatcttttacattacatgtcatggaaattcgtgcatcacaccgttccatgtaataataataataatttttaagccacccaacgcgccaatgaatcagacgacagcgtggcaggtgctgtcatctccagcggcggtagcaacgtagcatacagtgtaacagaagctgcgttgctgaccaacaccaccagcaaactaatgggcacgacgtcggccgccgccgtgacatcaacgacggcgatg

SEQ ID NO: 109527 - DNA, 1003 bp, Heterodera glycines
  Promoter: Source sequence=SeqID_7384; Location=3044..4046; Strand=+; Gene=SeqID_64668
tgattgttaatttagatgctcatcaatttcccggttctcactgggtcgcaatgtttgcatatggattaaagaagaaagtaatttattttgacagtctagcgctaccgataaacggatcaattggtagctcctttctcacttcatttcccggagcggtgtataaccaaaaagtctttcagtccatttcatcaaagtcatgtcatttttgcatttgtttttactttttatcatcaggttccacatttgatcaatttctaaataaatttaatcatttaaatagtcccgaattgtatgttcaacattttgttcacaattttccaataaaactttaaagaaatgactcttttttttttcattgtataattaggtctatttcacaaacgaaaggaatgaaaagtaaagtaaacacaaggtaccgtctagtgtctagcaccactggctgccgaatggacctaaccaatctgcaatgacccattgaacgctgattggctgaatatccattcacccattatttatataaccctttcctcctgcacaaatttaggtgtatgttgtgaaaaggccagaagaaggtcaatttactcgtatttccaatgggtgtttactttccacacagctattgcaaatgatgattggtcgtcgtccccttctcatttgtagatcccgctgaaatctcggcggacattgagaaaggaccggggaaggtcaatatattcgtatttccaatggatgtttaccttccactcgcaaatgatgattggtcgatgggcatttcccttttcatttgtagcttccgcagaaatgttgaatgatgattggatgaaagagtagaatggtcttatgactaatattgttggtcctttctgcataaaattgtgaaacaataattctgtttatatgtcttaatagtttccggtataaaaaagaatagaatatgctatgaattcattttattattggaaataataaaaaagtattttagcaaaataaataaaataaaatg

SEQ ID NO: 109528 - DNA, 996 bp, Heterodera glycines
  misc_feature (18)..(18): n is a, c, g, or t
  misc_feature (60)..(61): n is a, c, g, or t
  misc_feature (67)..(67): n is a, c, g, or t
  Promoter: Source sequence=SeqID_30543; Location=692..1687; Strand=-; Gene=SeqID_46224
atcatttgtgaagtattnaattaaaaataaataaataattaaataattatttttttaatnntagatnttgtacatcccatgcatgatcgcaatacgaaagcacacggactccacttgttatcgggttggtctgctggagtttgggtgcagccaccttaggcgctgttaaacaaaaattagcttttttagcccaatagaatcccatagtttaagcgaataaagctcattaagaagatatgtctaatgatacccaaattgctaatatccgataaccgaaaaaaaattatctatttttttataattctaatatcaaatatactttttataaatttttcatttttagtttttaaatatcaaatataattttttaatcaataaccgagtaggaatgccaaaaagttgtgcccgtatcagtcggttagggcatagttcggtttggaataatagtgggttcgagtcccaacgggtgaattaccctttattttcaaccttttcgaaactttgtactgattttttatgcaatttttgcatgccataataatgaaaatgccatgaaaattaaattgtttgcatattttggccctttccagttcatgttttatatcgccataaccgacatgctgagcttgttgatctgtgccattctgacgggcatttttgcaattatcggcgccgtttattgcacagcgccacgcttcatttacatcagcggagcatttggacttggtaaaatataaaaaaaaaattttttaaatcaatttttttttgctagcaaatacacactgtagatagtgttatactgtaagcaggaaataattcctttctgtctcagttgtactggaacagaaaattttacgctaattgaattcatttaatagctaatttgtcgataaattttacaactttgccaaatgaaagtttattcaaattataaaaatatgaaattcaatggttttaaatagaattttttatcagaaaacatccaaaaaataaatg

SEQ ID NO: 109529 - DNA, 625 bp, Heterodera glycines
  Promoter: Source sequence=SeqID_9407; Location=1..625; Strand=+; Gene= SeqID_71301
gcgggcgtcgcgaaaaattagggggtcaaataaataaatcaattattgaattcacaattttctcttttaaaagcaaaaagaaatgggggaccgtataataaaatataatttagaaattaaaataattaaaaggttaattaattaattattattcctaaaataaattttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaattttttattgtcccaatttttaccattttgtgttttttcaacaaaataaatatttgttcaaatttaaagaattaatttttaaaattttagacacaaaaacaaatcatg

SEQ ID NO: 109530 - DNA, 201 bp, Heterodera glycines
  Promoter: Source sequence=SeqID_21407; Location=622..822; Strand=+; Gene=SeqID_52018
taattagtaaaatgaaaataaaaaaatgattttactcatttaaattggcatttagaaaacaaatgtactttttctgagttagtaaaaagctaaggaaattaataaatttggatttaaatttaaaaaagaatttttacgaaattaataataatttatttctcaccaataattgcgcattctttcagcttttcgccgaaaatg

SEQ ID NO: 109531 - DNA, 248 bp, Heterodera glycines
  Promoter: Source sequence=SeqID_39385; Location=868..1115; Strand=-; Gene=SeqID_67962
tggagcaattatatcaaaaaattgctacaattcaaaccgatgtattttatagtggcagtaatttggttaatcagatcatcagtgaggcaaaagataaattggaggacttcaaagaaaaaagcggtgggtcaaattgagtcaggcgcaaatttgtccttggttcttgtggtgcccaagatacggtagggagtcaactgatgctttgtcgttggttgtggtgtccaagatacggtagggagtcaactatg

SEQ ID NO: 109532 - DNA, 348 bp, Heterodera glycines
  Promoter: Source sequence=SeqID_10145; Location=2045..2392; Strand=-; Gene=SeqID_73244
ccgatgttttttttcgtatttttgcatcgatttccaaaagtttaattatttttaagctgaactagtgacaaaaatttcgaccatcaactcagaacacagctacgcggctactccaatacaattcggcatcggctcaccggcgccatcaacttttacatggccaaccatcgtgagactccacaagaacagcttgttcaatattctttgagcgcgctatcgacttcgaaacaacgccttcagggatatattttttcacgattctttcgtttatatttaataaaaaatttagttcacgtgtgggaggaaatctttcgggcgcccctcttcccaattccaatttggaacatg

SEQ ID NO: 109533 - DNA, 193 bp, Heterodera glycines
  Promoter: Source sequence=SeqID_4608; Location=1517..1709; Strand=+; Gene=SeqID_55069
ttaataattacggcttacagtatacttctaattacagtatgctccataaggcccccattttccgggagccggtaaataccgtactgaataaaaaagatacggcttactgtatacttctactacagtagtcccattttccgaagccgtgcaattatcgtattgaatgaaaagtgtccgggctgtcttagaaatg

SEQ ID NO: 109534 - DNA, 396 bp, Heterodera glycines
  Promoter: Source sequence=SeqID_30715; Location=1..396; Strand=+; Gene=SeqID_61110
tgatgcagttgcgagggaatgcaaagtgttttcggtacctacttcggtgcgccgagtgcttctgatataatttttaaagattaattgttattatcattttctacctaaattcaattattttatttaaatattgttttttattcaaacgagaatataaataaagttagcatttcatttaaattaatttttttatttcttttttttaaaattataagatattgaaaaaaaaattctattaatagcttttcaaataatattcatattttttgttttggcctttttgtagtttcaatatttttcttcgttaaataataacaatcctttcattaattcttgataatgacaattaattttgaatttatttgtaataattatcataatataattttaagaatg

SEQ ID NO: 109535 - DNA, 267 bp, Heterodera glycines
  Promoter: Source sequence=SeqID_27505; Location=374..640; Strand=+; Gene=SeqID_58197
aatttgaaaatttgttttttaccattttttgaattcaaacggtttatgggcggagacttcagttttatttggtcaatgatcgggcattgtggttctgcagtgacaacatttccgtctccaatttgcagttgcagaagtgatcatttggtgtaggagggcgaaatttgtgaactccggacaattgatcaaactgtgcagttcacggagcaattcaccagagccatagtgaatggcgaaaaggcaaacgcagcggtcagatcggcgatg

SEQ ID NO: 109536 - DNA, 61 bp, Heterodera glycines
  Promoter: Source sequence=SeqID_36413; Location=561..621; Strand=-; Gene=SeqID_65721
ttccgtgatcacatttcttcgttccaaccaacaaatttttgacaaaagaggcaccagcatg

SEQ ID NO: 109537 - DNA, 196 bp, Heterodera glycines
  Promoter: Source sequence=SeqID_15759; Location=1179..1374; Strand=-; Gene=SeqID_80085
atttttttaaaacggtaaaaaatacggattaaatttttttgttcatattttggttatggaaaatctttttaacggaatataattgttgtttattacgctgtcccacccaaataaatagctcaacaattccataaatataatgatgataaaaatgccgagttaagatgatgctgatgaagatattctgaacagaatg

SEQ ID NO: 109538 - DNA, 358 bp, Heterodera glycines
  Promoter: Source sequence=SeqID_40352; Location=707..1064; Strand=-; Gene=SeqID_68716
tgtattgagctttttttttgccgatttacaggtcattattttttcaagtctgatcagaactgtgtttaaatggtactaaaaattctgctctatccaattataatcatattaacccaattggaacatgaaaattaattataaaaaatatcgtcgatttttttatgtttaaatagactattctttctgattgctctcctaaattgactagggtttcgtccaattaattaactaatcaattaattgccctttcctttgccttacgttcgctgcgcattttctccgatggtcgacgaaatcgcctgctcctccgtgaccctaaacggattgcgaaacgaaactcattaccagtgaatgaatg

SEQ ID NO: 109539 - DNA, 119 bp, Heterodera glycines
  Promoter: Source sequence=SeqID_42331; Location=1394..1512; Strand=-; Gene=SeqID_70255
tttttgtgaatttgattactcggatttgtccctattttaatacactataaataaactacattggcttaaacgtttttaactttcgcttaatagtttcagtttttagtttaaacgaaatg

SEQ ID NO: 109540 - DNA, 370 bp, Heterodera glycines
  Promoter: Source sequence=SeqID_21834; Location=1082..1451; Strand=-; Gene=SeqID_52467
ggagaaagcagattatgtcatttatccgagtggccagtataaatttatttttgcagttggcccctttggtgaggattatatttatttaaaatgtttattataatgtagcattaaaattgaaagatcatataatagggtaaattttataaaaaattaattgtgctttgttgtttaagacggcccaaaacagtattctcttttgactgacaaagaaggcaatctcgaatggaatttctacaaaaacatacacaacaataattttttaaaagaaaattacataagcactaaatcggcagaaaaaataacgattttggcggagaagggatccgataaacgtattataagcgaatttgttaattacgctgaaatg

SEQ ID NO: 109541 - DNA, 359 bp, Heterodera glycines
  Promoter: Source sequence=SeqID_2417; Location=877..1235; Strand=-; Gene=SeqID_79611
ccttaaaacattaaaaagtaaacaaaaactcttgagcaatttcattgagtataataatttcggtatttcgttatggaaatggttaaattaataataaaaaaggcaacgcgaaaagaaaagaaaaaatcgcgagttttcgaagttgtcgaaatcaaatgctgcatcagctacttgtgacgctcacaaaaatcaacaaacattttacatatcatagcaaaacgaactccggcttcgtcattgctgtgctcaactcgggctgctgctgaagcggtgactggcggcggcggcgatgtcaccggcgccggtggcgttgccgaccgcctcttccggcgctctctgcttctgctccggtgccgatg

SEQ ID NO: 109542 - DNA, 177 bp, Heterodera glycines
  Promoter: Source sequence=SeqID_794; Location=4258..4434; Strand=-; Gene=SeqID_61384
taaattaattaattctgtttagctaaaagtccgaaagtggcgaaacaattaccatcggtggtgaagccaatattttttaatgaagaaaacttccatgacgatttcattaatattgtccaaattctgaatgacatttcgaaatgtttttggaaaattggggaaaatgaattgaaaatg

SEQ ID NO: 109543 - DNA, 143 bp, Heterodera glycines
  Promoter: Source sequence=SeqID_4205; Location=7478..7620; Strand=+; Gene=SeqID_53593
atgagagattattgaatttgtgggagtgagtcataagcaattaatggccgggttccgaaaaatccagggggacaggatcgagaaaactcgagactcggagtcgcgaaattaccgaccatcattcacaaatagcaggagatatg

SEQ ID NO: 109544 - DNA, 252 bp, Heterodera glycines
  Promoter: Source sequence=SeqID_13177; Location=1..252; Strand=+; Gene=SeqID_77006
ttgccgaaattttgaatttttttgaggatttccaaaatttctgtaaaaaatccacaaaaaatataaaaaaaatgaaaatatataagaaaaaagttcaaaaatacaccaaatatgtaaaaaaatcccgaaatatgtaaatatgtataaaacaccgaaaagtgtaaaaatatataaataaaagttccgatttttaattggcagccatattaatcattgaaaaataaaacatttaatcatttcagaatttaaatg

SEQ ID NO: 109545 - DNA, 452 bp, Heterodera glycines
  misc_feature (32)..(33): n is a, c, g, or t
  misc_feature (63)..(63): n is a, c, g, or t
  Promoter: Source sequence=SeqID_40972; Location=1..452; Strand=+; Gene=SeqID_69192
aaaaatacttatgaattattttgcaaaaatannataagtaatgaaaaagtcagaattttgaanaatttaaaaacaacaagcgttggcatttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 109546 - DNA, 1003 bp, Heterodera glycines
  Promoter: Source sequence=SeqID_9835; Location=845..1847; Strand=-; Gene=SeqID_72853
ggggaagcaaaaaataaattgtaccaaatgctggtaagcccttatcaatctttgattattttggaaagtttcatattcaaaaacaatttaagattaactacttcattaaatagtacttgtgttttggtaattcatgaagatccccttttttctattaacatgtggaatcattgttaggaccacaagtcaaagcaagaatgaatttataatactttttaatatcagagtcattaatgattgttctgaagaaaggagagcggattgaatgagttgaaccaactcagggagatttgtttttagaacagagcccggaattttaaatcatatttttctatgcgttattatggcgagagaagcccaaaatattttctcagaacatttttatttagggctacttataaaaaaataaaaaccgcccgaccctaaaaatatatattttcttgaaaaaattttctcaaaatctgttaacaaatcgcattagaataatttcatgaaaatcaatgaattattaaaattttattacatttttattttttcaaaaattttcaatttataaagacttccagtttccagcagggtttgatttcgctttcacccttttggagtgaaagattttcacatcactaatgaatggcatttttttgtgggaaaggcaaaaaagttcatatatctttaaatacattttaatttacaaactttttgtgttaaatgcgatccaaaatgatcaaagattgacaggagcttcccagctggtataatttatatcgtgttcaattgctgttagtctgagcaaattgaatattaggatgacttgtaaatcattaagaaagaaaaaggctgttaatctccaaaattaaatttgaaatcattatttgtgctgtcaaatatttaaattattcggttgtccttaaacattgcacccgttggcccttgggaaaggtttttctcttttttataatgattttcattcatttttttttgaaattgtgtatatcctcaaatg

SEQ ID NO: 109547 - DNA, 72 bp, Heterodera glycines
  misc_feature (15)..(15): n is a, c, g, or t
  Promoter: Source sequence=SeqID_24698; Location=1..72; Strand=+; Gene= SeqID_55447
cccatccaacctatntcgcccaaaaaaaaattatttttcttcctgaaatattatttttaaattttagttatg

SEQ ID NO: 109548 - DNA, 380 bp, Heterodera glycines
  Promoter: Source sequence=SeqID_17809; Location=579..958; Strand=+; Gene=SeqID_82341
agccaaatgcccattaatcccacgacacaaaaatcgcagttcaaaaaagtgaaggccctttatgactttgaggcggcggaggacaacgagttgtcctttttagctggcgaattgataatcgtatacgacgataggtttttattttttggcttttcgttttgcgatcacttcgaattccgtccgttgtcagtgaccaaaattggtggcgcgggtcgacggaacgcggcggcggagcgagcggactttttccggcgagttttgtgaccgaaaacttcgacaacggacaaatttcgaacggaacggaacgaaacggcgagagaacggaggcagtggaaacggcggttgtcccaaaagtgcaaatcgatgaaactgtgctgatg

SEQ ID NO: 109549 - DNA, 98 bp, Heterodera glycines
  Promoter: Source sequence=SeqID_19016; Location=1373..1470; Strand=-; Gene=SeqID_83750
ggcactaataaattccactattttaaaaaaatttaaaaatttcatggaatgtttaataattttgccaggcccaaaatgttggtgacgaaaaaactatg

SEQ ID NO: 109550 - DNA, 553 bp, Heterodera glycines
  Promoter: Source sequence=SeqID_2781; Location=2915..3467; Strand=-; Gene=SeqID_81559
ttttgaactaaaaatgcaaagttcaaaaaatttgaattttccaacttttgttcgaattcaggtccggggttcgaaattgatcgaaatagatgccggattcgtgatcaacgaccccgaaaaccctaggatgtcttttgaaaacaaaaaaaaaaattcaaaaggggcctaccatcgacagtacaaaaaaatttaataataagaatactgagagaagaagattttgaaaaggacgaatgtgaatgctaaagtgaatgaagtgaaacgaattgagaacttaaatgggctgatccaatcattagtgtcagctcaaccaccaacagaattatatgaaacaaaatgccaatttatttttattaaaatagagcccggtaaaaaatttacggaaacgggaataaagaaaaagcgaacgggaaaaaggattcccgatcctgtcaattttaacggaaatccgtctggaaataggaattttttaacgaaaaatttaatttgtcaatttgtaatttacactttttttgctccacctgccttaaaattaattttgtttagcgcaatg

SEQ ID NO: 109551 - DNA, 334 bp, Heterodera glycines
  Promoter: Source sequence=SeqID_42254; Location=301..634; Strand=+; Gene=SeqID_70193
aaattagagaaaacagtcaaaaaaccattaaaaccgttaacccccccccccctcaaaaaataaagttattatggcgttgccgcgtgccatggctgcaaatgtttcttctggcgatccatcaaaaacaaaatgaagttgtttgtgactgagatggcattttcgccaatgttccttttaaggtacatttgtcgtggagacggccaatgcgacataataaacccaaaccatcgcaattcgtgccgcttttgtcggcttcagcgatgcctaaaggcaaaatgcgcaagggcaattaattgaccaattaattaattggggactatttaaggccggaatg

SEQ ID NO: 109552 - DNA, 539 bp, Heterodera glycines
  Promoter: Source sequence=SeqID_7570; Location=3222..3760; Strand=-; Gene=SeqID_65263
cccccccccccctcgcgaattgccctctttcccccgccgggccctccttcccatccatcattcgtctccgcccgcccaccggccatatcccatttcattcatccggcagattgccctcataccccaatgtgatgctcactttttcatggcctaaggcaatctcagccgaacaattaatgcgaaaggctccgctcatttgtcagcgccccattttattgtcggatgaaatcgtttcctttgtcagctttagcaaatcaactgatcaaggaaagttcaacatagaatgagtgtccgtcatcccttctcctttcgatcatttccatttttattcgctttgtgcccattttttggcgcttttggcgaatggttgccggacggagaaacgaaacccttttcattgtcctcaaatgaaacattttcgggcggaaattcaatcatcagtgtaaatgagagtccatttcagccaactacaggacggaagacaaatggaggcaaagagcagttcaagttgggacggacgggcaaaatgggaagaaatg

SEQ ID NO: 109553 - DNA, 497 bp, Heterodera glycines
  Promoter: Source sequence=SeqID_14621; Location=1382..1878; Strand=-; Gene=SeqID_78702
aaaatatttcttactgaatataatcaaaatgaagaaatgagttttcaaaaatgctcgtgtcacaattaagtcaagcgaatttttaatggggaccggaaaattggacacttgaaatttggacttcagaaaattggacaccaagcggaaatttggacaccggaagattgggcaccaagcggaaatttggacaccggaagattgggcaccaaatattatttatttaaaaaaaagaaataaaatttgaaaaaaaaattaattagaaatattggattaataatctaattcgattccgaatacatggtttatttaataaagggtcatttgtaagccaataaaatttagagaaatcaaatgcacatggatgcttgagaaaaagctgtaccgagtccagaaaattctgattttttgagttatcgatgcggtataaaataattttattataatttgattttgattttattatcaagtttatatgattttttttgtaccctataatg

SEQ ID NO: 109554 - DNA, 148 bp, Heterodera glycines
  misc_feature (100)..(117): n is a, c, g, or t
  Promoter: Source sequence=SeqID_41430; Location=1208..1355; Strand=-; Gene=SeqID_46662
caaatattaaaaacgatggacgatatatataattctatacaaaagaatcaacaaattgacattatctatattgattttgtcaaggcgtttgattcagttnnnnnnnnnnnnnnnnnnccttccattgtttattttcaaaacaaagatg

SEQ ID NO: 109555 - DNA, 326 bp, Heterodera glycines
  Promoter: Source sequence=SeqID_10786; Location=501..826; Strand=-; Gene=SeqID_74043
atttatctatgaaaattatatttaaaaaaattttttgttgtgctttgattgattgaggtatttttttaaaatggtgtttagcgttccgttttattgggcaatttttgatgagcctaacgtttggtgctgtttttccggaggacattctgcgcaatttattcaccatgtgcctttcttatgcctccgagggggccaaatcaatgaaaatatccgcggaccacttcattttccttctgacgtcaaaacaccttgactacgaagtggctgtacactttaaaaagctggacaactcggcaacagaaaaaatcctgacgcgttttgaaatg

SEQ ID NO: 109556 - DNA, 681 bp, Heterodera glycines
  Promoter: Source sequence=SeqID_32760; Location=266..946; Strand=-; Gene=SeqID_63007
gaattttttgaaaaaaaaattttttttttttttaaattattaaattttttttttgaaaaaaaacaaaacgagtttatgaaatgaaaaaaaaccaggatcatttacattgaccgcgtttaatgcaatcaattcaatttaaaaaaagcggaaaaatacacgccctaaatattgaggtttccaaaaacgaaaaaattcccccctaagaaccgactttttgagttggccccccccccccccgaaacgaaggtcctggctacgcccttgcaggagtataacctcagcaccaccgaacatcctaaacggactcagagctctttcccacactaagtttcattcggaaacgccacggaaacctggggaccgggggcaatttatgaacagaaattttacaaaaattactaatttgtcaaaaaaaactcaaaaaaaaatttccgaaaatttccgactttttatcaaaaatttcggaaatcggaagtcggaattccgacgaccaaaatttgacaaaaaatgtatttttcaaaaattaattttaggctagaattcgcttgacagtagcgtacgtagcatgtaaaattaaatttgtgttttgcaaatccttaggagctcatgaaaaaaaaagaaataaaaaaaaataatttcctaaaaaatgtgaagtgtcggataattcgtcggtcaaatatg

SEQ ID NO: 109557 - DNA, 425 bp, Heterodera glycines
  Promoter: Source sequence=SeqID_26187; Location=1865..2289; Strand=-; Gene=SeqID_56933
ggttgccgacaatttctaacattccactatactttgtatatctgcgcgctctctccgtagaaatttattcaagatatttcttgaaaaaaatataaatttaacttcgtgttgcacaaggcgtagccagacccttgacttcagggatgggggggggggcttgattcgttttgtagtggtgtatttttcttttttagtcccgaattaggaaatgttttttgctggaatttgtagtcattttcgccaaaaaaattttagaattttggggttccttttttaaaaatatagtaaaaatggaggtccatcgatgccgttaggaattttgtagggaattgcttaaagttttcaaactcattgtcagttttcctcggcttccccctcctccttccaactctgtccatgtttagaattggtccttttcagatatg

SEQ ID NO: 109558 - DNA, 381 bp, Heterodera glycines
  Promoter: Source sequence=SeqID_3984; Location=905..1285; Strand=+; Gene=SeqID_52698
tctcgttcaattctaagttgcaccaaaattcattttatttttgaggattcacaccgaaaacttcaaaaaataaacattgaaaaaatgaatttcgatgtaaaaagacaaaaaaaaaaacgaataaatgtttaaaaacatcatttatttaataaattttcagtgacaaatttgtacttttcagtatttatttatgtcgggcctacctgattatatttctgtcgtgtcggacaaatgttggcttttgctcaaaaatatgagcatctttcaccttttttgtgtaattttagatttttttaaataccaaaattttttacttctaacggtcgcttcacaaatccgctctcaacattcgcaacaaaggcacaactgaagaaaaaaatg

SEQ ID NO: 109559 - DNA, 403 bp, Heterodera glycines
  Promoter: Source sequence=SeqID_23958; Location=725..1127; Strand=-; Gene=SeqID_54660
ttggcaacggttgaccacgtgcgttgacaatttgcacaacgttcagaaggaagggatatacttgaaataaataaaattaattaaaatcgtaaacaaaatgaatgaaataatcggagaaggttgaggaaggatattggtgaatatacagaataaataaaatgacaaatgaattgttctgtccaagaaacgtcctttatatacaaaaataaggacgactttttcatggattcagaaagtctaaaaacagcaaattttaacgacttcggtattatcacaaaatttgcaaatacctaaattgggcctatttaataggaatcgctgattttacatatattttttttcattttgctaagctattttacatctgtcggaaattgtcttaataattaccttcaccaaaatg

SEQ ID NO: 109560 - DNA, 77 bp, Heterodera glycines
  Promoter: Source sequence=SeqID_25615; Location=904..980; Strand=-; Gene=SeqID_56365
ttgagatcatacaaaatccagtcagggatagacaagccaaatcaccaaatgagcattcaacggcaccaattcctatg

SEQ ID NO: 109561 - DNA, 300 bp, Heterodera glycines
  Promoter: Source sequence=SeqID_18515; Location=2272..2571; Strand=+; Gene=SeqID_83137
gtgaattgaataattgtaatattcctaagaaagaattaaaatcaaaattatttatgataagataaaattaaaaaaaaaactttcgaaacgattactttttctttttaatctatatactgtaaaaaaaaatatttttaaatatgtatgtatttatgtacattatgttatatacgtatatttgtttttgcttataaaatatgcataaaattttaaaaaataagtacgcccgtgcaataggtttaatcgcgtgggtttaatccgaagaaattaattctaaaaattagatcatttaggataatg

SEQ ID NO: 109562 - DNA, 267 bp, Heterodera glycines
  Promoter: Source sequence=SeqID_29034; Location=289..555; Strand=+; Gene=SeqID_46145
ttatttctgaaaaataggtatgtgtatgtacaaaataggaaattttttataaaaaatgtcaatttaacggactgttaatggaatcaagtgcaagcatttaaaagagattcagacattggcgatttgtttcaaataaaaaacactaaaaaaagaaaagttatttcatttcctctgggaagcctgccaaaaagtacaatccttttgtttctatcaaaattttaagcattgtgtcgacaaactaatcttattacattgcgctcgaatatg

SEQ ID NO: 109563 - DNA, 1003 bp, Heterodera glycines
  Promoter: Source sequence=SeqID_11000; Location=217..1219; Strand=+; Gene=SeqID_74318
atttttctcccccgccgatttttgtacccttcggcgtcgctcttttgcatcttaatctttgcccccccccagggggaaaatgttctggtacttaagtattgtttatcgtctatttggggccattccattccattccattccattccatttggcacacattcacctcttgctcttcactcgttctcactcctcaccatctttttctttttgctgaatctttcccaatttttgaccccctcaataatccttatcgcccttcccttcctccaattttcaccatataatccatcaacatctcgcgtataatcatccaccaatttttgaccattttatcatcatcatcaccaataaacattttgtcggaaaagtgttgaaagggtcagagggcaaaaagggggggaaaaattcgctcgggaacgaagtgaccaaaggggagccaaagccccgagaatcgaagcgggggacaatcccccgcagagcagcagaaaaaagggacgggagccagttcctggcggttgacgcagttcgcggccggaagtccaactcttctcccgaacctcaaccgggagcgccgacagctcttcaaaaagtcggtggtgccgttacagcaacaaccgcaaaccccatcttgtttgtcctccccaccccctccccagttcactcccttgggcacggacccaacggcagcagtagcagtttcaggaaattgagtgaattgggcccgagggacgggagagaaactcccgcgcacagaccccctagctgtcagcgccggccgagtttctttgccacaaacaatttggtgccgttagcagggggcaactgcagccatcaacaatcggtctacgagcgaccaacgagcacgaattcgagaagctaacggcaatttggtgccgttagcagggggaccagcaacaacactccggtcgcaaaggaccagcacaaccaccagcaacagcacttcggtcgccgaggaccaacacaacgcatttgaacaaaaatg

SEQ ID NO: 109564 - DNA, 450 bp, Heterodera glycines
  Promoter: Source sequence=SeqID_18822; Location=679..1128; Strand=+; Gene=SeqID_83510
aatgctttttgaaaatttatgatatttaggagccatttaattttgatctagcttcataccgatttatattatatatttatttgattatataatttgacaaaaaattaatttgcagataagaaatatttatatatataaataattcgtcaaggattttattctcattattattatgtttttttagaaatgaattaaatccatttttgttttaggtattgtcttaactttcgagtttttaaattgctgaatattcattttaaatgttaatatttagtaattaaatgaattttatttatatttggaaaatttattgcaatgattaaatttgtacaaaatttaaagtcatttattaaatatttacaaaattttattttatattcttatttttttcttataatttaaattataatgcatgttatttaaaaaaatattaaattttaaagttcaatg

SEQ ID NO: 109565 - DNA, 115 bp, Heterodera glycines
  Promoter: Source sequence=SeqID_8796; Location=1..115; Strand=+; Gene= SeqID_69253
caaatcaaaatcggatttcaatcgccctcctttaaaccatcaaaaccaaaattttgaatttgctggtccacggaacactaatttcagacaaaccggagacttacaaaatcaaatg

SEQ ID NO: 109566 - DNA, 128 bp, Heterodera glycines
  Promoter: Source sequence=SeqID_13967; Location=2765..2892; Strand=-; Gene=SeqID_77926
aaggagttcaagcagtacgtgcacttgaaatcaggaaatcggcaagggctcggagaagccgggcaatttggtccccggagcgtcatgtaccacgaaaacgaggcgcaattcaaccaagaactgggatg

SEQ ID NO: 109567 - DNA, 471 bp, Heterodera glycines
  Promoter: Source sequence=SeqID_45541; Location=1..471; Strand=+; Gene=SeqID_72817
cagagcacgttctaaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttgaagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 109568 - DNA, 86 bp, Heterodera glycines
  Promoter: Source sequence=SeqID_9183; Location=822..907; Strand=+; Gene=SeqID_70516
aattgaatttttaaaaatccatttaagccaattacattaatgagcaaacaattggttttttggatttcaatttgttgtttgtaatg

SEQ ID NO: 109569 - DNA, 134 bp, Heterodera glycines
  Promoter: Source sequence=SeqID_5486; Location=878..1011; Strand=+; Gene=SeqID_46051
acttttcttctccattgtcccttcggaaacaatttttaccggtggaaaaatcgaaattttttttttttttggatttttgaggcgggcttggtatttgaaaagtgaaaacaccgctcatgttgttgtaacaaatg

SEQ ID NO: 109570 - DNA, 194 bp, Heterodera glycines
  Promoter: Source sequence=SeqID_7727; Location=616..809; Strand=-; Gene=SeqID_65756
tccaaaggaggggggagaggtttcatttttcatcacaatcatcatcatcaccaacaatccccgtagggatagactgctttttacaagcagagcgacttcatcttttcagtcatgacacttttttatatagcatatgagacaaaaaatatataatctaaaatttttaaatttttttagaccctagccaagcgatg

SEQ ID NO: 109571 - DNA, 873 bp, Heterodera glycines
  Promoter: Source sequence=SeqID_20489; Location=733..1605; Strand=+; Gene=SeqID_51031
aggggagggggaggatgaaagggaagaggaaaaagagaaagaagaggaggaattagcaaaatgaacattttcatggaataacggtgaaagtaaaatactttttgaaattaatccctttttcctttcaacacataatcttttttatcttttcatgaaccgctttttgccctttgttgtggttgttgcttttacttattttatattccataaaacgaagcgcttttactgaccgattgcccggacgaacaaatggcaaaaatacaaatagggcgcctcttaaaaactgttaagtttggtcattttgtcaaaaatgcataagcaagaatgtaaatatttgttttcttcactaagtgttgacctaactttgtcctttctttactaattaggtaattaattattcattagccgagtgggggcgggtgcccttttgatgaatgaatcagataagaaaagttcgtttctttcatttcccccaccctttgctatctttcatttatttttccttttctttttatcggtcgtatttgcattaaaaaaaaagtttttatttcattcattaaaaaatatagggttgctccccgagccctcgggggacaaaatgtcgggggccggggacctcggggagtgacacgtcgggggtcgggtcggggaataggtcccaaaacgtctcgggtcgggtcggagggctcggggtcggggagcaaccctaaaaaaatacattccataaatatttaaatttgtttttttatttgttttatgccgtagggcaaggttgaaataatttgaattgtgccaaagggtgggtgccgtttcaccttattgaagcattaggttaatgaaggaaggataaatagacaatttgcacttaaaatg

SEQ ID NO: 109572 - DNA, 137 bp, Heterodera glycines
  Promoter: Source sequence=SeqID_17237; Location=1057..1193; Strand=-; Gene=SeqID_81705
aatggaattggcatgcatttgccaaataaatattggacctttcttaaggaagcgatcagtcgttacaccgaatggcaaaatcacgtggaggggaacagagcacccgaactgccgaccaaattgagtgacgaaagatg

SEQ ID NO: 109573 - DNA, 262 bp, Heterodera glycines
  Promoter: Source sequence=SeqID_22034; Location=998..1259; Strand=+; Gene=SeqID_52672
aaatatacaaaaactaaaatttttaataaaaacgatttcagtctttaacttagggttgatccacgagtctcaagggaagaaaagtcgagattggtaagggaaaaatctcgatgcaatttattgggagagaaaattttcataaaaaattgagaaaaagataacagaatttttgatagtcttgggaaattcaaaagtcattttaaaagatgaaaattttgatattcgaatgaaaaaaattacttacattttccaggaaattatg

SEQ ID NO: 109574 - DNA, 85 bp, Heterodera glycines
  Promoter: Source sequence=SeqID_42254; Location=1..85; Strand=+; Gene= SeqID_70194
caatttcatggtaaaagtataaaaattgcagtcctaattagcagacttaacttttcttactttcgtccacttaaatttgaaaatg

SEQ ID NO: 109575 - DNA, 163 bp, Heterodera glycines
  Promoter: Source sequence=SeqID_12226; Location=1..163; Strand=+; Gene=SeqID_75800
gggaaaaatttttgtattttttaatgcgatttgttaacagaatttgtaaaaaaatgaccaattgattaagttttgggtttttaggatgcttaacatgaaagaaaaaaattggaatattttttaaaattaaaattttaattaaaataatggtaaagaaaatatg

SEQ ID NO: 109576 - DNA, 151 bp, Heterodera glycines
  Promoter: Source sequence=SeqID_1133; Location=3614..3764; Strand=-; Gene=SeqID_68376
tcggatgtatatgagtgcactaaatttaaataatgatgacactacgagtgtgtaaattatgtatttaagccccgcccattattagggacagtataatgttagattctcgtcattttaatgaatcatttctaaaatattgacccaaaaaatg

SEQ ID NO: 109577 - DNA, 117 bp, Heterodera glycines
  Promoter: Source sequence=SeqID_9945; Location=1..117; Strand=+; Gene= SeqID_72991
ataagggtgggaatttaagtcactaaaaatcttcaaaaagtcgactaaaaaagtcataaaaatcccaaaaacatttaactttaattcccagccctactaatcatttttaaagcgatg

SEQ ID NO: 109578 - DNA, 420 bp, Heterodera glycines
  Promoter: Source sequence=SeqID_13116; Location=23..442; Strand=+; Gene=SeqID_76914
attctttccaaaatcacaggcaaaactcaattcaattatcggggtcaacagaacacggatcaatttggaggccgctttcggcagcaattcggccaaaacaattttcgtggccgcaataattttcgagggtcgaactttattcctttgggcaatcggttcccgagacagaacggtggcgattttcggccaaattttgaccaaaatcggaatgaacaaaattggagaggccgcggaggaggtaattcatacggaggacgcggaggaggcaaccaaggacgcggaaggagcggctggcgtgtgaatgaagtcaacttcccattcatttgctttattgcggttatttcggcaatttttatacccgccactggacaataccaaatttgcccaactcagccaactgagggaattacggtgacaatg

SEQ ID NO: 109579 - DNA, 113 bp, Heterodera glycines
  Promoter: Source sequence=SeqID_426; Location=942..1054; Strand=-; Gene=SeqID_52249
ttttacttttttttaatggaattttctttttatttatagtttttcattttcatagattttaaatggatttaattcttgccaccgattggataaacaacgcttatcccgaaatg

SEQ ID NO: 109580 - DNA, 453 bp, Heterodera glycines
  Promoter: Source sequence=SeqID_11228; Location=371..823; Strand=+; Gene=SeqID_74592
ggttgagtcggcccattccttcacactttctttctccatatttccttcagctgctttacgccgcccccaacaacaaattcccctccggcgctttttccaactttggcatttttgcacatccatccgaagttcgaacaatggtcacgccagatttgaacactataaaaagccaaacagatcacattatctaaaaagaaggaagaacggccaacaaaacaaaaaggaaggatgtgttaaataaaatgaacttggggaaagttcggcttcgaactttaggattattaaggtttcgaaaaacgaacgaaatgttgggaaaatataccccataaaaagatgaacaatcggggaaaatttattcctagcctaaagacagttaggctttgttttttagattttcccaggttggtttaaatttaccaaaaattaattaaccttatagaaattacatttatg

SEQ ID NO: 109581 - DNA, 94 bp, Heterodera glycines
  Promoter: Source sequence=SeqID_8064; Location=1..94; Strand=+; Gene =SeqID_66861
aaaaaaaacttcagcaaaaataggaaaaaattttttgaataaactttgatctccaaactgacttcagaaagagcacattggcatcactcagatg

SEQ ID NO: 109582 - DNA, 936 bp, Heterodera glycines
  Promoter: Source sequence=SeqID_21243; Location=600..1535; Strand=-; Gene=SeqID_51835
tttttaattgcgctgtgcattaattaattggcgcccggaaaatgcgtcagtggaaaaagcgtcagcagaaatgcgtcagcgaaaatttattgccttaaaaacaagttccttgcgttttcgaggtcactgaccacgaatccggtatccattccggccaatttagcatttttggttcaaaaacggaataactgatgtcttattgacaggggtgcgatcgaaaatttttcaaaatcaggacatcgggcccaaaaaatcagatttttgaaaattttttgcggcgcatttttccaaaaaactttaaagtcaagcgacgacttttttgctttaaaaacactttttgcggcgcattttttcgaaaaattttggaggatggacggaggatccggcggtgccgataggcgccgcagggaaaaatttttgcgatttttaatcaacttgttaacagatttttgtcaaaaataactaaattttgccacaaatcttatattttcttgataaaatagtgacattatgccataaaatttcaaaaatgtgggtttatttaagaaatcaggacaaattttggtcgctacctccaaatcaggacagatcgcacccctgcttattgaaggattgatggatgtcagtttgttttcgtgtatttaaaccgattttgaagaaaaactctaatttcgaaaattttgactttgactttttgttcgaattcgggttcggggttcgaaattcagaacgataattataaaattatacttcttattacaataccaatactacataacttaatattaaaatatttttatcactaacgcattttctgctgacgcattttccactgaccgattttccggtcacgcttgtaactggactcaagcgacgtgctgctgagacgtgcgaagcacctgcgactattcgtgctcaagtgctgcaaaaaacatg

SEQ ID NO: 109583 - DNA, 290 bp, Heterodera glycines
  Promoter: Source sequence=SeqID_40119; Location=1..290; Strand=+; Gene=SeqID_68543
ccgttcatttcttttcataaatgaacaaagaaaaactgacaaacatttagaagtagcatcattcattcaatattgtcaagagattcgcttgcttttaatgttcttttccgtaaattttttattgaatggttcaaatatcaaccgttaatttaaagaaaaattggatatttttttttacaaatcgttacacgctggcttttgttcttgtccgtaaatttgttgaagtcgttaaaatatgaacgtcaatttaggcgctcgaagtgcagaaaaatgcccagcaaaagacgatg

SEQ ID NO: 109584 - DNA, 1003 bp, Heterodera glycines
  Promoter: Source sequence=SeqID_11600; Location=763..1765; Strand=-; Gene=SeqID_75051
cttttttttaccaaaaaaccgactgactctgcacaccgattcctagtgttaattcaagttttattctcataaaatttaaatatttttgcataaaaagaatcgtctggcgttaattgtgacctcatttaatgaaaattgaattcattttgttaaaaacaatttaatataattatttatgattttcaatttatttaactgaaaaaattgaacaataattaattatgttgttcaaattttgatagaaatgagatttttaggtgctaaaaattctgaagaaataggtacctaaatagttgctaaaaaactgcaaaaatagtttctaaaaattggaaaaatatgtaaataaatgtatgaaatttgaaatttccattcattatccatttcggttgcaacacagcaggcgttaaaagatgttgattgtccgccaaatcatggccaggattttttgctttttgaaaagtcggaaaaacttttgaagtcgattctaaaggctgcatttttatatttttatttacatttttcataacaagttttttgttcacaagcaaaaatccaaaaacagctgaaaaaataatttccagctggggtgtagtcaaaaatacaacaaattttttgataagattctcgaatcgagtatgaaaacatgctaacaaatgccggatttgagtgccaagatgcgaaccttcaggctcttgtacacaccgtttcaaaaaacgagatgtgtaccaataaatagagagtgccagagaaaaacattatctttttttctctaattttttgtctccttttggcgtactatctaatatttctattattaggaataacaacattcacttcgctctatagaactttttttccgccttacagaatttcttcatattttgcttatagatagagaaaaaaatactgcatctgtctatagtgaattcatttttgtctatggtcaaactcaaaagttataaattttataattaaaaaactattcttttatttagattttatg

SEQ ID NO: 109585 - DNA, 157 bp, Heterodera glycines
  Promoter: Source sequence=SeqID_20966; Location=1..157; Strand=+; Gene=SeqID_51544
aaagtgattataagaggtacaacagtgattagaagaggtgcatcagcgattagaagaggtacaaacaatgattagaagaggtacaaacaatgattagaagaggtacaaaagtgatagaagaggtgtaacagtgattagaagaggtacaaatttgatg

SEQ ID NO: 109586 - DNA, 472 bp, Heterodera glycines
  Promoter: Source sequence=SeqID_1875; Location=428..899; Strand=+; Gene=SeqID_76520
tttttagaaattgacctgaaaatcgcagtgttatgtatgggggttcagagtacaaaattatgaatggaaattggggaaaaggtaataatttattgtttaaattagagttgtacgggaccgggaattttgagaaaaattttaaattcttttattacaattttaataacaaaaaaagagagtttgccgtttttatgagttatttggttaaattcacaatttatagaacagacagaaatttcattttgtttgattggaataaaataattaatttcattaattaattggcagatgaattggtggaattattggaattgttttcattgccatcatttggctttaaattcaataaatttaatcatttgagcatcaccacaaccgccaattatgattcaaataatttaactgcaaaatttgcacatttggaagcgtcgaaaaatgtgaccactttttcgaatggtttttcagctcaatg

SEQ ID NO: 109587 - DNA, 268 bp, Heterodera glycines
  Promoter: Source sequence=SeqID_27481; Location=855..1122; Strand=-; Gene=SeqID_58167
aaaaaatatagaggcccaagaaaccatgattacttctagtaaaattcgagactctcgaactctgttgatcatagaagtgaggaataacattttttcccgtgaacaggactcgtgcccaatttttcgggtctcgaatttcgcaaaattttcggtatcgaacacattaaataatatttggccgaactcataaaatattaaaaaacaaaaataaacaaataaatttaatttgctttcatttaaaattatttctagacaaatactaaacatg

SEQ ID NO: 109588 - DNA, 422 bp, Heterodera glycines
  Promoter: Source sequence=SeqID_1095; Location=1431..1852; Strand=-; Gene=SeqID_67761
tcccatcaaaagtgccgttaagcagaagtgaatgggtgcgcgtcaccaatttgcctgaatacggtaaaaaaattataaaaattttcatggtatatatatatggttgtaaaaactcgctctttaggcctcaacgtgcaaaattttaattttatgtgtaacatattggtgtttctccaaaaattcaatcccaaaattatcttggggtttttgacaattttttctcaaggttgcctaaccaaaattcgaacatttcaatgaaagaggtgatggggattatttgctaatcagtaatataaaaggatttgagttaaaattctatggatcagcaggacaacatattttacagaaaataagggaggccgaaaaggcttttttagtttctgatcatgtttccggtcctgttaggtgatcaccaagaaatg

SEQ ID NO: 109589 - DNA, 420 bp, Heterodera glycines
  Promoter: Source sequence=SeqID_4752; Location=378..797; Strand=+; Gene=SeqID_55609
attttcactcattttttatattttgtttaggcttcttctcgcctgttcagtgcatgttgtccttcagagaaggctccatttttatggacaattacaaataaaaacgaaagatgaatcatcgaaactgtcctcccaaatttaataattataatatcttccatatgaaaaatttaaatgaataaagagaagccttttgttttttattttgttgaattttatttgccttctctacaagaatggaaatctgaattccacattaaaacacatttattatcatgtcgtccgtttaaaattagggcatgcgtgaggtcgaatttcgtcagggttttaccggggttctcggtcctgttattgaataaattgtgtcagtgaaaccatgaattacacggttttttcggtcgcagtcacgattcacgaatg

SEQ ID NO: 109590 - DNA, 418 bp, Heterodera glycines
  Promoter: Source sequence=SeqID_6173; Location=1..418; Strand=+; Gene= SeqID_60584
aatcaatttcacattattttggagtttctccggggaatttctcgcaactatcgaatgaacccgtgaatttctgttaatttttacattttttattgttaaaattattgttgaatttatttttaaactgtttattttacattttatgctgaaatttaaaaagttgtttttactgtgatttttcatttttctgtacttggggcccaaacgaccccggggcccaaaaacgagggcccaaaaactggggcccaaacgcccccgactcctttttgagtatttttgcgcagataattatggcacaacccaataatgcttcttcttttttttttgcagattttttgacttaattactcaccctttcctttttatagtcaaattcaacaaaaataataacattttctggcccagaaaatacgcaatg

SEQ ID NO: 109591 - DNA, 176 bp, Heterodera glycines
  Promoter: Source sequence=SeqID_1189; Location=949..1124; Strand=+; Gene=SeqID_69544
aacctaaggtccacttgctggtgaaccattttgtacccttcgcccgacacaccaatttttggcacttttggacgagcagggtcaaaaagcattttgaaattttagcccgaatttttttaggcgatgaagcattgcattcggtgtggaggcgtttggaacagctgtggaaaacaatg

SEQ ID NO: 109592 - DNA, 1003 bp, Heterodera glycines
  Promoter: Source sequence=SeqID_8887; Location=3112..4114; Strand=+; Gene=SeqID_69536
tctatcgaatcacagtttattttttagctgtctagtttttaacccgagatcggctcttctatttttacaagggaaaatccccaaaaaatttcaccttgcattttaaacctttcaaagggagcggggcggctcgtttcccccccgccgtttcccccccgaatcagttcccccccgcatcgtttccccccgagaaaatttaaaaaaaaaaaattgctaacttagaaatttttcaagaataatttatgagttacgggggagaatttataagagggaaacggaggcgcgtgaatagaagttacgggacaccttcgagatgcacttattcgtgacaacgttgtcgatgggcagagtttgttcgagttggcttctccggttgctagaaacattttgtaactatatggacaccatgccacagttgatggaaccttcaaagagacttaacccgaaaaattcgaatagtttaatttttataatattaagtgctccccagctcattttacccaagtctacacaatttctgtactgatcgataaggtggccgtcccctgtgtttatggcatacttaaatcaaaatcagaaaataataccttaatgtttgttttagatttttttaaattagtgatcagtgccaaaatttttaagatgttccaagcagttgttcaatcagtcccactcaggttttcccaaatgccacaagggtgggctgtcttttccacttttgccaggcggtttaccgcaaattacaacgcctgcctcaacttcacactcacttttttcaaaacgcagaccaacacacggatatttaatgttttttcgctcttgcctttgtgcctgttggtgaaccactttacaattatttttgtttgttggttcaccaatttccgcataacgaggaagttgaacgtatgtattaaaaactaatttgatgggctaattaaaatttctagaattggtacggtattttctgatcacatggatcggttgtcgggatgtgctaaacatg

SEQ ID NO: 109593 - DNA, 470 bp, Heterodera glycines
  Promoter: Source sequence=SeqID_13362; Location=1288..1757; Strand=-; Gene=SeqID_77236
tttctcaaaatttaacggttcgttcgtctattagcgccgttttttttgttttgtggaagacaaagaagcggatctgatcagcggatttgagaaagaacctttttgcttcaactttaaacatatttttgtgatgaaatgcacaggagacggttttcataagcatttaaccatcgttttgtgcttctcttattaatggttgtaaatggtttgcgtattttttaatttaattttattcattaaaatttgaaaaaaataaagcgtatttattgattatattaatttgaaaaaggaaggttgcaaaacctttttatttaatttaaatttactttaaagttaaaaaaagtatttagaaacggttgagcaaataacatttgatattgttaaaaatcattaaaagtgacaatttcttattaatgatacaatttaaataaagcctaaattaaataaattgtataaaaactttcaaaatg

SEQ ID NO: 109594 - DNA, 78 bp, Heterodera glycines
  Promoter: Source sequence=SeqID_19404; Location=573..650; Strand=-; Gene=SeqID_84129
agccattcgtcgaggaattgtcgacatgaaacaaccgtttgccgaaagtgcaagaagagtggccacttggaaaggatg

SEQ ID NO: 109595 - DNA, 159 bp, Heterodera glycines
  Promoter: Source sequence=SeqID_28448; Location=1..159; Strand=+; Gene=SeqID_59064
gtaaagcatgctttgactatgtggccaagatatcgcagaaggacaacaacagttcgatgaagaacaaagtgaacgcttttctgactgaagtggccgaacgaatccatcggttgaaacacgtacagaggacgacgacgcaccggtaaaagcaagggaatg

SEQ ID NO: 109596 - DNA, 73 bp, Heterodera glycines
  Promoter: Source sequence=SeqID_36008; Location=927..999; Strand=-; Gene=SeqID_65448
attaggcaaatggcggtggtgtaaagagactttgcttaatgggcatttgattggctattaagccattcagatg

SEQ ID NO: 109597 - DNA, 389 bp, Heterodera glycines
  Promoter: Source sequence=SeqID_10855; Location=396..784; Strand=+; Gene=SeqID_74134
atttttttgaataatcgaagatgaccgaaaaaatggattctgttataagctccgccccttttgctgtaaatttatttgttattccgcttcttcgttcgaatgaggtcattaacatttaaaatattttagcttatgggcggagcctaatttatttatctaagtccaccactaaattttctgtataaaagcacaccgctttgctcactttgttcattcgaacagaagaagaagccgaagaagcaacaacaacaaaaaataaattcggagccatcgactagcgcatccctttgaccaataaaaaaaaatatatttgttgtgtttttttgagtgtttaataaattttttattgttaccattattcaatcttttctcccattaagaattaaatg

SEQ ID NO: 109598 - DNA, 134 bp, Heterodera glycines
  Promoter: Source sequence=SeqID_5083; Location=3295..3428; Strand=-; Gene=SeqID_56834
tgttttcttttctctgaaaatggatttaagttttttttttactatattattttgtattatctcatgaggagacacttgacatatttaacatcatcttatctgtcataatttagcaaatatttcaatttatcatg

SEQ ID NO: 109599 - DNA, 712 bp, Heterodera glycines
  Promoter: Source sequence=SeqID_11673; Location=597..1308; Strand=+; Gene=SeqID_75141
agcactagcgctgtgtccaaccgttcgccgcaaagcgtcaggccggaggccacaagccgcgaccaggcactagcgcaccagccccaagcacggggttgagcactagcgccgtgtccaaccgttcgccgcaaagtgtcaggccggaggccacaagccgcgaccaggcactagcgcaccagccccaagcacggggttgagcactagcgccgtgtccaaccgttcgccgcaaagcgtcaggccggaggctacaagccgcgaccaggcactagcacgccaaccccaagcacggggttgagcactagcgctgtgtccaaccgttcgccgcaaagcgtcaggccgaaggccacaagccgcgaccaggcactagcgcaccagccccaagcacggggttgagcactagcgccgtgtccaaccgttcgccgtcaagcttcaggccggaggccacaagccgcgaccaggcactagcgcaccacgccaatatcaaaacaaaaaacataaaaatgaatgaatgatgaaaaatatttagacaaaattcaattcagtaaatattaatgcatgagaaaggtcagagaattgctggacgggcaaaagaaagagggggaggagagaacggggggttaattatctcaaaattcagttctgtacgatttttatttaaatatttttttataaataattttaaaaaactttttagatttttaaaaaaaaaatg

SEQ ID NO: 109600 - DNA, 177 bp, Heterodera glycines
  Promoter: Source sequence=SeqID_24285; Location=1348..1524; Strand=-; Gene=SeqID_55004
aaatcaacgaactcatccaggtgggctaagggggtatagccaacgttcaatttttgaaaaaccagaaaaattttattttcaaaaaatccgtatgctgccacgcgggtttgaacccctataactgtttcaggcgaagtccgacggcgcccgaaatttgttggaatgccaaaatgaatg

SEQ ID NO: 109601 - DNA, 531 bp, Heterodera glycines
  Promoter: Source sequence=SeqID_12690; Location=1465..1995; Strand=+; Gene=SeqID_76372
tttgaaagggcggctgaggggaaaaagcgtcggaggaacggcacaacgcattttggccttgaggaaaagccacggaaaatatgagccgaattgtttcagtttaacctttagtattgtcccattgttggcgcaaaaccgaacaaaaagtgagaaaaaggccgaccaatttttgatcaccgcgtgaggcggcgatggcaaaggcggagggacaaatttgggaagggccgaagggaagggacgaaaagggcaaagggacgcagaggaagggattggcaccggcacggagcaaaagctcacagagggcaaaattaccagtcgaagcagcgatctgaaggaggaaaagggaaaaagatcagaaaagaggaatggcaaatgaatgaaatggccaatagccttttcccttccccccatttgtcaaattgttcaattaatttgaattgaaacattcgaaaatgatgcccctgggcattactctcccccccccccccctctccatcaaaaatttttttcctctcccttcccacctgaatg

SEQ ID NO: 109602 - DNA, 65 bp, Heterodera glycines
  Promoter: Source sequence=SeqID_1312; Location=2999..3063; Strand=-; Gene=SeqID_72327
aacaaaagaagcaaaataaaaatttgaaatttgttaattttcttcaaccaaacggtgatgaaatg

SEQ ID NO: 109603 - DNA, 148 bp, Heterodera glycines
  Promoter: Source sequence=SeqID_43708; Location=1..148; Strand=+; Gene=SeqID_71314
aataaatctggcacatttagtggagtttgtccaagtctgatcagcaattcaatccttttgtataataaatctgatcagaattgatcataaagtttgtccccattaagcgctgaccgacccgagcattcactacggatttcatcggatg

SEQ ID NO: 109604 - DNA, 319 bp, Heterodera glycines
  Promoter: Source sequence=SeqID_8401; Location=4344..4662; Strand=-; Gene=SeqID_67938
acgaaaaaaaaaaaaaaaatttttttttcgaaaaatttgctggaaagaaattttcctacaaattatattttaatttttttttcaaatatcctaggactgggacatccctgtaaaattattgtacacccataactccctcatgcaaacttttcggcacaaagccaaaaccaaggtcccgtcctctcatgacagggaccaatttttaacaaatttcacaaaaaaaaaatttttttaattttaatttttacaaaagttggtggcatagtctggtgctgctgctgttgtgcatgatgattgtgaaatgctgatgaggaagatg

SEQ ID NO: 109605 - DNA, 341 bp, Heterodera glycines
  Promoter: Source sequence=SeqID_43131; Location=1128..1468; Strand=-; Gene=SeqID_70880
tccattggtcgggacaatgactaggtcctggtttttcttggccttttttaattttctggtacgctgaacacaattatagcctttatctcggccggccatttcataacccttgaccaaaaaaacataaaatatagggtttgtacagtctgtaacaaaattacaggccataaatttgaaacactaaaaaacgttcaagtataaatgtccaataaaaagtttaaaattaattagtatattatgccaaaattcccttttatcagcattattatttttttattttttaggatttgctttttcgtatttaatttacgtaaatgtaatttcagctaatttttaagatg

SEQ ID NO: 109606 - DNA, 126 bp, Heterodera glycines; identical to SEQ ID NO: 103918
  Promoter: Source sequence=SeqID_22451; Location=299..424; Strand=-; Gene=SeqID_53123

SEQ ID NO: 109607 - DNA, 1003 bp, Heterodera glycines
  Promoter: Source sequence=SeqID_13925; Location=1429..2431; Strand=-; Gene=SeqID_77878
tgtcgcaaaaaacgcttattagagggtttttaagggtcaggaaaaccgattatgacttcgatttcgatcaattccgaaccccggacacgatttctaacaataaatcgaaaattcatttttaactaaagttcatcttttgttccaaaaaacgctttttaggggttttaagggtcaggaaaaccgattatgacttcgatttcgatcaattccgaaccccggacacgatttctaacaataaatcgaaaattcatttttaactaaagttcatcttttgttccaaaaaacgctttttaggggttttaagggtcaggaaaaccgattatgacttccatttcgatgaattccgaaccccggacacgatttctaacaataaatcgaaaattcatttttaactaaagttcatcttttgttccaaaaaacgctttttaggggttttaagggtcaggaaaaccgattatgacttcgatttcgaaaccccggacacgatttctaacaataaatcgaaaattcatttttaactaaagttcatcttttgttccaaaaaacgctttttaggggttttaagggtcaggaaaaccgattatgacttcgatttcgaaaccccggacacgatttctaacaataaatcgaaaattcatttttaactaaagttcatcttttgttccaaaaaacgctttttaggggttttaagggtcaggaaaaccgattatgacttcgatttcgaaaccccggacacgatttctaacaataaatcgaaaattcatttttaactaaagttcatcttttgttccaaaaaacgctttttaggggtttcatggtcggaaaacccgattctgacttcaattccgaacccaggacccgatttctaacaataagtcgaaaattaattttaaatgtgaattttgtaattaacaagtaagtacctaaatttatataaaaggcctgtgctcctcagtttcaattcacttttcctcttctcttaatcattatttgctgctcgatg

SEQ ID NO: 109608 - DNA, 648 bp, Heterodera glycines
  Promoter: Source sequence=SeqID_34461; Location=400..1047; Strand=-; Gene=SeqID_64244
tttcgtcaacaatattaaaacccacaataccattcgacccaaatttgttttataatttttatagccatttaacccagacctgagaatttatcctcattttgtggttttgataggtcagtgaggattcttttttaatgaggatttgaggatttttatggctatgagaaattttgaggcttttggggaaaatcgtcaaaacttttaaatttagtgattaattttaatcaatttggcataatgtttgacaatcatttaataatttggtttttaatagagcgacattttgataaaagcatttgcttcgaaattacagaccgttattggtgtgctgcttggtggcattaagatttttttaaaatctgaaacagaaaacgggaattgacaatttagcctagaggaagcaatcgcgacaattttgaacattcttgctttttaggtacatattgaacggttaagtcccagttctgtaactctgtttgaactgtcgccgactcctaaaaattgcaccattcaatttctcttacaattgctgagagaattgcaaattaaaatttggcaatttcttcaattttattttttagtgtttgtaaattgaataaattacacatattccctccctattcgctcgctgccttttcctgaaaaatg

SEQ ID NO: 109609 - DNA, 843 bp, Heterodera glycines
  Promoter: Source sequence=SeqID_32313; Location=1258..2100; Strand=-; Gene=SeqID_62618
aatacttttaagtaatataaaaaactaacttaataaatattcataaccagaaaatcctcaacgaacaaataaaccatcttcagcttagagatgaacaactagtagggggagggcagtcaagaattttttaagactgaactaaaatttttctcgaaaaataaataataaatcaaatgatataaaatttacctttgtataataatttattaaaaaagcttttataatgataattgaactaacattttccctgtgaatatataagctaacaggaaaacataagaattgctttacataaaaatgaattggcaaatctaaatgttaataaatcacaattatttctgattgttgggtagtgaataatttgaatttatggcgatctgacttattgactttatttgttatttctatgtccatccgccccctccctcgtccataaaagtggacacctcctcccattatttgttctttcctttcatcattcatttatattttatttcccaatttgccctccgaccgaatcaataaaattatttatttatttatttttctttgtgtgttctaagtggaagaacacaacaaattggcgcagtcagcagcctttcttcatcactgaggacaaggaccactgcaaattcaacaaaaaccaatagcacccaggtggtgtgaggtctgctaagaagcagtttaactcaaaaaaaaaccaatagacctaagaagggtgaggttccgcaagaagcgtttttttcaacaaattcgtcagcttagcaccaagacggtgtaagcatccaccaggtgtggattttgtggattttttttttcaacaatttcaattgacggacaatg

SEQ ID NO: 109610 - DNA, 1003 bp, Heterodera glycines
  Promoter: Source sequence=SeqID_12763; Location=2544..3546; Strand=-; Gene=SeqID_76473
tatgacattcatttcacgaattcaaacaaaaagtcggaattcaaactttcccttttttgttcacgctttagctttttattttgaaactaaaaataaaattatgggcctaaacacaaatagagccgatatgggtttagagtttccttttgtcgagggtcatagattaaaaataaaaaaggaaattttttgcaaggcgaagtggggacaaatttccaactacataatttcgtgatttttttgttgcccttcaagcaattttacggggcgcatgaatgagagaatctgtcaaaaatacggatgttttttttaagattttataccaaatggcaagtgatttttggttcaaattgaaaaaattaagtttttggggtccttttttcgggtgcaccccaaaatctcgccgccgaaatctcgccgccgaaatctcgccgccggaatctcgccggccggaatctcgccggccgaaatctcgccgccgaaatctcgccgccggaatctcgccgccggaatctcgccggccggaatctcgccgagacaaaatctcgccgccgaaatctcgccgccaaaatctcgccgccggaatctcgccgcagaaatttcaaaaaaaaatttcaaacttagaaatttttcaaggaaaaaattcttagaaaaatttttttataagaaaatttaaataaaaaaattgttgaaaaatttttcagcaatttttcagcaattttttttgaaattttatgaaaatttactgttttttttttaattttcaaaaaaacttagcaaatagtttttttttggaattttcttataaaaaaattttctaaaattttttccttgaaaaatttctaagtttgaattttttttttttgaaatttctgcggcgagatttcggccggcgagatttcagccggcgagattttggcggcgagattttgtctcggcgagatttcggccggcgagattccggcggcgagatttcgtcccgtcccctaaaaaggggggagggatg

SEQ ID NO: 109611 - DNA, 815 bp, Heterodera glycines
  Promoter: Source sequence=SeqID_25765; Location=1..815; Strand=+; Gene=SeqID_56505
attttatgaaaaaatctaaaatttttggcattttgtcccattatattaattttttactaaattaacctagaaatataaaattttcagtgaacatctgtaaaaaaggtcaaaaggtctaatttttctcccggcagcgccaatggctccgtccatcctccccccaaaaaaagaactcactttttttaagaaattgtcgcaaaaattttcttattttttggtgaaaatctgttaaaaaatctcacaatcaaatcttcaaaatttttacagcggcgcctattggcaccgccgtacccctccccctcaagttcccaaaagtctttttgaaaaaccgccgcaaacattccggtgaaaaatagatttgaagttaattaaccttttttaattttttttgttcaaatttttatgtgtactttgatttcataaatttcccacgttatgtacttggaaattggtattagcactgatctgagcccggattcgtgatcagcgacctcaaaaaccccttaaacttattttcattaatttctaaaacacatttattggcatctgaaagtgtatgtgaatctgccccgtaaactaaaaaagtaccattgtttttcgttcatttctgaccattaggcaaacccctaaaatctatccctagtaatgatataaaaaataattagcttacctatatgtattggaatttgattttgaaacaaacgaagcttttgaaatagcaggctaatagaaaattataaattgattcaattcggttttttcctcgaacagattttttcaattttgcatttatataaaaatttctatcaaaaatg

SEQ ID NO: 109612 - DNA, 276 bp, Heterodera glycines
  misc_feature (31)..(31): n is a, c, g, or t
  Promoter: Source sequence=SeqID_16790; Location=1896..2171; Strand=-; Gene=SeqID_81209
atatagaaaaaaaaaatcgattttctctacnactgatgtttagacagcgagaaaagtcagacagtttatttagacaacaccgtaaaaaatgaattgggctttgattaataatacaaaaatcaaaaaatctcaatttcgtgttttccgatctctgccgaggtccctttgctggtgccgccgcacagtgccgtctccgcgccgcacgattggccccgcgtgttccgcctcggccccgcttcgtccgtccggttccattcccagcgggcgcttctcatg

SEQ ID NO: 109613 - DNA, 1003 bp, Heterodera glycines
  Promoter: Source sequence=SeqID_30554; Location=310..1312; Strand=-; Gene=SeqID_60970
taggtgtctaatttccggcattttgtgccaataaaaagaaatcattgtgaattcaatgaatttgtattgttaaattggggataaataagggacggcctttacatcacgcaaaaatttagaattttatgtcacgcaattcttttcaaaagccaaatttttatctttaggttttcggtttaaaaggaaacgttatttaataatttccgttttttattcttagaaatatttaaaaaacattataattatcataaatgaatagaaggtataaaaattcttattatattatttttaatcggtgagaaaaaaaattcaaaaaagaaaatccccaattatgaaatttcgtaaaaaaacacataaatttacgttttttattttgttaattttgattttgtattaattttttataataccattttttaaatatttattttcaagaatgcaataaaaaaaagcaagctcactacaatttttttttgttaattttcaaaaattggtgcaatttcttattattttttgaccgcatagaaacaaaacaaaaaaaaattcaatttttttctcgaattcgtatataaaataattagggctgcgatttttagacaaatgccaaaatttctgcgcacttaatacgctcaaataagcacgaaaaacgtattttccgcttggtttggtgtgtctacaatgacttttataatgcctaagtttgcctattttggactttttgtgcttaatgcctaaatgcatatttttgtgcctatttcgcttaaatttttcggtttttaaaaaatcaatttagcatctgacaatgaatgctgttggttatttagaaaaaaatctaaaaaaatgtaattcacgttcgttttatttttcttttattaatttccattttatatatctctatgttaatagtgcagattgaatgagaaattatcagaacctagataaataatatatgcttagataaattgaaatttatttaaatcccgaaaaatcctatttcgaaatg

SEQ ID NO: 109614 - DNA, 106 bp, Heterodera glycines
  Promoter: Source sequence=SeqID_1739; Location=1186..1291; Strand=+; Gene=SeqID_75627
acattgactttgtcgggcggggggcagtccaaatttttgactatttggggacgcggcacgaaattaatgggcgaaaagcagcgaacggagcgagcgaaaacgaatg

SEQ ID NO: 109615 - DNA, 76 bp, Heterodera glycines
  Promoter: Source sequence=SeqID_9429; Location=1..76; Strand=+; Gene =SeqID_71377
aagtttcattgacagtaagcaattctttgtcagtcgttaggactcaatttatggctgttcttcagaagaggagatg

SEQ ID NO: 109616 - DNA, 349 bp, Heterodera glycines
  misc_feature (22)..(22): n is a, c, g, or t
  Promoter: Source sequence=SeqID_5018; Location=4603..4951; Strand=-; Gene=SeqID_56592
ataaatttttaataaaaaatanttgaatacaaaaaattcattttggcttattaaaagaagttaaaattgaagaaaaccaaatttatatttcaaaattaatgtaattattaaataaaattattttaaaaaaatataaaaataaaacaaaagaaatgttgatggactatcttttaaaaatatggagtaaaatttaatttttttttttttaataatggtattcaattcataaaattccaaaatttatattaaagaatttaataaaagaattaactacggctaatgtaataaaaactaattgcattttcaataaaattatataaataatttgaaaaataattgataaaaaatg

SEQ ID NO: 109617 - DNA, 67 bp, Heterodera glycines
  Promoter: Source sequence=SeqID_10173; Location=1003..1069; Strand=-; Gene=SeqID_73278
agtgcgtttgctttgtcacttttcgatttctgttttcattttttgatctttagacctcacaacgatg

SEQ ID NO: 109618 - DNA, 573 bp, Heterodera glycines
  Promoter: Source sequence=SeqID_10971; Location=178..750; Strand=+; Gene=SeqID_74278
aacaatcgactgaataatgcctcctttaccgttacacgtttatttgctgattttgttggctgttctttgatttcttatgcaattgatttactctttttttgtctttattaaatgtaaatgactacggtagtaaattcaacaacagttttaacatttattacaaaatgattaaactaggtaattttattcactagctacgctgtatacgatatttgaccccgagagtcgaaacatagactcaaaaaacacgggaattgctcaaaatccagccctactgataaggtgttagttaacaaattcaaatatgtcatgttggccttttgcctttttggttgtggcaaatggaaatggaaggatcgcatcactcattcattctcttgtcatttgtcagttgttgcatttccatgtgtaaatatttaaaccgagttttgttttgtttttctgtgtttctctttgcctttgctaatttctgttcaatttcagcagcagtcaaacggcgcgtcggtcccatgagctgtttgttgctcatgtccaaattcgcagcgagtaaactgcagctgttgcgcaacgatg

SEQ ID NO: 109619 - DNA, 376 bp, Heterodera glycines
  Promoter: Source sequence=SeqID_21658; Location=1333..1708; Strand=-; Gene=SeqID_52261
tttttgggtaatttaacttaagaaccaacttaatcatttaaatgcgagaaaaattattaacaaaagttttgatggagatcttttacatttgtgttttggtatggtcgaatcccatgctaaaatactccaattgctattagggtatgacatctgcattaattataattataaccaattattctttaatttttacaatctgaatatttctggtggaaagaagggttatgatggtacttaaattatgtgccacatttttgttgtaattcaatgaagcagaatacttgaaggctgagacaaaggaaatgatgaacactacatgagtatgataattgttgacagattaacttagttatggtattgatggctaggaaatatg

SEQ ID NO: 109620 - DNA, 556 bp, Heterodera glycines
  Promoter: Source sequence=SeqID_25031; Location=1..556; Strand=+; Gene=SeqID_55764
attcacttttacgttcatatctgcacagaataatattttttgatgtttcaatggtttttgactggatttagcttgttttggtcaattttggaacaaaagtgagaattttgaaattttttaattttcgactttttgttcggattcgggtccgggattcggaattagtcaaaatgaatgccagattcgtgatcagcgacccagaaaaccccaaggaaatgtgttttacacggcttttttaaaaacttttatttttttcgaaaaatgggggggggggggtaaacttcagtattaccaaaataagtctaagcatacaagcctaacctaagtctatgttcatcgccttttgtatgaattgtcatgactagagatgggatttttaggtttttacctatttttttgcggcttagttatgatgatagaagcccaaaaatagcattttcttcgaacaattgcgactttttagcatctaaaattactaaaactggattttcggtcatagcacctattttggcatttttcgagttttaacacctattttggccttttttcagaaatg

SEQ ID NO: 109621 - DNA, 307 bp, Heterodera glycines
  Promoter: Source sequence=SeqID_4413; Location=2187..2493; Strand=-; Gene=SeqID_54362
aaaaaaattcatcatctgtccagcggatccgaacccatgacatatggtcattaaaatgcaagaggaaaaaaataatcaaattaacaaatttttcctgggattttcatttgatcacttttttcagatcatttttggggtcagggccaaaaaaacccgaaaattggcaatagtaaatcgaatatgctctacaagataaaagtggtcttaaagcgatctgagcagtcacagttcggaatgttcccttgttagaaaattttcaaaaaaatttaaaaaaaaaattttgcatttaatttttttgcaacagatg

SEQ ID NO: 109622 - DNA, 485 bp, Heterodera glycines
  Promoter: Source sequence=SeqID_11309; Location=1772..2256; Strand=+; Gene=SeqID_46947
ttaatacactccatccatttaatgaccagatccaattcacatgcgaaatataaaaaaatgattaattgaaaatttaaaacaaaattaagaataaaaatgaatcaactctatcaaattaatttttttatctctttgtgttacctatttcagcttctttttccatatttctctaattaatttttcttctcgtctcacagttcacgtgtaaattttataatttaaagaaatttacaggcaaatcgtttcgtaaataaatcaattaggatctttgttatctgcagatttgcaattctaaaaaccaataaaacagactactaaaaaaaattcttagaaaagcttaaatacgcataaaattcctaaaaagtatgtttttcttgagttgacagacaatgatacaatacgatttactttcataattggcagttcaaaaataggcaaccgttttttaggtgttattgaaaaattattattacaaaggaaaaatg

SEQ ID NO: 109623 - DNA, 77 bp, Heterodera glycines
  Promoter: Source sequence=SeqID_44787; Location=1282..1358; Strand=+; Gene=SeqID_72212
ttcacccgtttgttgctgtacgttgggctgctagcctccagactggggtttgctgtccttctgttcagtggcgaatg

SEQ ID NO: 109624 - DNA, 70 bp, Heterodera glycines
  Promoter: Source sequence=SeqID_17916; Location=792..861; Strand=-; Gene=SeqID_82472
cgaaattcgcaacgattatgacgtgctgaacaaccgaaacagaagcgacatcgagtcgtggtacaaaatg

SEQ ID NO: 109625 - DNA, 195 bp, Heterodera glycines
  Promoter: Source sequence=SeqID_12063; Location=1..195; Strand=+; Gene=SeqID_75607
ttagtgcactctttctttgcacaatagggcaattcgccctttttaagatagctataaatcaatcattccaattagaaaatgttaaatgtaataaaattatttgaatatttaatattaaatatgacttaataaaagaattacctcagaaaaatatttaggcccttctacgagggcataattttctgcgcaacaatg

SEQ ID NO: 109626 - DNA, 991 bp, Heterodera glycines
  Promoter: Source sequence=SeqID_4853; Location=4002..4992; Strand=-; Gene=SeqID_55958
ttatttactaatcaaaacgtcattcttttgattacatttccctgtcgccgatttccctcccaaattgttgcgatcagtccgtttttttttcggcacaactcaaaggtttgtgtgttgtgttgggatgactagttttggcgcacccgattaggagagaaaaaaatgaaaatgtaatggcagatgaaatctacggctaaaatggccaattaaaaattcaaattttatagcgctaatcaaccgcgacctttttgcagattcttactcgtggtaattaattgctgtgattgatgagagtaattaatttaaaagatgcatttatcatcaatcatttcatttgtcccatttcaaaattgtgttaaaaacgacggtttttcggaaaaattcttcccattcactgatgaaggtcgaatgaatacttttgaaagactaaagatttgaacaaggaatttgggtggggaaacttcgctcattttgccgcgtctctctcattgtattttaatattaaaagggttggcatgtgacgcagaaagctcaaaagtcatcgggacattccatcattttcaaataaaatttaaaataatttttctttttaaatagaaaagcttttgagaaaccgaataaaccaaaaatgataaattcaacacgatctaaagagatttaatcaaaatctaaagtgtgccgagagttctgtatttttgtcgaaaatcaaattatatcggaattagggatacggttttttaggtttttacctatttttttcctgaagcacctaaaatctaaaaaaattgaaaaaactattttcaattattttagcgtttttcctaagatttattgggacccacgcgtttcggcgcgctcgtttcgacgccagctcgtttttccactatagcttttatcattcgaaagcttttaacatgctctatctctctatctctctctctctctctcatttatcagagaattctctcccccgatttatgggagaataatg

SEQ ID NO: 109627 - DNA, 614 bp, Heterodera glycines
  Promoter: Source sequence=SeqID_8244; Location=867..1480; Strand=+; Gene=SeqID_67414
tttgaaggaatttaatgctataagtatgaagaaaagattaattcattgaattgttaagcgatgttttggtaatactgccgatggttgccccattttttgaagtttttattattttcaaatcatgaaaatatgcttccaagcgttttaatggtcgctgctcaagaattcggcatccatttcggtctatttcgaaccctgtgcccgaatttgaacaaaaagtcgaattcaaaaatctcaaaattcacatgttcgaatttgtgcagaatgaaaaacattatgaagtaaattagatatgtatgttttctctgttaatagagaaaaataaatagtacgataaaatgagagatgttttttttcttcactctctatttgttggttctctctcattttatgagaaggcgtgtcaattcaagtgccctttgtatattattaactttaacttctctttcttctcattagttggtacaggatttatttcgtaatacataatacgtgatcaaatgtattccttatgtcatttcattaattcagacaatttatctttagttcgtttttcccataaagaaattcagacagaaaattatttaacttattccttaaaccaaaaaagcatg

SEQ ID NO: 109628 - DNA, 421 bp, Heterodera glycines
  Promoter: Source sequence=SeqID_21847; Location=726..1146; Strand=-; Gene=SeqID_52477
tcttgacaaattaataaaatttaaaaaaggaatcaatcgggtcaggaggacaaataatataaaaaattaaataaattgaacttataagcatgagattttgaaaaagcctggacccatcttggtctgggcctgtattttcttgacataacaggaccaggaaaccccaatcttttcgagacctgggttttttctcgctcaattttcgagatatatccgtgcttttgtatacaaatttcccaaaaaatattcaaaattccaccggcggtgcctgctagcaatgtcggaaaatatattctttctttttaaaacataacgattcaaaaaatctagtcccaattccaagagtcacgttaattttcgtatccaactaaatttttttttattgaaaattgtaaaatattttttacagctctctctgatg

SEQ ID NO: 109629 - DNA, 109 bp, Heterodera glycines
  Promoter: Source sequence=SeqID_5518; Location=1578..1686; Strand=-; Gene=SeqID_58315
tctaagattgaaaaaatgtaagtttgaacccaattttggacataggcgcaaataattttaaaaattagttgaaatataatatttttaggtatttccacaaattgaaatg

SEQ ID NO: 109630 - DNA, 68 bp, Heterodera glycines
  Promoter: Source sequence=SeqID_33423; Location=866..933; Strand=-; Gene=SeqID_63497
tttgggttttatccaaatatttcagctttttttccatttttctcctccacttttcttttttgcagatg

SEQ ID NO: 109631 - DNA, 198 bp, Heterodera glycines
  Promoter: Source sequence=SeqID_39539; Location=743..940; Strand=-; Gene=SeqID_68088
gaataaaaaagtaaatcaattgatcttttatatgacaattcaatataagaaaatgaaatatgttttgtgatttaaacatgtctttataatgatagaaacttaccgatctgagaggcgttcctcttgtccaattatcggcagctgatcaaatggtggacagatcggtcgaaaagcgaagagagacgggggaggccaatg

SEQ ID NO: 109632 - DNA, 163 bp, Heterodera glycines
  Promoter: Source sequence=SeqID_13197; Location=332..494; Strand=+; Gene=SeqID_77025
tcagctttcggtggagagtttgatggaaaaatgccagaaactgggcagcggggagagaaatgccaaaaattgagggagtgccggtaggaagattacggaaacggaggtgacaaaaattgggcgaactatgcctgaaatctcaaaaaaaaattaaacgaaaatg

SEQ ID NO: 109633 - DNA, 142 bp, Heterodera glycines
  Promoter: Source sequence=SeqID_6032; Location=2680..2821; Strand=+; Gene=SeqID_60076
tttcggcattttgtgtgttttgtctgtatgtctattttttgcctcctgcttttcctctcccttttatcccctttagctgcttcttcttgactttttcctctctccccttttggcattttcctcccctctctcccccaaaatg

SEQ ID NO: 109634 - DNA, 592 bp, Heterodera glycines
  Promoter: Source sequence=SeqID_11935; Location=955..1546; Strand=-; Gene=SeqID_75455
tgccattcccgccgcccttctcgtccaaagtgcagcgcaaggcaatttcggaaagtgcttaaatttgtgaaattacacacattcattattttgtttgatgacacttttctgttgcgtcgattcagtaattgtcgtcgagtcgacagagcacggaattggagcaaagagaacattcaatgggtaaatctgagccaaaaagggacgtatgaaaacggacgattaaatgggaaaagaaagggaggaaaggaccgggttgacggagaaacgcgcgacaaaattgtcaagggcaaaaaagtgggaatggcagtgaaaggtgcagtggtgacactcggccaagtcgatggacgaaggaaagggggacacctggcaaagagcgatgaatggacaaatatgggaagacaataagcaaaaaaaacccgacccaatgggacccattggccaaataatcgacaaatttagcaaaactcaaatggaacatttcgtccgtcattttggcaatcgacgaatttgcagaacaacttaaaatatgacagagcaatttttgccataaaaacaaaaagcggacgcattgcaacggagccaacaaatgatg

SEQ ID NO: 109635 - DNA, 474 bp, Heterodera glycines
  Promoter: Source sequence=SeqID_26023; Location=1..474; Strand=+; Gene=SeqID_56772
ttccttgtagaatttctttagcatttttgttgcgataatttaaaaacgatgaatatacaatatagttggtcctcattttagcaacgccactcaatcaattaatagatactcaatgaattcataagcacatcattctgacagttgccacaataagacgttgggttgtgagtctgctgcagaagaaacaatacagaataagtcactaattatcaaattcaaggacatgaatatgaaaataaaggattaaaaattgttgtgtgctcgataaaagaaggagaaaatcagtaaatttaggaacttaaaaatgcaagggtagagcatgcataataagacacaagtaattgtatattataatatgatgcatcagcacgatttgtagaaagtgtatcagatcgttaggcagtttcatttaagctgaacgatataatagatattcagtacaattctatcgctatagctcttttaaaagcaatg

SEQ ID NO: 109636 - DNA, 59 bp, Heterodera glycines
  Promoter: Source sequence=SeqID_2811; Location=2065..2123; Strand=+; Gene=SeqID_81740
taatctaaatttttttaattgataatttatgtcttctttgttttaggtttattaaaatg

SEQ ID NO: 109637 - DNA, 360 bp, Heterodera glycines
  Promoter: Source sequence=SeqID_21198; Location=1337..1696; Strand=-; Gene=SeqID_51788
cagataagcacaaaatttgccatttggccaatgggaattatgctcattgaaatttcatttgaccattttcttgctcaacaaagagaggcgccgttaattgaagtgagaaaaaggaacatcactttagggggggcaaatcaaattttggttttttcaatttacacttttgttttgaattaggatatttttaaatctgcccacagataacacacaagtacctttttttgtacgagttgccatgaaaacttttgttttacaaattttgtttagacatttctccgtgccaccacttctgtaagttacaaaattcaattttattttcttgtgaaaccaacgtcaattgaacaatttgaattgatg

SEQ ID NO: 109638 - DNA, 307 bp, Heterodera glycines
  Promoter: Source sequence=SeqID_14635; Location=794..1100; Strand=-; Gene=SeqID_78723
aaatgattgagttaaataaaaaatgggacaaatataaatgcgttgagttaaattcaattagctgtcatatgaccaaatgacggaatgtacaaattagaaaagaataaatgatgaaatggaaagaataaatgatgaaatggaaagacccagaagtggaaataattaaatgtcacggggaacaagccgaatgtagtatgtgtggatgatgattgtgaaaagagagagacagagcgaaaataaaagaacagagaaatgcagagatgtaaagagctagctgtatgtggaaagaaaaggaagcaaaattatg

SEQ ID NO: 109639 - DNA, 383 bp, Heterodera glycines
  Promoter: Source sequence=SeqID_1484; Location=1462..1844; Strand=+; Gene=SeqID_73832
ttttcaaaggtgggagtcctttttcggatgctcaatgggtgccggtgttggatttgtgcgagatcaaatgcgacgaggaaagggaaatttgtgtggagaatgacgaaatgaaacagcagtgctccaagtgtaagagagagggaaggggaaaaactgtcccaattacggcgagggaaggatttaatgatcgggcaaatggccatgatcagactatttttacttgatcaacaaattgggaatgatcggaatttcctgctgatcatttagacaatgaccagactattacttccgctgaaaagacaaataccaactgatcaataaagtcccttagtttggataacacttaagattatgccagtaaatatgaatttcagtgccggatg

SEQ ID NO: 109640 - DNA, 140 bp, Heterodera glycines
  Promoter: Source sequence=SeqID_4825; Location=689..828; Strand=+; Gene=SeqID_55860
tgtaaaaaattgaaattttctaaaaaaaactttaccaatttctcaccccctctcccacttccatttttaggcttgtgtcgcccaaattggtactgacccggcacttttggaccgattggcaaagccaacagttccaaatg

SEQ ID NO: 109641 - DNA, 71 bp, Heterodera glycines
  misc_feature (14)..(14): n is a, c, g, or t
  Promoter: Source sequence=SeqID_41441; Location=1008..1078; Strand=-; Gene=SeqID_69558
cacaacggaagaancacttgaaggccaacgaagaactcaactagttctacggcctcaacatcattggcatg

SEQ ID NO: 109642 - DNA, 174 bp, Heterodera glycines
  Promoter: Source sequence=SeqID_10813; Location=2486..2659; Strand=-; Gene=SeqID_74077
tttattctctgtcatctattttttatttattatattttattcgtttcttgcggacttattttatttattaaagtttattctttaaaatggaaaataaagaaaataaaaaatgacagaaaaagagaaaccgaaaatggaaaatgatttaagaaaaaaacgacagaaaagaaaatg

SEQ ID NO: 109643 - DNA, 85 bp, Heterodera glycines
  Promoter: Source sequence=SeqID_45409; Location=1243..1327; Strand=-; Gene=SeqID_72705
caactgagtcccggcggctaatttctcacttttgctcttgtttgaaggcccgtaactttttttctaaaactctgatcaaaaaatg

SEQ ID NO: 109644 - DNA, 648 bp, Heterodera glycines
  Promoter: Source sequence=SeqID_8383; Location=662..1309; Strand=+; Gene=SeqID_67877
tgcaactataataattatattgtgcttttttttttgtttgtttttttaaatttaattcgcaatttttcatcgcgggattaatttaattgatatgtaatattcgaatgaaatgatatgtttttatgctcgagttcttatttaaatgcaaagtttttctacacaccagaaatgtgaattttaagtttttgaagaaatcacttattggcatggaaatcctacacctttctggattataaaaaaaaatattcggatttttcgaaaaaatcaagggcgctttcatatgacatagaattttcgttttgatcaatagattcatgattagcccactaccttaaaaaaagttttggtttgtcggaagggatcatgtaatttttaggaagttgcagcatagcggtttccatttcaaggacagataaagctaaaacatatttccgtttcaaaattccacaaaatgacgcatttgtcaaactgaacaaattgagggattaacgaaaaaaatgaaaatttaatttgcttagctgtgattctgtgatttgaatgggaaatgaaagcacataaaaggagcgaatgaatcagtgaaattattcaactttaatttgactgtgcttccgaattgtcaaaatcattaattaattatcgcaaataatg

SEQ ID NO: 109645 - DNA, 330 bp, Heterodera glycines
  Promoter: Source sequence=SeqID_4567; Location=6993..7322; Strand=+; Gene=SeqID_54920
ataactcagtgtgttgataagccattttgttatcattcgtgatggattacccgagaataaatgagcatgaactcaaatttcccattccctccgggattgttgtcagcgggccctcctcttcgggtaagacgcagttggtccttcgcctgttggcacacgccaacgagatgtttgatccctcgccgaaggtgataggtaagccctctttgccatggtgtaatgggcgtcccattgggttaagtttgggcttacggtgagtactcctcgcagatccccgagctcgagaggcagggcgttgtcccgcacgctggtcctccctccgaagaaatg

SEQ ID NO: 109646 - DNA, 149 bp, Heterodera glycines
  Promoter: Source sequence=SeqID_13678; Location=415..563; Strand=+; Gene=SeqID_77594
ttgcgaaatggacgacctaataattgacgaaatgtggaaatatgcaatgacatattcaattcgaatgctcaatttggtcccaaattttattccctttaataggccataaaataaattcaaaagtaaatttaattaattgtcaggaaatg

SEQ ID NO: 109647 - DNA, 396 bp, Heterodera glycines
  Promoter: Source sequence=SeqID_26198; Location=895..1290; Strand=-; Gene=SeqID_56943
aaaatagggactaaaaactgccaaaaatatatgctttaaccctcaaaaattccaaaaaaggtgtatatattcaatatttgtttaaataaactgaaatacaataaacaaccaaaaaatggatttaaaaacttaaaaatgcaaatttttatcgtctcccattgtataaaaaatacttccaaatttgccaaaatttcgaaaagaattttcatttaaaaaaaaaaaaaattcgcaaaaaactgcgaaaatatttattaaaaatgccaaaatgaccggcgaaaactcaaaattttcgtatttttgggggagtaatttttaaaaatttccaaaaagtcaatcgttaggggtgtatttttcgtttttttttgtcatttttcttgtgaaattttgccaaaaatg

SEQ ID NO: 109648 - DNA, 1003 bp, Heterodera glycines
  Promoter: Source sequence=SeqID_2643; Location=1417..2419; Strand=-; Gene=SeqID_80864
gtataaatgaataactattaaaattattaaacttatattcacttataatgttggcaaacaactgactgatatttttgacagacacttcttttcactaataacaaagaatatatattcaatcgaaaagtttgtataataatattatatcataaaatttaattccaaaacaataaattaataagtcatagccgctacttttattaatgagacatcaagtctgtacagcaggattttgcatatttcgtcaatttatcagcaattagatgaattattctattatattactcatagtaaaaaaaagtaaatatgaaaggaatatgtcaaaatttcacaaaagattatatagtttatgttcttaaatttattttgaatttttttgtaaaagtaagagccaggaaaaataaaaaaattattaaaatgttaattaaaagaccaaaataattaaggtacttttttcataaatataaatttttgtgtataaattgtcaaaagaaatgcatttgagtcaaaagttcatttatctatcaaatacaacaaaaaatgaatttaaataatttataaaaaatattaattaagtaatttctggataaaggccgcgattttatcaagaaggtgagggatcgttaaaaattttattggaaaagcgaaaatattttacggaaatcactgtgatagacccaaattataatatgataaagactaaaaggtctttttacataaatgacatgatagacacaaattaaaagatattttaaataaataatttttcgtgaaactatcaaccaatcattgattaaaaattatttattaaaattatatataaaattcctttattttttattgtatccaattaaacgggccataaaattcaaattggcagagaatatattaatgagtatttaaaatacaaatattttttttatatccttatttagcattccataaacttaaagtataatcaataaacgaggagatgcacaatttccgcaccgacttcaacatg

SEQ ID NO: 109649 - DNA, 51 bp, Heterodera glycines
  Promoter: Source sequence=SeqID_39396; Location=1361..1411; Strand=-; Gene=SeqID_67970
attacaaatgtcaaatctgtacacactcattgtcagctaaacaaagaaatg

SEQ ID NO: 109650 - DNA, 72 bp, Heterodera glycines
  Promoter: Source sequence=SeqID_37534; Location=171..242; Strand=+; Gene=SeqID_66583
agtgaaaaaaaattcatttaaaattcaaatgaattaattttctaatttccagcaaaggatcggcctcggatg

SEQ ID NO: 109651 - DNA, 122 bp, Heterodera glycines
  Promoter: Source sequence=SeqID_14094; Location=443..564; Strand=+; Gene=SeqID_78077
attattcaaaaggcgatgcccatgagtttatgatgttctttctaaatacgcttcacattggcttgaatggcaccggaaagacgaattcgtcaatcgtttataagattttccgtggccgaatg

SEQ ID NO: 109652 - DNA, 554 bp, Heterodera glycines
  misc_feature (42)..(42): n is a, c, g, or t
  misc_feature (66)..(66): n is a, c, g, or t
  misc_feature (73)..(73): n is a, c, g, or t
  Promoter: Source sequence=SeqID_3271; Location=4827..5380; Strand=-; Gene=SeqID_84004
aaattagtaaataaattaggtgagtattacattttaggattntaaatacagaattcattttatcanaatgggnttaatggaaatttgtacaaaaaaaaattgtttttagaaaataaggcctaagcctaaaacttagcctagcctaagtaattgtactagttgcctttgtacgagttgtcatgacaccgtaatatgctctattagcttgaaaatttaaaaagaaaattgatttggaatgtaaaacaaattaaattgtttttatttttatattttaacaggaataatgatttttatatttttaaagttgtcggcatttcgactaattttagctttgtcggaatttcgactaattttagctttgttggtatttcgactaattttagttttgtcggcatttcaacgcgtcagcatttttacgaacagcggttaattaagccaaaatatgaaaagccaaagccaatgtgaactatttcaaaattaagctttcaattacaaatgcccttatacggcaaccgttcgaattgtttcgcaaagggaaggaaaaagtgattatg

SEQ ID NO: 109653 - DNA, 207 bp, Heterodera glycines
  Promoter: Source sequence=SeqID_7346; Location=1..207; Strand=+; Gene= SeqID_64538
tcaaaaggggggcggctttatttcagggtgggacctaatcaagggagtggggctatattataggaaatacggtaatttgaattattttatattaaatgagaaaaataaattcatatttatgcaaaatgaaatttcacataataacaaagcctttgctttggttgatgtattccgttatcatcttgcttttcagcgcacataccaatg

SEQ ID NO: 109654 - DNA, 67 bp, Heterodera glycines
  Promoter: Source sequence=SeqID_15146; Location=1833..1899; Strand=-; Gene=SeqID_79337
ttgatggcgaagcgttaaatgcgcggaccgcccataaggcaaaaaatgccaaaaaataaaaaaaatg

SEQ ID NO: 109655 - DNA, 274 bp, Heterodera glycines
  Promoter: Source sequence=SeqID_35847; Location=1..274; Strand=+; Gene=SeqID_65312
ttatgagtgaaggtccaagtgcatgttgataaacaatctcaaagccaaatgaaaactttttgtagttttcgtcagtgtcaatcatcgtgtttctgtcacttatattttgatatctttttgtaacccttaacaattataattggcaccaagtcattaagacatattttcatttagttgcattttggcgaacaaaagaaatctagaaaaatatttttaacagaggaaattagagttccgaaaaaataaaataaattatattttattgacagaaatg

SEQ ID NO: 109656 - DNA, 763 bp, Heterodera glycines
  Promoter: Source sequence=SeqID_5132; Location=1255..2017; Strand=+; Gene=SeqID_57029
ttctgctataaaatttcaaaattttgaatatatttaagaaataagaacaaaataagaacaatagcccgaaatgaggacaaatcttacaaataaggacatttttattttgtaagatttggaccctccaaataaggacaaatcttataaataaggacagatccgagccctggttttaatagccccaaaaaattgtacaacattgatcattttgctaaacatctgctgttaaaaatgatttataaatgcacaaaaatttttctggcgccaaaataaaataattatttcggaagggaaaatttgaagtttagggcctttttaaagacttttatccttttttattagtgaaattgtattgaatgaatttatcgggataaatgtcagtctcaaaatacgaaaaatatttttggttttttttttgcataaaaatgctaattatatgagtgaaatgtttaataattactatcattttaatacttttgttaatcaatccaatttacatttaataactagggctcggaaaaatatggatataaaatcgcaaaatatgtgccgctaaaatttgctcacttttagcgaaaaaccaacccgaaaagcgaaattttcgcattttagcttatttttggcgtaaattaaccaattttatcaaagttcaaatttaatcaatattttcgaaaaattttgttaaaaaataaccttttcggaaattcaaaaaggccaatttaactgatggaggccattataataaaggttttctggaaaaatg

SEQ ID NO: 109657 - DNA, 192 bp, Heterodera glycines
  Promoter: Source sequence=SeqID_8826; Location=656..847; Strand=-; Gene=SeqID_69334
tcggccaactactgaaaaatcttttaaattttctcagtttcctgtgtccatctcaattcaatgcctctgacgaaaaaccaaataaaataaaaataaataaatttaattattacattttaatgtgccaattaaatttaatttttttttttcatagggaagaaaatttattcagctgaagagaaaaaagaaatg

SEQ ID NO: 109658 - DNA, 295 bp, Heterodera glycines
  Promoter: Source sequence=SeqID_27177; Location=637..931; Strand=-; Gene=SeqID_57870
tattttttgttattttcattgttcatttcttcggtgtttatttttaaggacgaattttattgttccaccttttgattactgtattgtttcttatatgtatatgtatatatatttttttgccaaattttatattaaatataaataattttcacttaatcattaaaattttacttatgttggttggcctccaccgttgtcatgacaacatggaaaagtagcaaaccaacaaaaattataaaataaatccaaaaaatatatttttcctcttttgaattttcaaaaaattaaaaaaatg

SEQ ID NO: 109659 - DNA, 443 bp, Heterodera glycines
  Promoter: Source sequence=SeqID_16421; Location=372..814; Strand=+; Gene=SeqID_80826
gcaattagggatttgatctgccgacaaatagggccatacttgggaaagggtgggggcatctgtttttagctgtgtcctatttcggcatttatttttgatctttcaaaaccactctgatttatttgcacagacggggcttgctgatgggagcggagctttgtacattgggacggcatcgaaaggcataatcgacagaagtcaccagcacaatgcacaggtgggctttaacaatgatcacatttaattgatcattagcagtgaaggaatgccaaacggaaaggattgaaaagatactcaacaaagacaattttcgttgatttttatgacttaaattttgccaatcttttgccgcgctgattaaattctgatcaatcatttgtcatgtcaattgttctttgaaggtttatcggtgcctttacgcacaaaatccattcaatgaaatg

SEQ ID NO: 109660 - DNA, 399 bp, Heterodera glycines
  Promoter: Source sequence=SeqID_30321; Location=681..1079; Strand=-; Gene=SeqID_60738
aaaaaatcaaatttatttttaaaattttgttacttcaaattcaacaaaataaaataaaaaattatgagaaagtaaagttttgtgaaaatttttaatttcaaaatttttgaaaatattaaaaaaaaaaattcatttacgagtaaacattttcgaaattttagaggtttctataaatgcaatctttatttttattttattagaaaatttgaagcaaaaaacaaaaatattcatttgcctaaaacatgacattaagcaagttttatcagctaaacaataattaaaatggcatgaaaatttgaaaagcaatttaacaaaagcacctaaaataaattctgaaaggctttgctgagcttccggcacacttcacgcccatcatcggaagcggtgctaggctttatg

SEQ ID NO: 109661 - DNA, 90 bp, Heterodera glycines
  Promoter: Source sequence=SeqID_2735; Location=5052..5141; Strand=+; Gene=SeqID_81349
attgataaatagataaaaaataaatatataaaagcgaaacagctaagagagcactcgtttaattaaacatttagaagagcgcaaaaaatg

SEQ ID NO: 109662 - DNA, 266 bp, Heterodera glycines
  misc_feature (7)..(8): n is a, c, g, or t
  Promoter: Source sequence=SeqID_36019; Location=1..266; Strand=+; Gene=SeqID_65460
cctgcannggtcaaaattaaagttgaattttcgccggtggtccgaaaatccccccccatgtgttcaaaaaatggccagagccaaagctgctaaatgccgaagaattgaaacaggaaaaaggcattggcaaacaaattattgaattttttaaagggaaaagcccaaaaaaaggaaaaggaaagggagagagctcaacagaatcaattggtagcaaagaaaatgcatatcgtttacatgaaaattttaaaaactttttgaatgaaatg

SEQ ID NO: 109663 - DNA, 354 bp, Heterodera glycines
  Promoter: Source sequence=SeqID_12831; Location=386..739; Strand=+; Gene=SeqID_76557
actgaaataatttagcaaaatttccattgtagcatgattgggtccaacacaattggcttttttttagaaaatccacgggatcctcatccaaaccagagtgctctcccgactaagctaccggggggggggaggattagccatctttggattctcgatcaataaattgctttttatggagcaattttacttgcattaagcatgtcagggatggacaacaccgaagccgagtcattgttgcttgtatagaatgagaaaaggtccggtgacaacaaatggggacgacgacgacggcgccatttgggggatgggaaaagggagaaaaagcggggcgacagcaacgcgatgtgatcaatg

SEQ ID NO: 109664 - DNA, 101 bp, Heterodera glycines
  Promoter: Source sequence=SeqID_23275; Location=1028..1128; Strand=-; Gene=SeqID_53981
aaaaaaatgggcaagtaaaaatcgtaattcgctcaaaaagcttctcaaacattttagcgcttccaattccttctacaatcgcctttatacatcccattatg

SEQ ID NO: 109665 - DNA, 1003 bp, Heterodera glycines
  Promoter: Source sequence=SeqID_8523; Location=393..1395; Strand=-; Gene=SeqID_68385
atttgaatattaaaatttctttcaaattcataaaaataattttgtagaaattaattggcattccataagaaatttccatctcattataatgaataccttttaatgctcgtgcgcattatcatttgtgtcttttcattaaatgtcattctcttttttaattttaaaatgacacaatgcgatctttctgttaatttttcataaaacaaaataatttaaatagtaaaaaaaaaatttaaaattattttctgggattattttttgaattcatttttttttattcaaattttgttaagttgtaccaaatcactttaatatacatataattaaattcaataaaaaaaattactcaaaaaactaattaatttaaaaaaattgtttttaaatagttttttaaaagtttttttcttttatcattaattttttaaatactgacgttttatctcatctcattaaaatattttgtatgttgatatgcttgcacatttaaatggttttgttgaaaataattggtgtaacgctaattacttgcaaaaagaatacatttttatactatttctggcatggcatttcgtggcatttctttgaaaattcgttaaatttttttctttcatataatctgtaatttttaccctaaatataactggaatataaagagtttccttaaaaaaaatttgtaatgaaaattattaatcaaatttattagtcttaccacctcaataaaattttaattaaggttttaccttaattcagcagcaaaactgccatttaatattactttgaatcagggatgggctttcgctttcgcgttttactttcgcaaatttagattttttcggtactttcgcttttgcgttttctcgtttcgcattttatttttcgatttggcccatccctggtttgaatgtcattaaaattgcataaaatgaacatataaattgcgaatattccattattatctatttttaaattaaataaaatttatatttttagattaaataaaatg

SEQ ID NO: 109666 - DNA, 253 bp, Heterodera glycines
  Promoter: Source sequence=SeqID_17862; Location=2243..2495; Strand=-; Gene=SeqID_82407
tatcagtggcgccattttttctggggggttggaggaatgttcagcccaaatgttgtggatgtgggtggaatttggggccgatgtcgaaatggggtgggaaaaccgttgcttgccggatcttgataaatgatcccgaaagcttagtaatttggcggtgttatttggaaaggtgaaaaagaaaatatggggacttaagctgtaaaagaagaaactaaattaatttattaattcatatctttcagaaaacaaaatg

SEQ ID NO: 109667 - DNA, 341 bp, Heterodera glycines
  Promoter: Source sequence=SeqID_14635; Location=1..341; Strand=+; Gene=SeqID_78724
accatggcttcattggattgggccgcccattaatatttttaatttttggggaaaaatcatttgggaaaaataagaaagaaaggcaaaagaaatggtttggaggaaatttctccgccatcaaaaacatagttgggtttaacattctttcaggtattggtcatttagggttaatccataaattatgcaaaaacaataatgcaaaaaacccaaatatttattattcatggtaaataaagtgatccgcggatcaggtcgatttagaggaaaggaaaatagcgttggatttgatgagaactactgaggaaaagaaaaggaatacaatccacggatcgagatccatg

SEQ ID NO: 109668 - DNA, 214 bp, Heterodera glycines
  Promoter: Source sequence=SeqID_4369; Location=1110..1323; Strand=+; Gene=SeqID_54195
tggcattgtcatcggccggaaattcgatcaagaaattgtcggcatagaaaaagagaaagtgaattgatggaaatcgttgagaattgacgggacgaatttacgcaaacggcggaaaaatttggcgtacaattccaaggcacaaatgtttttcccgataattggcaaaatgttgcgcaaaacggactccaaatcgggatcagtgctcttaaaaatg

SEQ ID NO: 109669 - DNA, 332 bp, Heterodera glycines
  Promoter: Source sequence=SeqID_17504; Location=2224..2555; Strand=-; Gene=SeqID_82010
ttcaatttttattcaaatcgtaataaataatttttgaatttaatacatcataaattttagtaggttctaaaatgtaaaaaataaaataaattttcgaaatcgctcataaattcttaaacgaattcttatatttttgagtcatttttggcactgccatttttgcggcttcaaaaacatttagggcattataacattttcttttttttgttgctctaagtctgtttgatttctaaaatgcaatttctcgtatgtcttaaaaaaccctttggtcaaattgactttttatctcctttttttttgctcattagctgaatcgctcgcccgtcaaaatg

SEQ ID NO: 109670 - DNA, 1003 bp, Heterodera glycines
  Promoter: Source sequence=SeqID_7071; Location=1062..2064; Strand=-; Gene=SeqID_63739
aagcaaccaaatttttaattcttgatgccatttgatggccttaaacacactctgtaagagaaactaaaaaaccttgtttttttgaacattttcgccataatttttttgaaaattttttttttggaatatttcaggcactaaagagagagagcatttagaactatcgaatgatatcaagtagggtagcacgagaccggtaccgataccgatccggtaattaccggttttttcaggtaccggtaccggtctcggtcccggtttttgaaaaaagtcaagtctcggtcccggtttttgagtaacggcggtaccggtactaaccggtactaaatatgcactggtaagaatggagttctgagagcaaaagaaagagagaaggttgggaaatgggaaaatatttgtattttgaataacatttcgccaaattttacagtcagtgggttgtgtgtcaagcaattgtccacctcatttatttctttcattttttgatttccatctactttttttcatttagaattaattgattaaaatgtctgatatttggaaacattacaacaaaaatttgactggtgcaacttgcaaaatctgcgcaaaaaaagtcacccgaagtgacggctctactacaggaatgtggaaacatttggaagcaaagcatcaaaaggaattttctgtgttaaaaaacacagaaaatttagggcaaatgggggaggataaggtttattgtgatttttattgtaatagagactaatttttagaaacaaaagcaaatacaatcttttttggtgacaaaaaagaatgagacggaaattgctgaagaacgcatcgtgcgaataatggtccggcaaaacaattcattctattttttcgatgacccagacttaaaggatttgtttcaaaaagcacatccgaacattgtacatcataatatatcttatacattgtgaatttatttttgaaggatcttggtgcacgagaacattttcgccgaaaagtgattcccaggatg

SEQ ID NO: 109671 - DNA, 542 bp, Heterodera glycines
  Promoter: Source sequence=SeqID_679; Location=4829..5370; Strand=-; Gene=SeqID_58862
ccccctatcacattttcctccaaatatgtgctttccctttgcaataaatatttgtgtgttgtcctttcctttggacagaggaaaatagcccttccctttgggcaatcaccaaatttcggtcatgcggttggggcattcggcgcccctaatcgcattcggagcgatcagcaattgtcgtgcgggattggatcactcctgatccttgcccactccctcccatcgcccttccctcctcagcgatcggagtcgggactcatcccggcaggcaattgggaggttcactcactccttaactgagtggtggtgccgttacatcacccccattttgtcggccctccccattctcctttctcggcccccttgggcattcaattcggaaaggggtcgacaaagccgagaaggagggcaaaggaaaccggcgatcacccctccattgatcgccacctttttcgacaaactggtgccgttagcaaggggctgcacaactcatcgaccggtcacccgacgaccgcgccaaattcggacttcgaacagccgcaatg

SEQ ID NO: 109672 - DNA, 278 bp, Heterodera glycines
  Promoter: Source sequence=SeqID_4213; Location=1450..1727; Strand=-; Gene=SeqID_53616
aattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaattcttgaatttgcttctgaattttttaattttaaatagaaaattcctttttctgaaattcacaataacaatttggcgaagaaattcattgaaatttttataaagcattttgattaaaaatg

SEQ ID NO: 109673 - DNA, 361 bp, Heterodera glycines
  Promoter: Source sequence=SeqID_8944; Location=1470..1830; Strand=-; Gene=SeqID_69753
tctgaatttgtttgttcacattttgcgccgccgcttttccttttccgccgctgcgcacattttccaatttttaatgcacacactttctcacatttattccactgtcttttgcttaatgggaacgcccgtcagcgtggggccgcgtggcctaatggacaaggcgcctgacttctaatcaggagattgtgggttcgagtcccaccgtggtcatccgaatttttttgtgtttttttaaaaatccgttcggaaagccattaaaaagcaattaaaatatttcaaatagaaattattaaaatgactgattacaaataagatttgtctccgtaaaattcgttttaactcgaaaaacattcccaaaatg

SEQ ID NO: 109674 - DNA, 79 bp, Heterodera glycines
  Promoter: Source sequence=SeqID_467; Location=1935..2013; Strand=-; Gene=SeqID_53578
aaagagtgttgatgacattggcagcgttgttcgcctttctgagagaaatgtaaattctcttcagtattggaaaaaaatg

SEQ ID NO: 109675 - DNA, 95 bp, Heterodera glycines
  Promoter: Source sequence=SeqID_8089; Location=3716..3810; Strand=-; Gene=SeqID_46542
tgctcccattacagtatcccgaccgtttccaaggccttttgttacctcaaaaatccattttattgggtggtgctcaaggcagtggaaaagagatg

SEQ ID NO: 109676 - DNA, 321 bp, Heterodera glycines
  Promoter: Source sequence=SeqID_3410; Location=710..1030; Strand=-; Gene=SeqID_84567
aaaattggaggacaaatttattcgcgaaataattatttttattaagcgaaaatttgcgttgatcagtaaagacattttgtgtagggcaatttggacaatttcgattaaaaactatttttgtgaattgtcccaattcgtcgaattcgatttttgcagcataacgggagaccatttatgcctcaattaattaattaattaattgttcgtgcaacaatttgtaccctttaaaaagcaatgaaaatggtcagaagaaagcgccaattcatttattttattcagtttaattattttgtcttcgaaaatttaattgcccaaaatatg

SEQ ID NO: 109677 - DNA, 216 bp, Heterodera glycines
  Promoter: Source sequence=SeqID_20981; Location=840..1055; Strand=+; Gene=SeqID_51554
aaacaatgtgtttgatcaatcatccgcaaatgttaagatcaaagttgcgccaagaaaaggaaaaagaaatacgcggtcgtctcgcgttccgcgtcctcttccaacgcttcgcggcgttcctcgcgctcctcctcctccgcctctttctcttcttccttttcgtcctcttcttcttcctctcattcaccttccgccaaaaaacaaaagaaagaaatg

SEQ ID NO: 109678 - DNA, 75 bp, Heterodera glycines
  Promoter: Source sequence=SeqID_1913; Location=804..878; Strand=+; Gene=SeqID_76755
ggtgaacccttttataattttaaaagctcaatttgtactgaaatttaatcatttcagttagcgattgacagaatg

SEQ ID NO: 109679 - DNA, 516 bp, Heterodera glycines
  Promoter: Source sequence=SeqID_4712; Location=816..1331; Strand=-; Gene=SeqID_55481
ttgttgatggccgaatggaaggagttagctccctgagacggaacaccggcacaaacgtaaaaccaaaaaacatggcaggtgatttttgccggaacgggtcactaacggatcgaccgttaagtattttcatagacagccaaatccaaatatgcacatgctggtagcactcgattattctcatcaaaattactcaaaattgcattataataaatttatgaaaaagttgcaaaaaaagaaatgccactcttttagggcctttttaaggcaagttgactttgtttcagggggctttcaaaggtatcattattaaaacaaaattccaaattgtgccgtttttaaaaccggtcagcggcctggctcataattttttttggagtcgtgcattttttaaaattttgtccttttaaaagaaatgcttaaattggttctatcgaaacagacaagcttatttaattaattaggttttaagaaaattggttttaaaaaattgaaaaaccaaatcaagcagcaggaatg

SEQ ID NO: 109680 - DNA, 1003 bp, Heterodera glycines
  Promoter: Source sequence=SeqID_18059; Location=101..1103; Strand=+; Gene=SeqID_82649
tgttaatttcaatttcttcttttaaagaagaaggcagaattattttttcattaataaaagttttcgtggcaataaaaaatcatattcaaaaagcgttggttacgtccaacatcgacaattttatgaaatttttttagcttataacttggtgaatactagagcaaataaaaccattttatgctcattttgaagggaaaattctggagaatattgtaaattttatttggtttggccttaaattgtggacttggctaaaaaagaattaaaattattgaaaatttcacctagttgaaaaatttttccctatgttcaaattttcttcaaattttgcataggcccatagtttgaccccctttatcggatccctgtttattttatgaaagttatgtttttaactcgagatcagctcttccatttttacaagggaaaatccccggaaaattttaagttttgcaaagttttggcgttctgattactaaataaaaatccagcataattgtacttggagcccaaaattgggccgctgtgtttaaacaattaaattaattatataaatcaatgtcaatgaatttcataatacaaaaatatttaaatataaattaaaaataataatttccccgtttttgtataaggtatcatattttgtaagattcaatttaatccatgtaacatccgcttgttaagccttaagcaagccgtataaaaccatgatttattcaattctctaattttcctggttcaagaataacctcgaaaaaacaaagattttatttatttttttaaatttaagcaatattctaatttttaaaaatacttaatataattgaagagtgtaataataattatttgaatttataaatcgcataatttaatgtaattaggtattatattaatcattgagactattttcgggtcgcctacacttagtttttttttcggttcgacctagtatcattttttacaataactttttccccgtttttaagtcgtcattgaacaaatg

SEQ ID NO: 109681 - DNA, 233 bp, Heterodera glycines
  Promoter: Source sequence=SeqID_24472; Location=447..679; Strand=-; Gene=SeqID_55199
ttaaaaaattaaaaaacgggcgcgaagccccgtcctgaggccgcgaagcgtcctaatttccctacaaagtttgaaaacgggcgcgaagcgcccgtcctgaggccgtgaagcggccgaaagtcctccacaaaattatgaatgcgtcctcgcgatgccttaggccgaaaatcccttggcgtgggctgagaggggagaggcgtgtgggggggggggggcagccactccattctatg

SEQ ID NO: 109682 - DNA, 321 bp, Heterodera glycines
  Promoter: Source sequence=SeqID_1576; Location=2143..2463; Strand=+; Gene=SeqID_74560
tctaaataaaaaagcacgggaaatttgaaggaaatgaaaattattttgggttttttgggaaagaagggatagacggtgccgacaagccaggctccaagtttttcttcctattgggttgatgaaaaagttctgaccctctgaaaaaacaaattatgcaaaaaaatgatatttaattctaaagagattgaaaaagggaggcaggcaattgggggatgaatcagcggacggttggccatcttttggccatttgcattcgttgtatagtcattacttttgcaaaatcgaacgattttcaaaaaatggaaaaaattcgcctaaatg

SEQ ID NO: 109683 - DNA, 713 bp, Heterodera glycines
  Promoter: Source sequence=SeqID_1235; Location=2071..2783; Strand=-; Gene=SeqID_70393
tattccgcgtgccgtctcttcaaatggtttttcagtccggtggtgttcccattcgttgtcgaaattttctgatggcacagcaaacatttggccacgtcccgagaaatgcgtttgaaaaagcccactcgccaaaaggcactccgcaggcgatttttgtcgattaacatacagagaaaaagctaaaatttagttattagtagcaattaacatcatttaaaatttaaaaggatttctgctatcgtcagaaactaattaaagtttgtgcttttggaaagttaaatttgaattttaattattattattggcatttcattttattcgttaataaaattcgttaatttgcaaatttaagctcaggcaccaaaattgtcccttttcctttaaaaatctttagttaatgagacgcccaacttttttgcgattcaatgccattccttctttgttttgccaatgttctcccaagcacttaatgctttcttcttatttttcgtccgattgtccttcaccgtctcatcctcaattagccgttgtctccaaatctaaagtccaatttttaattttgtttattatttttactttcccaatttaaggtctatttttgtttattttgcatgtcttttccccttcagtttcgctctccctcatcggaagatgccgtcgacacgtctctcgcccgtgtgccttgccattacatcaaaacggcccgccaaatg

SEQ ID NO: 109684 - DNA, 778 bp, Heterodera glycines
  Promoter: Source sequence=SeqID_22121; Location=1..778; Strand=+; Gene=SeqID_52773
ttttcaaaattttacctataaattggctaattttcagtgaaaaactgtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaaatttaaaaaaatgatttttgctttatgattttaactattaaaaagttgaatattttggggagggaggggtagcaaaacaaggaagtacccccagtgttaagcattttgttaagcgaatgtttaaagatttggtcgctggcagcacattgtatccgattactataatgtaacggtcaacgggattatgtgaaaaggccttaagaaagtccatttatctgcaacacaacaatttgtaacaactctttgctggattcaaaaagctgcggacaagacccattgaaaatttattcaaaaaactaattttcgaacgcccatatcttttttctaactcatccaaccggttagcatttgcttagaaaaagcttcttctcatcaattgctttcgaatg

SEQ ID NO: 109685 - DNA, 270 bp, Heterodera glycines
  Promoter: Source sequence=SeqID_3924; Location=749..1018; Strand=-; Gene=SeqID_52461
tctcaaattgaagtgctttgacaatccatcgacagggcaaacagtgagaaaagcgcaacagacagaaaacggcaagaacagagagatgatcagtgatcaatcggtcgaccggaaggcaaaattggcaaacggaagccacattctttcgcagcactctgatcgatcagtcccgtgtcagtttcggcaacgcttcggaaatcccggcttcgatcgaacattcttcgctgtctcgcctgtctcgacttggtttctcccatccctctgctaatg

SEQ ID NO: 109686 - DNA, 176 bp, Heterodera glycines
  Promoter: Source sequence=SeqID_28459; Location=1..176; Strand=+; Gene=SeqID_59073
tccagattgtgtggtggttggggttggtctgtgtagaattggtgacaatttcgtccaaattggcatcggaatcgtccgcatttggcacattcattgaggaaacgacaaccctgggccatctatgggacgaattgctccaatttctgaaccatattctggtgcatgaggaaaaaatg

SEQ ID NO: 109687 - DNA, 600 bp, Heterodera glycines
  Promoter: Source sequence=SeqID_12211; Location=595..1194; Strand=-; Gene=SeqID_75789
tgccgggcaaatgactgaaattaaataaaattaaatttttattaaattaaatttcaattaaaatgaaacgaatggcgaaacaaaagtcccttcgatcggccgaatgggcgtttatttaaaaagaaattgcgaatggggcggcggtgagcgaacactttttctcggctttgctgtgaaaatggctaatctcgccaatcgtcgggggaatgtcggcgatggcgtgggaaaagcgaagtgtaaaggccaatttatgtgcttcgaatgatgagaatcgttcggagttcacttttgtccctttggctctgctgatcactctctttcccagcgatcacttccgtttttgctaatggcgggaacgaattacgccgtcgtctccgttcacccgtctattttcctccaatcactttgcctatttattcgctcgcttttcctccgatcactttgcctatttacccgctcgtttttcctctgatcattttgctatttcttttaatccgatcactttgccttttatccgctcgcttcccctctgggcttttcctttattttctttggctttttcaatgatttttctcccttttagggcattatttgaaaatg

SEQ ID NO: 109688 - DNA, 267 bp, Heterodera glycines
  Promoter: Source sequence=SeqID_4926; Location=3510..3776; Strand=-; Gene=SeqID_56229
ttatcaaaaaattattttaaaaatcaggaattgaaaatgcaattttattttattaatattaaagtgacttaaaatgaatgaaaatctgattttatacttgttattatttacttaacctatattcatgactgttataaatagcgcttgaatttctttttttttcattaatcatcttcgcaaaattattttgcagtttttttttctagaaaaggacttattcgttttaaaattttatattaattaattctagattaatttgcaaaaatg

SEQ ID NO: 109689 - DNA, 376 bp, Heterodera glycines
  misc_feature (105)..(105): n is a, c, g, or t
  Promoter: Source sequence=SeqID_19335; Location=1147..1522; Strand=-; Gene=SeqID_84075
caaagaacatgcagcaataagcctgcaaaatctaataagtggaaaatacatgagtatagaattattttcagaaagtgtcaacagacttttggaaaaatatattgncaatttatcaaaaattttgagaagtgagttagaaatgataatcttcacgattcaaaccaattttcgttgctctaattaatccaaagcgaaacaacaaagatggtgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgaaataaatcaaaaattatg

SEQ ID NO: 109690 - DNA, 71 bp, Heterodera glycines
  Promoter: Source sequence=SeqID_4561; Location=950..1020; Strand=+; Gene=SeqID_54898
agttggacacggccaacgaccaaatccaacgattggaacaaatgcaattccgaatttacgtataaaacatg

SEQ ID NO: 109691 - DNA, 719 bp, Heterodera glycines
  Promoter: Source sequence=SeqID_25456; Location=335..1053; Strand=-; Gene=SeqID_56186
tgtcgaatttgtacaacggtcgaccattaatgaatgactcattaatgagtgggatataaagaccaaatgacctccggagaaaaaaaaagattacaaatttgttctgaaaatgttagagaaaagtgaagggcagatcccttggatatgtttacctttaattaattaattaattagcgacaagtcacaggaaaatggccagccagctaaagtacagtatggaatattgttaaagattaaaaaacaaattctttaaaaaattgattacttaaaattggtcaaaatacttaatattcatattaaaattttaagttaaaataaataaattataaattataaatacaatatgcttgactcattcattttttaatgatttaaaaaatatttttattttctttttaatgtaccaaaatttagctatgagtttgagtaataagtgatcgaaaccactttttataaccatatagttttccagtcaatttaaattaatttattttttgccaaacttttttaaaattaattttcctcttatccttaatgattaaatttttgcgtttatggcatggtgaggaaccaaatataactcacggcaattgttttccgtccaattcctagggctatagctgtgacacgccaaacagattaggcgctgtgcccggttgataattaattaattaattaacggtcattaacagcaactgttgctgcacactggcaaaatg

SEQ ID NO: 109692 - DNA, 91 bp, Heterodera glycines
  Promoter: Source sequence=SeqID_936; Location=441..531; Strand=-; Gene=SeqID_64512
tttttagactaaagatataaaattctaaaagttaaattttctatttttttttgttcgatttcggatccggtattcggaattggtcgaaatg

SEQ ID NO: 109693 - DNA, 402 bp, Heterodera glycines
  misc_feature (10)..(10): n is a, c, g, or t
  Promoter: Source sequence=SeqID_10615; Location=1..402; Strand=+; Gene=SeqID_73845
atagattttnaaagaagtgataataactgttctgattatttttgtcacttcaatgaaattattatccataaaaccccaaaaagaaaaaatgatttttttcaataatttggcaccaattaaggctaaagaacgtgtttttaaggaccaataagttatatcaagcaagatattcttgtaatttaatgatgaaagccttgctttactattttatcttattgagataaattttccaaatgattttttttttttggcaaatttaatcaatataatcaaattgatgatttttattggaataaatttgccaattattaaattatttggcaaattaatcaatataaccaaactgatgattaaataattttggcaaaaaatgattaaatttttacattaaataaaaaaatg

SEQ ID NO: 109694 - DNA, 379 bp, Heterodera glycines
  Promoter: Source sequence=SeqID_38673; Location=556..934; Strand=-; Gene=SeqID_67416
tttcagtagaaggaatatttttgaaggaaaaagaaccatcagcttaatttaaaaatgaaaattgtaaaagtaaattccgtcattaagactaattgtaaaagaccctctgtcggtgtaagcaaatcgtcgtccgcgaagcaatcatccactacaaaatcattgttgtttctgctaattgttgtgtcgatttcattggagtgagtagaggggttcgtcatattagccttttccttattttaatttgcaatgtctgcaaatattcgaaaacaatgaatcaaagaatgtaataaaaaataacaagggaaatttaaaaaaatattaaataaaatatgacaaaattaaaataattaaatttttgtattttttggtcttaataatg

SEQ ID NO: 109695 - DNA, 784 bp, Heterodera glycines
  Promoter: Source sequence=SeqID_5110; Location=1..784; Strand=+; Gene= SeqID_56946
ttttcaagctattgctcattatttgcacattttaaatgattcatcatccaagcaaagatggactcatttcaaaatataaatggcattcaaacgaagttttaacccattaaaccaattgaaagcgcacattagcaaagtgccgccatttctttcgcctttattaggccaaattcactgggctttgaaaaaaaaagcattttttaattctgttaataaacttatgacttatgatgaaaacaaaaatcaaataaaaacgcatttattggaagcattttcaaaagttcgaatgcatttcgttggaatttgatagaaattaataaatgaattggcctttggtgggaaataataaataatttaattattgacaaagtaattaagacttatttttcgtgcttttttctatcaaaaaaaagctacagaaaaaattaattttaaataaaaatattaaattgtcccacgcttaatttcgttggtatgctaaagaaattttgtccgctgtcattaattcactttattattaaagtgaaaataacacctgctgttccctcaaatgggaatgaatttttatcttttttcgattttttatataaatttttaaaattttcccgacttgggctttctttaacaaagccaaattcgatcgagatcataatatttatcgactaaagactgaggagattctcgagcacattaataggttattgttaatgttttcaatttcattttttcagtgatttaattaattgcttttctctcacgacactttcaattcattttccaaatg

SEQ ID NO: 109696 - DNA, 168 bp, Heterodera glycines
  Promoter: Source sequence=SeqID_1650; Location=2041..2208; Strand=-; Gene=SeqID_75076
ttgctgcggttctgctgtttaacgcattgttgcgaatttcaacgattttcgtcccactgctaacgcattgctgcgataagtgaggacgtggtaccgacttattagcgcattgttgctaacttttggactccgaaacgccaaattttattgccgccgcttagagggatg

SEQ ID NO: 109697 - DNA, 246 bp, Heterodera glycines
  Promoter: Source sequence=SeqID_29426; Location=1..246; Strand=+; Gene=SeqID_46164
ttttccattttttgcattttttttattattccggaatgaactttcaataaaaccatttttatattattttttcaatttattcacattatttatcaatctttgtcattttttattattattattaggtgctctccgagcccgggttgaaagcttcaaaaacaatttttaaatttaaaattttatttgtaattaattatttttacattgccattttttaattattaggtgctctctgagcctgggatg

SEQ ID NO: 109698 - DNA, 99 bp, Heterodera glycines
  Promoter: Source sequence=SeqID_36986; Location=1..99; Strand=+; Gene= SeqID_66174
tggttggtaagggaagaaggggagggggggcaaaaatgggccaaaatgggaggggctgtgaatctaagacaaaaacgggaaatttttgctataaaaatg

SEQ ID NO: 109699 - DNA, 81 bp, Heterodera glycines
  Promoter: Source sequence=SeqID_43547; Location=1..81; Strand=+; Gene= SeqID_71191
aaatattctacgacaacaaattggtcacttatcagttgacgaaaaacattcacttgcgccaaataataaaccaacaaaatg

SEQ ID NO: 109700 - DNA, 174 bp, Heterodera glycines
  Promoter: Source sequence=SeqID_679; Location=4038..4211; Strand=-; Gene=SeqID_58863
gactgtcaacctgcgggaaacgatcccgctgtccatcgcacgccgttccctccaccgcaagttcatgaaccacagaccaatcatcagccggtcgatttgctgtttggacaattcccaagacggttcgagcagctgaacatccaagaggaacgacgggcagtgacgcccgtgatg

SEQ ID NO: 109701 - DNA, 401 bp, Heterodera glycines
  Promoter: Source sequence=SeqID_154; Location=1696..2096; Strand=-; Gene=SeqID_75370
atttttttttttgaaaaattttcggttggggtgtggtggaaaggagccccgacttttgcggttatgtccaaaattggattcaaagttgcattttttcaagtcctgatagcttaaacagcattaaaattaagaaaaaactgtcttctagtttattaggaacattaattctgttgtttgattttattattttttcaaaaattcattaacgatcaaatgatcggatacaatcattttcaataacttatttaaagctgattagtcgatcagggattgaaaaaacttaattttgaacccgattttggacataaccgcaaatgtcgggccgcaaaagtcggtacacgggtggaaagcattggcaaaaatgttttgacttttttttttagatggccgtcaaactcatg

SEQ ID NO: 109702 - DNA, 80 bp, Heterodera glycines
  Promoter: Source sequence=SeqID_39092; Location=960..1039; Strand=-; Gene=SeqID_67741
cgtaagaatggatttgattggcgcgccttttttttggctaaatgtgtaaatcaatcgttttttttttgaaggccaatatg

SEQ ID NO: 109703 - DNA, 509 bp, Heterodera glycines
  Promoter: Source sequence=SeqID_2969; Location=1835..2343; Strand=+; Gene=SeqID_82562
attagttgattggcgagaaacaaatggacgaagccgacctcaagcattgccctataaaatgcattggattttttgattgataagaatctgataattaattaggttgtcataatttgtattattttttgcacgaataaaagttctcaactgaaactagcactgtgattttaaggcagatttcaaaaatatgttaatttattttgtgagtataactttaaaatatttgcttttctctccttgatcgataattaatcattagggagaagcaggcttaaatggtacaaaattccaaaatttagatttaatatggatgaaaaaaaccgaactatggaagaaaaatatggacgaaacgctgagacaaggacaaaaagatgggaaatttctaaagatataattttttaaaatttttataaaaaccgagaagacagtttgatactttaagtttgaggcgtaaaattgttaatcgaaaaaaaaaatctttcatttggttcaaactttgttgccaaatg

SEQ ID NO: 109704 - DNA, 177 bp, Heterodera glycines
  Promoter: Source sequence=SeqID_21391; Location=718..894; Strand=-; Gene=SeqID_52003
gattttcctaatgcaatgtgttggtgttcgaaaaaaaacaaatgtagtaaaaaatttccaaaaaaattccgtgaaaaaacagaaataaatgaaaattgttacccgttatataaacgccctaacaatggaagaacttatacaaaaattgattggaaaacagggaaaaaaagagttatg

SEQ ID NO: 109705 - DNA, 745 bp, Heterodera glycines
  Promoter: Source sequence=SeqID_12708; Location=726..1470; Strand=+; Gene=SeqID_47073
gtgccatcgacagcgaacaccccggcaaggcgtatagttttagaaaaaatcttatttttggggtccaaatcttagttttagcctcgtttgtccttattttgaaaaaaaaacttggccaccctgctgtattgcttattgtaatctgttgttgccgtatattcgctgttgtacatatgcatgtatattgtatattgtgttgtacacactgtaatgttctcatcatactataaatgttttggtctgtaaaaatgttcaaaatttcgactttttgcaatttatgttatgacttttatgataattgtctaatcaccagacaatagcatagaattagcttctaaacatgttaagcttcagaatgataccaagatttaacatgtttttttcggaaaatgcccaaattgatcaaccgagttttcaatatgcaagcactgtttttgataatcaaatgcagattatgacaaaattcatttaaaaaaaagcccactcaattttctatttccctgccggcgacgccctataaaaggaggcattttccaccgaccgacccacacatttccctcatttgtcacaagtacatttattgtgcctaattttattcgtgacgtcggcatttgtacatattacgacagttcgtcgtcgactgctgcatattattatttgttgtcttcaccacacactcgtcaagctgctggttgagcgcaatgtccaagagacggcttcgacaggtgtcactcatttggggatg

SEQ ID NO: 109706 - DNA, 130 bp, Heterodera glycines
  Promoter: Source sequence=SeqID_38268; Location=1..130; Strand=+; Gene=SeqID_67137
ttattaaaaattagagatcggagaaaaggattggccagttttttgagtaaaaagtctaaaaacccgaattctaaaaccttcgaaaaacataaacaaaagtctctatacctatgaaatactgtttattatg

SEQ ID NO: 109707 - DNA, 638 bp, Heterodera glycines
  Promoter: Source sequence=SeqID_14725; Location=652..1289; Strand=+; Gene=SeqID_78851
cgtgcgcctgccccgtgccctgctccttccccgtgccgtgccctgcgccttccctgtgccgtgccctgcgccttccccttaccattcccctttgtgcccattttatcatgtcggatttatttgttcattaattaattatggtttaattacccaagtttgagggtacaaaataaagtgaatttttggcgccttgggtctttaaattttgtcaactcgctctgaatacgtccgcccagcccattcaaacttttttgccgtcatcagaacgacaaaagtggtgccacgacccgggaccaacagaaattcgtccatttgctcatcaaaacctgaccaaacgtccgttaaacattcaacctaacaacaaaacacgagtgagctgaagcagttgacaaaatcaaacaaaaataaaccaaatcaatcaaaaaaaacacacgggtcaccaagcccaattaaaccaaacaagcaaaccaataaacaaaaaataaattccaaaatacttcagtgaaacgagtgacccgcgcaagttctcgcccaccagtgagcaaattgaatcaagaagtggcgaacaaagaattgaaccaaattttgaaaaattaaaaattttgcaccaaaaatggcaaaatttaatgaggcaaatg

SEQ ID NO: 109708 - DNA, 503 bp, Heterodera glycines
  Promoter: Source sequence=SeqID_43966; Location=1..503; Strand=+; Gene=SeqID_71527
ggaagaggggaaaatgccaaaggatggcatttggaggggggggagagaatgcggaaggcagccgactgaccgtcctctttgattccgtaagtgaccaccaacggactaaacagagaatcattagaaaattaattgctccaaaaatatgaacaaaccgtgtgttatattcccacactgaaaatgattaatcaattgaactgatcgtccaaatgtgataagtcaaatcaccgaccgatcagtgcgcatccgacgagcgcagcaaaagtggccaaaatgacaatggccagccaaaggaggcgcaaatgacccgacgtctgaacagtgtcgcggatgccgtggaaagttgtgttttgctatggagggacagttaaaaactgtacagcattcattttggcatgacgataaacaccgtaagcatcgtacagtaggaagacactgtcggctcggcatttgcacccgcggcgcccaaaggtagtggggaataactgctgcttcttcggatg

SEQ ID NO: 109709 - DNA, 57 bp, Heterodera glycines
  Promoter: Source sequence=SeqID_20981; Location=1..57; Strand=+; Gene= SeqID_51555
cgacgaattttatccattaaaaagagaaaataaaggcgcaattctaagccaaaaatg

SEQ ID NO: 109710 - DNA, 584 bp, Heterodera glycines
  Promoter: Source sequence=SeqID_15303; Location=2166..2749; Strand=-; Gene=SeqID_79537
ttcgaattaagtggaaataaatatttatttatttattcactaaaaaaaagttggcacgatgtaactcggcactcgtactcattcagcaaaaacaaaaacacttttcgtataacgcatgaaaagcgggctaaaaacctttcgaaaactgcaaatttaatgccttgtcattacgtaatcaatatgctgcgttgtaaaaagatggcaaattaatagcataaaaagaaattgctgcccaaaaccatcatatttttatggaaaagaaattaaaaaaatttatatttctcaatattggcaggaaatatctctaaacactaggctttttcaatcgaatattgccataacatttcttaaatccactaaattatggaacctttggcatcgtaagataagattttatcttaaaattcttgagatccttcattatgtggagtcaaaaagagtcataatccacaatcctttttaatacttacgtctagccatgtccaaacagcatcaataataataaaaaaccatttatattttaaggctgatcaatttaatagaaattcagtattttccaaaaaaaatcctaaaaaaattctatg

SEQ ID NO: 109711 - DNA, 347 bp, Heterodera glycines
  Promoter: Source sequence=SeqID_25602; Location=1464..1810; Strand=-; Gene=SeqID_56347
gttagcatcatagcagtgcttttccttgtctttttgatgccctcgcaaaatctggttcgcttctgatcagtttataaaaaaaaagttaagcctaaaatttttcgcatatttaaaaagcaattaaaaatttttagattttttattcatctccctttttgaaaggaaggcatcagagaccttagtctacttttaattaacatttggtgcgtttcagagcacgttgtaaagagtatggatgaatgaatgtcgccatatagttagtaattaacggaagaggcagaatttcgaaacatgtaaataacgacaagcgatggcattttttcaggttaacatagtcctttgcaatg

SEQ ID NO: 109712 - DNA, 93 bp, Heterodera glycines
  Promoter: Source sequence=SeqID_22464; Location=2117..2209; Strand=-; Gene=SeqID_53135
ctttgcctactattttctctacaatttttctcccattcttctgcatttattcctattgtaattgcttatccccgcccattgccttcagcgatg

SEQ ID NO: 109713 - DNA, 559 bp, Heterodera glycines
  Promoter: Source sequence=SeqID_7536; Location=1734..2292; Strand=-; Gene=SeqID_65150
atggacattgaaaaagtgtcggaatttgcacgagaggaggttgagagcagtcgattgagtgaaaaaatatacataaatggacttccatggaaaattgaagcagaactaaatgaactcgttgacagtgagaaatggttgagcatttatctattgtgtgatgctactgaaaaaggtgcaaattaactgttattaaatgctaattaacaacgatgagtaataatcattaagattcgaattggcgctgctgcgttcgttcggcaacttttcgaattatatcgcaaaaaaatgtgacggagaattccattgggacattttgtgattatgtttttgacaaaaaatcaaataatttgggattccctaatttcgtttcgtttgcggtaagtgccaactcaaacaaatattttaatttgacattcgtggaccagccaatattgaagttcatttatttatttgcctggtgtaaagaaatcataacaaaataaattaatttctaaaacataaccaattgaccacgcataaacaaaaattaaattagatgatttaaattaaggaattgatg

SEQ ID NO: 109714 - DNA, 143 bp, Heterodera glycines
  Promoter: Source sequence=SeqID_27911; Location=1..143; Strand=+; Gene=SeqID_58572
tcacaaatgcaatgaacgctgggtgtgaaaattgtcacattttccacgaatttgagcggggatgttttattcgcccattggagccgaacaagaagaaagaaacaaatgggtggcgccttgtcatcttcgacgttgaaacaatg

SEQ ID NO: 109715 - DNA, 72 bp, Heterodera glycines
  misc_feature (29)..(29): n is a, c, g, or t
  Promoter: Source sequence=SeqID_12783; Location=1..72; Strand=+; Gene= SeqID_76496
tgtgccatttgctgtccgccctcgaccancctgtcatttgctgtgccattctttgtccaatgcttcgcaatg

SEQ ID NO: 109716 - DNA, 380 bp, Heterodera glycines
  Promoter: Source sequence=SeqID_405; Location=2614..2993; Strand=-; Gene=SeqID_51618
gcgaaattgggaggagcggtgagggggtgggtgatggggtgatcagtacaagggggaggggggttgatcattgatcagagtgttgatcagaatttggtgatgatgggggggggggtgtgcgtgtgttgaaggaaggggggcgtcagcggcgaatgatgatgccggccgtgcatatattatgcaggcaaagaacaaaatgagagaagagaataaaagagagggagaggcagacagtggaaaataaaagagagtgagagggagagagaataaatgaaagagagaggcagagataaatgagagagagagaggcagacagtggaaaataagagagagtgtgagagggagagagatggagagtgcgaaagggaggggaagagatg

SEQ ID NO: 109717 - DNA, 938 bp, Heterodera glycines
  Promoter: Source sequence=SeqID_31500; Location=1..938; Strand=+; Gene=SeqID_61832
cgtcatttcgtcccgcgtcgtttcgtcccgcgtcgtttcgtcccgcgtcgtttcgtcccccaagccgaaattagtcgtttcgtccccaaattaaattctgtttttaaaaggcattaaatttcgagttattagtgcctattttggcagtttttagagactaaaatccggtccatagttaatgaattaataaaatactttattaattgggcaaataacataacataattgaaaaaacatagatcaaccaaattctaaggggcattcattgaatcttccgtattttcatagtccttcaattttcctgcgtatcctccgacctgcaggccaagagccgtgataacatcatgaatttcggcatcactgttgtatgtagcgtccgctaaaattcgcatgatgactgttagcgtttgtgtcgtttgtgcatgaagtttcgagccgatctaagcccagaaaaattcggaagaagcgagggaacagtcgaaaatttggtatgattcccgaccaaaagtcacggccaacaagttccaaaaaggagagaaagttatggtcgtctttcctggtcaaaatcgtcgttcgcctcacaaaaagttactttggtcacattttggaccatatttgatcacagaaattggtgattcatcggcaaatttggtaccaatagacaaaaaggagatcaccccaataaaagtgccgattgaacgattggttataaagtcccaaaaggcgtcccagacatttcgacactgcctaaagggaaaaatccgtttaaaaacgacctaaaattgttgtcgatgtacgcaggaattcgttcagaaatttgcgaagtgactggaaataagtgccgcgaaattgggggaaaaagcgaatcgcaattggggacaattgcttcatattgtttggggggaaattggaaaagcgactccttttcagagccaatg

SEQ ID NO: 109718 - DNA, 1003 bp, Heterodera glycines
  Promoter: Source sequence=SeqID_30565; Location=398..1400; Strand=-; Gene=SeqID_60980
caacaccgcaggaattcccgagatttctgataatgatttaataaaatagaaaaaattagctttgatagcaatacaataagagaattgtaaaagaatcattatgatttaaattaacaataattgtaaaaatcaagaataaaaaaataatttagaactgaagccattgttattaataaatttattaaaaactttattccatcaatttaaccaagaaaaataaaatctcgttcagaatgttaagcttattaaaataaattaaaattaactttaattaaaattaaccaaaatgaaattttagataaatgtcacagaaaaaaatataatattcctgctgagaaaagcaaaaaatagaaatgtaaaaaattatttcaaaaaaccactgcctaaataaattgaatgaaaacaattattcgaaatgccgtcgactgaaaaaatgtaaccgattaggtgatatatgaaaatacgaacagattatatttaaaaaccccaaaaaaagaaaatagaacacactgaaaatttcaagaaaatgatagaaatattaattaaaaaatgaatgcttaaaaaagaaaatgattgggaatattgtgagtttcgattgatttatattgtgaaatattaaacccataattttaaaggcacgagacccaaaaaaatacagcggactattatagtatgcccgaaggatagataaaaaagatttaatagaaaaatgtgaaataaattcaaaaataaaatacgaaatagagcagaattttcgaagaggagttagatttgaaatggaaaaaataaaaattgactgggagacaacctgtgttatacttgaaaaactttttaaaatatttgattaaaagatcatttaatttcgaagaactcatggtttgcatgaaaataattgaaatgtaaaaccaatgaatgatagataaattgataaaatattatatgagaagagatatctagtacaacgataattatatcttaaaaaaataattaggagaaggaaatg

SEQ ID NO: 109719 - DNA, 159 bp, Heterodera glycines
  Promoter: Source sequence=SeqID_7857; Location=4469..4627; Strand=-; Gene=SeqID_66186
gcccagaatggtaatatttttatgtgataatattattttgtaataatgtggaatgacgggaagtgatttttaaacccctaaaaaactgaaatcattcgttattcaaacccaggccttaatttcgaattaaaatcttgggttttcaggctcatacaaatg

SEQ ID NO: 109720 - DNA, 130 bp, Heterodera glycines
  Promoter: Source sequence=SeqID_15524; Location=375..504; Strand=+; Gene=SeqID_79803
tttcaatttgttccgttggggcatcgaatttatgtgcgtttttctctgccttttccgtttcgattcccttaatttgccaaggcgtcacgtggacatcgttctgaagaagtatccgctgtacaccaacatg

SEQ ID NO: 109721 - DNA, 647 bp, Heterodera glycines
  Promoter: Source sequence=SeqID_23544; Location=957..1603; Strand=-; Gene=SeqID_54235
ccaaaaggtcattatattatagcaaatgtattgtgggtataaatgattagaattcggagggaccggagtcatgccgggattttgcaggatcggtccattcatttcaaattccgatcactaatgtttacacatgatgtttcttttgcactaattataagacatcattattttgaaactctatatctatattttcgttttgcctgtctctatttaaactcgcggaatctaaacatcactctcgttgtttaatgctaaaaaatagtaattacgtcattacgagcactaaaatgcgaaggcataactaattaatgaagaaagcctgtatatactacgcctatcagggtgggacgcgactgcgttgtggcactgtcgcgttgtctcagtcccacatttgccgactatgtagaaattaagtataagaagataagcacttggtacgctacaccattatttgtctatttatttgcctatagcctcaagctcaaacaccaaacaatccatttctttttcctttaaaaaaatatataatgccaaactttattaaaaaaatcttatttaaaaagttttattttttttcaattttttgctccaaacgcctagacccacacttatatgttaggtaggtaatataatttcctttcactatg

SEQ ID NO: 109722 - DNA, 828 bp, Heterodera glycines
  Promoter: Source sequence=SeqID_3359; Location=2248..3075; Strand=-; Gene=SeqID_84355
ttttggaaccccctcgctcgtacgtttttggccaatggcagacgtttcaaactggaaacgcgataaagacatcatagaaaattaaacaaattgaataggaagggttatctgaaaaacaaataaatttgaaacttaaattaattaattaattttagcggttgaaaattttaaaatagtgaaattagatatgtatttaattaatttagcggttgacaaaattaaaaattaaaactagtgaaattagatatgcataaaatttaagaataatgaaatgaaaataaatgcgtggctttcttttaaatgccatttttttttgtaaagccacgcccatgagatagcatatcgctgatcgaaaataaattttgagtaaaattaatcattgtttattattaggactcgcaaacaaaaaggccccaaatcgcgaaagtggtacaattagttggcaaaaaaaattgaaaaaaagcatgaaaaggaactaaattccgaaaaatacgtgaaaaaagcatttacagcttgttattaagggtttttagggctatacgagaaaaactctaccaaaaaaaaacaattttgatcatttaaataaatattataaatatttttatataatgtttttctaacaatgacaattttcaaacataaaactttttatcaagaaaaatgaaattttgtcgacaatttttgagaagatttttcaattcataggtggtggcgcattttctgaaaattttttcagatcatttcttagtgttgaaaaattccgttttgaaacattattcaaatttaaaaattggtccgacggtgctgtgaagcgctgtcggcgaaatg

SEQ ID NO: 109723 - DNA, 715 bp, Heterodera glycines
  Promoter: Source sequence=SeqID_19932; Location=541..1255; Strand=+; Gene=SeqID_84693
aaccattctgtccatttctgtgaaattaccatttggtttaggaaaaactttcggaaaattttggaaatagcggacaaagagaaaatttcagggtttgtgagtttttgtctttttcgttaattgttaaccaaattaagccttttgcgcattgtcgagtcttttatcattgattccgaatgcatccacccaattaggaagcttgaatatgcagcaggtcaaaactgaatctgcagggtccgacaaataactcaaatgttctttcaaaaacagaatatcggatgagccgactcgctgacacagtgcttcgattatttcctactcaaattgaccggctcgattcattattcttatatttagcagaaaatggagagacattggccgatgttcacttggatgtacttaaaatgcttgacattcatgattcatacattgttatgtaaaacaaattcttgctcttgacaagattttatctcttataattcagttttgcttttattttgggacgttttttgttttttcattccaatgtcttctccttcgtcctttctatttgagcagtttttcccatggttggtctccttaattgctctgttctctataattatttggttgcgaagcaaaacaaatcgaactttgtttgtgaatcacgaaaaaggtaaggtttaaagaggaggagaatgttaattaagttgtaacaaaagggagaagactaatg

SEQ ID NO: 109724 - DNA, 388 bp, Heterodera glycines
  Promoter: Source sequence=SeqID_19670; Location=806..1193; Strand=+; Gene=SeqID_84404
tactagtaaactgaaaaaaaaagaatttaagaatttgctcgacattaaatcaaacataaatttgaatttacgcaattacatattcttttccaattttggcgaaatatttttttttgtaaaacagagcttcaaaatttagtttttcttttaaaaatttactgacacattttcttccgatggttttgcccggtcattgatagaaaaccataaagaacattccgctgtgccaattacataaagcttaggtaaccaaaaaccaccaaaaataatgttgcgaattaagccctcaggctacaacacgcaatttgcttccatttcttttccaaaatcaaaatacgattttataacgcaattattttgtttcagaaaagtgtaatgatcaacaatg

SEQ ID NO: 109725 - DNA, 184 bp, Heterodera glycines
  Promoter: Source sequence=SeqID_15032; Location=2577..2760; Strand=-; Gene=SeqID_47259
tttcctgacaattaattaaatttacttttgaatttattttatggcctattaaagggaataaaatttgggaccaaattgagcattcgaattgaatatgtcattgcatatttccacatttcgtcaattattaggtcgtccatttcgcaatgcttttcccatatttcttcgacattttggccgcatg

SEQ ID NO: 109726 - DNA, 274 bp, Heterodera glycines
  Promoter: Source sequence=SeqID_11452; Location=1..274; Strand=+; Gene=SeqID_74849
gttgaattttcaggcgtaatttcccatcatttagtaaagtttttttaattttggaagtggtaaattaaaaaaattaaaataattaattaagccaagattaaagttatggaaatgaaacttgtgattaattcgcttgaatttttaaaatgttctttaaatttaaaatgttcgtaataaataatatttttattattttttgatattctttcggcataactaatttttttttaatatgtcatctatgtttttttatttcaggttttacttacaaatg

SEQ ID NO: 109727 - DNA, 1003 bp, Heterodera glycines
  Promoter: Source sequence=SeqID_23725; Location=356..1358; Strand=+; Gene=SeqID_54420
ggggaaattggaaatatttgaggagacagaaaaaaagagaaaagaaaattggagggagacagacaaaaggcgggggatttggggaagaaattgaaaaaaggcaaaaaaggaagaggaaggaatattgtaaattaatggaaaatgaattaatgaaatggaaataattaaataatagccatagataattaaaatggagagagagagagaggggtagagaaagatagaagacagaaggggtaaaggagagagggaaagatagaagagagacagatagaagaagaaaaagcgagagagagagagagaggagagagacaagaaagataaatcgaagtcttttgtgttcaaaaaaacataaactgagagaagcaaattagtaagatcaggggattaaagagccaatttctgatcattcaacaccgccggtgataaaaaatgctaatgaacggactgattaactcgggaagaacagctcagtgataggttaagcttaagcattaaactgaccattcattttcatccatggaaatgtctgaactgtcgtcgaactctgctgatgatgtctttgctggtggctgtgatcaacaccggcggatgagaaatgggcggacgaagacgaagaagaagagggacaatggacagcggaggaaggggggaggacgagggaagaggaggaggagggcacggcaccgtagaaactaaacggaggggggagtggtcgaagaatggcacgaagacgaacaaaacgcgagagcacagaaagaaatgccgaattgggatttgaatgagggaagaagggccaaaagggaaggaatcagcggatgattgatggtcggatttaaatgatcaattgattaccaccagctttcaaaatggtaaataccctcctcaattgcttttcctcggcttctcgcccgcccccccccccaattaaatgttttaattttacccaacggccgccgctgctgccgctgtgtttgcctctgcccaatgagcggccaacatg

SEQ ID NO: 109728 - DNA, 757 bp, Heterodera glycines
  Promoter: Source sequence=SeqID_15799; Location=1450..2206; Strand=-; Gene=SeqID_80119
tatcttttgtcacaacatgtttgttatgccatgcaagaaatttaatgagaatctaaacatcatacagtatcaataatattttattttaattaaaatttcatattgaaccttttttattttatactcattgtttaattaataattgttattgttgttgtttgtttggttgttgttattttggttgtgactttcacagcttacaattttcgtgttctttcattcttttccaacacttcgttatgattttattcaatattttaaattaattaccacattatttgtttaattgttaaaagtaaaaagagccagagaaagtaaagtataatgatattttattatatttaagattccaattacataagctgattccaaaattgattcgcgaatttttctaatacttctctttatctaatctccctctttctaatttttctctaatctctctcactctctctctctttttccactccccccccccccctccctctcatacatctctcctttttctttctctttttctctctgtctctctcttttcttttttctctccctccccctcatttatcactcctttccggtctacctcagttcggccccagcacgtttcggccccaaataaaacaattaatttttcaaataaaatttcacgcaaaaattagcaagcaaaatgacttttttaaattaatagtgttattcttatttttatatttttaattttaattcgaacataaatttaaactttttaagatttattatg

SEQ ID NO: 109729 - DNA, 1003 bp, Heterodera glycines
  Promoter: Source sequence=SeqID_3740; Location=1187..2189; Strand=+; Gene=SeqID_51697
aaatttctttttgtttcgcgccttcgactgaacatatttttaaaatgtaattaaacgatcaccacttttgaattgaatttgaaattatcaccttgctgccagcagatgttgcaggtaattcttgatttttctaaaattaaaatgaaaaaaaaacactcaataattcgtctaatcttaatacaatccccccccccccctttaggttgtttttccgcatcggatgggtcccccgtacaaaagggcgctcaaaacattggcagcagaactcacgcaaatgattatccaagacgatggtatgtttgaatatacaaataatttaaattcaattccattcgtctggaccaaaaaattattgaaaaatgaaatttttttaaaaattgcgctagggctgggaatatttgttttttttttaatatcctaaaatgataaaaaaaattaaatggcccttgatctcaaaataaaatcatttgaaaaattgtttaacaattactttttttaaaaattcataaataattttctggccagtttataccctagagaatttttcggtctttcttatttcccacttcggtaatatgttagttttttttaaagtccacatttaccgattttggcagtttgaggtagggttaagccccgactctcggggagcaaaatgtcggggaacggggaggaaattttcataaaaagtctaaaaaaacaaaaagaaaaagtccagaacaaaaaagtcttaaaaactcatttaaagatacttccatcttatttcaagtgcactttacgactttcgtaattccccgaaacctgtcggggcttaaccctagtttgaggttccaaaaaacacacagtaatggaatcctacattttttatttaaaaaatttaaaaaacgcatttttatttatttcttttttgctgtttagagtccggccacgacagcaaggaggacgcgttggcatgcatgcgcataatgttgcgcaagtgccggggtggtgccggtgcgccatg

SEQ ID NO: 109730 - DNA, 262 bp, Heterodera glycines
  Promoter: Source sequence=SeqID_35611; Location=1..262; Strand=+; Gene=SeqID_65130
atgctctacacgataaaagtgatttaaagcgatctgactctcaccggacagttcggaatgttcccttgtcagcacgtcattctatacccataaacattctcaattaacctgcaaaattcaaaattcattaataatatgtttgtttgttattgatcagtaaggttggggaaaacaattttaaattattttttggcccaacttttttttttgaaatttaatgaatttctaataaaataaaaaacgatttgactagagagtgatg

SEQ ID NO: 109731 - DNA, 121 bp, Heterodera glycines
  Promoter: Source sequence=SeqID_4885; Location=4550..4670; Strand=-; Gene=SeqID_56078
ccgccgtgtctatgaaaagaataacctttttaatgattttttaacaaattaccgtttttctaatgtgtatactgtaatcaatgttgatttttgttttatttaagtagctttacgaaaaatg

SEQ ID NO: 109732 - DNA, 877 bp, Heterodera glycines
  Promoter: Source sequence=SeqID_12798; Location=1182..2058; Strand=+; Gene=SeqID_76531
tttaaattaatctataaatgacaaaacaaaataggtggcatttccaactgatgttttccaattgatgtctcgagcgttatttgcatttttctgcatttttgctatatgtaaaagaaactcaaaaatagaattttttgtgttacaatttttgtttgttttggttaaggccgtttattatgagaaaaataagtccagaaatgggaaatttcatttttctactactcatttcttcaaaattaatattagttttattttgaatttttttttctaaatttatttcataccatatttaatgcttaaatttaacgaattgaagaaattttgaaaatttgaagaacgctcgcaattgaacccgaatatgatgtccgtttcgacccatttcgaactccgaacccggattcgaacaattatcaaaattcaattttttttctttcaaaaatgctttcccacttcattgccgactaatttccttatcagcaaattgcttcctacctacgcccacacccttttccctcatttatttggtcaagagttgcaggtcatttttttgcgttatcaatgcgagaacaaacaaagtgggcatgcagaacgacaacggcaatataaatatgatttcttgcgatgataataatttttaggagaaaaaatgaaaaaaaaaattgaattttgataattgttcgaatccgggttcggagttcgaaatgggtcgaaacggacatcatattcgggttctacgaccccgaaaacccatggaaacgactttttaatttaaaatcaatttaacaaagagaaaaattttgttgacacaaaacccgaaagtaccccaaaacgacttgaatctaaggaccctgctctgcaaattattacggacactatg

SEQ ID NO: 109733 - DNA, 140 bp, Heterodera glycines
  Promoter: Source sequence=SeqID_33434; Location=1..140; Strand=+; Gene=SeqID_63506
caggttcgaatcctctacatgtttgtccattttagacttttgttttttgttttttatgcaaggtcaattataaaaaaaaatttttaatgaaataaaatttttattaatttttttaattaaaaaattcattaaagataatg

SEQ ID NO: 109734 - DNA, 77 bp, Heterodera glycines
  Promoter: Source sequence=SeqID_2056; Location=5920..5996; Strand=-; Gene=SeqID_47147
aaattggggctagtaaaccgatagaagaagaaaaaacagaaggaaaaacaagaggtgaaatattaaagaaaaaaatg

SEQ ID NO: 109735 - DNA, 385 bp, Heterodera glycines
  Promoter: Source sequence=SeqID_26035; Location=1..385; Strand=+; Gene=SeqID_56785
agctcaaccattcgcttcctcacccaaccaaatttttttctgtaagaaatggaaaattttaaggtgccaacgatgaaccacatcatgcagcaagtgaagcaataaattgagtttggtgcatgcgcgttgtataaaacaacatgtgaatgaatgtgtttgtggtgggaagggtgttgacgattgggcaagcaaaacattgggaaaatggacagattagacgagagtttcaattaagaaaaatgcaaaaaattggagtgcgctaaactaattagccgatcttaaccacatctggtcagcggaaagccggaaaataatgaaaaaaaaatgaaatttgaaaaaataagtgaatatattgaagaaatgaacagacagacagaccaccatg

SEQ ID NO: 109736 - DNA, 1003 bp, Heterodera glycines
  Promoter: Source sequence=SeqID_7010; Location=124..1126; Strand=+; Gene=SeqID_63562
ggaaaaaaaaaaaattgaaaatagcattttttacataaaaaattttaaatctataaatatatttaagaaatctgaacaattttcgtcgctaccccaaaatcagaacattcttataaataacgcactcttgttggcgctaacgaaatcagatgattaaagtgaaaaaaggaagatttacgagcatttaaaaataaaaattgagtttttcgttaaaattttgttgatcactacccgatcggggtccccgacccccgacaattgagctcccccccgacccgacccccgacatgtcgtcccccgaggtccccggcccccgacattttgccccccgagggactcggggcttaaccctacttgaagatttaaaaaaattcaaaatttaagagaagccaactttaaattaaaaaaaaaattattagtctcaaagactatccaaaaacgaccctaaaaaatcattaaaaataaaattaaagaaaagttttgaaatgttttgagatttcactaattgcaaaggctataaaaaattgccttagggaaaaatcattaaaaatgcaaaagacagtgaaattaaaaacttaaaaaaatcattaaaaaacattaaaaattttgaattttttaaaatcccataaaaaattcttgtaagataagaaaaaaaaattacatttttttgaaaatttagagagaaccagctttaaaattaaaaaaaaattattactcacaaaggcaataaaaaaaaaccctagaaaagccccattaaaaatgcaaatgtccgagacacttaaaaattttaaaaatttttcggaaaatttttgagtttttttttaaatgcgtaaaaaaaattcttttaagataacgaagaaaaataatatttacattctcgaattgacattggtgttgaaaacggtggggtacagtgtgtcattgttcaaatctgatgaaacggttgggccccacaagaacaacggaaggttgtagaaggtggcaccgtagccggcgaccaatg

SEQ ID NO: 109737 - DNA, 904 bp, Heterodera glycines
  Promoter: Source sequence=SeqID_7995; Location=2345..3248; Strand=-; Gene=SeqID_66628
atctccgttttcgctcgccgagagtttgccccgagggatgaaatttgttaattggtgacaccgacaatttagttattattttttttggcttaaatccgcaaattcaaagacaccttctaattacgggtcattcttttctccctttccctctttcccttttgtcatttcgtttctttttaattgcccctttttcttttttttttgtatttactgtaattacggttttatgtcttttggtatttatgtgcttattaattaattttttattatataaagaattttttcatctttcgtttttgcgtttgtttctgtttttaattaattttgaaaatgttttcccgtgtcactcttttttttttactttttgccattgcgcgaatttacggcatcgccgccactaatggacatccgcccaccccattgggtgccgggtgtttggaacggatgagaagcgaatggcactgccaaataaatccgtctctttggcgcaattaatttttttctcacattgaccgaaagcattttatgtctgagagagtttttatcattcccttggacaaaaaatgcccaattaatatgaattaattaattaattaggaaatgtaccatcaatatcagttagaggtgagaaatttataagcaaagtgatatttgctttgcaaataaaaataaataaaattattcaaaaagggaaaaaatcaatgaaaaaattattaattttatgccctcctttccctccttagcaaatttttccccgctcgtcggcggcgggtcgcgagacgccgtccaccgcgttgatcagcgatcgggacataggcaacgccaacattgtcgggagttcctcctccgcgcattcgattgacaacaattcgaccccgtcagcgtcgatttcgcccgtccaatg

SEQ ID NO: 109738 - DNA, 451 bp, Heterodera glycines
  Promoter: Source sequence=SeqID_44933; Location=414..864; Strand=-; Gene=SeqID_72341
tggaataaattttggaactgcgctgcctaacggcggtgcttaaagtgcgctaaaaatgatcaaatgattatcaatttttatttttcttaattccaaaatgaattcgaaacgcaaaaatttaatcataatacatgtggtaaaaaatgcatttaaaaataaaaaaaattcttgaatttgcttctgaattttttaattttaaatagtaaattactttttcgaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagaggggagaaacgggcgttgttggctttggaaaaatagcttataataaaggagagacgagcagacgatgagtgagagaaaaatattggtaaaaatg

SEQ ID NO: 109739 - DNA, 279 bp, Heterodera glycines
  Promoter: Source sequence=SeqID_1326; Location=1072..1350; Strand=-; Gene=SeqID_72563
acatttttaatatttaaaaaaaaaaaagttgtgtgaccgattatccgattggacatccaactctccacgtgctctgcgaggaagttgattggcgccgacccgaggacaacccatacccgctcgccattctaaaagtgttcgtcattccaccgcgacaaatcgacatccccgttttgccggtcaaagttgacgatcggctttgttttccactttgcatcaaatgttgcaaaaaatttccgaatggtgccgtcaaatcatcatacagttgtactcacgatg

SEQ ID NO: 109740 - DNA, 141 bp, Heterodera glycines
  misc_feature (23)..(23): n is a, c, g, or t
  misc_feature (40)..(40): n is a, c, g, or t
  misc_feature (125)..(125): n is a, c, g, or t
  Promoter: Source sequence=SeqID_319; Location=2070..2210; Strand=-; Gene=SeqID_82135
agaggtggcaaaataaagcatgnatcagtccactgagttnggttcatttttgatcagatcgtcgatcggttcggctgggacactcccgcctatgactacgccatgtggcgaaaagcgtttgggcncaacaatttcggcatg

SEQ ID NO: 109741 - DNA, 58 bp, Heterodera glycines
  Promoter: Source sequence=SeqID_13697; Location=2288..2345; Strand=-; Gene=SeqID_77613
cgactttatagcgagcattttgatgtacgaatctctgtcaagatcggcactgacaatg

SEQ ID NO: 109742 - DNA, 172 bp, Heterodera glycines
  Promoter: Source sequence=SeqID_69; Location=8216..8387; Strand=+; Gene=SeqID_61209
aacaaattttattctaaagattaataaattataattaggagcatgtgatctaaacgatgaacatcatgtgtcgcacaacgtacaatccatcgtgcgcgtagagaatccagacgaccgtctttgtctagcacgtgccgtgctaatagggcttcgagaccgtgaaaccaggatg

SEQ ID NO: 109743 - DNA, 613 bp, Heterodera glycines
  Promoter: Source sequence=SeqID_4052; Location=894..1506; Strand=+; Gene=SeqID_52973
acaacgccgacaacaactacgacaaagccaaggaacaaaaaggcagagttgcctaaggcaaatggtgctatgcaatggcctcaacttttattgtgcggagcccttctgccatttttggcatttgtttggcggcaccaaaggggtttgtttaagtttataggaaatttggtcaaaaaatttttgaatcctcctcaatcaaaaaagggaaattttgtgaatttcaatcaaaacatttttcgtttatttcaagatttgagtttttgagaacttatagaaagtatttcatgcttcctagggattttttcaaaaaaaataaaataattttttagcaaaatttttgtacacatttcgtgcttttttgcatactaaatattatatttacatattttaaaaatatggatgaaataaatatttttccctaaaacctcaaaatatttttttattaatgaaaaaattaattttaaatgaaaaaatttagtgcatgaatgcgttttttgatctcctttcttcaatgcatataagcaaaaaaaaaaaaaataaataaaatcacagtcctactgataattcatttaacaaatttacagacgtcgccaatttgttggaagacacaatg

SEQ ID NO: 109744 - DNA, 64 bp, Heterodera glycines
  Promoter: Source sequence=SeqID_7370; Location=1195..1258; Strand=-; Gene=SeqID_64631
ggtggacaaaccaattgggagctaacaaatcaaagacaaaccaaagaacaaacaattacagatg

SEQ ID NO: 109745 - DNA, 399 bp, Heterodera glycines
  Promoter: Source sequence=SeqID_18379; Location=1..399; Strand=+; Gene=SeqID_82980
aaaaaaattagatttgctcatattgatttacggtatggccgtaaatagaataagcagagacaaaaagccgatgaggaaaatgccgcgtaggaaaagccgataaaaaaggcagagacaaaaagccgatgaggaaaatgccgcgtaggaaaagccgatagaataagcagagacaaaaagccgatgaggaaaatgccgcggaggaaaagccgataaaaaagtcagagacaaaaagccgatgaggaaaatgccgcggaggaaaagccgataaaaaaggcagatgttccgttgcctagacatcagctaaagctttcgttttctttgagtttaaaatgccaactgaataaatttcccagtgccaataacgttttttagataatatcttttttaattatagaaatg

SEQ ID NO: 109746 - DNA, 251 bp, Heterodera glycines
  Promoter: Source sequence=SeqID_12667; Location=2616..2866; Strand=-; Gene=SeqID_76341
ctcagaaagtgtttttatgtaattttgagttggtaacgtattcggcaatttttcctaattgaactgcttttgcaattcattttgcgagaaaataaattcaaaaacagatttgagaggccaatgattttgtttttaaagttaatagcaatggaatttacaaaaataataatgctttatgctattgcttaatttaatagcagttgaagctttcttatttgtaaatttccgaattatgatcgcttggcgaaatg

SEQ ID NO: 109747 - DNA, 320 bp, Heterodera glycines
  Promoter: Source sequence=SeqID_11039; Location=1288..1607; Strand=+; Gene=SeqID_74371
aaaaatataaagtcattcttattttaaatcaattgcggatcaattaacagaaatggcggagccaaaggaagtccatccaatggaagaaatgaccgacggagagcagctatcgctccaatcgatggaaagaagcctgcttaagcaattggaaaaagtcagaaaaacattggccagtggccaattaaggtgcgggaagaggaggaccaagtggcaccaataatgaaggaggaaaatgaaatgaatgacgatgatgggaaaccggaaactgaaaaaaaggaattaaaattggaagcaaaagagaagggcaccaataggaaatg

SEQ ID NO: 109748 - DNA, 1003 bp, Heterodera glycines
  Promoter: Source sequence=SeqID_18850; Location=420..1422; Strand=-; Gene=SeqID_83544
taatttaatgaatgtttaattacttttgaatggaaaacgcaaatttgagaagcattggagccaatgtttgaacagtccgtcgaggcggtcaatgggaatgtgagtgatcaatcgaactaattaattgttaattgactcttctgctgctatggcttttttattgacgtaagacgcataggaacgaagacaaatgagcacagcaaaagaaatggacaaattaaaaagcaactaaatccgcatgcttaatgaattaacttaattaacgtgtctttttctttttcatttcaaataaatcattaagtttgttttcgagtacaacttgtaaatatctcaaaaaagttaaatcttctaaaaagtgatcgcatttcgcacccaaaagaaaaccagcgcaaattgcactttctgctgttcgctgtctctttctcttctcaaccggcggatggcgttgtgaatgaattaatgaatgattggctgatccgaagtgccgccttttctcctttcgcttccaagtttttaaattagcgtaatcccattagcaagcagaaaattatcaaagtgtgcgacttgggtgggaacggaaaaagaagcgcaggaactggcggaatgagaaagggcaaaaattggaatgatcggaaacgaaagagagggggtggggagggggtgaaaagcatttctcccttcgcgaggcggggtgggtggaagcatttctgccctcgacctgctaaagcggcacccttttaacaccgccggcgcccaaataacgccaaactccttccgtaaatcccatgagaagcattgcacttatgataatcaaaagccggatgatcagcatggatttgatttgtcatttggagcataaaaaaggcggtcaacaaaaacctttttgaccggactttcatttgggcattgccatggcattggattgacagaccaatcactccgatcattaatttattcactgctctctcttaattttaatttattttatgcttatgcttaaatg

SEQ ID NO: 109749 - DNA, 331 bp, Heterodera glycines
  Promoter: Source sequence=SeqID_26071; Location=441..771; Strand=+; Gene=SeqID_56818
aaatgttaagtatatattaattttttattcgacaaaaatcaagcattcatgcttttttatattttgcaggtaaatgtatgcagctataaatttacaacgaatacaaaatatattctacagagaatataaatgttaagtatatattaattttttattcgacaaaaatcaagcattcatgcttttttatattttgcaggtaaatttatgcagctataaatttacaacgaatacaaaatatattctacagagaatataaaatgttaagtatatattaattttttattcgacaaaaatcaagcattcatgcttttttatattttgcaggtaaatg

SEQ ID NO: 109750 - DNA, 295 bp, Heterodera glycines
  misc_feature (188)..(188): n is a, c, g, or t
  misc_feature (263)..(264): n is a, c, g, or t
  Promoter: Source sequence=SeqID_3051; Location=1286..1580; Strand=-; Gene=SeqID_82981
ttaatttttatattttttgaaaaaactttctagcgatttaaggttttataatgatcaaaaaattcgcaaaatacgctgaaaattttttcaaaaattttattttcttcattcttatggaaaaattttatttgattttttttgataatttttgtttgaaaaatttttcaaaaaattttcgggcgtgcgtnggcggtgaattagtgcacctttgtactgtagcattgtcctaccgtatccacccctctgtagcgtataccgtatcnncacacacccacaggagacagtgtttgccatg

SEQ ID NO: 109751 - DNA, 456 bp, Heterodera glycines
  Promoter: Source sequence=SeqID_238; Location=7318..7773; Strand=+; Gene=SeqID_79392
aattagaaggaaggcctagtacatctgtgcaaaggaatccgaatgagaagccattgattggaaggatgagaatgcgaacgtgtcacaagtgtggagaacaaggacacattgcgaagaattgccggcaatgagaaagagtaagtccgtggaaatgaatggttaagaatgagtgtgaggcccggggacggtccctaaggggtattggaggagaatgaccataaagagtgcttaagaaaacgcttttgcagtgggctatggcccaatacgtattttgaggcctcctgcgttgtctttcttttctcaaaatcttatttttgtccactattgtacctaactgtcttcttccgctttattttctattgtaaaataatacatttaacttttcttaatatgaaataatgactagtgagctacggcccaaaagtattaaaaatgacgtcaaatatttcagcaatg

SEQ ID NO: 109752 - DNA, 90 bp, Heterodera glycines
  Promoter: Source sequence=SeqID_24158; Location=1686..1775; Strand=-; Gene=SeqID_54864
aggtcccatatagtcatcttaggaatacatatagggcgcacattcctcctcccgcctgataaagatgacgacacgcccattgcaaaaatg

SEQ ID NO: 109753 - DNA, 59 bp, Heterodera glycines
  Promoter: Source sequence=SeqID_7778; Location=1..59; Strand=+; Gene =SeqID_65928
cccccccccccccctcaaaaaatataaatttttgtttatatcagtgtcgacacaaaatg

SEQ ID NO: 109754 - DNA, 161 bp, Heterodera glycines
  misc_feature (94)..(94): n is a, c, g, or t
  Promoter: Source sequence=SeqID_42591; Location=1..161; Strand=+; Gene=SeqID_70446
gagaattgcaccaagttcgtctccaacaaaattttatttgtttcgggaaaatttcaatttttgcagaagcaaatgaccgacttggacttttcgnatgacaaaggcgcatcagcagaagcaggaaaagtggccgaactgacgggaggaactcacggcaaatg

SEQ ID NO: 109755 - DNA, 341 bp, Heterodera glycines
  Promoter: Source sequence=SeqID_36825; Location=314..654; Strand=-; Gene=SeqID_66053
ggttaataaaaattcatttagttttaggaatttgatgacttccacaatttcactatttacctgaacaaataattcaaatttttgatgattaaattgaaaaagtgccaaattttcggtgattctgtttgctcatctgctgtcatactttcttttttgtactggtctcacaaactacagtcaaaagttggcatatttaagtcagaatttgccaatccaatcccttcaccaattcctctgtttaaagcccttttttaaatcggaaatgaatcccaacggttttttctttgttttagcggtgctctttcttgtcaaagtcgactttttacagtgcaaatacaatg

SEQ ID NO: 109756 - DNA, 130 bp, Heterodera glycines
  Promoter: Source sequence=SeqID_4954; Location=2345..2474; Strand=+; Gene=SeqID_56353
tctgttggaccgagtattggccgggcgggtgcgtccgctgcgcattggcatgtcgtgccagccgccgcagttcgcctcgccctaccacatcccacaccgcgctccggagcagaacaccgccgcagcaatg

SEQ ID NO: 109757 - DNA, 938 bp, Heterodera glycines
  Promoter: Source sequence=SeqID_20138; Location=747..1684; Strand=+; Gene=SeqID_84925
ttttcttgataaccgaaggagggggcgagaggagtcgtcggatggttaaaaatcccccgaattttcgactcggctatttttggttaatatttcctccaccatatttttaatgggtttttttggataaatcactttcaaatcggcagaataatccaagcaatcaaaaactaagttttcctttgtgaatatttgtcatttttaaagtcttaaggcgacgcagaaaattctcaaaattttattaacttaaaaattgtctgtccacttttctttttgtttaattttgaaaataattcttttttttttaatttgaaagttctcctaaaattccttaattaaggtgtgatctgttaacaaattttctattttttgcagcattatttttcctagatttttagtggaggaggtccggcggtgccggtaggcgccgtccgggaaaattttgaaaattaaagtgcaatttcaaccagattttttaaaaaaatgagcaatttttgagaatttgaattttttaaatttaggattttagtttcgcgatcgattaattcaataaaatttctattttcttccaatccaaataataattttctctctgattacatcggtgctaggacaaaagagaattttctaaatttaacatagttataaaaaaatttcgaccataatttaatcaatgcgttagcaattggcaaattcattcaaaaccaaccataaattgaaagttgattcagcggcaggtgctccctcccaattgtcactgcccccagggtaagtaccaattttcttcacaatttcgatattttttcaaattaaatcattgtgcattttgtcatgtgtcatgtgtactcagctgcaaattaaaattgaaatttcctaataaatttgccaatgctttcattaaatatttaattcaacttccatttggaaaaaattcaagaatg

SEQ ID NO: 109758 - DNA, 612 bp, Heterodera glycines
  Promoter: Source sequence=SeqID_10905; Location=2056..2667; Strand=-; Gene=SeqID_74185
attaaaagaaaattggataaatttgccgtgaaattttatttgaaaaactgtttatcaaaatttgtatttatattaaaaaatatatatatatatatattttacagtccggttgcaaaagtaatgcatcaaaatgtttaatcgaccaaaactcaattttaagtttagataaaattctaaaacaatttctgctaagctaacttttgattctgatcaaaaaaagtctttaattaaataataaatggctgtatatgagtgccataatgaaaatcaaaccaaaaatgtcaagcgccaaaaggacaaagaaaaatttgccattttaaaattggtgggaaaaatttaatgtacgcgcggcctaattcttaattgaaaaatgtgacctcatttactgaaaagtaccgagaattccatcataaaagcttcaaagaattttcttcttatacatatctttatttttagttatattttaataattttttaatttttttcttactcaatttcctttttattatttttattttttattattattaattacatataattgtagtaatgaattcattattaagtttaggtaattgttatttgaattaattttcgcagaaaataaaaatg

SEQ ID NO: 109759 - DNA, 308 bp, Heterodera glycines
  Promoter: Source sequence=SeqID_28155; Location=1..308; Strand=+; Gene=SeqID_58806
acggagttggctgggacggagttggcgggacggagttgtcctttttgtattgggacggagttggcaggacggagttggctcgggacggagttggcctgggacggagttggcctgggacggagttggcgggacggagttggctgggacggagttggcgggacggagttgacccgcttcgcgcgaaaacgaccctgaccgttttttgcagacctactaatcatcaatccttcccttcaacgcaattaattcttccttccctttgtgaaatcattcggaactcggccaaattgtgctaattgcgaaaaatg

SEQ ID NO: 109760 - DNA, 422 bp, Heterodera glycines
  Promoter: Source sequence=SeqID_11719; Location=795..1216; Strand=-; Gene=SeqID_75206
ttctctcgccgtttctcaatttctcactcgcttccccatcacacccccccctcggacggtacagtaccgaaaaatatataaataaaaaattttcgtttttctcgtaaagcttagatttttaaaactctaaaggtatgtggatcatattttgtagataggaaaccaatgaatatacaaactttgcatttgtattttcttttcctcttctttttccacactctctaattgttgtgtctcttacaaattagttttgtaataagacattattgatttgtttgtccattgcatgtttgtgctcctcaatatttattccgatttcgtacattttaatttgtcggttcaaagaccgaacacgttttttttgcattgaataatttcgaatacttttttctcttccagagtttgaaattaaattaattatg

SEQ ID NO: 109761 - DNA, 71 bp, Heterodera glycines
  Promoter: Source sequence=SeqID_6091; Location=1..71; Strand=+; Gene =SeqID_60301
ttttagataataaatcggacgaagacacaacgccaatcgaaggaaaaaaagagcggcacagtaaagaaatg

SEQ ID NO: 109762 - DNA, 158 bp, Heterodera glycines
  Promoter: Source sequence=SeqID_11316; Location=1412..1569; Strand=-; Gene=SeqID_74695
tgttgaagaagcaggaacaacaattattctctgtgaattttatagaaaattattttttaaacataaatattaaataaattgggatgaatgaaattttcctatggaaatatttttttatataagattaatcaatgtattacgtgtaaaaacgcaaaatg

SEQ ID NO: 109763 - DNA, 51 bp, Heterodera glycines
  Promoter: Source sequence=SeqID_15959; Location=1816..1866; Strand=-; Gene=SeqID_47330
tcgtttgcgcgacgggttggcgcactgtcgtgcagccaacactttcgcatg

SEQ ID NO: 109764 - DNA, 716 bp, Heterodera glycines
  Promoter: Source sequence=SeqID_27331; Location=381..1096; Strand=-; Gene=SeqID_58021
ttttttaagactcagctttttttctttttttcatttttttttattgagtcatcatttttaatgggttttttttcatttgtttgtgcacattttttcacgttcctggaaccccccccccatgggttggggggggtataaaagcccgggcccattattacatttttcttcactctgatcactttttgagtaagtccagccgggacagttttctgttcaaagcaatttgcattaaattgtaattgtaaatatttgaataaagattaagaaagagtcttagtcttttctctatctgtaaaagggacgctcaggagccctttcatacagatcattaagccattgacccacgttgggtcaaagaaaaggctttcaaaaggaaaggagaagcattttcctcctttcaaattgtcccttcagtaaaggagaggaatttcctccctttcatttgtccctttggactctgtgagtttctgtcttttggacagaaattcgctttgcttaaaagactcccccttctgccgggagagtctgcttccccttctgccgggaagtgcaaatttttgtggccttttgcccataaaattggagccccttaggggtcggcttccagtcgtaagcctaccctccaaccaaaccaatccaaagcgcggcctgagcgcttggatcaaacacacaacccaaaggggtttattgtgttttcatcaagcgtaagagcaatg

SEQ ID NO: 109765 - DNA, 176 bp, Heterodera glycines
  Promoter: Source sequence=SeqID_31744; Location=1..176; Strand=+; Gene=SeqID_62052
ttgatttgatggcattggtgggcaattggctgccgactgaaattaaaaatgccaaaaattgggaattgccaattaaagcaaatttcgaattaaaaaaaactttgcatttcttccatttgaccaccacccaaatgaacacataaaaaacaattgcgataaaattggccatcagcatg

SEQ ID NO: 109766 - DNA, 769 bp, Heterodera glycines
  Promoter: Source sequence=SeqID_8916; Location=4310..5078; Strand=+; Gene=SeqID_69633
ttttggccaccgccgtggcgaacagtgccgtgatcggtccgaacagtgcgcagccaatagtctgcgcgccaaagtgtgctgcgagcgcaaatgcgctgatcagcagggtgcgaacaaagtgtgcggaggacgcgtcggcacgcggaaacgcgcggaggaggagaccaacgaggatgccaaagatggagccgatcagcagctcggcaggcagccgggtcagcgtgtagatgagtgcatctgtttcggaagattgttttatttggagcagagtgaatcagcggaaaaatggtggtgatcaaacagactcaacagacataggaactgatcagcaataaataaaatgatcaacataatacatgaaaatgcaaaactgatcagttcgttcaatgccaacaattgaaaattaagagagtttttagttttaaaatcccatcatgatttgttttattaaataaaactatggaaaactttttttacaattttccatgagtgagaatgactgatcgatcgattaattaattatggatctgaaatgattaaatagttttttttaaaattgaatcagatccaaaattccaattaacactggatattcgtcattaaccgggtcaggattttaggttttactaaatttttgaagagtataatttattagaaaagtttggggttcgaaatttatcgaaatggatgttatattcgtgatcagcgaccctgaaaaccttctaaaacattttttttctttaaaattaaaattttttttcaaaaaatg

SEQ ID NO: 109767 - DNA, 1003 bp, Heterodera glycines
  Promoter: Source sequence=SeqID_9995; Location=893..1895; Strand=+; Gene=SeqID_73044
ttttttgccaattcaaaatcgtttattattgtgaaataattattttgtatgtggctttctacttcgtttttgtttccaaatgaaactaaaaagcataaaatttgccatccctgctctaatgttagaagatatttataagcaagtgctgagctaagcatttaagcaattcatcaaaaaagttcgcggctgaaaatctaataagtcagaatttttgcatattttaatttacagttttttacatgcctgcaatgctttgtcatttttgagagcttaataatgctaattaagagcttccgggtgattccatgtttgttggatttggtaacgtgtgttatatttcttcggcacccatacggttgcgcccaaatgtctcaccattctgccaaaaatttccctgtgttgttctttcaaatttttatttgtagcacttcggcgctcaattcgctgtttttctttaaaaaaaattagatttcatatttaaaatgtatttatttttactttttttattattttcgcccgttcctaagccaattttttccatgaattgaacaatggactgaaccagttccattcgcccgatttgttcaatgaacgtcaatgatggcgtagaatctgcgatcagagtgatcagataagagagagagagagaggggggaatgcatttggatgacgtcagactggcttactggctttaagcaactaatttttgtgttattactcaacgctattccttctatttatttatgacctaaccaaactaattatatattttttggtggcaaaaaaaaatcaggaaaaaattggaaatattttgaaaaatatcggaattatgaagcattcattttcaaataaatattcaagtttttaaataatattttttgaattttccaaatctgataaaattcagtagaaaattgaaaaatattaccgagcataaaattccaaaaaataataaaaagcgcacaaaaaatgaaagttgttttaacaattttttcaaaaaatg

SEQ ID NO: 109768 - DNA, 672 bp, Heterodera glycines
  Promoter: Source sequence=SeqID_16231; Location=1498..2169; Strand=+; Gene=SeqID_80609
tagcccccccccactcctcgtgggattcattttactgatgctcaaatgagtcccggtgaaatttgggaaaaaagaaagtgatggatggcattggcattaaccaagtattttttgagaaattttgggaaaaaaagggatggcgttggcactaaccaaatttttaaagtttatttcaatggaactctcataaaacgatttaaatttagtaaaacagacagagagagccccgaggacttcccttagagggggagggtggctctattacggggggatatcaaaaaacgcaaaataaacgaaattaattcaaatatttaaaaatttttgtaatatggatattttaagttaaccaaatcttggtcaagaaaaaattttttacgggatgaatttttaataaatttttttcaattttattatagtgtattttcagaaattttttcattcttagggctgtgttttttttggtcattttttgcttttccgtaaatatccattttattattcttttttttcttttcaagtgccatcatttttccttatcaaattttgttaaaccccgcctgggaaagagatttgaacaacaaaaaagaagtaactttttgtacaattttttcaattggcaatattttttgaatgaattcaaaggcgaaaaggtaaacagagaaagaaaaaatg

SEQ ID NO: 109769 - DNA, 158 bp, Heterodera glycines
  Promoter: Source sequence=SeqID_723; Location=2143..2300; Strand=-; Gene=SeqID_59826
ggtcagagggacagcaattttggtgtaatgagtgaatttgttttcaaaggcatcgcttaacttttaatccatttctgtcccttttcgcctctttttaggacccttttttcgaagtgtacgtccaattccgcgagtacggcgcctttgtgaatgtcatg

SEQ ID NO: 109770 - DNA, 100 bp, Heterodera glycines
  Promoter: Source sequence=SeqID_3426; Location=4815..4914; Strand=-; Gene=SeqID_84642
cggcatcggtgcgttggagcagccgacgacgacggtactggcgacaatcgccgggggaaatgccgtgacagtggcgacaacactggtttctgcggttatg

SEQ ID NO: 109771 - DNA, 83 bp, Heterodera glycines
  Promoter: Source sequence=SeqID_38618; Location=678..760; Strand=+; Gene=SeqID_67380
tagccgcgagggctgtcccacccagcttcaactcggtcccatcggtgccacagcccaacccgggcccaattaagcagcagatg

SEQ ID NO: 109772 - DNA, 186 bp, Heterodera glycines
  Promoter: Source sequence=SeqID_12726; Location=2268..2453; Strand=+; Gene=SeqID_76426
tctttaattttattttagaaaataacagcaaaaaatcaattaaatttttaaaaattggaaaatttaccaattctggcttccagaatcggattttttgaacaggaaaataacgcttttgaattgttttaaagaaatttgtgatttctttttttataaagaaatccttaagcaaccggtccctatatg

SEQ ID NO: 109773 - DNA, 434 bp, Heterodera glycines
  Promoter: Source sequence=SeqID_5359; Location=2479..2912; Strand=-; Gene=SeqID_57784
ttttcgtccaacatgtctcatcaatagggcgtccaaaaatatggatataaaatcgcgaaatatggccataaaatatggacaacaaatcgcaaaatatggacataaaattgccaaaatatcaaaacatggacataaaattgcaaaatatggacataaatttttccaaatataggctataatttctcaaaatttcatcaaattcgctaaatgcaaagtaaaacttttaagaatggctagatatgtattaaaaatcatttttgaagaaaaaaacacgatacattaatcaaaattttcgacaaaattttgataaaaaatgtctttttcgcaaaaattttccgatttggggtcaaaatcccaatttagctgatgggggccgttctaataggttttttagaaaaatcccagaatatggacataaaatatggataaaaatg

SEQ ID NO: 109774 - DNA, 227 bp, Heterodera glycines
  Promoter: Source sequence=SeqID_14113; Location=981..1207; Strand=-; Gene=SeqID_78100
tggcaaaataaatggaagtgatcccaatcccctcccccccccctctacccgttttgatctattttcaactttttatgcataaatgcattttccgttattttctcatataaaatatttggggttcttgaaaaaatccctttttgattaagatgaaaattttgagctcgagagaaggctggacgatgcatagcgggccagaccccgagacttacacgcggagggaaatg

SEQ ID NO: 109775 - DNA, 219 bp, Heterodera glycines
  Promoter: Source sequence=SeqID_6315; Location=2232..2450; Strand=-; Gene=SeqID_61123
cctcaaatcaaggcaattaataatcaaagacatttgctaattaggttttgttttgtaccaaatgaatttcatttttgaagttccggtgggtcaatctcgaaaaaagcaaagattcgctaacaataatcggctttggcatttgttcaacaaatttgagtgtaatttatccaatgtataaattaattttgccaaattggccacctgataagcgtatcgatg

SEQ ID NO: 109776 - DNA, 250 bp, Heterodera glycines
  Promoter: Source sequence=SeqID_3447; Location=1..250; Strand=+; Gene= SeqID_84717
ataactttgcttatgggcaataaaattttacattcttggtaccattcgatagtccagctttttctctattagcataaaaaacttcaaaaaaattatcaaatttaacataagttatcgtagaaatagttaccacacaactttttctaaagttgaccaatttttttttaaattttggaggcttatagagaaaaagcttggctatcgaatgataccaagaatatataatttggttgcttttaagcaaataatg

SEQ ID NO: 109777 - DNA, 131 bp, Heterodera glycines
  misc_feature (119)..(119): n is a, c, g, or t
  Promoter: Source sequence=SeqID_9561; Location=1482..1612; Strand=-; Gene=SeqID_71889
tcagatcaggtccctaaacaatggaacttatagatttttgaaatcaaagattttaaatttcaatttctgaattttttttaattttaaatttgtttttaattttttaaatttaatttttntaagttgcaatg

SEQ ID NO: 109778 - DNA, 191 bp, Heterodera glycines
  Promoter: Source sequence=SeqID_1319; Location=433..623; Strand=+; Gene=SeqID_72421
attttggatcgttttgttgaatgctattttcccttgttgataaattactatttgttgaatttggtacagtaaatttcttattatttgttaaagttgacaattttccttaaatacatcatctttgtttagccaacatgcatttcggtaaactcaaaaattaagattaattcgtgttaacaaatgatataatg

SEQ ID NO: 109779 - DNA, 407 bp, Heterodera glycines
  Promoter: Source sequence=SeqID_33201; Location=1..407; Strand=+; Gene=SeqID_63334
tcaataccagaaatagtttgtgaaaccaaaaaaaaataaataaaggtttggggaaactataaaccaaaaatggaaattgttttgatgtgtccggaaaccagaaaccaaatcaggaattgattttctgataatacaaaccaaaacagaaatagttgtccggaaaaacacaaaccaaatcaggaatttatttgcggaaaaatattttaaaaaacataaaagttttgtgtaaaacacaaacaaaaatattaaaaaaatttttgggtaaatataaatcagtaatgtgaattttgtttttgtttatacaaaaccaaaaaacagcaaaattaaataaataaataattattgtaatgcaaaaatggttgtttataaatcaacttttaattaattacgaattgattgcaaaaatg

SEQ ID NO: 109780 - DNA, 772 bp, Heterodera glycines
  Promoter: Source sequence=SeqID_20596; Location=1260..2031; Strand=-; Gene=SeqID_51149
tcaccaaatcattcctccaacagcttacccaactctctgaagtatgttctttgtgtttttttagttcctttttttctgttttaggcatttgaaaatgcttccaaacaaatcagcaccccgcggagtgatttgcccgacacttcctcccatttgttgcgcaatgacactgggcttggcgtcagtgtgagcagcaccgaatcggtgaaggtaaattatggccaacaaaaccaggaataaaaatgcctaaaatagcgcttttgatgaattttttaattgtaaatagaatgtcactaaaatttgaaacaaatccgctagagggcgactttgaacaacgtgttttcctaaacatgctcctgatttttttaaactaaaacaatactgcttctgtaattttaggtggtgtttacgtgccattccccggcggtgaacaatcgacgtgttcagaccgccaaaatcagtccgtcttcaccaactgttttgggaaccggaggacgggaaaattttgaattgagagtattatttaaaaaactatcgcaaaaaacggttaatttttgtgcatttgagcgtttttaagaagaaaaaaaaagttattggggttcggtgtgaatcgccgagaaaaatcgttggaattttatttaaaatatgagaatttttgctagcagttttgcataaaatggccattttcatgacagttagttgaaaacctgaatttattttaaaaatttttttattgctctttttaggccgttctgcgacagcccttcagcatatg

SEQ ID NO: 109781 - DNA, 401 bp, Heterodera glycines
  Promoter: Source sequence=SeqID_31024; Location=795..1195; Strand=-; Gene=SeqID_61392
ttgtctaaatcgaatgacattattgggcatgccttaatgaggcgataaattaaatttttttctatttttttatttttaattccagaacttaatctctattttttaaagaaattttttaaatattaaaacaaataatttttaaatttatttatattttatgaattttaaaataaatttaaatttattatttactttcacaattttagttactggagttaaatcaattctatttttcatcaacaaattcaaccaatttgcttaattttgcaaaatatttaaaataaataattttcacttttttccagcaaaagttggctttaaataaatttcaaaattacctcaataataataataataattaattaaattattcattattcttcatcattattcgtctgatg

SEQ ID NO: 109782 - DNA, 261 bp, Heterodera glycines
  Promoter: Source sequence=SeqID_43415; Location=1..261; Strand=+; Gene=SeqID_71081
atttaattaaaaagagccccgagcttttcttaatttgtcattttgtttatagataataagtattattatgcgttcctctttttttatatacacaaattgtgcgttccttttcaatgtaaaaaaaactaatttttctgcccatgggcaaaaaaatatcgatttaaaattttcaaatatttaaatagttattttataattatatgatacatttcaaaaatcgttaaggaattaaaaaaaaacaacaaaaattgttgagccatg

SEQ ID NO: 109783 - DNA, 150 bp, Heterodera glycines
  Promoter: Source sequence=SeqID_5828; Location=398..547; Strand=+; Gene=SeqID_59358
gacgctaattaataaacaatagtaattaatttgcattgtttagaaaattggagttgcaaatgttctttaacttttcgaattgtgtcgcaaaagagcggcgtaaaggattataagagagaaataagcaaagaaaaaatagacaataaaatg

SEQ ID NO: 109784 - DNA, 302 bp, Heterodera glycines
  Promoter: Source sequence=SeqID_42838; Location=1..302; Strand=+; Gene=SeqID_70649
tcaaagaacatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatg

SEQ ID NO: 109785 - DNA, 167 bp, Heterodera glycines
  Promoter: Source sequence=SeqID_13401; Location=1056..1222; Strand=-; Gene=SeqID_77288
agttgaacgagcgtcaacgacagatcaatcgtgccaaaatacaaaagaaggggctggatccaaacgatgcaaattcgcgctttccggttagttttgggagtcgatcattttggcaaaaatgatcagaaatttcttgtagccaaaagttgccatttcatccaaatatg

SEQ ID NO: 109786 - DNA, 191 bp, Heterodera glycines
  Promoter: Source sequence=SeqID_28470; Location=688..878; Strand=+; Gene=SeqID_59084
ggtcattttagggaacgcaaaatgattaaaactactatatctatctccaaatccaattccgggctctaaatcgagcattttttgtatttcatatttatgctttctataaaagctaaaaatttatagaaggctttcaggctttgttagtttttttttggttttgttacctaaaatagaaattcaaaaatatg

SEQ ID NO: 109787 - DNA, 1003 bp, Heterodera glycines
  Promoter: Source sequence=SeqID_12234; Location=2102..3104; Strand=+; Gene=SeqID_75806
ttgaacaatagagagcccctggggctctaatcggttttcatgtgctcattttggcgtacagaattttcattgaaaaataggtaccaaaatattttatgactcctttcaagggggcagaaaaacgaactctcggatttaaattcagaaaatttggtgttgccaaaaaattgcagcccttaattgatgatgatgagtttaatgatcattaaatcctaaaataccgcaaaaattcttttacaaatcaaattaaaaatgtttttttattgctttaatttgtgattcaaaaatcgaatcgaatttgatcaccaccgaatgatctgtctgatcagtggcataaaatgcggtgaactgatcaaacacactttgagaatgaatgaatgaaaaaatgaaatgtggtggcgttttggtgacgaaggacagaaaaaaaaattatttatataagaaattgatcagtgtcaaccctctgaaaatcaatgctctttcattaagcccctgcttaaaactgaactgatcacatgcacaagtaaatttttgggtcaatttttagaattttaaaaatttttctttttaaatttttcttattagcgatttaattagaaggcttgaatttatctaatttagtgggcagtttgatttgaacaaaaaattttattttaaattcgcatttttacattttacaaaaaaaaatgataatgaaaatatattatttcttagaaattcaaaaaatttttttttgcatttccaatttaaaattttcttattagcgatttatttagaatgtcttaatttatttaaattattaaaaatatattttaaatatttctttttatttttgttggacagctttatttgaacagaaattttttatttttttaaaattcacatttcagccatgttaatccaagaattttcttggcaaatcttttacagaaaacactttggatttggcaaatcccaaaagttttttatttaaatttttttttaatttaatattttagcaatg

SEQ ID NO: 109788 - DNA, 705 bp, Heterodera glycines
  Promoter: Source sequence=SeqID_44697; Location=514..1218; Strand=-; Gene=SeqID_72143
ttcgtcttagtggtctgtgagttagtcatcaaaaagggggtctcaggttcaaatcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggtgaatactagagcaaataaaaccattttatgctcattttgaagggaaaattctgaagaatatttctaatttagtcaaaagattattaaaattgtttattggcaaataaatgtttcatgtgttattttatatgttagagacatggaaatagtacactaaaatgaaagaaaaagaaaaaactttgtcctgggtcaaaaaatttttcctagggtcagattttcttgaaattttgcataggcccatattttgaccccctctatcgaatccctgtttattttttcgaagttatgtttttaactcgagatcggctcttctatttttacaagggaaaatcccaaaaaaattttaagttttgcaaagttttggcgttctgattactaaataaaaatccagcataattgtacttggagcccaaaattgggccgctgtgtgaaatgttgagaccaaccaaacctttaaagggtcgattttggcattttgttagctgtccaaacaaatg

SEQ ID NO: 109789 - DNA, 205 bp, Heterodera glycines
  Promoter: Source sequence=SeqID_14085; Location=1357..1561; Strand=+; Gene=SeqID_78060
ttccgttctgaatgtaaaaaatggcactttaaatccggtgatgctaaggttaaattgtgcccgattgattgcccattgcttttccctttctccttttgtccgcttcgcttttctttggcctttccgcttttccgcttacccttacgcatttggccaagcggcacgcctggcacgccctccgggatgcttttgtgattcgacaatg

SEQ ID NO: 109790 - DNA, 98 bp, Heterodera glycines
  Promoter: Source sequence=SeqID_4595; Location=645..742; Strand=+; Gene=SeqID_55023
ggtacactttttgaaggagcttaaaaaaaagaaagccctaggattacctttgtcaactatcatttttttccaagcaggcacaacaatgtcgtcagatg

SEQ ID NO: 109791 - DNA, 402 bp, Heterodera glycines
  Promoter: Source sequence=SeqID_11012; Location=614..1015; Strand=+; Gene=SeqID_74331
aaactagcagaaataaatcacaggtaattttaacagcaaaataagtcattttatgtagattcgaacatacataaagtaaaaataaaaattttcaattttgttcgaattcttgtctggggttcgaaatggatatcttattcgtgatcagcgaccttgaaaacctcaggaaagacttttatttagatgacttttaaaaaataatttatttttaagtaaaaaataaattaaaaaaattgttcgaatcaggatttggggttcgaaaaaagtcaaaaaaacgatcatattcgtgctcagcgcatcaagtaacccctaaaaatggtttttttttattttctttttttgtgggaccaataatcttcacaattgccgtttatttctcttttccttttttgttcggtcatg

SEQ ID NO: 109792 - DNA, 952 bp, Heterodera glycines
  Promoter: Source sequence=SeqID_1689; Location=1782..2733; Strand=-; Gene=SeqID_75335
aagtgatcagcagataaaaactaaaaaatattctgttttctttgaagtatatcaaaaataatatgatattataatttcaaatttaaaaatcatgacaagagaacctgtttgttaaaaaaagtgaaggttattaagaaaagtgcgactaaaaatttatttgaaaaacatatgaattacctttcacattcatttaaaatttcattgaaacgataaaatagtcccatttatataataaataaatcactgtatgacaacaggtgattaaaaaaccctgaggatgtgaaataaatgaatgtagacgacaagatgttaagagaaaatctttattgctagtgaaaacttgagatgccgaaaaaatgaaacttagatctttaactatgaaacttatacatattgattttcataatatttatacaaaaataatcatcaacttttttgctccgtaagtgcaatatagctcatgagatattatataattaatatgataaaacaattttcatttcatatatattcttatgaaaatttaaaaataaaataaaaaatattccgttaaaattacggaagcaacccaattttcccataaaagaaaatttctgtacattaaagaaaaataattacttgaaattaaaaaaatcttttacatttacaaaaaactagcttatttgttgatatatgtagtaaaaaaatcaattgcttatttcaatattataaaaacaaatatattataaattaaatatatgaactattaaaaaaaatgaaatgaaccaataattataatttaatcccatggaaaggttgagtgtccagaacatgagaaatagcgcaggaaatggctgaaaattgagaaaattcaaaatttttaaattatatttagaacaacaaaaagacagtaattccaaagctccaatgatctaatttaagaacagctaaatattcaatgatcctcaagatg

SEQ ID NO: 109793 - DNA, 500 bp, Heterodera glycines
  Promoter: Source sequence=SeqID_25145; Location=419..918; Strand=-; Gene=SeqID_55871
tttgtaaaattcaaatgaattaacaaacttaattaattggttggggtgtcgtcggcacggcactaattaaataatgggccccgggtatcggcacggcattcccttctcaatgccctcttccctttctgtcgttgtctcacctttcttcttctcttcttcgttcctctgctcttcttctctcccccgaggccatacaaatgcaatcaattcgaattgtagcaattaccaacagaatttcactcgcaaatgctgcttattttgtttttgcggctgagagagggaaaattaatttccaatcggacaaatggcaaaagtggcggcaaagggtcgcctggcgggggcatttatagcgaagagagtccgccacctggggacattttcaaattgaaattggcatcgattggaaattactttggcacagttttcgacttcctaattaccccaagaaaagattggccaagttttgctctgcataaatttgtccgctttctgttcgaatg

SEQ ID NO: 109794 - DNA, 201 bp, Heterodera glycines
  Promoter: Source sequence=SeqID_43558; Location=573..773; Strand=-; Gene=SeqID_71208
aatggcaatgctgcgttcgttcggcaaattttcgaattgtctcgcaaaataaaggggctgagaattccactggcacactttgtgaccgcgtttttaacaacaaattgaacggctggggattcaaaatttcatttcgtttgcggtgagttcaattaatctgttttcttaattgatcaattatgggcaattaaggaattaatg

SEQ ID NO: 109795 - DNA, 213 bp, Heterodera glycines
  Promoter: Source sequence=SeqID_4245; Location=2717..2929; Strand=-; Gene=SeqID_53748
ttttttttatcaaaatttcactaattaggttcttatctgggggttaattatttaataattaccattaatgaatttggttacaaattcctttgcataagcaaaacattgaactctcgtttccgtttgctgttcagtttcactttatttttgatgttcacattattattaaaatataattagctccatcgctcggcttattatttgtaaaaaatg

SEQ ID NO: 109796 - DNA, 707 bp, Heterodera glycines
  Promoter: Source sequence=SeqID_3778; Location=1308..2014; Strand=+; Gene=SeqID_51843
aatccccgttctcgctaattttacgtggtcgagcagctcctcgtccttgaggaacgtctcatcgcatgattggtatccaattagataccaatacctcacagcaccgcagatgcgacgatggcgccttgtcgtacagggccaaagacgtcacttcatactcagttgtgccatcgtcgtcctccgcgatgtcggcagcattttgatccgggtgtcgatgttggcactaataaacaaatttgtccattaaaaatgaggtagttacgaatggcttctaactcattttgcactcaaaattatgaaaagatctatctcgggatgagtcaaattatcattttttgcctataatctataatttcacaattaatttagacttattagataaaaattaccccgaccgtccctaatcgcaatttcaacaaattttataacacattcaataaattcaaattttgccgccgccaaaacatgtcagtggggcgcttaaagtcacctattcttttgtgtccaatattccctgcactaatctttgttgatcgccccgagccaaacaaagaaagataacatctgtatgaccatttctacaatgaagaggtgacaaaagaaacaaatttttggagaactaaagtggatggggaaggggaaggggggggggggggtttagcgatcggcatactccgctggtcatttctccgaatattcgcgccatg

SEQ ID NO: 109797 - DNA, 283 bp, Heterodera glycines
  Promoter: Source sequence=SeqID_19637; Location=1..283; Strand=+; Gene=SeqID_84379
aaaaatccaggggggatttaattttatttatttaatttttaatgtaaaatatttttttaataataaatatttttataaaaataataataataaggtcatcgttctgtgttcgctaaacacccaattttgttcaccgaatctggcattttctattttgaaatcagaattaaaagctgtaaaaggtgaaattacaaaaaaaaattaagttcgatttgatttatattttaatttagtctttgctcaattggatttgccaccaaagcgatgccattgggcgaaaatg

SEQ ID NO: 109798 - DNA, 256 bp, Heterodera glycines
  Promoter: Source sequence=SeqID_15320; Location=1439..1694; Strand=-; Gene=SeqID_79558
atctttctgtgacaattgatggcgaaatgaaaatactaaacgaagtgagggaaatgcgtaccaggctgattgaggcggttaaaaagcgttttttacaaaaagaaaataggtatatacctacttaaaatactagtaagttttataaataaaacatttagactttgtatgttgagcacttttctcgaccctcgcatcaaggatcgtttttcctctgaaagcgacatattttttgcgcgcgtttcacgttcaaaatatg

SEQ ID NO: 109799 - DNA, 639 bp, Heterodera glycines
  Promoter: Source sequence=SeqID_29609; Location=1..639; Strand=+; Gene=SeqID_60081
taaatttgataatttttaccggaataaataatcataaaaatttgacgattaaaatcaaatataataatattaataaaaaattatttaaattattaaacgactagccatattaaatataattagtttagaaaaattattttgaataaaacaaaatcttttatataaattaatttatatttattttgcttaataaaattgcttttgctttgctttattgctgtggcttgtgtgtctacggataagggcctaaacacacggaataattattttattaagttttaataaaaagaggacaccgtactgaagaggcccagtctctttttattaatttttgcacttttcgcgaaacgcccatttttgcacttttcgcgaaacgcccatttttgcacttttcgcgaaacgcccattttgcacttttcgcgagaaaggggacacacccatcgcctgcgtaaaattggggaccttcgtatgaaatttggtcctgctgacgggtgccggcgggtcgttactcaaaaaccatcaaaataaaaaaatttttgacagattaacgaattttttgtttgtttgtaagtttgcagtataatagaaaacaattttatatttgttcctcaatttacaggtgcgatttatccgacaatg

SEQ ID NO: 109800 - DNA, 1003 bp, Heterodera glycines
  misc_feature (528)..(528): n is a, c, g, or t
  Promoter: Source sequence=SeqID_13462; Location=1963..2965; Strand=+; Gene=SeqID_77354
cccattacccgactgggccctccccgaaaacaaaatctcatctctttcattttctcatcgcaactcaaaacttaacaaaacttcgagctacgtcatcgggatgccggcatttaatatggttattgttctcattaattttaattcttttgccacttgtcatcggtaccaaacagaaagcatcatcaaataaattgtcggataaattaattttaaaatttcataaatccagcaaatggtcaaagctcccaataatataaagctgtccaatttgttcaaaattacaaaaacattttcgattctcttttaagtgacacattccaaaaatcacggggtcaaaattcctcttacgaaatgtaacgcgaccacaaattcattgaaaatttataaaaaaatataattttacgaatattgctttaaatgaatttgtttaagttctttcgctttttaattatcattttattgttttttcgcttttacaaattgatacaaatattaaattgccacaaaattccgagcattttttattanatcaatttttactcaactcaattaaaaaaatatatttttgcaaaaaaatgaaaatagtaatattttttattttttaaatttaatttgttattgttttagtcaatatttattgcaatatttcttgatttatcattgctccgctaatcaactactacacaaaatttctttattacataatacaatttaactttatggcggaaaaggcaaaaaataattctcacttatggtaccgttgaaatgtattatgccaaaatttagaaatcctggacagaaacttttaacaatatgttattgttctccaccctattttggactctaatttaaagttattcgaatttttcaaaattttgtcacctttaagccgagcacctctaattttatgtcttcactcgattaacccactaacatcgaacataaattgaaacaaactgattaaaaagtatgtatgtaaatttgaaggaaataattgctaatg

SEQ ID NO: 109801 - DNA, 660 bp, Heterodera glycines
  Promoter: Source sequence=SeqID_2768; Location=2677..3336; Strand=+; Gene=SeqID_81482
aggaatttaattacaatttgggatactaatacactaattaatgcttgtatattttgggtgcccctcaaatggcgaagagttggtggcagagaaaaacaaggcagcaaaaatcggacggacgatcgaatgcgatcattgcggcattgacttttgcggcgatttcgtcgttgcaaatggacgaagaagaggaagagaaaggcgaacaaaaatcagaagggatgagaaaaagaaaaacgaacggagccgaaaagcaaatcgaatggaaaagtacggaattttgagagggaaaagcaaatcggaaggatgggaacggaagagatcgacgcgtcatggaatttttagaatagcaacgcatttcttcatcattttatcttttttaaaatttcataaactgttcaaaaaacaaacaaaacaactgccgcccatgggaatgtgcttttgcagttgttttttcgcttttcctgctgatgactcatccgtccgtccgttttcacttccgtccgtttcacttccattcactcatcccttcgcttctttcttcgtcatcgctctgttcgacttcgtccgtccctttgccattcatttccatttaaatcattccgtcgccccatcaaataaaataaaataaatatttcacaataaaacacacaaatcaaaatg

SEQ ID NO: 109802 - DNA, 561 bp, Heterodera glycines
  Promoter: Source sequence=SeqID_16450; Location=700..1260; Strand=-; Gene=SeqID_80853
gtatttaaaatgatctcttccgccttcatgtgcatttactcccacttgattgtttattgtacattgcatcgcctattactgtgttcaaaatattattaattatcgcccagcacagatacccatgccaaatattgcctttctattgcatcattgatactactgtaatatacaaaagacgatgaataaatcataataacatacaaggaattttgccaaatacagaattggaaatagtacctaaatgcttttttaagttttgatactttctgtttttactaattgtatgcttgcgattagcggttttgattttcttttgctattgaaatcatcggaggtgttgttttgggtgaatcatcccatgcaccgatcatatgtacacattgggagggtgaggggtccttcccttttccatttcttttcattttcacagtcaaattttatgagtgtagtaaaaaacagttaaatctctttccccctcttcacacgtttaaacaaactcttcttgtcccttccatttcgattaaaaagtgtcattttgattaattacttttgttgcgaatg

SEQ ID NO: 109803 - DNA, 453 bp, Heterodera glycines
  Promoter: Source sequence=SeqID_8018; Location=2357..2809; Strand=-; Gene=SeqID_66711
tcaccagtgtacttcgtttttgtattttttttatggatttgacccgccaatttctccattttaaactgaccaaactgtgcgcttgactgccggctttaacctaaaacaaataaggaatttattattttatacaaaaaaaaaatcggtaaacaaaagtgttgcagttttggcattccgcgccaacaatggcattttaaaaaataaaaaaattgccttgcaatcgcagcagctagccgcggaaattgtggttggcctccactcgtcctgcccgttcacagtcactcgttgcaacacatcaaaattacggtaccgctgattacagacgccccatccttgaaaaattggattatatatttggaacattgatcgaaagaagtggaaaatggatgcttgatcacgactgattggaatcgcaaaaatttaaaaaaaataattaaaaattatatgaagatg

SEQ ID NO: 109804 - DNA, 444 bp, Heterodera glycines
  Promoter: Source sequence=SeqID_23556; Location=808..1251; Strand=-; Gene=SeqID_54245
tcctttttaaataaatttcccaaaggtttacacaaaaacattgaagcctaccagtccccattgacatcaacatgtgccccccattgtattgtgtttgtttaccacatgtcccacggaaaatcattcgataaatttatacatattctcaaaacttgttcaaaccctgacatgtattcattaataatgttaaataaaatgttgaacagttaaattatattttcaatttcttaattttttcaaaattgtgtcttccacctactaattatgcattattctacctaaaagttacattttccaacgcttaattattttcgtaatttatttcacattcattaattatgcatgcaataaaataaaaaggggcggagcttatccatttgagttggaacaccggtataaaagccgctcgaatttcttcattcagacataaaaaaatctgaaatg

SEQ ID NO: 109805 - DNA, 83 bp, Heterodera glycines
  Promoter: Source sequence=SeqID_4350; Location=1646..1728; Strand=+; Gene=SeqID_54146
ttccgtcgcttttcacttcaaagtcaacggggggggggggagagggaaacgcacttcgcaccgttccttttaagctgccgatg

SEQ ID NO: 109806 - DNA, 128 bp, Heterodera glycines
  Promoter: Source sequence=SeqID_28889; Location=1..128; Strand=+; Gene=SeqID_59459
cttcccgacttttcctttccttcccttcgttctctgctttattttctttctttgcttagctttacgttcccaccgtcgaagacactttccatgtccaattcggcgactttcgttccgttgaccaaatg

SEQ ID NO: 109807 - DNA, 1003 bp, Heterodera glycines
  Promoter: Source sequence=SeqID_7702; Location=1654..2656; Strand=+; Gene=SeqID_65676
gagactcgagactgagatcagcagaaaaacatgactttaaaaaagtttaaattgtacacttgaaacccgattaaaacttaattaatttaaataattcttttttattgaaatttcaaacaaattttgccgttgcgaattttggttcaattacaatttatcaatcaatcgttattttaaaaataaataaaataagtggttgatcaagttaatttctcttgcctgggctatttttacaaaattaaaaaaggaggtttcgtcgtagagaattgagggaatgccaaaggtggaatagaaaaaaaaacaataaaatttggaagcctcttttttctcttcgcaaattcaatcggattttgtcctttaaaggctcccagacatttggaccggcggagtggacaattggacattaattactacagtgaaagaaatatttttttattggttttagcattgtaaatattttggattctaagaaaaatgaaaaaaaaattaatttcattgctagtcttttttaagagtaaaaaattaattcactgccgttatgtcctctgttcaattgtccgttactttccaaatgacttcctcttaatgtccattggccaaatgtccggtcacacctaaatgcccattttttgaatttttgggttgaagcccggcgccgggaactttaaaactttgaggaggagttcaatcgccaatcgcaaggcccttttctgacccccctcttgcacagctaagaaattagctaaaaattcgttgacatttaaaattactcaatttattaggaggcatggaatcaattcgtcgacttcgcagtggacaaaggcacaaattatgcaattaaatgtgcgatcgaaactacggaaaagaaggcaaatgaatttatgattaaaaacccctatttttgtttacaaatttcagaaggaatttttatggattattaaaatgcaaaaaattaattaagcaaattaatattataactttcagaaaaataagcccaaaaatg

SEQ ID NO: 109808 - DNA, 226 bp, Heterodera glycines
  Promoter: Source sequence=SeqID_2599; Location=1..226; Strand=+; Gene= SeqID_80639
caaggataaaactgtacgagtacatggagcaggtcttccccgaggaagggtctaagctgctgtattgtgatacaggtgctcaggaataaaaagaaaataaaaaccaaaaatttagattctctagcttttgctcatcggaaggggcggtgtccgttggtggaggggaaatttttggggtaaaacattatttttgaaacgcatctaaattgtggttttaagggagatg

SEQ ID NO: 109809 - DNA, 624 bp, Heterodera glycines
  Promoter: Source sequence=SeqID_18129; Location=119..742; Strand=+; Gene=SeqID_82712
tgtctgcttggacgagttgttcaaacaacgggtctctacgatcaaaaacttcggagcgaagaaaatcaggataagcaattctaaattactaaagaataaagcgttttaatttcttccccacgggaaatcatccagagaaattgcatttatccgctcagtcgacggctgcttcacattttttgccctaacattagcaagcgtagtggccaagcgtgtagaaggaagcctttttagcaataatgaacaaactgacaaatgcattaaaattttttattgaatcttaatttgatttatttcaatgataagagataaattaagcagttgtttttcaaagtcagtaattaaaaaaatatgaattaaaaatttagtaatttctgtaactgcaaacattggaagggcggatatataagtagatttatttgggaataaaatgaaatgcagagaaattttgaataaataattaattgtatggccttatgttttgaaatttaaaaaggctgattcgccgatttacctttccctttttctcttatctgcatttttcaatttttcaatttctcatttctttccttttcttttttgtctcaaaactaatctaaggttaagaaaccaactattgcgatg

SEQ ID NO: 109810 - DNA, 685 bp, Heterodera glycines
  Promoter: Source sequence=SeqID_17947; Location=1..685; Strand=+; Gene=SeqID_82502
aaaaataattcgatataacatgtcttacacgcattaaaataaaaatattaaaaatcaaatattagaaaattcgcaattaaaaaaacaaatatgcagttaatatattttactagatttagctgaatatttatgacgattaacatacaaaatcatcaaaaatataataattaaaaaattgaaagggaaaaattattgaaagtattataatccatagaatagaataaatattctcagcaagtaaatttaaataaatatgtatttttcatttaaataatatacaaatgtgaaatatataaaacttttttaattcgtaattgaattattttgtcaatcttcaatgtgaaacttatttcaaattcattaatctatctatagcaattaaatttaatgaatatttgatctacaaaaagcaaacaacattaacaatataaaaatacatattaaaataatggaattgattttcttttaacaaaaatttattttaaaagcctctccaactcgaaattttaaaaactaaatatatttaacgaaattaaaaaatcaataaatataaacacctatatcttgaaaaaacttccatttaggtattgtaagccgggactcgggtctcggctaccgattgggattgaaggggagaggctcctccccattggaacgcccaccgggattccccttttaagcgatg

SEQ ID NO: 109811 - DNA, 207 bp, Heterodera glycines
  Promoter: Source sequence=SeqID_23674; Location=1276..1482; Strand=+; Gene=SeqID_54371
aagcagaaggaaaatttatgaaatattaaaaagaaaaaacaaagaaaaatgcggaatttgtgcaaaatttgcaaataataaatatacatatcctaaaaaccctcctctaccagtgtttagagtaaaagggaaaagtgcatttgaacatgttggaattgattattttggacccctctccgtaaaaactttggatggcaataaaaaatg

SEQ ID NO: 109812 - DNA, 275 bp, Heterodera glycines
  Promoter: Source sequence=SeqID_12100; Location=1..275; Strand=+; Gene=SeqID_75660
atctgttcaccgaggaagtgccacggagggtcatctcccagctggtgcccaaccaaaattacattgggcacaatcagaataaccccttttacttcaaccaccacaacgtaagtgccgctttgacatgtatttctggcagaaaaaaaaatgttcaggtgcgggatattgaactgaccgcctctggcaggacatacccacagtttccgtacaacttggactacaagaacaacaggtacgcaagggcgtaccatgacacccaggagcaccttggcatg

SEQ ID NO: 109813 - DNA, 1003 bp, Heterodera glycines
  Promoter: Source sequence=SeqID_21870; Location=345..1347; Strand=+; Gene=SeqID_52501
gagatcgagacccccccaaaaagccgagaattttttttttaattgaaaattgactcgctcatctctccctaaatagtataatggcaaaaatggtagtcgggcatgggagttgatcttcttctgtgcactttttgatcaccggcgcaattccccgattccgttccccgcaaaaaaggcacgacggcgaaaataccccgccaaactcacaacaaaatattgagggtaaacaatcaactgccgagaatcgaaaatgatactgatgatgatgattaatgtttgggatgttacaacgcaaaaatttatttatttatttatttgggcatttcaaaagtgtgaaaattaacggggcaatcgcgtccctccctataaaaacggcacggagggcggcactttgcaccaaaaaaaaaaatttttttttttttttattacaaatatttatgattaattgtaggtactacacctaaatatatttttgtttttaatctttgtttttgttgggtatgtgtttattattttgtacgcttaacggaccaaaaaaaaaaaaaaattgtattttcttcataactttttctttacagtaatgttgcaaccaaatttgacaaagtggcaaattttaataaaaaaaaaaaaatttcactaaaatttccaaaatttttccacgcctagccgtccaatagattattttatgctttttgccaaattttccaaaaaatacatagtagtcatttttgggccaaattcaattaataaatgtgctaaatgctattatgtatttatttcatccgaggttcaccgaatttttgaaaaaataaaattttgcaaaaaaaattttggggctaaaagcagaaaaaacttttttggattttcttccaccttcgaaatttaatgataccaagttttgttggatttggttgacaaaaagtgatttgccaaaatcctctacgatttggccttcccagattttgttttaaaagagaaaaaaacggaaattaatttaaaaatg

SEQ ID NO: 109814 - DNA, 950 bp, Heterodera glycines
  Promoter: Source sequence=SeqID_4304; Location=5100..6049; Strand=+; Gene=SeqID_53968
accaaatattgttgtataatcttataataaatctcataaaattatgtaccgaacatataccgccggacatattgcctcaaaaaaccaaaattaataaaaacaatttcttgttggatttatatgggaaaacaaatttgatcggaatttttatttctttatcgcgttaaatagcctggatcattcttttttcgacgaagtttcttctcaaaactgttttttccatcttataatgctattttcaaatttttttcaaaaaattttctcttgggaaaattcccggttggtcccggtcccggcttatttgttctccaaattgtttcttccaattgaaaatgctctttagatgaatttcaatatttttgcaattttattatcacttatttttggattttcactttttatttgccaataaattttcattttttctattttttgttcctccgttattcttttacagcgaattccaaattgtttcttccatttgttaattatgtctcggccgactccaattttcttacaaatttcgacataattttgtttccattcttttcaacatttttcggcgctaaaatttcatttttggccattttacaccaattttctgatataatgaaatttcataaaatctctttaatttttctaaaatctctttacattgtgaatttattttatttttattgaaaatatgtttattattttcgaatgagctccagtagaaagtaataaaattttattaatcattaatttaccaattggcaattattttgtcattaagataaaattattattattatttctttgaaattaaacaggatttccttattttattaagtaaaataatgatttattcagttttttaatcagaaaaaaatcatttaaatgcctcaaaaaatgaattgccatttaattgaagaaaaataaaacaaaattatttcgagacgacaaaaatg

SEQ ID NO: 109815 - DNA, 79 bp, Heterodera glycines
  Promoter: Source sequence=SeqID_26884; Location=504..582; Strand=-; Gene=SeqID_57627
aaaatttttataaaaatagatttgttaattaattgactttgtatgtatattttcttttcagagattaatatataaaatg

SEQ ID NO: 109816 - DNA, 558 bp, Heterodera glycines
  misc_feature (34)..(34): n is a, c, g, or t
  Promoter: Source sequence=SeqID_37413; Location=1..558; Strand=+; Gene=SeqID_66493
acgggggaggtgaagaagtaatagcattggacancacggcgagaagagacaaaagtattggaaggactcagaaaagaaagacgaagaaggaccatttgaatgtcaaaatataatctgaaaaaaagtgagagaggaaaggcaattgaaactccaaacgagcatggcattaattggcttttaaatcatcattgaaaaataaattaattttgagttattttttaaacaaagtgccaaataaattcaatttttcacgcattttgttttgcttctacaagtacaaaaatatgcttgaacttgttgaacatctctttaccttttattattccatttaatccactggcactttgctgatttctctcccgttccttcaaaaaacaaagggccgggggggggcttttttcgttatcagcaactccaaaaaccctgtgaagatttattatgacaaagaaaactttgcaaccataaggggtcccattttgtttaataaattcaaacatttttcgggggagtccatttgcaaaaccattacatttttccgtttacagcactaaacacatg

SEQ ID NO: 109817 - DNA, 101 bp, Heterodera glycines
  Promoter: Source sequence=SeqID_6451; Location=3023..3123; Strand=-; Gene=SeqID_46251
ggtgaaagctggcacaatttctatgtccaaaataaacaaatgattttaaaaaagtaaaagaattgagcggatgagtgagttttatttgaaaagtttagatg

SEQ ID NO: 109818 - DNA, 101 bp, Heterodera glycines
  misc_feature (53)..(53): n is a, c, g, or t
  Promoter: Source sequence=SeqID_17284; Location=2387..2487; Strand=-; Gene=SeqID_81757
ttggactcagcggacgcactttggagagcgacagcgtaaaagtgcagctgacngtgcaatgtgagaccggacggattctccagcaggtagctaatgctatg

SEQ ID NO: 109819 - DNA, 428 bp, Heterodera glycines
  Promoter: Source sequence=SeqID_23844; Location=1..428; Strand=+; Gene=SeqID_54538
cggagtcgttgaaagggcaaatcggacaataaaggagcgcttgtacagatattttacaaagaaagacactcttcgatgggtcgacgtaatagacaaaataataacaaacattaacaacagtgtgaataggacattgggggccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattttcaaagggatacctcccaaactttaccgaagaattgtttaaaatcgttgttgccaattcgacgacacccgattcatacaggatcgaagatttggaaggaaatttaataaaaggcatattttataaccaggaattagtgaaaacagatg

SEQ ID NO: 109820 - DNA, 282 bp, Heterodera glycines
  misc_feature (13)..(13): n is a, c, g, or t
  Promoter: Source sequence=SeqID_11742; Location=22..303; Strand=+; Gene=SeqID_75226
ttaaaaaataatntggagaatgttcaagatcctgtccaaattccgaaaaagtgttctttgttgccattttgcgtaatatatatttgcttcattttgtatgcattaccatctctccgcttattcaatatttttgtgttatgtaaacatgaacccggtattaaatgaatggtgtctagagacaatgggtggtcttgaataataatcactttcccattattcgaaagaaaaaaaaataacaacaaaatcattttacttttttcccctgttgacgtagcaaatatg

SEQ ID NO: 109821 - DNA, 359 bp, Heterodera glycines
  Promoter: Source sequence=SeqID_18196; Location=469..827; Strand=-; Gene=SeqID_82781
tatttggccatttttggcctttttagtccatatttcgggcttttttagtccatatttaatgtccatatttcgcgttttttagtccatataatttacaaccctaattataaaaaatcttttttattaatttaaaatttatttcaaaaaatttatttcatttagtatttaaatacattaatacaatatttttaacaagtaaactgaaataaattcgaaaaataattatttttattaattttaaatttttattaaaaaattattccatttagttaaaattgaattatttatttatttaatattttatattatagtaaatttttggccagatcagttacatcagttgggtggaggagcgcatg

SEQ ID NO: 109822 - DNA, 414 bp, Heterodera glycines
  Promoter: Source sequence=SeqID_12434; Location=218..631; Strand=+; Gene=SeqID_76044
tgttagcaaaaaataaaaaaaaattttatgtcacttgggtacctctcctttttgcagtgtgggcgttccacaaaaaagctcagtgattgataaaataaaataaattttaaaatattaattattgaacggcaagtgtaattttgatttaatttctattagatgtgttataaaaaagaatttataatatttattacatagctaaaaaaggaaaattcacaaattaattgaacacaattgattaggtgctaattttctttgcatttcatgtaaagattttataatttcattcccgaaacagtgaattaattgataacataagaatgtcatagtaaaattttgagtatttaagctaatttttattaatctataaatcacaaatttaaacaaatattcactctcccaatcgctgcaatg

SEQ ID NO: 109823 - DNA, 760 bp, Heterodera glycines
  Promoter: Source sequence=SeqID_21519; Location=1..760; Strand=+; Gene=SeqID_52129
aaaaaccatcaaatgaataattttgacagaaaattattcataatttcgtctaaaatggatcaaattttataatattgatatttttcgatagccctatgtgttttctattatcctgcaaaattaaaaaaaaattctttaagtttaaaaaaagttatgacctgagaagctcaaaaaaccaagttttttgaacatttttaatcataactttcttgaaacttaacgaaactttttggaattttgtaggctaatagaaaacacttagtgctgctatttaatgatatcaagaattaaaaatttagttgcttttgggcaaagttatatcaaaaatattttcatttgatggtttttgactaatgtcatagcaccaatgataccgtacccatccacaaggaccacaaaagtggcatggacaatgaaaaagttcctctgcgggtagagaggttgacaagtagagcccggttttgggaaaaattaaaaataaaattgaacaaaaaatttgtataaaaattggaattaatcgaaagaaaatttataaatggaaaaaagaattaaaattaaataaaaataaaagaaacttaaagcattattatgaaaaaagcaggaatttattgaacgaattgatgaatttaaaagaatgcccaaaaatggaaaacagaagcaatttgcgaaagaattgggcattgaaattggcaaaagtgaatttaatttaatttttaattttaattttaaatatttcagggtattctaatgaaaaaaaatg

SEQ ID NO: 109824 - DNA, 55 bp, Heterodera glycines
  Promoter: Source sequence=SeqID_30576; Location=1..55; Strand=+; Gene= SeqID_60985
aatgaaagtgtcagttacgccgtaaagacagcggccgtaggggaagggcaaaatg

SEQ ID NO: 109825 - DNA, 1003 bp, Heterodera glycines
  Promoter: Source sequence=SeqID_1361; Location=1541..2543; Strand=+; Gene=SeqID_73033
tgcttgctcgagagtctcaggaaattttctgtttcaagcagaaatagtgcgggcaaggacgggcgaagctcagcttagcactcgaaaccgaaagcgaacccaatttttttcgaagctcgaagtttcgcccacccctggtgcggtgcgggtgcctcgaaaaactttcacaaaagattatcgtaaatatcagccagccctgacctggctccccaccccccccccggccaattgtacgtcgtactggaatactgctggttgaccccttacacacttgtggtcataatcagggctaaaaattttaaaaattagtattttaccgacaatacacagcaattggggtcaaagagcagcttataccccttgaaaacagcaaaatgctgataaatcagcagagttgagagccctttgatcataatgaattacgtcgcaaaaaaataaatttaagaaataagcacatttggaagctaaaattaaagatgagaagctaaactaatctcttttaccccctttgttccccaaaagttttttggaaaaagcgccgcaaaaaccatcttcttttctaacaaaaaatttctcaaattttgatcatggacaatcagaaatataacattgaacattttaagcctgttttgaataaattttgtaaaaatgaggtatatttgcctgccaaatgaggctttttaaaattgagaagctaaattggtctctttttttcagagaagttctctttcaaatctcacaagcaaaaaatttatttatttattttttgctagccatttgtttttaaagaatttttgttgtttttaaggcaatgtgccaaacttttttttaaaaaaattctcagtgacgaaacgatcggccaccgttgacttcacataaatatgagttatgtgtttattttttcaaaagatttcctcattttagtcgaaattacatattcttttctaaatggcaccgcccgtcaaaaaaaaagaaaaaactttcctccgtcgaccaccaaatg

SEQ ID NO: 109826 - DNA, 418 bp, Heterodera glycines
  Promoter: Source sequence=SeqID_18641; Location=1..418; Strand=+; Gene=SeqID_83295
gggcccgtagaataagaaggtggttaaatgaccgggtcaaacgaccatggttatttgacctggtcaaatgaccacgaagttggtggtaaacccgtagaataagaaaatgaccacgaagtgacgtttttaccaccaacctccgtcaaacgaccatgaactatgttcctattctaccgggttacttaaccacgtgcacttttgggacaatttgtttacacattttttatggaaaaataacttttgttttttaggtctatcgcataacaaatcgttgccaataatcaattttatgttttacccaccaaatgttacatatatttttcaacaccaatatattatttatttgtgagttgaaaaagaaatgatcaatcaataaattatattttttaattaaatcaaatcaaataaatttaggatg

SEQ ID NO: 109827 - DNA, 90 bp, Heterodera glycines
  Promoter: Source sequence=SeqID_2974; Location=982..1071; Strand=+; Gene=SeqID_82580
agtgtatttgccgatcgaatagtcgtgctgtgcacacctggacaaaaaatactatttaaggagcgaaagtacgcgcaggatcgcaaaatg

SEQ ID NO: 109828 - DNA, 63 bp, Heterodera glycines
  Promoter: Source sequence=SeqID_27027; Location=1..63; Strand=+; Gene= SeqID_57758
ctgttagttcaaaagttataggtagggcgtgtaattatatcgtatataaaatcgcgaaatatg

SEQ ID NO: 109829 - DNA, 777 bp, Heterodera glycines
  Promoter: Source sequence=SeqID_14127; Location=1290..2066; Strand=-; Gene=SeqID_78121
aatattttgacctctctctgcttaatttatttctataaattgtgttatttttctctccgacctctgacctacctataattatgttttcctttctttttgttgttttcgctaattatgttgttattttcaatagatatttcctttgctagatttccccgcatgtctccaggaggatttcttttttcatggtacattttactaaggacactgttctctctaaatattttgtgtgcatttatttattcgtcaattttaattaattggtctacagtccgttcgcttgtcatcttgtcggctttctcaatcgtcgactattccgccccgagtggcaaagcaaaagggagaagaattgaattaaaattggacgatatgatttgaatggataaaaaagcatagtattggacaaaaacccgcgcattttttgtttttacaaaatttatggagtgggaaaaacgtgcaaacctattttggtgtaatgtgcaaacagcaacgatttgaattttttaaatatgtatgtccttatttttccgcttgccctagggatatgaatttaatattattattttttgttattgtaaattatgtaaaatatttctaatttttgatgaaacattcattggataattgtcctgatttttttgtgtttgtactgtttttttataatcgatttaaaagcaataaattcgcattttcttcatttaataaataattttataaagctaaaaattcccaattttacattgataattaggcaatatttattgccaattaaaaatg

SEQ ID NO: 109830 - DNA, 69 bp, Heterodera glycines
  Promoter: Source sequence=SeqID_38841; Location=1719..1787; Strand=-; Gene=SeqID_67558
ccgagtggcggcggcacgggtgaccgtggcaccggcgacactgtgccggcggcgaccaccgtagcgatg

SEQ ID NO: 109831 - DNA, 1003 bp, Heterodera glycines
  Promoter: Source sequence=SeqID_16193; Location=613..1615; Strand=-; Gene=SeqID_80556
tcaatcaaaataaaaaaaggtaattaataataaagactggaatttcgaaaccaccggtctttgacaatcgactgggcccggtattttcatttaacgggctcggtaaaagccggtcggacgtccaacgcgtccaggtcctatcaattccctcccgccaatttatgacattttagtcgattttgatttccatttatttatttcttgttattaatccccctcaacttttattgttttttcttcctccttcgcctgctgtgtttattttgcagaaattggattatttgcataaatggcgaaaatgcccaaatcccccgggggtttccgtccaattcgcagttggaattgccatcgtcggtgggctgcttttgccaaaagtttattcttatgccgtgcccaatttggtcatctcatccggcagattaaactcaagtggtcttaggggcggaggaattggacgacgattaaaaaaggattcggtggaataaaataaacggttgaaaacaatagtaaatatagtattatcagctgaataatccaaattttatccccaccccattttttctctctccgtccgtttttatccattggaggaatttctatggacatatgggaggaataaaaaaggataattaccgcaaatttgtgtaatgagcagcataagcaaaaaggacgaacagaagagagacatcggtggaatcggaaaaagcaaagaaaaaatttaggggaataaagcaaaggaaagggaaaaggaggacgattgggttttgagttgagtgaatttgaagaagagcgctgacaagggagcgaatgttgagagatttaaggagagaaagtggggggggggggggaggagggcggagcaaaactgaaattgcgtagagaaggaccaaaaataaaggcggtcaaaataaatttggatatttgttagaacttgggaatagttttaatcaaaatttattgttataattaaaaatgagaattatagaataaaattaaagtaatg

SEQ ID NO: 109832 - DNA, 78 bp, Heterodera glycines
  Promoter: Source sequence=SeqID_23991; Location=1163..1240; Strand=-; Gene=SeqID_54694
cccctttccctaaaaaagttttaacaaaattttttaagaattttttaaatcgtttagccgtcccagtccggctacatg

SEQ ID NO: 109833 - DNA, 747 bp, Heterodera glycines
  Promoter: Source sequence=SeqID_30171; Location=509..1255; Strand=-; Gene=SeqID_60603
tcatggtcatgttattttcaattttttttaattaaggcgatttttttaatagattttgaccaaaattctaataaataataaaaatttgggaaaaaacctttttttttttgaaaaaagcaccaaaaaacaaaattatgattaagcatcacatttggtagccatggttttatcaaagtaatatgaccatattcaatttcagaaattcacgagtgaatttttttacgccctaaattaattttaatttttttttattcaattatttggccaatgttgttgtataacattaatcagttccgcttcaattccactcaaaaattcgccaaattcgttgagaattatcaatctcaaagacaaaaaaaaagaccatttcttttttgaaattaaaataaattaatttctgtcagttttgttcccccaatttgtcgaagaaaaaaataaataaattgaaaacctgttcgttaaatttcgcagctgactttgttttaatggaacacccaaacacacaatataaaaaaggtcaaatttcctaacgacagacaattccaaatccaaatcactttataaatttaatttttgatttgtcattggccaaaaatgaaatttaatgccttcaaaaacactaaaaaaattttactaaatttaatttctttaaaatatttttttaacttttactataatttgttttaattttcagattaattttgtaaacaaaaacccatagccttgcccaaattaaatcacaaaatg

SEQ ID NO: 109834 - DNA, 140 bp, Heterodera glycines
  Promoter: Source sequence=SeqID_7401; Location=1..140; Strand=+; Gene= SeqID_64712
agacgtgccattattgtttaacccaccaccaaatgtgccggtaattttgggtcgttttaggttgcgttttctcaaatgaccaagtgtattttttaggaaattcgtgtgggaccaaatcatgatgggcattttttccaatg

SEQ ID NO: 109835 - DNA, 647 bp, Heterodera glycines
  Promoter: Source sequence=SeqID_8252; Location=4586..5232; Strand=-; Gene=SeqID_67448
ctttttctttgtaaaccaaatccagtattgttggtgtcgttcgaaagcttaatctatttagaagctttttgtaagctattgctttgcgattagacaattatcaaaacagttatgcatgaaaattgcgaaaagtcgaaatttttgaagttttttcttaataaaatttttacaggcttgaaaaacttttcgtttttgataaggctaatagagcatgttaagagctttcgaatgataccaagattgttggatttggatgccaaagaaaaaagcttaagtggaaaaacgagctggcgccgaaacgggagcgccgaaacaccggacgccgaaacgcgagcgccgaaacacgagcgccgaaacgcgtgggtccctattttgcgggccaggacgttttcgcgtggccgttttcgcgtggccattttcgcgtggccgttttcgcgtgagggccgttttcgcgtggggtacgttttcgcgtggccgttttcgcgtggggtacgttttcgcgtggccgttttcgcgtggttgcatataaaagagaattcataactcacattatattttgccaaaatttgtttcactcttttttctaacgagtttttattttaatgagtttataaactaaattaaggctatttaaattatataatatg

SEQ ID NO: 109836 - DNA, 760 bp, Heterodera glycines
  Promoter: Source sequence=SeqID_12687; Location=2093..2852; Strand=-; Gene=SeqID_76366
tttcggtaacgcttttttctctgtgagcgaagtgcatcgggggatttgctttgtggtacttaattgaccttttgacttctttttatgttttgaattataattatttgttggcgttttgttttcctttttttatggaccttaaaatatttgtgagttttttactgttcggttttttttgttttcttgtctgctcttgaattgctttgaatttcttttgatgctgacttcttctcaattgattgttgtggtctcgtctttttaattattattgttgcggtttaaaatttatcgccgtaaattattttgttttgtttatttattaaagtgtttgcgaattcgttttgaaacaggtgctgacaagccgacagataattgtgtttgatccatttctgaaaagagacaacccatccccatccaaatttgttggttttgttcaacttggcgctcctggcgacaaaggtttggcttagtggcgactattcattaaaggataatatcggccataaaatttttgtgaaatcaagtgaacaaagtgatttctataccctcgtgttgggtttaaagcatcattcggcgtatttttgccgaccttacaactttctgctcgccgattaaaagcactcgtgttgtgctttacgaattaacgaattttgttaaaagctcgtgttgttttaaaactgatctttattgttttatatcgtgttgataaattctgatgattttccgctcaccaccactgacaaggcaaaggctcagaatg

SEQ ID NO: 109837 - DNA, 363 bp, Heterodera glycines
  Promoter: Source sequence=SeqID_10746; Location=255..617; Strand=-; Gene=SeqID_73992
ggcccaaaaaaaccccaggaaaatctaggtccaggaaaaattgatccagtgaaaatccagaaaaattcaggtccaggaaaatgcaggcccagaataaattccaggtccaggaaaaatacaggaaaacctaggcctagaaaaatcctggtttcccaaaaacgacctgggcctgggcctggatacagatccagactgagctctaaatggaacttttttattaactgaagtaaatttcttattaaagttttctttccaaataaattatatactaatattttttaataataaaaattagttaattaaaaaaattaaaaagtatttaatttgacgaaaatttacttataattagacaatgcatcaatg

SEQ ID NO: 109838 - DNA, 1003 bp, Heterodera glycines
  Promoter: Source sequence=SeqID_11060; Location=138..1140; Strand=+; Gene=SeqID_74396
tggcattttatacaaggcatcccaggccccaaaaattttcagaaatcgaattccgaggctcaattttaacctaaaaaatttgacaattttagtggtgcgcttttcaaaaacttttggaaacttggggcgggaatgaggtccggcggtgaagacaggcgccgtcgagaaaatttttgaaaatgagtataatttgttaagagaattttgtccaaaaattgtcaaattttgtgattttcaagccaattattggtaaaaaaaaaatttggagttttgggaggccggcggtgccgataggcgccgccgaaagtttttcggaattttaggaatttttaattaattttattaagaaaattgtacaaatttaaaaattttcaagagtccccaattccccgagttagtgtcggggggtcgggggataaaaagtcggaggtagggggctcggggagcaaccctattataaacccccaaaataggtgctaaaaatggaaacgagataaatattttaaaaatcaaaaatgtagtcaagtaaataaataaataaattttgaatatgaatttttgataaaattttccatttctcaggggtgtatttttagttttattgcatttttgttaataatttttttcaaaatagcagaaaatattttacaaaaaattcttcaaaatgaaaaagagcacaaaaaaagcaataaatttattattattacaggttatatcgctccaatttgattcggtttttataaaagtcggtcggttgtttcggttttttgattatttcggtcggtcggtttcggttaaaaacccgaaaaaaaccgaaaaagtcaaaaatttctcggtcggtttttttcggccaaaaaccgaaaccgaaaaataccgaaaaaaaccgaaaaaaaaccgaccggtccgatctctatttgtatccatattttctcattaagaaatgcaattttttctaagcataaacaatatagtaatcccttaaacattatattgttagtctatg

SEQ ID NO: 109839 - DNA, 346 bp, Heterodera glycines
  Promoter: Source sequence=SeqID_10567; Location=1843..2188; Strand=-; Gene=SeqID_73806
tttttccttacccatacaatctttctcttttagactttaagctgtacagattaccgcgtacgactattttcgactagttggcgaaatgtccgtttttggcttagtgatggaatgtctgtattaccatttaggtattttaattactaaaaatttatgaattatgcataatattatatctaaatatattttttcatttaaacgcaataaacaaaaaatccacacaaaaaatcaataaatgtctcctttaatttccagaagaatacttcgaatttatcaataataaaaataaaatatataaaactagttgacattttcataaattcccaaacagtcaaatcgtaaaatg

SEQ ID NO: 109840 - DNA, 164 bp, Heterodera glycines
  misc_feature (44)..(44): n is a, c, g, or t
  Promoter: Source sequence=SeqID_33760; Location=1..164; Strand=+; Gene=SeqID_63724
aaaaaagtttgtccccccatacatcaaaagttttccaccccccnccgtccttatcaaaatttcaaaaagtttccacatgccaaagccgtcagcacttcaaaagcgactccgcctccctcactctcagaccagagtgcctgtggcacacgcgcggtaaaaccatg

SEQ ID NO: 109841 - DNA, 159 bp, Heterodera glycines
  Promoter: Source sequence=SeqID_38523; Location=626..784; Strand=-; Gene=SeqID_67312
atttcttctaaagccgagacggctctaaaattattcgaaagcggagtcggcacgccaaattcgtcaaaagccgggttggctaaatattaaattgacacctattggtgcaatacttcaacgtttattgatttcgggtcgaaacaataatcgtctacaatg

SEQ ID NO: 109842 - DNA, 557 bp, Heterodera glycines
  Promoter: Source sequence=SeqID_13803; Location=990..1546; Strand=-; Gene=SeqID_77733
ttttattttcttcttctgaaacaaagttagggccaaaagtactaaaacaaccaggttttcagacagttttggtcataacttttttgaaccttaacgaaattttttgaaattttccggctattagagaactcttttagctatcgaatgatatcaagaatgtttaatttagttgactttgacaaaagttataggcatttttttgttgaaatttttcatttgatggttttaacggctcagctccctgcaaaatacttgttaaagatttgaatatttcttggggtgtctttcgttgatttgcctaaaattaatgctttgcttttgtgaacattcgctacatttaaacaaccatttcaatcaatagcatgatatgccaaatcattgatgccaagccaaatttttgcacgtcaaatgccacccccgtccccctgtttaaggtgggtgccatgccaaatttggctgtaaaatctttccccttctgattaagggttgatgccatgccaatttggcacgtctaattccttcaaaataatttaatataaaaaaaatatctagaaatg

SEQ ID NO: 109843 - DNA, 921 bp, Heterodera glycines
  Promoter: Source sequence=SeqID_21877; Location=394..1314; Strand=+; Gene=SeqID_52517
aaaagcaaaaaaattcactgatttttaaattgatatatgctaattttctaaaaatttaactgagtttgggttggaaaatctaagttttaatatgaatttttaatgtcttaattaaccttaattgcttaaagacaccctgatgagtaccaaaagaaaaaggcagccgaagaaaaaatgggcgcgagaccgttggatgtgaagagttaaatggcaaaattaatcatgtgttttgagagaataatgaaatctttcgattttattcaaaatttattttggtatttgtcacaaataatcatatttacacagaaaaaatattgaaagatatcaaaataaaatattatttattaatttaatttatattccaaatgaatgggttaaataaataatcaaaaatttattatttttcaatcaaattttcgcataaataaaaaaaatggaaaaaataaaaaattatgttatttaaacagctattaatggacttttccccataaccatcttaacaaaaataaaataaattaaaatttgaaaattaagggagcgaatcaaatgcactttcgtttttgcaataaattcatataaacaatgtctatgtgcttaaaaatacgatttatttgaatacgtaaattccattttgatgaaacgatgaaattcatgagttttttcgctatttaagcaggtcatacaataaaagcatgcaatgaaaaaactctgtttattgattacatttaaactttaataattgttttcctcattttatttattaatgacaagaaagcacaaagaaagggaatttaatgtgttaatgtaattttttttcttaaattaatattgaatacaaattatttttttaatgtttaattaataataatttgaaattaaattttttgaaatcttttttagatttttaacttttctacaatg

SEQ ID NO: 109844 - DNA, 148 bp, Heterodera glycines
  Promoter: Source sequence=SeqID_19115; Location=3055..3202; Strand=-; Gene=SeqID_83854
gattttgaaatttatttttaataaagcaattagtactattttgttttctctcaaatttgaaatttttcgagcctagtttttggatttaaaaatttaaattgttcatttttaaggtgtccgctcgtctgcgcgccctcaatgaccaatg

SEQ ID NO: 109845 - DNA, 80 bp, Heterodera glycines
  Promoter: Source sequence=SeqID_3085; Location=320..399; Strand=+; Gene=SeqID_83145
ttcagtgtgtgtgacagtgatcgaaccgcgggtgttggctggtcggtgggaagggcgaaaaggggtgaaaagcaaaaatg

SEQ ID NO: 109846 - DNA, 115 bp, Heterodera glycines
  Promoter: Source sequence=SeqID_412; Location=1..115; Strand=+; Gene =SeqID_51751
gaaaaaaaatttgttgaaatttattaaaatattatagagtttcatgaaatttcattattttcatttaattttcaatgtttttctatagaattttcgtgaaagatttatcaaaatg

SEQ ID NO: 109847 - DNA, 115 bp, Heterodera glycines
  Promoter: Source sequence=SeqID_1778; Location=1950..2064; Strand=-; Gene=SeqID_75903
ttttaaggcatgcgccaaaaaaaattttcatttaatattcctctcaaatttggtgccaagttcagatcatgttgagaagaattcttggtgatcaaaaatttttatttgaaaaatg

SEQ ID NO: 109848 - DNA, 287 bp, Heterodera glycines
  Promoter: Source sequence=SeqID_39980; Location=1..287; Strand=+; Gene=SeqID_68425
gtcaaaagaggaaaggaaattgctcctttttcattcgatgttgcgattagacgagaacaaacagacgacgaatcgttttctattcgcgagcaaagaaacattttggaaacaatggaagagaatttacagcaacagttgggaggagccatgattctgaaagttgacaacattttttacgatggcatcggaggaattttaatactccgtgtgaaaattgcccgttttataagtacaacgattaagcataaaacacaaatccaaaactttttttagattttggcaggatg

SEQ ID NO: 109849 - DNA, 170 bp, Heterodera glycines
  Promoter: Source sequence=SeqID_6513; Location=1..170; Strand=+; Gene= SeqID_61846
gagccattacttatgcgaactatccgcataagtgtccagccctaattagtcaaacgggatggatgcgttgtccacgatgttctgggccacatccgattggatacccatgttttatacaacctctgaaagatgaacctactagcggaagaagaagaagagagagaagaatg

SEQ ID NO: 109850 - DNA, 274 bp, Heterodera glycines
  Promoter: Source sequence=SeqID_31755; Location=498..771; Strand=-; Gene=SeqID_62061
actgaaaaagaataatgaattgcgcccccgtcaaaattttattactttgtacttccttatgaaagattgatatgaaaagcatcgttaaaaaaacaaaacatatttgttgtttttttcttcttaattgtttaatatgaattccaaaattttaaatagaaatttttttctgtgttgaaaaacgtatttgaaagaattaataaattttataagaaatttcattatttaatttttatctagacaattaattgccggaattttcaaaataatcataatg

SEQ ID NO: 109851 - DNA, 64 bp, Heterodera glycines
  Promoter: Source sequence=SeqID_17892; Location=784..847; Strand=+; Gene=SeqID_82442
ggtacgcaaaagtgaaagaaatgcaaaatttgcaacgccaaaaccatagaatttgaaaagcatg

SEQ ID NO: 109852 - DNA, 364 bp, Heterodera glycines
  Promoter: Source sequence=SeqID_4433; Location=3868..4231; Strand=-; Gene=SeqID_54423
caaatcagtaaatattcaaagaacaaatacgaatcacaccttggctttgtattttttatgagaaagaattggaaatgtgataaaattgcggataaatttgaagaatatgaacggacagaatgtcaaaaatatcgaaaatatttggactttttgtacgaaaaaatataatctcaacaaatttttcaattattattttgaaccaaaatattatataaatttgcaaccgaaattcgatgatgaaatttcatgggtgagacttaacacttaaataaaaattaaataaattcaaattttagactaaagatgctctactttcggaatttgttataggactagcgacaaattttcataaatttttaggatg

SEQ ID NO: 109853 - DNA, 638 bp, Heterodera glycines
  Promoter: Source sequence=SeqID_11286; Location=510..1147; Strand=-; Gene=SeqID_74660
tttgtgattctctctctctctctctgtttcgtttgtctctcttttacattcttctctcttctcgccttctctctccttacacttcagatgatcaccttcgaagcggcgatgattctcttttcttcactcactatctctcattctctttttctctgtctcttttttcatttttttttctttctcaatctctcctctctctctctcttttcctttctctttctctctgtgtatcttcgtctctccttttacactgatcactttcgacccattctttttttaccttttctgatcactttccattcttccgatcaatctcagctcaacacagcatactgaataagcatgtgatttttgttcattctctccgggcaacagctgttacggaagggcacaaaatgtatgggatttatctcgaaaattcgtgggaaggaggctatttattcacgcttagagctcctcgtcggaagcgaatgctttgtcaaatggattagataaaaatgtttcaaaatttgccattttacaatcgggggaacttaaaaatttcaaccctaatttttttgttttcttttaaaattaattaataaaaataaaataaattttaggtaaaatttgtgcgtaaacacagagccaacaacatg

SEQ ID NO: 109854 - DNA, 468 bp, Heterodera glycines
  Promoter: Source sequence=SeqID_29133; Location=1..468; Strand=+; Gene=SeqID_59685
ggtaggcagattaaaattttcaaaagcctcatttggcaggcaaaaaagcctcatttttacaaaatttattcaaaacacgtttaaaatgctcaaatgttatatttttgattttccatgatcaatttgagcaatttttgttagaaataagcatttgggaaattctgagcacgaaaaatcgaagttgattttttgcggcacttttttcaaaaacaaaaatggctgattcgcgctaacaaattatttttttcacactataaatgcatctttattagttaatacataatcaaacgagagaaagtggatattattagtcattaataactttggccttttttatccggcactccggctgattgtgagccaattttcttgactgacaaatttattcaaaagctcctcatgtcttaagtaccaaaatttttattaattaataaaattcaggaattccgtgaaaagtttgcaaaaatg

SEQ ID NO: 109855 - DNA, 520 bp, Heterodera glycines
  Promoter: Source sequence=SeqID_8138; Location=1..520; Strand=+; Gene= SeqID_67099
attacttaggtaatccaaaattcttaggtattaatctaaagcttaaagtttagcgtatttattaatacaagaaaaaaacaaatacttacatatattaagaaaaaatttacacttccccaaattttaagctttcgattagagcacaattttctcccactttttttctatccaaaaatacaaaaatatctttgtttattaatacgtttaggtaattatcgtacattgcatctatttttcaaaatatatttgtttacgtttgcatttagtcggatcaattttttttaccgatggcaaagcgatgaaaaaatgcataaaaacagggggggggaaggagcacaacgaaacatttgcatgttttttttttgctacaaatttcctcaaaataatcacaaagcccaactgaacataaagttttgctgattttgtgccgtggtttttatttcttgccaattttgaaattgccaataattttaccgcatttaaatagataattaaacgaatgatggaattgcttagcatg

SEQ ID NO: 109856 - DNA, 222 bp, Heterodera glycines
  Promoter: Source sequence=SeqID_37556; Location=1178..1399; Strand=-; Gene=SeqID_66601
ttaggctcgccttttttttattgtcatgacgaccatttattaggtagaaaatgaattaacaatataacttaaaaattgacatgttcagaaaattttaatttgaaatactttttttgtataattttaaatttgataattagcattcattattaaacaaataaaaattgatttttatagggagagaatttccgttccatttaataatttaataaacccaaaatg

SEQ ID NO: 109857 - DNA, 147 bp, Heterodera glycines
  misc_feature (28)..(28): n is a, c, g, or t
  Promoter: Source sequence=SeqID_39662; Location=988..1134; Strand=-; Gene=SeqID_68172
tcccgaaaaaaaatcgaggtcccggtcncggcttctcaggtcccggcaagtcccggtcccggttttggcaaaaattcccggtcccgtggcactctactttttaatattgctttagaaaatgccccgaggaaaagccgagaaaaaatg

SEQ ID NO: 109858 - DNA, 138 bp, Heterodera glycines
  Promoter: Source sequence=SeqID_16903; Location=1..138; Strand=+; Gene=SeqID_81336
gcgacggcgtcgcgttcgtattgctcccaattttacataaatgttcacaataaaaagcataataatttttgttttaaataattctttttcttttttagctcaaaagcttcccagctcgttcacaattttttattgatg

SEQ ID NO: 109859 - DNA, 135 bp, Heterodera glycines
  Promoter: Source sequence=SeqID_3487; Location=82..216; Strand=+; Gene=SeqID_84872
agtgagtgacgcaattgtaacatttctattcatttattctgttttcttttttagattttgaacatttcgcccattttggaggatggcactgttcgccttcgttggcgtatttgttacctcggcttgctgagcatg

SEQ ID NO: 109860 - DNA, 393 bp, Heterodera glycines
  Promoter: Source sequence=SeqID_16193; Location=1..393; Strand=+; Gene=SeqID_80557
atttaacataattagtaggaagttttaagatgccttttgtgaagctgtccaccctccgccccatcttcaaccaccctcattatgaaagtgaagaagtccggtactgtcactgtttttaacaaaaaccaacagtttgcttcaggaatagaactttgctggtttattcgctttacagtaggaaatccctcaccgaagtaatgtaaaaaattatcgtgcaaaattccacttttatttctttgaaggtgtaccattcgctgcgttcttcgaacattcatttttacgtgtttcagccgcaacaatgcatagagaaacacccaaagtgagttcataaatttgcttatgcatttttacccgtttgaatacggtagaaacggatgttcgtatttggaaatg

SEQ ID NO: 109861 - DNA, 316 bp, Heterodera glycines
  Promoter: Source sequence=SeqID_9406; Location=1448..1763; Strand=+; Gene=SeqID_71300
tttgtgtaatttgacaccacttcttttttcttttcgttaaaaattaaaaagattgtctggaatttgtcttgcgccacaccgctgtgccattcatttatgtaatttgacaccagtctgataataatttcgacaaaatttatttttatttgtccatttattacgaattatcttatatctttcgatccaaattttggacatattgttttttcttttcctttttagcaattttgctggtttattcaattaaaataaataaatatttgttcatctttaaagtaataatttttataaaatttagacacaaaaacaaatcatg

SEQ ID NO: 109862 - DNA, 131 bp, Heterodera glycines
  Promoter: Source sequence=SeqID_44536; Location=214..344; Strand=+; Gene=SeqID_72019
tttggtatttgtcgttattccacggctggtgtcaacgtggcagttcaaaccgaaccgctaatcagcaaagaggtgagtcgaccgtttgaaacaaatgaacatttttttattgttaggtcttgctaaaaatg

SEQ ID NO: 109863 - DNA, 251 bp, Heterodera glycines
  Promoter: Source sequence=SeqID_32108; Location=268..518; Strand=+; Gene=SeqID_62431
tatttttttttctgaaattttgtgtcatttattatacaagaaaggaaaatacatcatatacccattatttttgtcgaatttataaatttcaactagggctggtcaataaacattccagaaaaatggctatctatttttttgagaaattttctatgcaacaaacgctctcgaacatgaaacgaagtgcggtgcgccgtggccattttatttttcaaataatttttaaatttaatagatattccagaaaaatg

SEQ ID NO: 109864 - DNA, 201 bp, Heterodera glycines
  Promoter: Source sequence=SeqID_20612; Location=1..201; Strand=+; Gene=SeqID_51168
ctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatg

SEQ ID NO: 109865 - DNA, 70 bp, Heterodera glycines
  Promoter: Source sequence=SeqID_14838; Location=1..70; Strand=+; Gene= SeqID_78994
tcagtcaaaaagggaggaatgtttgaggaaaatacgacattttggttctttgccgacggacacagcgatg

SEQ ID NO: 109866 - DNA, 88 bp, Heterodera glycines
  Promoter: Source sequence=SeqID_18092; Location=1462..1549; Strand=-; Gene=SeqID_82677
ttttcggtttgcacggaactgaaagaaaacaaatggttgaattaccaattaattggcacccatttcaaaaattcgattcgagaaaatg

SEQ ID NO: 109867 - DNA, 119 bp, Heterodera glycines
  Promoter: Source sequence=SeqID_35003; Location=1..119; Strand=+; Gene=SeqID_64671
tccacttcaccggataacattccttacattttattaaaaaattgtgctgagccaattacaaaaatattagctgacatatttcgacttgctttggattccggtcaaattccggaaatatg

SEQ ID NO: 109868 - DNA, 227 bp, Heterodera glycines
  Promoter: Source sequence=SeqID_42849; Location=1..227; Strand=+; Gene=SeqID_70657
tacatcccattatggagcgctaaaattatcagagtgccgaaaatcgcacgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatcgtgatctaagcctagcaaaaaatg

SEQ ID NO: 109869 - DNA, 300 bp, Heterodera glycines
  Promoter: Source sequence=SeqID_287; Location=3448..3747; Strand=-; Gene=SeqID_81328
atcgctttgatttgagtttcatgcggttccgcttttttctctctgttctaataaaagatgaacattaaacttgaacgagaaggggatgggagggggtgtcatcatcgatttgaattgtcgcacgggactcagtattgagtgcccatcccacccaatctttactcaattccttttgcgtaatttgacgttttaaattggagggggggggctcaattgatgtccagccgggtgtatataagcagctgttaattccgccgtcttccatttcattctcgaaaatttttctcccaaataaaaatg

SEQ ID NO: 109870 - DNA, 395 bp, Heterodera glycines
  Promoter: Source sequence=SeqID_3923; Location=1698..2092; Strand=-; Gene=SeqID_52459
aaggggggaagcggaagaacaaggggtacaggtgcaaaaccataacccaaagcgacggataaggtgaagggaagagggggaacggaaggggaaaagggacatttgaaaagtgtggtacaaaatacggacggaagtgagggcggaagaaagacgagcaaattcatcgaaacaatgcgaaggaaattctcacgttcctccgggacattccaatcgagaaaaagtaaagcactgatggaaagacaacgaaatgttaagcaaattaatactcagaagcatcaagcgaaagtggcgattttgagaggggaaattcgacgaggtaagccaaaaatgagagagaatttgaaaaagttgggggggggggggcaggagacatttgcattagaaaaaaggagatg

SEQ ID NO: 109871 - DNA, 118 bp, Heterodera glycines
  misc_feature (106)..(106): n is a, c, g, or t
  Promoter: Source sequence=SeqID_44708; Location=1..118; Strand=+; Gene=SeqID_72152
agtactattcttttaccttcatttattttgttgtatagttgattccgggagagcgtccggatttgaaaatttatcaaaaataaagaagtacaaaacttacttaaanaacacaaaaatg

SEQ ID NO: 109872 - DNA, 186 bp, Heterodera glycines
  Promoter: Source sequence=SeqID_30034; Location=930..1115; Strand=-; Gene=SeqID_60484
ttttcagggctagttgattcggcaggtgagttgttacacactccttagcggattccgacttccatggccaccgtcctgctgtctatatcaaccaacaccttttatgaggtctaatgagcgggcactttggcaccttaactccacgtttggttcatcccacatcgccagttctgcttaccaaaaatg

SEQ ID NO: 109873 - DNA, 309 bp, Heterodera glycines
  Promoter: Source sequence=SeqID_28166; Location=1..309; Strand=+; Gene=SeqID_58814
ttccaaaatcacgcattttccatctgatcattggacctcagtaaaaatcgcaaataaaagggagtcatgtggaaaatgaaggaaaatgaatcggaatatcggcggagttgtttatcattgcaaaaatgggaggagaaggggggggggggaaacacgttgagaaatggtaaataaaagtcgaggaagtcgtcgggactcactcttggccattcattcgctccctattcccctttttgaatttcaataaattattttccaattttttttctaaattttgctgaaatgtcggccaaatacttgcgcagaatg

SEQ ID NO: 109874 - DNA, 495 bp, Heterodera glycines
  Promoter: Source sequence=SeqID_30272; Location=1..495; Strand=+; Gene=SeqID_60693
gtacattccccctccccaccttttatcattacccaaccattttttaaattttcaaaaaaagaaaatatttcaaaaaattcataaaattggcgataaacacttaaaatgagaatctacaattgaaaaaacgtcgtaatttgagttgacaaggcaaatttttatttcaaactttgtgatttttatttgccaaaaaacgcagccctactaattacgctaaagatgtaccatccgccaaattggtggctcacaatcagttggttaaattactatttttgaaggtccgggttcgaacccaacatgaatcatgttctcgattttcgtccctttgtctgatgaagcgcatatttagtaagacaaccattgcagcaatattttttgttacacaaattttcttcaaaacactgactgaaactgaccgtcactgagttgttggcacattcaaagtcaaacagtgggcccggcacttcgccaaccgcaattgtgaatgccacaatg

SEQ ID NO: 109875 - DNA, 64 bp, Heterodera glycines; identical to SEQ ID NO: 99473
  Promoter: Source sequence=SeqID_30521; Location=425..488; Strand=-; Gene=SeqID_60933

SEQ ID NO: 109876 - DNA, 351 bp, Heterodera glycines
  Promoter: Source sequence=SeqID_29448; Location=1215..1565; Strand=-; Gene=SeqID_59946
gctaaaaaatggtaggtaattgcgtagacatttttataacggtaaaagtaattccgtaagactatataacagggatgggatccgtccttgaatggcaaggacatccttgaaattgggccctctttcttgaaaataaaaaaatgtccttggatgcaaggacgtccttgaaaatgagaatttggaaaagtggaaaaaataatcaaaggaaatttggtaattttataacatatttggatattaaattatggcattatgttaattttttttgctcatagttgagaattattatttattattattattaatatggtattaggaatctttcatgatacccatttttatttcagaatg

SEQ ID NO: 109877 - DNA, 110 bp, Heterodera glycines
  misc_feature (19)..(19): n is a, c, g, or t
  misc_feature (94)..(94): n is a, c, g, or t
  misc_feature (105)..(105): n is a, c, g, or t
  Promoter: Source sequence=SeqID_23499; Location=1734..1843; Strand=-; Gene=SeqID_54193
atcaaatgtcacaaacccnccatgagcttagcaaaaatttatacaggctcctgggtgagggaagtgatccgttagcaaaaaaggtacgatcacnacagaattctntcatg

SEQ ID NO: 109878 - DNA, 1003 bp, Heterodera glycines
  Promoter: Source sequence=SeqID_256; Location=830..1832; Strand=+; Gene=SeqID_79944
tattaattacattcaatattaaatcttactttttaataaacgatttccttaattatttaattttaaaaccatgattgtaccctttttaaccattattgtaccattccaacaattattgtaccttttcgacagtggttgtacctcatctaatcactgttgtacctcttctaatcactgttttacctcttctaatcacttttgttcaaattttaatcactgttgcacctcttctaatcactattgtacctcttccaacaccttttccaacaaatcaccaaatttaaaaaacgggcgcgaagcgcctgtacaaccagaacaaaatttgaaaaacgggcgcgaagcgcccgtcgagcccaacaaaatttaaaaaacgggcgcgaataattttaaaaattttttaaaataatttaaacgttttttttgttaataataaaaaatttatttatgttttaaattaatttttttgtgttgaaataaaaaaaaacaagaaaattcattagatttatttttaagcaaaattagatttaaaaaacactgttgtaccacttcccgtggttgtacctctttccccgtggttgtacctcttctaatcacaattgtacctcttcaaatccctgttgtacctcttctaatcacttttgtacctcttctaacaattttgtacctcttcaaatccctgttgtgcctttcccttccgtggttgcacctcttttaatcactgttgtacctcttctaatcattgttgtacctcttctaatcattgttgtacctcttctaatcactgttttacctcttctaatcactattgttcaaattttaatcactgttgtacctcttctaatcactattgtacctcttccaacaccttttccaacaaatcaccaaatttaaaaaacgggcgcgaagcgcctgtacaaccacaacaaaatttgaaaaacgggcgcgaagcgcccgtccaaggccaataaaatttgagaaaccggcgctaagcgcccgccctatg

SEQ ID NO: 109879 - DNA, 1003 bp, Heterodera glycines
  Promoter: Source sequence=SeqID_40844; Location=607..1609; Strand=-; Gene=SeqID_69090
cttttttgattataatacatacgaaaaaaaatctgatttgatttttgatatttgtttgaatgaaaaaaatgttttgtatagtaaaaagagaatgaacaagcctttaatggattgaaagaaagcaatgtaaatctacatctcaaattttcctgttcgggtggataattatatgcagttgggatatattacgtgccgcttgctgaatgaccgcttgctgaatgaaatttatgtggaatattttaaattaacgtttacaggtcagtttttgttttgaatttgggggtgggtgcaataacgattctcttttatatgtttttaaaaaaaaaccctctcccccatctgcaaactattaacttaattactgctttttttgagcgaaaaaagaaaaagttgaaatgcttcttttttttgtttttgtgtacattcttttattttcaaagtttgtttcaaggtttaaaatatctaccgctgatttttgtaatgaatttaagacctagaattggaatttaaatttgattgtgtttgtaaatgctaatgaattgtttgtgaaaaaagtcacatttaatttttttaaatatgaatttaattgtttggttatcagcagaaatttttgtttatgttatgattaattgaaaacgaattgttagtaaatgaaagttttgttgtttgatatgtatcatgttgtgctgattcaagttgcaatttttttacaaatggatgttttacgatatcgaagccaatctacaaaatgtgatgtttttgaaaattttaaaaattaacgggataacaggtcagtttgattttttctctttttaatgagagataatttgaccttgcattatttttgacccactcatttttatttttaatcattttattaaatattcacacttgcttgaatatgttgtttggttcacatttatatatttgttattttgtaaatgattttgttatgtaatgttctttcaggtttaaactttctactgcctcctttgttataatg

SEQ ID NO: 109880 - DNA, 1003 bp, Heterodera glycines
  Promoter: Source sequence=SeqID_9547; Location=1838..2840; Strand=-; Gene=SeqID_71840
cttttctttctctctctcgctctctctcttatctctctctctctcactctctttcttttttctttctctctctcttatatctctcttttctctctctctctcttttttctttctctctctcactctctctcttatctctctcttttctctctctctctcttttttctttctctctctcactctctctcttatctctctctcactctctctcttttttctttctctctcttatctctctctctctctcactctctctcttttttctttctctctctctctcattctctcttctctctcactctctctctcttttctcttgctctctctaataccacacaaaaatataaataataataataataaattaattaaaaaattaaattttgttaaaataataatagttaaaaaattaatacctaaataaatttaaaataatagataaaaatttaaaaataaatgaaaaaatataaaattaattaattaaataattattaaagtcaaatcgtattggagggacggacatcagctgtcgtgccctttgggagggaagggatgccaggccatttgagcgctcgcgcgtgccatttgaccgcacgcaggggccatttgagcgcatatgccatggcatgaacaatttagttgccaacctgccaaatgaccacatgcttgagtgaaggtcaagctccgcccacttgtgagggtataaatagccggctattaccagcaaaagtcaacttctcccattcattcgcgaaaattctacccacattcattgcttgcgcgctccgtcaaaaaatatttaaactaacaaatttgcaactacattaccctttcatccaatattttaccaatattcaacttataaaaaaaaaaatattttcaataattttctattacaactataaaatttacatttttctaattcaaaatattctttcatattatcttatatcacctataaatcataaatttttcattcatatattattattcaaataaaatg

SEQ ID NO: 109881 - DNA, 598 bp, Heterodera glycines
  Promoter: Source sequence=SeqID_7160; Location=580..1177; Strand=-; Gene=SeqID_64009
ttcggggttcgaaatggatatcagattcggattctacgacaccgataacctatagaaacaactttttataaatttcaaataaatttaacaaacaaatttttttgttgacacaaaacccacaaggcgtgccgaaaaaagtgctgtatttattacattaaagaatttctgtaaaattattgaaggaaataaagattaaaaatttcttcaatatgtaagcaatatgtataaaaacccaaaatgtgtacgaaaatatgtaaataaaattttttttattaaaaaagattccccaataaatttttcaaaaatcttactgtgagaaaattctttataattaactaatttttctagccattactcagaattttttaaatttttttcaaaatgcgtttttcgtgcttatctgagtgcattgtgcgcaaaaattttaggcatttgcctaaaaacacagccctaagtattacatatagattttcagcaaaatacgtacagtaacccaagccttaatggcgtcctaatcaccgcacttattatttccacattttttttgaataatataaaattgttaaaaaaaagagaaaaaggtacacagtaaaaaatg

SEQ ID NO: 109882 - DNA, 100 bp, Heterodera glycines
  Promoter: Source sequence=SeqID_546; Location=1055..1154; Strand=-; Gene=SeqID_45913
aaagccatgacggaaaaacgaaacaaatcgcactaaaagtaccgattgctttttttaaattggcaaatactcccaaaaggaaccctttctcgccgaaatg

SEQ ID NO: 109883 - DNA, 63 bp, Heterodera glycines
  Promoter: Source sequence=SeqID_24318; Location=380..442; Strand=-; Gene=SeqID_55041
ttccaaccctccttcgccaaactattattgccgattgcttccattcagattgaaccgctgatg

SEQ ID NO: 109884 - DNA, 915 bp, Heterodera glycines
  Promoter: Source sequence=SeqID_32174; Location=244..1158; Strand=+; Gene=SeqID_62500
tttttagcaatttttgtctctatttgtacatgctaatcatgttaattgggtgctgtttattaatatgttggacaattgcaattagcagacccaagtcccctgagtttatattagcatggatttcatcgaaaaaatttttcttctaccctttcttatgaggaggtaaaaattataactcaattggatattggtagaatgagaagcagtaaaaaaaatctgaacttaagtcatcgcaaaagggggcaataacattttttaaacaatatttttttttttactatttttcacatttaattacttgtcctacacaatactgacaaatgaatgtaataattggtttagctaattatcattttccaattaattagccaaattaaattcaattttatattctgagaataattttgacatgagcacatatttagtgatgaatttgtttcgttcatttaccatttcgcaggttttcttctgccttcccaatacgtcgattttattttggccaaattggcacacaaatcgggcactttttgggccgaatatttcgaggcgcgtattgcgagcgtttttctgttggaacaaatcaacaaaaaggagagatttttggatcgaattggaccagcgaaaatacgaaacgaattgaagagaaaaatcgttgaggcgaagacgcaattttatggccaactcaaagaacaaatgtcgccaatttggcgcaaaaatttgtgcattttggtcgaacttgaaatattttttacgaaaatatttgaaaagagaaatgaatttacaatggacaaaatcagaaaatgggagccaggaaagcatttagaaataatgaaaaaaaaattagaaaaacggagaaatttattaattaattatttaaatattaatttatatttacttttttagactgcaaaaatg

SEQ ID NO: 109885 - DNA, 315 bp, Heterodera glycines
  misc_feature (39)..(39): n is a, c, g, or t
  misc_feature (47)..(47): n is a, c, g, or t
  Promoter: Source sequence=SeqID_42703; Location=955..1269; Strand=-; Gene=SeqID_70531
taaaatgagccattatgaattacaagcgtatatctggtnccacatgnagtgtgtgggcgagattaagtaattttctgaaagagctcaaatgcagctttcgaatggtgtattcaattaattgtttacttgaaaattcacagagatatgtccaactgaatcttgaaatgaataatggcgtagtattctataaaaaaaatttttcttaggaattttacagtgcccagggatttgaattatccataaacacatcatagggtaaatatctagaaaaaacaaatttttttttacacaaaatcctagtccagcagacagatg

SEQ ID NO: 109886 - DNA, 53 bp, Heterodera glycines
  Promoter: Source sequence=SeqID_4796; Location=1782..1834; Strand=+; Gene=SeqID_55751
acttacagcaatcaacatttaaatgccattaaagggagaagcaggaaagcatg

SEQ ID NO: 109887 - DNA, 59 bp, Heterodera glycines
  Promoter: Source sequence=SeqID_5878; Location=3945..4003; Strand=-; Gene=SeqID_59526
atgaatttattcgtgaacggcaaaaagacgacggaccatgaatatggacggaaggaatg

SEQ ID NO: 109888 - DNA, 414 bp, Heterodera glycines
  misc_feature (24)..(24): n is a, c, g, or t
  Promoter: Source sequence=SeqID_14217; Location=1838..2251; Strand=-; Gene=SeqID_78236
ttaaaattaataaactgtattaanttgagacaaaacataagatatgtaaaagaacggaagtgcaaaaaaatctcgcagtttttataaattaatttcgagaaaaactattcgacgaaaattatcagcaattttcattaaaattcctagattttttgcccggcggcgcctaacccacaaccctaattttttttaatgaaaaaccattcacaaaatgtgttgttcaaagaaaaaaacaaaagatttttacatattaattgacgcctttcgcaaagttttcgtttgttcacagccgccccctctctttttttctcattatgctgctaattgaactaatcaaaactttatattttttcacatccaaaaagccgagtcgtagaattacataattttttttttgtagtaacccctagaatg

SEQ ID NO: 109889 - DNA, 460 bp, Heterodera glycines
  Promoter: Source sequence=SeqID_1469; Location=619..1078; Strand=-; Gene=SeqID_73724
ttttcaactttttctttctttctttccccccacttttttgcccccccccttcattttttgttgtttctgctgatgaattacatatgaagcaaaaaactgtgataataaggccaaaaagggatcggttggcccgccaaagggcgccggcgcataaaaaatcggcacaccgattttccattgccgggccatcctccgcagagctttcggtgggtgtctctgattttaaagcgccaattggtcgcgcaatttgttcgtctaaacggacacgaaaaaatcggattatattaattctttatttaattttattactttaattaatgcttgtgttgataaaagaaaggttcgagtcggtgttctttatataattatgaggagttaattatgacaattaaaccaaattagaggtcagcgggggcggtactcccacgggacccgcaggtttttttactgggcaaaaatg

SEQ ID NO: 109890 - DNA, 777 bp, Heterodera glycines
  Promoter: Source sequence=SeqID_5513; Location=1163..1939; Strand=+; Gene=SeqID_58292
tttctgtgatcaatttgtgataattcgttcaccatttcaaaatttttgtttaattacccaagtttgaggtcatttcccggaataaattttttattaattccgtgtctcgtccctgcctgcccctgaaccccgcaccgtggaattcatttggcccgaccccagagcaagtcgggacaaattggcgctcctgggtggatttgctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacgaagtacttgccctccgaggaagtacttcgtacaaaagggtgttcaagcgcgcacaaggccattgacaaataaggaaaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacagaaggtccaggaccaaggccagactgatctcggaaaaagacacaaaacaacaagcacacacacacacacgcacaatcaaacagcacaatg

SEQ ID NO: 109891 - DNA, 151 bp, Heterodera glycines
  Promoter: Source sequence=SeqID_5278; Location=5409..5559; Strand=+; Gene=SeqID_57542
accttttaaccttaaggaaaaacttcctgaatattgttgtaatgacgtacaaatactcacccacgccctcgtcgaattacgccgggaattcaagcaactcaccaaacgggacggaaaacacgggggaatcgacattctttggcaagccatg

SEQ ID NO: 109892 - DNA, 400 bp, Heterodera glycines
  Promoter: Source sequence=SeqID_11100; Location=2201..2600; Strand=+; Gene=SeqID_74431
ttgttaatcagcggtcggttcggcggcttaattacccccttcccctcactcactcccgcccctttctgatcagtagggaaagcgcgcagcaatttttaacttaatttttaatcaatttttgaatttttttttgaattttatgaatgtttcattgcatttttgacatcaaaatttgctttggaaacattgatttgaataatctgcacaaatccaatccattcagcggcagcgcgtcacattttgtttaatccgctattttttgcaagcttaaaatctgctccgatcatccgatttagtttttttgacctcctttaaaatgatttgactttgtttttttttaattttgactattttttgtttaggtaattaaaatcaaagtttatttcgaattgccaaaatg

SEQ ID NO: 109893 - DNA, 685 bp, Heterodera glycines
  Promoter: Source sequence=SeqID_18929; Location=1..685; Strand=+; Gene=SeqID_83652
tagaaaaaataaatttattatctaaacaataaacgttcatttaaaaagcgtttttatcttactaattaatggtttctcgtagtaatttgtgttttggtctttcttgaccatggaatgctattgtcatttgaagccccgagggggcaaatgacgtcgaggtcattcgtattgtggttttaattaatattaattagtttataattaacattaactcattgctccactatacgaaaatgctgccgaaaaattaactaataataatcacctaaattaacaagttaaaactttcgactcggaaatgttacagcaatagtttttttttatttaactaaggacttaccacacaatttatatttttacaattatcaagcctaaacttgatacatagatcaggttatagtcaagataacaagccaataataaatagagtaaattgattgtttattaagaaaattaaaatatttgtgtacaattttttatattaattttattaagataatccgttttctaaaaaacattatcaagatgacggttttcactttatctgttgcttttttgtttttatatgcgcatcaattagtttcttcacatggaatgatcgctgaaaaagcgcatatgaaaatggtggaatagaattttcaaataattaaaaaccttaaaaattttagaaagaaaattttgtatg

SEQ ID NO: 109894 - DNA, 109 bp, Heterodera glycines
  Promoter: Source sequence=SeqID_41983; Location=1..109; Strand=+; Gene=SeqID_70004
ctttgcgcagtacaaagacagcggcccaattcgtttgaaggactgctaccatggaggacgtgtgggtccacaacgactacactacgaggtgccggaggggtggcggatg

SEQ ID NO: 109895 - DNA, 452 bp, Heterodera glycines
  Promoter: Source sequence=SeqID_8795; Location=2114..2565; Strand=-; Gene=SeqID_69252
aagtacggaaaaagaagcaattgggaaaagtaaccggcaagagtacggtggcaaacaacggtagtactgtaatgccaagtcaattagtgggcttaatgatggggctttggacacattttttgcaaagagttcgcaaatcagaccaagacaaagctactcaaactaatccagaggtaattctaatgagtgaggatgtgtggggacgggggggggggaaggattttcatccccgttccccgtttttcctatcccaggaaacggggatccccgcacctcattcctaccgtggacgggcatgaaacatactaaaaatgggctcaacaacaataatgaagaaactttttgacgaaatttaagcaaataaaaaaatgggaggaaaatttgtttcaaaatttttcctccggccttatcggcatcccagaaccactaattcctttcgatattcaaaaatg

SEQ ID NO: 109896 - DNA, 239 bp, Heterodera glycines
  Promoter: Source sequence=SeqID_27615; Location=622..860; Strand=-; Gene=SeqID_58295
aattaaatttaaaacagtggcataatccattagcatttgggacctcctctcttttagggtgtaatgctctttctcatttaatcaggctaaaaacaaaaagaacatctgatcagctgccagagaagtgtccccaatgccgtaaaccaatcaaaaccaaacaaaacaaaccttttgaagctgaatttgccgcggatagtcagcccaaggaacgttcgctgttcagtgccgaacttagaatg

SEQ ID NO: 109897 - DNA, 120 bp, Heterodera glycines
  Promoter: Source sequence=SeqID_3152; Location=3734..3853; Strand=-; Gene=SeqID_47541
taaaaaaatgtcccacaatacaaattttattattttgacctgcgtggtttgggtgaacccatccgccttttgcttcactatgttggccaaccgtttgaggacatccgctttaaagacatg

SEQ ID NO: 109898 - DNA, 103 bp, Heterodera glycines
  Promoter: Source sequence=SeqID_12082; Location=1413..1515; Strand=+; Gene=SeqID_75639
gctgaacggattggtggagaatatgggacggatggagtcgcagtggggggacaaaatcacacaaataatggccaaagtgagcgaattgcggcactttgaaatg

SEQ ID NO: 109899 - DNA, 255 bp, Heterodera glycines
  Promoter: Source sequence=SeqID_16532; Location=1416..1670; Strand=-; Gene=SeqID_80936
tgggtcttcaatgggcgtgttcttaacaatacttggctagcagatgaaactcaattagctttaactgacgcaccagggaaatcgacagtgcgtagctgtaatagtactctgaaattaacagaacaaaacttagcctattttattgtaaagaatggtcgtcagaccaaaagaaaaagagcattggatagtcttgttactaattctcaattcgcatcacaattgacttatttggacactgaagtgtctgaaactatg

SEQ ID NO: 109900 - DNA, 371 bp, Heterodera glycines
  Promoter: Source sequence=SeqID_40224; Location=1..371; Strand=+; Gene=SeqID_68625
ccgccgggggaaaaattgagcattttgaccatatttttagcagattttcattaaaaaattctttattttgtggttttttggaaaatttaacaaaaaaccacaaaaagcctcaaaatttctgaaaaaaccacaaaaagcctcaaagcctcattgtgtgtgagagagagtgagaggagagaggaaaaaaatatagaagcgatataataaatttaataattttttttattaaacaatttatgtaaaaaaaaagtccaacattgaccccttgaaaacagcaaaatgatgataaatcagcagaattggcaactctgatttaatatacatatctatttcagttagaccttcaaaacattcaaagcaacactaaaatg

SEQ ID NO: 109901 - DNA, 1003 bp, Heterodera glycines
  Promoter: Source sequence=SeqID_10230; Location=448..1450; Strand=+; Gene=SeqID_73375
tttttaagaagggtttctcccctaatccgggggcagaaattttcgatggcgcataaaattatttatggccgaacagacctgaatcttttctccattccatttttaaaccatcaacacgttttcacattccctttttagatttaacactaaatataaaatgggcaataaattcattccatttgctgggagggcaacaaaattatggaataaactggagaaagaacgaattaaataaattaattaaatcgtttaaaataaaatcatttattaggataataaaacctgaaaacctagaaaatttcataggttatttggtattttttatgctgtagatctcagttggactttgactaatttaaattcattttgcccttatggatgacttgttttttaaatttttggaataaacgataaaaggtttcttgaatttcaaagtttaatattaaatttgttaaacaggagggaaatgatgtgaaaggggtggggttgtgaaattttgttttcgtttcaccattcattgtttgaaattagactttttatgccgtttgaatgatttttaatttttttttacctgggctataattgtcaaatttttttgaattcgggcgccctgctgtttttgaggtatgatttaatattgctatttaattttatttagtttttcgtctataaaattttctacgaaaatcaatgccacatgaatagacaagaaaatcattaaaagctaatattatttcctttcactctccgctcttcatttattcaagacaacattttatttattcaaataaagatgatttgcggatttccgccttttttagcaattttttttggttggcagttttagaaagaagccaaatgaatgctttatgaaataatataaattagcaattaaaatgcaaaattatcgtcattaattgtattttagttaatttattctttttgtaaaaattttttttaaatgccgagaaaattcaattcgctttcagttttattaataatg

SEQ ID NO: 109902 - DNA, 686 bp, Heterodera glycines
  misc_feature (332)..(332): n is a, c, g, or t
  Promoter: Source sequence=SeqID_7922; Location=767..1452; Strand=-; Gene=SeqID_66387
ataattaattaaaattaaactaattcattttatccatcataatccccccctcagatcggagctgtcccccctgcgtgtgccattgcggcatcagtgtttgcggcaacggatttgagccggtccgagtcacacacaaaattatgggcccaaaatgcgcgtgtaattgttcttgtcgatacgaatgtgtataataaataaattaatacaatggaacgaattttcaatgataagctcaaaatggtcttaagttttttatggcattggcaatttttgcagggaaaagccaccatttcgcaacattctcaaaagcgttaattgacaactgaataatngaataatacaatgattaaaataataataattgcattaatttctcttattaatttgttatattaatggtaaataatgaattatttttctttgataataaactccatattttgtgtaaatgcaaaagttttccaaaattaatcctcctttttataccagcgaattttaattaatttttgttccatgactgagtaataagtaaaatgcctacatttttgaagggccgtaaaaattcacatatgtgaaaagaatcagctatttccagtaccaattttattttatttgaagacataaaatgaaacatttctcttctaaatagaaaaaaaattccatttttctgtaattaatgactaatg

SEQ ID NO: 109903 - DNA, 161 bp, Heterodera glycines
  Promoter: Source sequence=SeqID_18246; Location=1..161; Strand=+; Gene=SeqID_82841
taaatttggaaaaattgcatttaatttcggtttctaattgttaggaatttcttcgtgccctcaccacttcttcggcgagctatataattcgacttgtactatttgatgaatcaacggaaattgggccatttgaattggtgaatgaacggaccaacgaaatg

SEQ ID NO: 109904 - DNA, 539 bp, Heterodera glycines
  Promoter: Source sequence=SeqID_1959; Location=207..745; Strand=-; Gene=SeqID_77021
ttttggccccggttgctttttgctcccacagcactttgagctcccacagctattttcgatcagtcattacagtaacattcgttgctgattatgaaaatgcgtcagaaaatagcattagagggaaagtcgtagcgcaattccctctatgttgatcaagacaataatttgcgtcacatttttgctggaatttatacagaaagcagcagcagaaaatccacatcgaaaggataacactcaaattcgtgatctgcgacctcaaaacccttataaattcatttttcgcctttttaaaatctaaaaatcttttcgaaaaaggggctaccaccggtggtactcctactcctacccagaaataatttttgagaaatttaaaccaattaggtaatactttaataagataattttattgaaattagccaatattttttaaaattatatctcagtgacgaaatgaacgtgacggatcagtgacgaaatgataggtaaccattaaaacattaattaataacaaagataaattattcatttaagtgattatg

SEQ ID NO: 109905 - DNA, 312 bp, Heterodera glycines
  Promoter: Source sequence=SeqID_37252; Location=1..312; Strand=+; Gene=SeqID_66362
ttgaagctataatcaatcctcaagaaattaattaaaaattgagcaaattttcaaaaaattattgatcaaatgctttctctttaaattgttcgtttaatgggtttcgctgataaactgaacaaattttgcaaaatttgctgcagcaagattttttagggtttctttgataatgtgaattctttaaattgttcttaatgggttttggcgataaagtgatcaatttttctaattttgtgctttcatgtgattgtgcattggcttgacaattataaaagggttaatttttcttaaaaattatatttttataaaatg

SEQ ID NO: 109906 - DNA, 745 bp, Heterodera glycines
  Promoter: Source sequence=SeqID_23748; Location=86..830; Strand=+; Gene=SeqID_54446
ttttgatatttgcaaatttaaaataaatatataaatattttttttaatttagaaaatgatgcaagcaagacttagcgatgctcgagattcactctcagtctcgagtcacggatttctcagtttcggtctcgattttcgatacccaagacttttttacaccccaaccaatttgtgaattgtattaaatctttttgggtttaactactcctttttcattttttttaattaaataattcgaaatttttcgtttggcgtttcaaacatgaaatctagagcccggacgggaccgggatcccgccgggattttgccggactcccggtcccggcttttttggacaaaccaccgggaccgggagtcccggaaaaacgggagtcccgggatcccgtctcggtccattttccaagtcccggtcccggccattagggccgaaaaaacgggactaaattatacacccctaagaatggtatattcgtggattaaaaggcaaaaatttatacaattttattttttaaacattttgacaaacttttatgtaataaaaaggaaattttgtttttttaaataatattttgtggattggtggttagtgcttcaaaactagctgtattttttgttatgagttcgatacccgttgaagttttcttttaaatttatttttttttctgataatagacaaaaataccagggatggactttcgcgtttcgctttctcatttttttttttagccgtagttttattacatg

SEQ ID NO: 109907 - DNA, 177 bp, Heterodera glycines
  Promoter: Source sequence=SeqID_16053; Location=1..177; Strand=+; Gene=SeqID_80411
ttttttttttttgttgggtgccatttttcccgttcttttttgtgtgtgtaccagggatggcacggaattccgagttccgacatttttggggtcggaattccgacttccgaaaaaatttatgggcctcggaattccatccctggtgtgtaccatgtcgaaattttcaggcacggaatg

SEQ ID NO: 109908 - DNA, 234 bp, Heterodera glycines
  Promoter: Source sequence=SeqID_36428; Location=751..984; Strand=-; Gene=SeqID_65732
tcaagtgacgactttttttgcctctaaaaacgctttttttgcggcgcgtttcttcaaaaaattttgcgagatggacaggtgcgtccagtggcgtcgataggctccgccgggaaaatttttgtaatttttaatgcgatttgttaacagatttttgtccaaaaatgaccaaattttgtgtaaacttatatttcttgataaaatagtgacattctgccataaaatttcaaaattatg

SEQ ID NO: 109909 - DNA, 843 bp, Heterodera glycines
  misc_feature (832)..(833): n is a, c, g, or t
  Promoter: Source sequence=SeqID_17961; Location=1..843; Strand=+; Gene=SeqID_82525
gttctgtccaattcattgaacagctcgaaatttctccattttttactgagttttattggctaaaaatggcaaaaagcatttggcattgccaaaacaaaattgttttttttccactcgtcttgcacaaacggtcgcttaatcggacaatgccccgcccctttggtcatccaaatgacagctgattttgtcattctcataattatttgtctttacatagcacacattttaaggtcctaaatacgtctatggcatttgaatgctcaaatcatttctttgcccccccgttggccattttcagttccttggcccaaataagcggacattccgtatccccagaggattataaacgagtcttccgttaagtttgtgaaacggaagaacacattaggccatcatctttgccatttgtctctctttcgccaaagatcgatggcaccgataaaatttggtgcgagtgaaaagcaaacggccgaaaatggagagaatttttgtgacatttattgggtaatgactggattaaaaaaggctttgtccgatgcggtttcgttctgctccgactgttttgcccactgaattcccctcaaaatgccccccccccaaaaatttgcattgattcgcttttcccgcccatgccaatatttttccggtgcatttcccctgcttaaagaaagggactttgttgtatgctaaaggcacaacgaccccgaaatgccaaatgaatgaatgaatgactatgtaaatcccccccccccgtgggtcaacataaaatgaagaaaatcctttgcaatttcagcgggaaatgcccttgaattagttggccgcttcccttgcnncagggcaatg

SEQ ID NO: 109910 - DNA, 181 bp, Heterodera glycines
  Promoter: Source sequence=SeqID_15333; Location=1785..1965; Strand=-; Gene=SeqID_79576
atgctaagacggatccctttttggccccctttacgggcgaatgggaaagattagattccttttctcccaatttattgaatattaattaatgagtgtcaaagacttgcactttcctcgaggtcccactcgcgccaccgcgacgatgccaataacaacgaaaaacactccgcccacggcgatg

SEQ ID NO: 109911 - DNA, 239 bp, Heterodera glycines
  Promoter: Source sequence=SeqID_21330; Location=740..978; Strand=-; Gene=SeqID_51933
ataaataaaagaaaaatttcgtattcaccaaaagagtttaagtcaaaattgctttcaataaaattcttttgtttcttttttctacgatttgtaataattttacgcttgcttcatttttaattaatttttcttcgtataaaagatgacaaaaaattcattattggaaattaatattaaataccaatgaaaataaaatttttatataactttaataaaaaaaacttttaaaaggcaaaatg

SEQ ID NO: 109912 - DNA, 889 bp, Heterodera glycines
  Promoter: Source sequence=SeqID_33456; Location=1..889; Strand=+; Gene=SeqID_63519
ggggtttttcaatttttccctagttccaaatagtcaaaaaattttttattattttttcggaaataatatctattaatttccataataatattaggtactgtttttctattgttctagttcgttcgtatcagaaattttgtattagaattaattatttcttcttgaaatcttaacaactttttattaccttttagttttccaaaacatcttttttcacgtcgctcttttataaagacttaaggagaaagggtacggcgtccggcggttccgatagtcgccgccgggaaaatttgaaaatttggttagatctgttaacagattttgtccaaaatatgctaaatttttgcgattttgagccaatttttttaataaggtttatgactttttgggccctgtgatgccgataggcagcgctaaattttggaattaagctctatttctaagatttttcatcaaaaaaatttatgaatttcggtaaatttttgtttttcttcgatatgtattttgtcaaaatatgccaagattggtcgatttctatgtgtatttaatttaaaaaaaaacaatttgtcacaaagaaaataattaaagaagaaaacatcaaacggtatcgaactcacgacagaaagtaatgtcaatggcactaacctctacaccacattccaaatgtccgaaattgagcaaatcttctttatttaataaaaatttggcaaatggttaaaaaaaaattcaaatttcgtctaacttttttgcattttctcccacgaaaatgccattcttaggggtgtatatttaaccccgaccccgatcgggagggtcggggttcggggttgtcggggtatgaagcgtcggggttcggggtcggggttttccccgaaaatggccaaaaatg

SEQ ID NO: 109913 - DNA, 675 bp, Heterodera glycines
  Promoter: Source sequence=SeqID_13256; Location=827..1501; Strand=-; Gene=SeqID_77085
acttgaaaaaaaaatcatttttattaaaaatgaataaaataataattttttttgagataaattagtctgatatatgcgaaacacacactgagttttattgatttttaaaagaataatatacaatataataattattattaatttattacaatatgaacaaaaaaaattattattttaattaattttttacagttttgtatgggaaaaacaaactaatttgattttaaaaagtcatttatttaatattttttcaatgaattgcaatttttgtttcattagtatttttgctaagaatttttttgtgatttttccttattggtagcacctcaaagattttcctccccaaaaatctaaaaaattgcgccaaaattgcaaaatttggccatttttagaaatttaataaatcagaacaaattttcaaaattttccccgtcggaactctcgttttgccacaaaaaaattttttttttaaaacactattcattttacataaactattctgcatatttactattgattatattgttgtaatttccgcctacgtgtttaatctacaaaaaataatttataaaaaatatttatttacataattttatatcgtaagaaataaaattgcaaaaaaaaaaaaaaatgaaaaaactaatttttattatatctttattaaatataaatatg

SEQ ID NO: 109914 - DNA, 238 bp, Heterodera glycines
  Promoter: Source sequence=SeqID_5460; Location=827..1064; Strand=-; Gene=SeqID_58136
ttgtaattggttatactttaaaagatggaagtggtcgtgaatgtatgaatataaatttaaatttaaaaataataaataaaatgataattaaaatattaattaataatttaattataaatgtggaggtaaaacagaaaattaattgttgattggtgattaaaaatgagagtttaggaattaatctcatgatcaagcagtgaaaatggtgaaaaatcattgctaagaatgctctaaaatg

SEQ ID NO: 109915 - DNA, 891 bp, Heterodera glycines
  Promoter: Source sequence=SeqID_10462; Location=1855..2745; Strand=+; Gene=SeqID_73666
aaattccaaataaaatttctgggtttttcattgatttgacattaacttaaaggcaaaaaacgccatcgaaatgtgtactgacggattgtgggatggaaaatcggatggattttataaatttagttaatttaaaaaatatatgaattttacattgttttattttctaatttttttaacgggcttcgttacaaatttcaaattgtgttttttttattataaccgaaccaaaaactttttattaaatgcgaaattgttaaaattgcccatatcatcaacaaaaaactttttgtacagcattttttaaacgaatcttttttgtaataattcatacgcaatttattcttgaccttgccctaacggttacaaaaacggatgagaatgataaatgagggcggatgaatgtttatgcaaatgtctcagtcttcattatcacaataataaatctcttcatcgaaaatcctcttgataagcaatgttccttttaccgaaatgtcacagacgtaaaaaaaccataataattccaccgtttcattctgctttttaaacaaataatcattttttccccttttttgacttttctgaattgacatttcgtcgtccttttgtgaatgcgtcaaatgccagctgaattgcacagtcatttctgtattcaaaaagcgacattttaaaatatcagtcaccaattatttggctaaaattaagcattaaaccaacgctttttgaaataaggtttttattctctgaaaattaaatgtttcgctttgttgtttgtgtgctccttctcccggaattcgttcatggtttttacgaccttgaacaaaaagaaagatttggtaaaaatgaaaaagctttttatttttgatttcccttatttcagtgattgacaaaatg

SEQ ID NO: 109916 - DNA, 1003 bp, Heterodera glycines
  Promoter: Source sequence=SeqID_2089; Location=857..1859; Strand=-; Gene=SeqID_77798
tcgacttgcagcttcacaataatctattaaattgccaataatttattatttcttgttcatcaaaagtgaaaaacaaataaaaaggaaattggacaaatttaattgtcttatccgcagatatcggaattgtatatggaatttagaattggataaaccaaatgtgaatgtcttaaaatttggatggcctaatggagtgcgataatttgtaattttaatttagcatgaagcttcttgagcacctttattagtgcaccttttttccctttcccactttctgcggttaattgccactttttgcacttttatgccttttccgacttttttcggcacttttttaaatcccttagaaaattttttataaaaaacgcaccccaataatcaatgctcaaactttgaagatcactcttttttattaaggaatttaattaaacccaatttgaaatttttatgatattccttaattatggatgatagggggccgacagtgccattgggcgccgccgaggaaaatttgaatagaatttgttgaaagatttgtctgaaatgatcaaatttcgcggttatatgtcatttttttaagaaaatgtcgacagaagaaaatttgacaatttttttaccctttttcttaaaaacccaaaattattttctgattttgaaacagctatttttaaatgtattttacaaatatacaaaatgaatatttgtattagcatttgatataatttgttttcctctcccattatccgcacttgaaaatcagcacggtgtgttggttgaccttgaaaagcgcgaatgactccaattcataggacacgcgtgagccgaaactgcgccccacgacacaatgccaagtgccggcgaagcgctgctccattgtgtctttgacgaagctggcaatgtcctgcagggcgggggggggggggcaatttggtaatccaattaatttacaataaatctttttaatgaatttaaaaaaaagaattttagcattttgttccgcatg

SEQ ID NO: 109917 - DNA, 1003 bp, Heterodera glycines
  Promoter: Source sequence=SeqID_17297; Location=178..1180; Strand=-; Gene=SeqID_81773
gatcaagagagtatctgatcattgattagagattggtatcactgatcagagacggataagattaataatatgaccaaaattgaaatattgatcactgattagagaaaaattcgatcgccaatgtgatcaagaggaaacattgatcactgatcagagattggttttcatctcagagactgaattttttgcgtaattaaaatgaaatgccttttggggccttcttttataaatgattgcttcagcagctctcctaatcattgcatttggacaaattttgcgcggtaaaaggccaaaaatgtgcgacatttcacattactaattaactaattaatgatcgctgatcgcccacccattcattccgaaaggactgttggtcaactttttcaatctttattcgtttaacctccttaagtgagactttgatacccctaaaaacaactaaacaactcacgccatcacacaacagcgccggggggaaaatgcaattaactaattaataaattaattaattttgtgttattttcggcgaaatttaggggaaatttttgtgtataaattgttctgcatcgacgatacacattcattcagtatagcataaattcgtcttatttttgcttcaccctactgatcagcgcatctgcaatggcacataacccaaattcaatgccttttttgatcaaattcgttcgacagttcgcaagattagcttacccaatcttggacgcttattttttataagactgaatttgtcaattaagccccagaccctgttatggcatgaaatgttgctcaatctcccaaatgcccgatttttgactctgataaatgtgcattaagccctatcaatcgagtatctctctgcttcgtcgcccaatttattttaaattttcaaatgttgcccaagtcaattgatcagggtcaggcaatgacaactgatcgttgaatgtactgcttgaacttgatcccccgttggttgtagaataatcgtattgttacaaaaatg

SEQ ID NO: 109918 - DNA, 778 bp, Heterodera glycines
  Promoter: Source sequence=SeqID_15745; Location=417..1194; Strand=-; Gene=SeqID_80072
tttaaaattctaaaccaaaaattttacattattttttgtatgtttttaggaaaatgtttacatatacatatttacaccaccacttttttctatttttatttaaaagtacaaatttgtttgtgttatttgtgtccaagtgtccaaatttgccaccatttatacacatttgtgtccagcggcaggcaccaaaagaggaggagtaaacaaatgtgttttgtgaatgaactcttaagtgatttgtcgacagctttaaactgctgctgattaattgaacccaaaatatcccataatcaatcacctcattaaaatttcaaaattatccagtgaactttttgttttcaagggctttttaatgggggaagggggggggcctcgctagaaaaaaaatcgcaaaggaataaatcaatgttttttttttcacatgacttttaaaatgggcactccggcagagccgagaatcgactaccgcgggaaagaattttaatattggcaaaaaatttttttcgaaaatttgccattttctccaaaaaaatttttatatgaagagctggggtacggatgaacttgctgctgctgctgggatggggaaagaggagcacttggaatagaaagatgaagcaatcgaacaatttaagctacccaccaccctcactcactcaatcagcacaagcaaacaaaggaataaaaaagaggcaatcaaacaaaaaaaaattccaaaaaatactctgctaatgaatgtctcgtaaatgtgctacttaccaacccaaattaattaatg

SEQ ID NO: 109919 - DNA, 1003 bp, Heterodera glycines
  Promoter: Source sequence=SeqID_7063; Location=1363..2365; Strand=-; Gene=SeqID_63714
gttgccgatggcgccgtcggaaaaatttttttattttggttctggtttgttaatagattttcaccaaaaaggccaatttttgcaattaatagacaagcattgatttttttgcattaaaaacgtttttttccggcgtgctttttctaggaaattttgggggacggggggaggggtgtcccgggaaaatttttaatgcgatttgttaacaggtttttgtcaaaaaaattaccaaattttgcgcaagccttaatttttaatttatttcaagcgaaaatataaataattaattttttatttggttttttatttttaaaatccaaagttaaagcaaaattaattataatatatttaatcaatatttcaaaccaaatatatttcaattatttcaaacaaataatcattttcggactaaatgatcgaataatattagaattcagtttgcttttcttatcacttttgtgatttgttaacagattttcaacaaaaaggctggtttttgggattactaggctcaatttgtacgagttttctttaaaaaatgacaaaatatgagacaattaaaaattatgaagaatcatattttgtcgatagaaaacccatgattatacaaaaaaataaaaatattttaattactgtagaggaattgaaccatggggaagcagaagggaaagtcaaggagactagccagtaggcctttgcgcacaattggaagtgttacttttaaagaatattaattttaaattttttcctttcattccaattttcttcactaatttttcactcagacccccatgacgatccacattgggtacaaaattcactgctcgcgtaccgcaccacgccgaacgcaagtttaaatggtcgtacgcctgccgaattgttcttagggcggcccgttcgaactgttctatcgttaattaaaccaaattcccaaaaacaaaaacagggacccgtgttaaacgagcagaacagaaaatggcgaaacaattcaacaaacaccatg

SEQ ID NO: 109920 - DNA, 591 bp, Heterodera glycines
  Promoter: Source sequence=SeqID_21074; Location=479..1069; Strand=+; Gene=SeqID_51662
aaggaagggaaggaactgtgctgatactgctccgactccttcgcatttgaacacagtccatttggaacaaatacctatatattttatctcttcattttttatcacgtttatcgatatccggtgattagccaattatacatacatacaatatacatacatagacacaaataatgatcacacaacggttttgatggaatgtgacaaatgggcgaaaatcaacatttatataccaaattaagacgcttcttttccagaaaaagtttcacttttgccaggcaaccaaaaggggccgataaaggaaggcattttccaccagacagcagtctactagagatcatactcataattttgaaactttatggcataatgtcactttgtggcaaaatttggtcattttctggacaaaatttgttaacaaatcacattaaaaattacaatttggcaaaatgcgccgcaaaaaatgaaaaagctgtttttgagcccgattgcttttgatttttaagccctattggcaaaataagcattttaagtttctaagactcgacccttctaagctcctttgttgtcatctataggaggttatttactatg

SEQ ID NO: 109921 - DNA, 338 bp, Heterodera glycines
  Promoter: Source sequence=SeqID_19279; Location=1..338; Strand=+; Gene=SeqID_84025
ttttttgagccaattttaaaccttttttaaaatttttttaaaaaaaaacgaattgaaaaataaattttacccctttaattgggcaaacgaatccccccttttcccataaatagaagaaaaaataaaaattttaatgcaaaatttaacacaaaattgcatgtggtcaaattacccgatagaataggaacattatagttcatggtcgtttgacggaggttggtagtctaaacggcactgaaggtcattttcttatagtacgggtttaccatcaactttgtggtcatttgaccaggtcaaacgcggtcatttaaccattttcttatagtacgggccgaatg

SEQ ID NO: 109922 - DNA, 1003 bp, Heterodera glycines
  misc_feature (423)..(423): n is a, c, g, or t
  Promoter: Source sequence=SeqID_21530; Location=300..1302; Strand=+; Gene=SeqID_52140
catttaagccccattttccggaatttcttccttttgacggcccaaacactgttaattcagtgcctgtcgtcatggaaacttgtcaaaaagttttcgacacgtatttttggtaaaattcaaatgaattttttacggattttacgaattcgcgacagataaaagacagtaaaacacggcgaattacttactgtagacgactttctgtaccaattggtgtaaacaatgggcggctttttaattgtgtaaataaaggtgattaggaaggagaggcaaatgcacagaaattaaaacatttattaaaatttccgccatttttgtccaaaaaaggaattggacaaaacgtcaaaattaaaattccccgccaatttaataatttcggctctaagttcatttctctctctctctgttcgtccttttccacanaactttttgccctccccccccccccatcgatgaattcgaattcaaaggcttcttctcccctcggcactgccattgctttggccaccgccggtgccgtggtgaccattcaaagcgcaatcattgccattctctacaggaaatgtgccaaactgacgcaaattattcacaatttacagaccgaaaattcgaacacttcgcattcgttgaggtaaataattttatattttattccctgaggcaaaaaaaagaaaaagaaaatggctgaaaatttgttttgagtaaaaacggaaattacatttcaattctcaaaattcccttttccaacaaaaaattctttgaaaatagcgtggcaaaagaataaagaataattagggctgccgaagagcaaaaaaaagaaaagaaaaagaaataaagaaaccaccgcctgccaaaaagcatttgccattcccaatttcttatagtcttataattctgacactgactgatctttccaaaaaggaacgaattggtccttttgcgccgcactgtccttttgttggagaggcgaattgcccaaagtgaggccaatcgtaccgaaatg

SEQ ID NO: 109923 - DNA, 1003 bp, Heterodera glycines
  Promoter: Source sequence=SeqID_489; Location=939..1941; Strand=+; Gene=SeqID_54226
tgcaattaatgcaattcttggggctcacataattgtttccttccattaactggttcgtacaaacacgaattgtgataagtgtgagaactttctttcatcttggtaactgctgttgttgttattgttgttggtgtttgcctttgtgtgcacgcgtctgccgctgcttttggcacagcgtggcgttgtgctgctgctcgacttcactgcgtttgtgctgtctgtgtgtgtgcggcgtagtctttctcaaatgaactctcccgacttcctttcgcccttttcccacttttttgtgcctctgtttttctcacacataacacaacgacgcttaaacaaatgtggcgccacatgggaagacccaatctcatcattttcataagagtgcgttgtgttggcacacacatttttcgagaaatgaacaaaggtccccattaaacgggggggggggagagaaaattgcccgaggagtaattagcgcccatttatgtgtaatcgctgggctgatatccttcgcgtatggaattttttgacggcatggaaaaattaacgccttttatgcaaattacttataaccaaatacaatggggggaataatcaacggcgaaaaacaatatgtttaagacgctcaaacaaaaaatttctcacaaaacaaatttaagaactgacgacgatggaaacagggcaaaacagtgaaaatgctgcgacagttgaaaccgccgggaatgatgtggagatgtcaaccgaaggttttgcaattttttttttcttcaatttctcacccgttgattttcaaaaagaaaaaaacataaaaacttgccttggtttgatgtttatcaatcttattaggagccattcaaagtttctgtaattcaatcgcattagatgaaaacttttttcatcatattttcctaaacaaattttgaattgacaaaaaattctttgacccattcaccatttgttcaatgtttttcattccttgcaattagacactgctgttgctgaaatg

SEQ ID NO: 109924 - DNA, 111 bp, Heterodera glycines
  Promoter: Source sequence=SeqID_22963; Location=2265..2375; Strand=-; Gene=SeqID_53662
caactcgacaaatgcaaatttttgcagcccgaacttttgttccttgggcatattgtgtcagcaaacggaattcgtcctgacccgtcgcgttcagacgcaattcggaaaatg

SEQ ID NO: 109925 - DNA, 760 bp, Heterodera glycines
  Promoter: Source sequence=SeqID_4922; Location=1..760; Strand=+; Gene= SeqID_56202
aaataaagagacaattaaaattaataataatttcaaatagaataaattacttcggctcccggaaaatgcgccagtggaaattttattggcataaaaacaactcctttggattttcgaggtcattgatcacgaatccggtaccgatttgtgccaattccggaccccggactcgaattcgaacaaaaattcgaatgtccaaattttcgaatttagcatttattgttcaaaaacggcataaatgatctcttattgaaggattaatggctttcagtttgtttccgtgtatttgaaccttttccaaaatttggactttcgattttttgttcgaattcgtgtccggggttcggaattcagaatggtgttcttacagaattaatttaatattacaataaacagaattttgttttaaaatgtttgtatcgctgacgcattttccggtcactattaattctattcaaaaaataaaacatgaaatattaaaaaagaattaatttaaaaaatataagttttatttgtgtgcattcattaacagactttttggaacggaattcctcacaaatggaaaaaagaggggcgaaatttaattcgctgctataatttattcccaaaacgaatgaatgataatatttcgtatacattatttgctcaattaagtggaaattgagatgaattcaattgcaattttgaaagctttttcccctccacagaaaacgtttgagaaaacaaaattttgtaatttttagcctatgttttttcaatg

SEQ ID NO: 109926 - DNA, 423 bp, Heterodera glycines
  misc_feature (25)..(25): n is a, c, g, or t
  misc_feature (52)..(52): n is a, c, g, or t
  Promoter: Source sequence=SeqID_1409; Location=811..1233; Strand=-; Gene=SeqID_73351
tttgttcatattttggcaagccctnaatgataataaggggaaaaattgtgangggaaattttcattatttttcattgagaattttgtgagttctagcgaaatctcgactcaatacctaaatcccagttccgggctctaaatttcaggcataaatcgacaaaaaagaatccctaaaagcccatatgctttgaatgcgtcaatagaaaatgcgtcagtgagacagtaaatttctaaaaaatacttcgacaaaaaagctaagaattttaaaaacgaaaaaaagcttaaattccttaaatccggaaggtttactacattcttagattttgaaaaattctggtttttttaatcaggtcggagccaccgtctgcgggccttttcctcactattaaaggcagaataaaataatatgtaaaattaaaaatg

SEQ ID NO: 109927 - DNA, 506 bp, Heterodera glycines
  Promoter: Source sequence=SeqID_18654; Location=171..676; Strand=-; Gene=SeqID_83310
gttttcaaaaaaaagcctttaagacgattttttttaaattttttcataaaactgttgaaaattttatttttgtggtgacgttatgtcccacgatgtttcagttgcgacgttttgaagtgtaccgaaatagtggtggcacgtgtcgcccccccccgccctcccgaaatattttttaaaaagtgccaccaacctgaacagcaactgtccggcccgatacagtgccaactgatctgggctcagactgtcccgaaccgagaacagcgcatgttgaggggctggtacggcggtaaactgtgtgacgttgaaattttatgggtattggataaattggccagtttaagtcgctctccaaaaaaaaacccggcgtaagtttttcaagagtacgtggagaaactaacgccctatggtaagcaggaaagatttcagagggtcgaaagctgagagtgtttttgtgcttttcgcgaccagaattgttttgttaatttttctaaattataggtgcaatg

SEQ ID NO: 109928 - DNA, 283 bp, Heterodera glycines
  Promoter: Source sequence=SeqID_37567; Location=733..1015; Strand=-; Gene=SeqID_66607
tcaccagcatgaatggcaaccgcgttttcgtagcggaaataggcaatttagaggaggtaaaaaaacaatttttattaaacttttattgtaaaatgtaatacgatttattttctttttttttctggtcacgtgcgcgcattacaacgcccattttttcgtgtacaccaacgaaccggagcgggttttagcgaaatggggcaaaatggtaaaaaaacttttttacggattttttaaaattatttaattgtatgcgaattttttagtttttgcagcagctgacatg

SEQ ID NO: 109929 - DNA, 1003 bp, Heterodera glycines
  Promoter: Source sequence=SeqID_5852; Location=128..1130; Strand=+; Gene=SeqID_59446
actgatcggacaattggtcgaatcaaaactaattatgatcgggacacgcggtccattccaaaatgggaccatatgatttgattgaatatttgcagcttgagacaaaaagcggggcccgccccgccggtgtttcccccgtccgattaccgtaccgaataaacccccgctgcccatcgccccatttttggggtacggcgcgattatttccccggcgggggacaaaggccccccccactttccccacaattttcgcataaattgctccgcactcggctggaaaaaatggaagagaaactgaaggacaacaataaaaacgaggggaaaaagcgaaatttatgggcaaaaccaaaaacccctcgggcgatggacggacggacgaaagcatccatcggtcagccgttttttgaatcgaatcgcccgaggggaaaagttgtggcggacggacggacggattgatggcggtgggaaatgaacacggattttgaaagggaaaagtgaacggaaaaaatttgggaatggagaatttgagttattgcaattaatttaaagcaattaaaataaaataaattaattaccaattatggtcagtcgctaaaagtccttttaatgtgtaattaattaattttatttaattcataaaaaatataatttaaaatcataagaaaaatattttgattgttcaaatattttattttttgactattcatcgctaggctccaattttagttgctaaaaactgccaaaatagttagttttttaggttttaaaaaacccaaaaaataaaaaaataggtttaaaaaccaaaaattggagcccattcatctctagacatttaacattatataataagagttttatgagtttagccaacaataaaaaaatgaatttaatcgccgcccattaccatcttaattaataactgactcattctcagtctcctcttgctgctttgctctgattagccttatttggcccattttcagaacacttccagcaacagatg

SEQ ID NO: 109930 - DNA, 1003 bp, Heterodera glycines
  Promoter: Source sequence=SeqID_14147; Location=280..1282; Strand=-; Gene=SeqID_78147
ctgcgcaggatcctgcagattttaaatgcaggatttgcaggattaatccggccgggtccggtcctgcaaaaatttttgaattctaatcctgcaacaggatccgcaaatttgaaatttccgggctctagttcagataaacgggtaatacaaaaaataatattaaaatacaaaaattatttttaggcatttaaatattttgagggaaaaacttttaatttttttaaatatgatgaaatatgtgaagtaactgtttaaaaatattcagacacaataatttcttgaaaagaaaacacttaaatacagactaatatatgtatttccttgttgtttttgttgttttggaaatatttgttttcttataaaatcacatgaaaatatgtgcgcaggaaattaataagtctttcactcaataaaaatgtttatcaataccggaaatatgtaaaaaacatatacatattttaaaagcctacaatggaaaagccggaaataaaaatctacttctttttaaattcatatatttaagccttttgaaaattgtgttagtgcctcatttattcatttaaggagctaagaacgttggtaaatttgaacatcgggatttccaatagctaataaggattgcaaaatgggcataaataggcagaaataactttaataacttaaaacaggcacaaaaatatggaaataaatttttcttattatttttatgtatcaaaacagcacacacaaaacttaattttatatctaactatttaataaagataaatcattcaaaactgtttaccaaacgagataacctagagttgccgattacatcaaaatgcatttatagaaaaacgataatcaacattttagtgaaaaggaaacctttacaaaatatatgtataatgtttcataaagtttaaaaatgtatatttagaacaaaaattcatagtcctcttcatgtcagcgaacaatcttcttatcttatcattagacaaaattcaagttctgctggatgatg

SEQ ID NO: 109931 - DNA, 388 bp, Heterodera glycines
  misc_feature (23)..(23): n is a, c, g, or t
  Promoter: Source sequence=SeqID_32489; Location=1393..1780; Strand=-; Gene=SeqID_62794
ctttcatattgtacgattgaacncaatttgttatcttccatatccctaagtgttctctctttccctccccctccctctttctctctcttcctctctctccctctccccctctctctctctctatcgctttttgttcagtttttccccgttactaaggacgacgaccaattgggtgaagaaatgggggggaggggggaagggaatctttagactaatggaagcagcggcaaagggacacaaaaagataaccgatggattaaaccaaatgatcgacattaattaaaaaagggatttaattaataaagggaagaaaagcaaagaaaaatcaacgcagctgtctatatcggtcgctaaactttatgccaaaacattcagaaattcgacgatg

SEQ ID NO: 109932 - DNA, 742 bp, Heterodera glycines
  Promoter: Source sequence=SeqID_7431; Location=2689..3430; Strand=-; Gene=SeqID_64793
aatttttaaatgttttcaattataaaaagttgacgaattaaaagtcattaggcatttttcatttaatttgtttttgcaaaaattaatcaattcgaatcaaagaaagtgccatttctgtcaccttaacaattgtttttgtgccgttctcaattcttttctgattggcattgggcaggccaaacgcattggtccgtctgcgaattgcgcagcattcccggcacacaatcgcacgagcaaaagcagtgcatttgcgtgcaaatttcgggcattgggttgtcgcaggtcggctcgcacccggcgcaacgcaattggccaatttgttcggaagaagagcactgattgaaaatatgagggaatattataataatattgtttattattagtttataaaaaagattggatttagtaggtgaaatgccgcaaaaaatgacaatttttttaaatagattacacataaataaacaaggatattttaaattcaatgattcttaatttatggtcataatattttaagatagcaaaatcattcggaacaattttcatggagcttatttgttttttatgaaacttggtaagccttttttgcttaaacataaaatgctcattaataacaccaattacacttttttctttgcttttttatttattttagttatttaaattgttattaagttttaaaaatcgggccattacattgcatgctccgttttgagcagctaagggcagagcactgaataaaatg

SEQ ID NO: 109933 - DNA, 133 bp, Heterodera glycines
  Promoter: Source sequence=SeqID_40711; Location=656..788; Strand=-; Gene=SeqID_68963
gcaaaaatattaattttaaatttaatttgattaataaaattcaaaaattaccatttaccccaaattaaccagctttttcgctctagaaagctcgataaatttaccgttttacaggtcatcttttggaaaaatg

SEQ ID NO: 109934 - DNA, 822 bp, Heterodera glycines
  Promoter: Source sequence=SeqID_11082; Location=1..822; Strand=+; Gene=SeqID_74416
ccttttgctgcgttacgcccgcctgttcaagacggcgtcagtgcttgtggccaccagtcaacttgtccaagtgattgggattttgtttcttaaaaatcaataaatgccatattttttgaatttttggttgtgccattgctctcagaaatgccaatttcaaccccgcaagatttgcattccgaaattttgcaaacattattttcttgcgtttcggcaacttttcgattcataaagctcctctgatcactaattactcttgatcagttgggatagagcattttctcatattttaagtttgtaagtgccaaaaaaaattttttttgcttaaatccatagggaaaatagcaaaaattgttaagagttatatttttcttggaaaatgcttaattatacttaggaatttttcaattattcacattccttaattaaggaacaaatttttataaagaaaagagttcggctatttttcttatgcaatatttaaattacatggtttttttacaagaaaacattgaataatttttttaaaaataaattttaatagtttcaatgaaattcgaagccacaaattaaaattaaaatgttaatttaatctaaatagaaaaaaaaattgcatggcaattgtaaaattcaaaaaaaaagataatttggatggcagagaggagatttttatcagtaagcagcagttttattactggaaaacgaacgatgtttctgacttacattttatttcataattttaaaaacaaaataatttatttaaaaagaaaatttaaaaataaaatcattttttaattttcaagtttttagaaagtcaaaatg

SEQ ID NO: 109935 - DNA, 1003 bp, Heterodera glycines
  Promoter: Source sequence=SeqID_20627; Location=1136..2138; Strand=-; Gene=SeqID_51178
cctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttttgttttcggggcagtccccccgaaccgatgcgcccaaatttatggggagaccgaatccttccggaatagcttccctatagcctgtactttaattctgcgggggatttttgctccccataattgtttgagtaccccaaacggacacttgaaaaaatcgattttttttgttttcggggcagcccccccgaaccgatgcgcccagatttatggggagaccgaatccttccggaatagcttccctataccctgtactttaattctgcgggggatttttgctccccataattgtttgagtaccccaaacggacacttgaaaaaatcgatttttttgtattcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 109936 - DNA, 190 bp, Heterodera glycines
  Promoter: Source sequence=SeqID_16053; Location=1599..1788; Strand=-; Gene=SeqID_80412
attgtgagctctaataattttcttcgttctttttttagtaatttttctctcggctcttttatggaaaaatttaaaatataggctaaggctgtgccaaaaattgactgccaaagtttttatgaatttaataaaaaaaaatataaattttttgttccactaatttcactccccacttttttggcacagtatg

SEQ ID NO: 109937 - DNA, 69 bp, Heterodera glycines
  Promoter: Source sequence=SeqID_1909; Location=1..69; Strand=+; Gene =SeqID_76710
gccgagaaggcatttttaagcagtttgtttaatttttacaaactttatgaaaaaaagctcttccaaatg

SEQ ID NO: 109938 - DNA, 220 bp, Heterodera glycines
  Promoter: Source sequence=SeqID_15715; Location=1..220; Strand=+; Gene=SeqID_80034
acgtgttttgaataaattttgtaaaaatgaggcttttttgcctgccaaatgaggcttttgaaaattttgatctgggagccctgagtaataatataatttatttgcgttaataaattaaataataaaaatattccaacgataaaaagtttttgtaataaaaaggaatcttgaagtttttacaactatgtcttgacttctatcttttttagatgcaaaaatg

SEQ ID NO: 109939 - DNA, 68 bp, Heterodera glycines; identical to SEQ ID NO: 109495
  Promoter: Source sequence=SeqID_27758; Location=631..698; Strand=-; Gene=SeqID_58427

SEQ ID NO: 109940 - DNA, 113 bp, Heterodera glycines
  Promoter: Source sequence=SeqID_17655; Location=909..1021; Strand=-; Gene=SeqID_82182
tttgactcagttttcaggcgtgtcgtaaaagcgaatgccgccgatgccatcatcagacaaaaaaccactggcacttggcattttctccgccaaaataatttatttaaaaaatg

SEQ ID NO: 109941 - DNA, 446 bp, Heterodera glycines
  Promoter: Source sequence=SeqID_3961; Location=460..905; Strand=+; Gene=SeqID_52589
gaaatggcatttttgaaatgattagaattccattcccgagtgatctgaaagttttcggcgggattagttaacggacaattgtttgggattaatataatggattctctaaagtgattaaagaaagaatgtctttcgaatgattaaaattgattaagtctgatctaaaagatttgaatgatctgaatctaatttcagacaaactgttagaattttgagtgatttgtggaattaaaactttttttattagaatgggtttccgagtgatcggaagcctttttcataaatgatcaattatatagaacacttcttggggtaattaaacagaatttttggatttcggcaatcagaaacactttggttaattaattttttgtttttaattaggctattagcaaacatttaaatcattgccccctttcaaaggcgacgacgggcccgaaccgatg

SEQ ID NO: 109942 - DNA, 938 bp, Heterodera glycines
  Promoter: Source sequence=SeqID_9665; Location=784..1721; Strand=+; Gene=SeqID_72258
tttttcattttttacatttaattcggaaaatctgttgggcgaaaaaggaggaagaaatatgcggataatgatggggcgattttgaaattgatggggctaattagatcaattaatggccaatcactggaaaaagcatggacaaataaaacacgagaacagcagaaggaattgaaattgccaaactatgtttcttcttcttccttcgtccccctgcagatacagcggcgttttggtggcggttgccaaagaaattcatttgttcgtggatcagttgcgcgtggacacaattcgcatggaccaatcaatcgaatggatgcgatacggacgcatgggacgcgaggagggcgttttggtcatcgccacttttggtggggaaatgggcgggggacgggggggggcgaagggtgtgacggacaaaaacatcactcaattaggaggtggtctgtgcgtgaaaatcttccgccgtgtggccaattttgaggagaaccgacagacaatggcacaacgaaaggcgacaaagggcagcatcgaattgccgaaaaagtcgcgcactttcatcgatcagagtctgagggagcggcaaaatgcgcaacttttgcatcaggtggacaaaaaagcggggacgggggggactcatttttgatggattttggcaaatgccgtgtcattcattcattgactgtccgaagcattaatggcaccacttcatgtagatttaccaacgtgattggttcatgatcaaatggcacgcaaccaaaacatttgccgagctgaagtcgggcaaccacggcgcgttgccaaccgccgactcggacgaaccggtccaagtgcagttcgacctgctcggcttcggccccctcttccgtctcaaaattcgcctcgtggcgagcaagtgagagcagaaagggcacaaaagccgaataattggttgaatgatg

SEQ ID NO: 109943 - DNA, 843 bp, Heterodera glycines
  Promoter: Source sequence=SeqID_1817; Location=1..843; Strand=+; Gene= SeqID_76151
aaaagtcagaatttttgcatattttaatttataacttttttacatgtcggtatatctttgtgatttttgggaagctgatagagcttgttaagagctttcgattgatgccaaatttataaaatttggccagctgagaaaaagttacgatgctctaaacttggctcagactataacggccagactatagtgtcccagtccgtttttgtcactcaaatttggcaaaatgtccaaaaatatttcaaaatgtttttttgaccttttcatgacttttttcacattttcggcaaaatttgaattttagtcaagaaaattactaaaaataagtcaatcgtagacagcgagaaaaagatttacctacatcaaaagcattgaaatgcttttgattagcactgggctagcgaaatggataaaagaaagggaacgtgccgggccgaaaatagaacttttcccgagtttgggttcctcgggataattgtgattttccaattccatatttgattgtccaaatcccttaaaataattctccgctttttataatttccatatcctctctttttacttctccattatccatttaacttgatcgatttatttattttaaaaaatggaaaatggttgtgattaaatgtgagaatggaattgtgatttcaatatgaaaatcggtgaaaaataagattacgtaaatgagaaattggtgaaaatggaaatggtccgagttctaagtgttcttttagtgaaaatggccgaaagaggagaatcctgagggacggcccggggaggggagtgggaaagagaaccaaagatgaattttatccgggaatcgaaaggggggggtgggaaatg

SEQ ID NO: 109944 - DNA, 757 bp, Heterodera glycines
  Promoter: Source sequence=SeqID_20165; Location=396..1152; Strand=-; Gene=SeqID_84950
tctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 109945 - DNA, 144 bp, Heterodera glycines
  Promoter: Source sequence=SeqID_44166; Location=950..1093; Strand=-; Gene=SeqID_71697
caacgcggttgggtcaacaagagcacttcaattgaactgaacgcagcgatcgagtaggggtatcgcgtcaacaaagtgttccgcgtgctggagtacgagcagagtgatgatcagctgttccgaccatacattgctgagttcatg

SEQ ID NO: 109946 - DNA, 102 bp, Heterodera glycines
  Promoter: Source sequence=SeqID_34738; Location=1..102; Strand=+; Gene=SeqID_64459
aattggggacaaatcggaattgcattcaaaaatggattaaacaatttgatctacaaaaattcaaattaaaattggagtaagccatggaacaattaaaaaatg

SEQ ID NO: 109947 - DNA, 127 bp, Heterodera glycines
  misc_feature (23)..(23): n is a, c, g, or t
  Promoter: Source sequence=SeqID_38706; Location=1..127; Strand=+; Gene=SeqID_67439
ttcatctccgccgactgtgggcnttgtgtgttcgatctgcttccggcttcacaacttggccttgaattgcgctgatcagccaccgttttgacttttacgtggacgaacacttcaaaactcgcaaatg

SEQ ID NO: 109948 - DNA, 149 bp, Heterodera glycines
  Promoter: Source sequence=SeqID_8601; Location=1..149; Strand=+; Gene= SeqID_68660
agaaagaattttgaaaaactaaaatacattcctcaccatctttcgatctatgataatgccaattttgcctttttaggagttttgatcggcataaaaaagagttagatgaagaaattgaaaagtgccaaagtgatctgttgaaggcaatg

SEQ ID NO: 109949 - DNA, 1003 bp, Heterodera glycines
  Promoter: Source sequence=SeqID_6145; Location=934..1936; Strand=+; Gene=SeqID_60503
actagggcgtattccaacaccaaagggaaaatttagtgagaagaaaaatgaaactcaatttatgaaaatatttaggtatattttatgcacttgagttcgctaagctttatcaaacggttggacgtgaaatttctcgtgataaattccgacatatcatgaaaacagggaaaaaacaacatgaattagcattggttttgatggaaaaggctgggataaatacacaggagaaaacttttgggcttaaacacctcgaatttgtgcaaaacttttgggacaaagaattcccagatatatttcgtatcgttgcgtttgatatggtaaacgaacatttcctaaacttcgtgtgattgttttatttagaaaaccggacttagaccgattttcaaagggaagggagtaagaaaaaacgaagtttgtgtgataagagtgggcgaacattgggatggtttaaaatctgttactcaatttttcgccgtcaaaaatttttgtgtaagctgtgaggtgacattttggaccaaagaccgtcaccgaatggaatgtagggagcgctgcaaaaagtgttgccggatggtggttcgggttcccctgtttggatgtttgtgaggcgatacactgtggagaatgcaatcggaatttctacaacaatgattgtttcgagtctcacaaaaagacagcttgtagggagtacaagaaatgcaacaaatgtggggaaacatatcaaacacgatcaaaacacacgtgcggggagaaattctgtagaatttgcaaagtctatcatccgggtcggcaatgtttcattaaaaaaatcaaactccgacagcagaaagcataccgtattgtggcttatgacctcgagacgacggttgaagggggcgaacacaaaccaaatcttgttagtgccgcgcatacttgtagtgtttgtgtgggagaagagagggaatgcgaaatttgtaatggtccgcggatgatcacttggtctgtagcagatgggtttgaaccgatg

SEQ ID NO: 109950 - DNA, 378 bp, Heterodera glycines
  Promoter: Source sequence=SeqID_39991; Location=352..729; Strand=-; Gene=SeqID_68430
acttggaggaggtgggcggaagaatagccgaaaattttatttaaatttttgcatttttttatacaaattgggcgtggtaaataaaatgaggccaacagaaattgccaaagttgcacgacaaatcattaaaataatactaaactttttgtaaaccatcttataattagcgccgcctttgttacagttcaaaaggcagcgcgccgcacgcgagtcggcacgacgacggaccgttcagtcgtttctcaatgggtacgacgagccgagttgggcccacacacttcaggtttggtggggaacacacagccaacctattcaatacaattttttcattgggtccaaataaaaaagggaaagcgcttttcccctcgtctgaccatg

SEQ ID NO: 109951 - DNA, 205 bp, Heterodera glycines
  Promoter: Source sequence=SeqID_44404; Location=1388..1592; Strand=-; Gene=SeqID_71890
tttttgaggagaatccgggaaaactataggtttttttctctgagggccaactgagtcccggcggctaatttctcacttttgcttgcgtttgatggcccataactttttttctaaaactcgaatcaaaaaatgttcgctgtgagggggctaagttgaagtgttttctaaaaaacaaaaaaaattccaggcctctacctataatatg

SEQ ID NO: 109952 - DNA, 499 bp, Heterodera glycines
  Promoter: Source sequence=SeqID_9515; Location=464..962; Strand=+; Gene=SeqID_71711
ttttaattgcgctaaaaacaaaataaatgcattttaaaaataaaattctaaaaacgccatccgttcctgaggtcagattttcttgaaattttgcataggctcatattttgatctcttctagagaagttttgtttgttatttttcaactcgagaccggctcttgcatttgacaagggaatcacaaatcttttttaaattgtggcaaatttggcgttcagatactaactgaataaaaaataaacttacctaattgggagcccaaattgactcgctttgattaaaaggctttttatcacatcattttcataacttgtccttatttcctttcgtttatgattttatttacagaatgtttaaacctcggattcctctttttctcacaacggacagagtaaatgtacaaagagcacattttgcttttgagagaaaagtaccatcaaaaaaattccttggctatcgtgtttgccatgggaatcaggtgatgtttcagcgaaaaatg

SEQ ID NO: 109953 - DNA, 965 bp, Heterodera glycines
  Promoter: Source sequence=SeqID_6544; Location=1..965; Strand=+; Gene= SeqID_61954
caaatgttttaaaaaaccaaaaaattgttttttcaacaaaataagagaaattgttgtgtacataagttgaataaactatatatatatatatacatatatatatatatatatatatttgcttttttttaaattaataaacagagaaataaatttgatttaaaaaaaacataattttttctccatttatttttcgtaataactaaatatgttaattcatatcttgctcacaaatcaacaatgttttgttgaaaaataataatttgttttcccccaattattttgagcaatttgttgaccgtgggcaaagcgactaaaaatgagagaaatttgggggggggggggtcataacgaaacattactttctcctgctgctgacctacataaattatcataaacaaattattggtttttgggtgtgtggcctattagccgattaattctttacgtttttttcgactcgaaaattcctttttcaaatttccttgagaaagttaaatttgcggcagaaaaaaaaacaacttgcgaattggcacaattcggattatatgaattttattttatgcaagtccataataatttggttttttatgaaacaaaattccaaaaaaaaaaatttaaaaaataaaagcatcttaaatattttcattgccaaaaattgccattaataatcagattttgatttttaaaattgttttaatataaattttgcaatctttaattaaattgttaaaaattaattttttattttaatttattcttttgaatttgttatttttaaatgtgagattgttttttattgctttgacaaaatatttttgcaaaaaccttttttctgtttcatttttgtgcatttcattacaaatttgttgtataaaattaaggaaaaaaactattttattataatgaaaagaatcggccaagaaagtgttaatggcgggcaaaagccaaggaaaagcaagaaaatg

SEQ ID NO: 109954 - DNA, 271 bp, Heterodera glycines
  Promoter: Source sequence=SeqID_11296; Location=3901..4171; Strand=-; Gene=SeqID_74670
gcaaaaatggtgtagagcagaagcttggtgattaatggagaatgcgattttttagttccaaaagtgccaaatttgggattcattttttaagtgctgccaaattcggtataaaatttttaggtgccaaacgtgttcataattgtgcaaaaaaatataattcgataatctaaaagtttagtaatttttttgttgaaaaatatgtaaaaaagttttttatttatagtttttgtatctcacttataaattccaacgcaatcatgattaatatatg

SEQ ID NO: 109955 - DNA, 148 bp, Heterodera glycines
  Promoter: Source sequence=SeqID_20805; Location=1..148; Strand=+; Gene=SeqID_51382
gctttttagcttttctttgttaaccataataaattgattgggattccgattggaaagtggcaaaataaaaatatcaaataaattgttgcattttaacaaaaattaattactaatttttgcaaaaaataaattaaaaaaacaaatcatg

SEQ ID NO: 109956 - DNA, 65 bp, Heterodera glycines
  Promoter: Source sequence=SeqID_16262; Location=2251..2315; Strand=+; Gene=SeqID_80646
tcttaaacacatgtgatttttatgaacaaaaaggaaaagcccactccgtaagacaatagacaatg

SEQ ID NO: 109957 - DNA, 491 bp, Heterodera glycines
  Promoter: Source sequence=SeqID_3502; Location=4436..4926; Strand=-; Gene=SeqID_84936
tgcctgcaattagcgccacctagaagatgtatattaatgtctaattgaaaaaaataaatgctaaagtgcgggagaggaatgtaaaacgttatgaatttatacgaagtcaagttgtccatccagttgtaagtgtattaggctacgagatcgctaaaatgttaatgagcaacaaataaatgagtggatttgaagacggaatgaaaaaatttctatgtgacttcatttctctctactccttcgttaattttactacacactactcgattggtaaaccaatgtacatgtgctgaatgaataagtcgagttaaatacccggaagataaacactaccccttgacaatactcaaagttttggatgatttctttagaaaattcgatattctgttttgcccgtcaaagtgaatggtaggctctgattctctttatttatgaagtgcaccaaaaacaatcaaaaaggcaggatagacgtaaatacatatgcaaacataatg

SEQ ID NO: 109958 - DNA, 74 bp, Heterodera glycines
  Promoter: Source sequence=SeqID_14575; Location=1..74; Strand=+; Gene= SeqID_78649
gtgaagatttaaatctttaatccattaaaatcatcttttaccgttttttgcagtttgttccttagtttccaatg

SEQ ID NO: 109959 - DNA, 276 bp, Heterodera glycines
  Promoter: Source sequence=SeqID_39673; Location=1053..1328; Strand=-; Gene=SeqID_68186
aagtcgacttttgcaaggtgagagaaagcgaatcattcattcattgctaaaataattaattggtcaccgagaagacttttacgatggcaaacaaagagagaatttattttataaaaaattagagactggactgaagaagtctcgagaatagactcgggatgagactaagaccacgaaaacccaaagttttcatctaatcaaaactgagacaatcgagcatttcaggcatctactatatttttgccatgccatttttagacgcgctcgcgtgatatg

SEQ ID NO: 109960 - DNA, 285 bp, Heterodera glycines
  Promoter: Source sequence=SeqID_19226; Location=2655..2939; Strand=-; Gene=SeqID_83967
atcatttttgcccgcacaattgcaaataaaaaacattccccaccaggttgggggtaaaattagtcctttttggtaaattctttttaaagataatttttccatcagttgagtaagtgccatcaagaagcttcgatatccagtaacgaattaatgaagaattcgattttcgatacacgaaataaataaagaaaattttgagagcctataaaaatggcacgaaagttgatttttaggggtgcatttttgaattttttgtgtttttcttagatatttttttcaaaaatg

SEQ ID NO: 109961 - DNA, 218 bp, Heterodera glycines
  Promoter: Source sequence=SeqID_6901; Location=1222..1439; Strand=-; Gene=SeqID_63240
tttgccgggtttttggggtccgtgcctggtttttgccgggtttttgaagttgccgggtttttgccgggtttttgtgttttttccgggtttcctatttcaattcatttatttgaattttattaaacattttgccaaaattgagatccaaatatagttttcgttaattgttccggtttattttattaatttttgatcctcattttctagtctgcagaatg

SEQ ID NO: 109962 - DNA, 186 bp, Heterodera glycines
  misc_feature (84)..(84): n is a, c, g, or t
  Promoter: Source sequence=SeqID_19956; Location=1..186; Strand=+; Gene=SeqID_84721
ctatcgaccaagcacatgaaccaaatgtctgaacctgcggttcctctcgtactaagcaggattactatcatagcaacaggtctntagtagggtaaaactaacctgtctcacgacggtctaaacccagctcacgttccctattggtgggtgaacaatccaacgcttggcgaattctgcttcgcaatg

SEQ ID NO: 109963 - DNA, 461 bp, Heterodera glycines
  Promoter: Source sequence=SeqID_4148; Location=38..498; Strand=+; Gene=SeqID_53373
agagattaggagcacaaacgatggacctaatggtcaagatttggggggtatgaagggaaaaactatggaataagaaaagcgaagcgaaacattcatttgaatgggacaaaaaggaagcgaaaggataggcaaaacgacgaaagaaacagattaaacagcgttttcctttcatttcaacaattactttttgcaattcgttttggtagattccttttaaatttatttttctctcatttttgtcaatttctatttttctccccattttaagcggttgcaatgtgaatgcgttgcgctctgtccgcgattcgccctcctcccgtcaacaacaaaacgcgtcgtcttcgtctcccaccccctccacccccgtggccgagctgtacgcacgcagcaaacagacgccactgcacaccgccgttcagtggggcctcacagaagtggcacgggcactgatcgccaatatg

SEQ ID NO: 109964 - DNA, 511 bp, Heterodera glycines
  Promoter: Source sequence=SeqID_25312; Location=1..511; Strand=+; Gene=SeqID_56061
ggtcccgacttttctggtcccggtcccggtttttgtcaaatttcccggtccgctcaactctagtttattttcaaaaaaattttttgtcatagcaaaaaatttgttaaattttataacaataataattaattttcattacttttgtacaattttcattttatttttttattgttttttcttttttaaaattttcattatttttactcccattttttaatatttgcacaactttaaaaaacagagatatgccaacagaaaaaaaaagttcaaatttttaacggaatcttttggcggaaacgaaccaaaaaattgacatcttccaaactgagcccatcaaatcaataaaaattcactgctaaacaaatgaaaattttttatgtctgccaacactttccgttcatcgaaaatgaaaacggtgcaaaaaatttccgtataaaagggtaattaaattgtcatttctcagcatattaaaaataaaacttttaaatttgaaatttgattatagtaaatg

SEQ ID NO: 109965 - DNA, 173 bp, Heterodera glycines
  Promoter: Source sequence=SeqID_8902; Location=578..750; Strand=-; Gene=SeqID_69578
attgagggttttaatgcatttgttaatgctaaatctgctattgtttgcttaacataaattatggcaatgacattttgttaggtgatcaaaatgcgaagcgtcgtaaattgatggttgagagtgatgatgagtcggtgtgtaattcatgcgacagcgacgccatcgacgcgatg

SEQ ID NO: 109966 - DNA, 136 bp, Heterodera glycines
  Promoter: Source sequence=SeqID_9304; Location=3698..3833; Strand=-; Gene=SeqID_70920
ttaattattattattgaaaaaaatcaccaatggagagagaggtacatgttaaaattttcacctgaatttatttccaaatactttattttattttcatcattataaatatattctgttttttagttaacaaagaatg

SEQ ID NO: 109967 - DNA, 107 bp, Heterodera glycines
  Promoter: Source sequence=SeqID_29316; Location=1325..1431; Strand=-; Gene=SeqID_59822
tggacaaacagcgaaggagcagaacaaacgatcagtttcttcgacagcaggtccgcaacagagacgcactgatcactgcgcttcggcggcagttggagggaaagatg

SEQ ID NO: 109968 - DNA, 721 bp, Heterodera glycines
  Promoter: Source sequence=SeqID_31046; Location=188..908; Strand=-; Gene=SeqID_61416
aaattttttaattagaaataaaattatttagatcatcaaaaattctgatcaaatctttgtcagaaacaacaaaattaagaaagcttgatatcattcagccctaagtgtcctctattagcctgcaaaatttcaaaaaatttggctaagtttcaaaaaagttatggccaaaaatgtgtgaaaacctggttgcttgtgtacttttataaacaatactcaactgccaaacttgaccaaaatttttgtaatttaggtgagcttatagagaacacttaaggctatcaaatcatatcaagaatgttgaatttggttgactgtgacaaaagttatggacagctttatgttgaaaattttcatttgatggttttttatataacgccctttttgatggtttttatataatgactcagcaccgcttcaacataaaattttgcaaatactcaattcccaaataaattttatgtttttttctaaaaaaatttttatggccagagtaactcaaaaaagcatattctcgaatataattttttggaatttggctggataatagagcatattaggctgatcggattatatgaagaattcaaaataaggtttctttttagcaaagttataagcaaaaattttcattttgatggtttttgagtaaagtcataaaaccaaagaaactgctcaaattttcaaattaaaaaaaaattttttttagaggcacggagggaaaatg

SEQ ID NO: 109969 - DNA, 269 bp, Heterodera glycines
  Promoter: Source sequence=SeqID_3127; Location=2302..2570; Strand=-; Gene=SeqID_83320
tctgccacgtcgattcaattgtgtttgtatgctgaccagtgacaggatccttgaagttttttaagtgtttccattaatctaaaagcaattctgacaataaaaaagaaaaaaaaaattttgaaaaaatttgaccaaaaatgtggatacaaacgcaatgagtaccgcattttgaacctatccggcagaaattgagacttcatttgttttaggtcggctacaaattccgctttgaagatcagaccagcgaacggactcgactcgtttacatg

SEQ ID NO: 109970 - DNA, 703 bp, Heterodera glycines
  Promoter: Source sequence=SeqID_13441; Location=1..703; Strand=+; Gene=SeqID_77329
ccgtcacaaataattaaaaataaattgtcaattactttttggtctaagtaggtcagttaatcgatggcatagcaatggggaggggatgtaaaggacaccatcactgggtgcaatgggaacgcgacgccatcgcacaaaacattgcctcccaagcttatagcttacaataataaacatctttttgtattgttcatttttcatttttatccgtaaagatttcccaactcgtgtatatatttattattcatggcggaccaaaatttaccggtcaatgaatgtaattttatttattattttcaacgatctaattttttttctcaaaagggcctcatcacacaaccccaacggaccaacaatatgttttgttctgtgaattaaacaattaaaaaatcatcattttgtctctcattttaatctattccctactctggctgaccttcctttgtgttggtcgtccagagtagggatccttattttctcacaatctttttaagttatggctgaccttttttcatattggttgtcctctcttattaagattgtttcattaatctcataataataataataattttataaaattcactggtatatgatgaaaacgttaggcagacaacaacaacaacgacggaggaaggcgggacgaaaatgggaatgcaagaggaggggaaaaagacggagggaggacaggacgaaccaaatg

SEQ ID NO: 109971 - DNA, 131 bp, Heterodera glycines
  Promoter: Source sequence=SeqID_7326; Location=1..131; Strand=+; Gene= SeqID_64486
tacgacaacgcttccggcaaacgcgcagcagttcctcccgctcctcgtcacgaatgcagcatcatcagcacaacaacgacgaagacaccgaattggaggcgtacacgcccgatctgttgccttccgccatg

SEQ ID NO: 109972 - DNA, 1003 bp, Heterodera glycines
  Promoter: Source sequence=SeqID_14399; Location=221..1223; Strand=-; Gene=SeqID_78436
atagtgaattttcaaattaaaattaaaaaaaaattttttttttcaaaaatgaatactaaaatttgaatttttcaaagattttaactagagtgccacgggaccgagaccgggccgggaattcccggtcatccgaggtcccggtcccggattttgaaaagctcaggtcccggttccggtagggcaaccgggaaccgggaaaaacaagcactggtaagaatgggggtctgagtgaaaaattagtgatgaaaattggagttaaaggaaaaaattaaggaataatctcaaagtaccaagtgtgcaaatggcctagtggctagtctccttgactttccctgcttctttcccctggttcaatccctctacagaaattaaagtattttgaattttctttttgtatactcatggctttcctatcgataaaatatgattcctcatagttttattttaattgacacatttttatcattttttaaatgaaaatcctaccaattaagcttaatagtcccaaaaaccataacaaattacacccaaatttcaaaatttcacccggcggcgcctatcggcaccgccggaccccccttctttcccaaaaattttttgaaaaaccgcgccgaaaaaatgttatgtgaaaagcaaatattaatttataataatatcaatcatttagtccaaaaaatattaattgtttgaaataattaaagaaatttgtttgaaaattttcattaatttaatttagctttaacttttggattttattaaataaaaacaaaataaaaatttaattttgtattattttcacttgaaataaattaaaatttgaattttttaacccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgtcgggtgccgcggggtaagcagtgatg

SEQ ID NO: 109973 - DNA, 648 bp, Heterodera glycines
  Promoter: Source sequence=SeqID_19428; Location=995..1642; Strand=-; Gene=SeqID_84147
gtagcaacaaaatcattgttttcacaaaatgcaattttaatttcgtatttatcctggcattgattttcaagaatttgggcgatgcgaaaaaaactcagttttgggataagaaaaacctaatatttaattatgcgattcactaatttatataataataaaatttaaaaatattttatttactcgatttttttgccattcaaaaatttatatgtgaaatcaataactctgaaacacgtataattttacgctgccacgtaaaggtaaaatcaatgtacatacgatgagtttttatatattcttaacataaaaattaaaaactaaataaaaatttaaaaaatgaataaaattttttttttatttgagtattcgactaccaataattctgcttttgaagaatttataaaaaatcacggggctatagaacttgtcaaaagctatcaaaataaagaaattaagacattaaaaaaacttcatgaacaaatgcagctaaagggtattaagttaagcttttgtacattagaccgttacatgcaaaaactattttcaattatagtatgaaatttcatgccgatccttttgttttttttttgcattttccgcccataattgacaaaagatattcatgcaaaaaaatttagaacaaaaatg

SEQ ID NO: 109974 - DNA, 184 bp, Heterodera glycines
  misc_feature (94)..(94): n is a, c, g, or t
  misc_feature (168)..(168): n is a, c, g, or t
  Promoter: Source sequence=SeqID_30283; Location=1..184; Strand=+; Gene=SeqID_60702
tcagcatcatccgtgtgtgtgcctaaccgctcgaggaggtgctcgttcagcaggtggaccgcacttcgcgacgggaagttaaggacggatattngctgccgcaggatgcgtaccgaaaaggcacggcactttggctttgaaccatcaattctttcccttacggttttnagcgctcgaccgaatg

SEQ ID NO: 109975 - DNA, 798 bp, Heterodera glycines
  Promoter: Source sequence=SeqID_742; Location=1631..2428; Strand=+; Gene=SeqID_60282
tgttagcgtaagttgattatcttaatttaaaataaaaataattttaattattaaacaataaatttatatttttaatctgtcgatatgtaatttttgccttacaattctaatgaatagaaaaaatctttggttatcaaaagtaattaaatcaaaaacgttgttttaatattgttcagaatcttttgttaattaattggcaggtgtaaaatgaaattttgttcttgacatgagattaatctttttaacaaacaggtgcaaatttctctctaaaaagataatcttttaactaaatgagttacttttcagaaaacaaattttatcttttaataaacgatggaaagaagtgacacttaattaattgaaatgaataaaataattgtaattattgggtagccgagtttgaaagtggtatccaaaaacgtcatttttcagaaacatctctgaataaaaaatttgcaatgccatctgaaaacactatattaatataattctatattaggcttttatggccctaatttggttataagaatcatttgaggaatgattaggtctattttcgatcacaaaaataagttgcgaacattgcaataattaaaatttttaaaaaagatcacctcaaaatattaacattcaatgttaaatatatgttatagaggattaaataatataatgatttagtccaatatctcatttatttatcattcattatggatgtttttaaaattttttccatcatttgtgaaaattttctgacaatgatggttattaggtttcgcattttgaatttttagactaatg

SEQ ID NO: 109976 - DNA, 179 bp, Heterodera glycines
  Promoter: Source sequence=SeqID_27073; Location=753..931; Strand=+; Gene=SeqID_57792
tccgcaaatcaattgatatgggcgggcaattaattgcatcactaattcatttatttcatttaacaataatacataaattaataattatgacgtttagtagttttctcattaattagaaaatattacatttattcattaatattttaatgattccatttaaaaagaattactcaaaaatg

SEQ ID NO: 109977 - DNA, 269 bp, Heterodera glycines
  Promoter: Source sequence=SeqID_43827; Location=397..665; Strand=-; Gene=SeqID_71412
aataaaataattaattaatttggaatgtaattaaattataaacgacataaattaattgctttttagtgtgttcttcaaaatgacggaacgctgaagctcagaacatggaataacggaaatgcccgtttatctgtaattaatttgaataaaaaaacaattaaataaatttttaaacaaaaatatagatatagattttaattactttaattatcattctaaggtttgtattgtacgagcgaatacaatggaaattttggattgccaaaatg

SEQ ID NO: 109978 - DNA, 146 bp, Heterodera glycines
  Promoter: Source sequence=SeqID_23232; Location=1..146; Strand=+; Gene=SeqID_53946
taaaaccctgaaaaacttgctcattcacccaataacctcccagtgttcccttttagtgtgtgataattaaacaatgggctgtttctcttcaacccttttgccttttatgttcgccgcctttttggttacgctgatcagcgaacatg

SEQ ID NO: 109979 - DNA, 254 bp, Heterodera glycines
  Promoter: Source sequence=SeqID_9034; Location=1602..1855; Strand=-; Gene=SeqID_70067
atccaggaagccaccttgactgcgccgagactgagctaattcaacatctcggaccgaagccgaccgaaaagcggccactaacagttcaagtttttggagggagaaagcagcggatccgatccgcaacttatcgcttgcgactcaagcggatcgatggcggatgggagagcattgaagtggcggaagtgcctctgatctgcaccccgatcagaacagagctcatcgagtcgggagcagtacccgacagcgacatg

SEQ ID NO: 109980 - DNA, 247 bp, Heterodera glycines
  Promoter: Source sequence=SeqID_5601; Location=1..247; Strand=+; Gene= SeqID_58604
gccgattggcagactggcgatgatgctgctgagaaagcagcccaagcagcagcagatcattgtgtggtgttgagttaacaagttctgtagctgtacatcgcgcacactttcagaaaggcggagaaagtgccctcaggggaaattggggggggggggaggggggcacatagggacggagcgtaagggtgtcacgaccgaaattatatttatttgcaacgcgtaattaattattgtttttagaaaaatg

SEQ ID NO: 109981 - DNA, 57 bp, Heterodera glycines
  Promoter: Source sequence=SeqID_13994; Location=248..304; Strand=-; Gene=SeqID_77962
atatatccatcactcacattgttcctggattcgtgataactagggctataaattatg

SEQ ID NO: 109982 - DNA, 86 bp, Heterodera glycines
  Promoter: Source sequence=SeqID_2270; Location=464..549; Strand=+; Gene=SeqID_78835
ttttaaataaaaaaaatgacaaaattttgccgaaaaaataaactgaattaaattggatttatttttgaagctcttagtttgccatg

SEQ ID NO: 109983 - DNA, 248 bp, Heterodera glycines
  Promoter: Source sequence=SeqID_4498; Location=413..660; Strand=+; Gene=SeqID_45830
gagtccaaagttcgctttggcgtttttttggcctttcttctgcactttccttcttttctgcccatgagaatgaccttttcccctcatatgtaaaagtaatatttttgggtcctatcatttcccccgccgcggttttctaggatatacctatataacgttttacttattcacccaatttttaatttggtatacatattttctcccatctgttcaccaaatctggaattatattttcgttagaaataatg

SEQ ID NO: 109984 - DNA, 247 bp, Heterodera glycines
  misc_feature (75)..(75): n is a, c, g, or t
  Promoter: Source sequence=SeqID_26484; Location=1083..1329; Strand=-; Gene=SeqID_57219
tgggtttcaaaaaatattcgaaacattacgtcaaaaatatgcaggaaaataaaaaaacgaataataatttaaaantaaatgcattaaaatagaaatttttaaatatttatgaaattcaattaaaataattaaggctgcaaaagttgcttcctaaagcgtcataacaaactcaaaacaatttattttatttttttcattaattatggcataaatcaaaatttgcggttcaggtcagtgttctgaaatg

SEQ ID NO: 109985 - DNA, 68 bp, Heterodera glycines
  Promoter: Source sequence=SeqID_30426; Location=1186..1253; Strand=-; Gene=SeqID_60834
ggtaacagcaaactattttactaaagaattattatgaaagtaaactctgtgcccaaaactggagaatg

SEQ ID NO: 109986 - DNA, 147 bp, Heterodera glycines
  Promoter: Source sequence=SeqID_24511; Location=1109..1255; Strand=-; Gene=SeqID_55241
ttttatgttgcacaaaatttgaaaaaagtgaaacaaatacaaaaaatgacgaaactgagacaataaaatttggacaaaaattgttggacgaattctgccaaaattttaaaaaaggacatggaattaattgtacaagcagtaaaaatg

SEQ ID NO: 109987 - DNA, 137 bp, Heterodera glycines
  Promoter: Source sequence=SeqID_2894; Location=4901..5037; Strand=-; Gene=SeqID_82219
atttttggcactttcttttttattttctcctttttcagcttgttatccgaaaatctgaccaaaccccgcgcaactttctcatttgcgttagccgaatttttgcgtttgaaaaatggcaacttttgatcaccgcaatg

SEQ ID NO: 109988 - DNA, 273 bp, Heterodera glycines
  Promoter: Source sequence=SeqID_14861; Location=699..971; Strand=-; Gene=SeqID_79012
ttctcagttcgttctgtttggttttgcctttgggccgcgttcgtcctctttcaagtcgctcattccgtcgtttcccctattcctttggcatttccgttcatttctttcagtcggttttcttccaatcattcgccgcctttctccgagtcgcattttttggctcaaattgacccaatccgtcagtgtccgtctctctcccgcgcattgcttttgcgttgtgtggacccggagcgtaagtaatgaagcaacgaaaatctatcaattgaactaatg

SEQ ID NO: 109989 - DNA, 284 bp, Heterodera glycines; identical to SEQ ID NO: 98949
  Promoter: Source sequence=SeqID_27454; Location=324..607; Strand=+; Gene=SeqID_58149

SEQ ID NO: 109990 - DNA, 269 bp, Heterodera glycines
  Promoter: Source sequence=SeqID_14237; Location=1..269; Strand=+; Gene=SeqID_78254
aaatagatgccatttttcttactaaaataaaaccccgaataataattaacaaaagcttgaaaaccttctaaaaattctacgacgaactttttttcaaattatttaaacaacaagaaactagggccagtcatagttaccaaacccaatccctagcaatgaccattttgagattaaaaatttatcattatcaattaacacaaaatccccaatttttaattgcttttgtttaaaaaaatattttgaatcaatttgtaggaaggcactcaatg

SEQ ID NO: 109991 - DNA, 1003 bp, Heterodera glycines
  Promoter: Source sequence=SeqID_8996; Location=2666..3668; Strand=-; Gene=SeqID_69946
ccgccaaagcggcgtacacaaatgaatgaattgggtgaatggaaatatttcgactgctgctgatgcatacggaaatggagaaaagtgcaaaaggcagccgcttgagcgccttccctcctgtctcatttttttgaaaatttctctccgcatgataaactgtgtgggcgcgttcgtggtggcatttcgggtcagatcggcatcaacaaattaaatttttcttggcattttatttgcggcaattgctagagaccggcgggaacggattcccgcggtatgactcactgccgaaaaattcatatgggattcccattaaaaactgataaattaaagggtgaaagagtgggagcgagagataggccaaaagacaaaaagaaagtgagggagagaaagagagagaagagtaatggcgagtagaccagacgctagacgagagggaaacagtgaaatgaaaatatgacagaatcaaaagagcgagagatgtgaggctaaaatgataaaatgagggattgttattttataaggttctctacgtgttcaaaaatgaggccctaaccgccagggcgccaatgactaggtgtttcttatttaggtaaatgccgaaaattccgatgtgcttgataggcacaattaaatacgaaaaacgcgttttcctttggtttggagtatctacgatgacttttttaatgtatattttttcctattttaaggttttatgcttctttttttgcatatttcccatttttggcgctcggaaaaatccttaaaattagaaattttggtttaaaaattgtccttgttataaaaattttaataatttgttttacaattgaaatataatcaaaattaaattttaagtcttaggtattttactacctaaaaagcattatttaaaagttttatttgcatatctttgtgctatttattgcctatttttcgattttttctttttaggtgcctatttcgcgattttttgtgcctaaaaaggaagacagacctacaaatg

SEQ ID NO: 109992 - DNA, 887 bp, Heterodera glycines
  Promoter: Source sequence=SeqID_9894; Location=131..1017; Strand=+; Gene=SeqID_72922
gatttataattagcaattgaatgaaaaatggatttagctaaaatgtttaattaattaatatttttttaaaatttccatagcaaaaaattggcaaatattgcattccgtttttaaattaaattatagttcattaaaaaattctatatataaatagaaacaataaaattgtaaaatataacttttaaatttattactgttaaaaagagccccaaaaaatgatgaaactgttgttattttttcttcttcctcttttttcttggcataacgttttgggaatttagtagccggaagaagtgatacaactaaaggatatcatttgcatttgccatgataattggccaacctatagatgatgtaaaagcgatagagaattggacatacaatcagatagattatttgcatattttaattacgtgtataaaattgaatacatataaacaggaagcgccaaaaaatattatacatacacataaaaatttattttaataggcattaataaatttattcgataaatatataaaaaatattaaattaataacatcaaaaaatattatacatgtatattatcttttataataggcactaataattttatgcaataattaaattggattaaattattcttgtttatcaatattttaattcaggcaaaaatatgacaaataaattctttattaaaaatttaatttattaattattatttattaataattattatattatttattattaaattaatatcaatcttcctaccatacataatattattattaaggaaggtaaaaaaattaatattcaacaaaacataaaaaatttcccctttaaaaaaatgcataaattaaaaatatttaaatataatgtatttagtatatataccattgccaatg

SEQ ID NO: 109993 - DNA, 65 bp, Heterodera glycines
  Promoter: Source sequence=SeqID_16859; Location=1..65; Strand=+; Gene= SeqID_81286
cgcatttacaggccattaagtaccttgactggcgcgctatagtgaagggctccagatccaacatg

SEQ ID NO: 109994 - DNA, 287 bp, Heterodera glycines
  Promoter: Source sequence=SeqID_26628; Location=1..287; Strand=+; Gene=SeqID_57379
agttcccctccaagtcattattttttcttctaatttttcaaaattattcctttttcaatggaaaattcaaaataaaatttaatatttgttagaattttttcaatttaaatgaagaataaaaaatccatattatgaacattgatttatttaataaaaagggccaaaatttgcaccttttcacatgccggcgacgcctaaaaccaccatatttcttaaaaaattagctcaaaatggaaaatttggacattttttgtaaaaatctgttaataaattgaaaaagaaaaatg

SEQ ID NO: 109995 - DNA, 1003 bp, Heterodera glycines
  Promoter: Source sequence=SeqID_2188; Location=1596..2598; Strand=+; Gene=SeqID_78364
attgccaatgaattgagagttcaattcaataaaatttaccagagaagaagtatttggtaagaaaataataaaaaaattaattatacttattatctcattgagatataattcaaatgaataaaaaacagaaaaatttgaacaatttgaaaatttccacgccaataataaccaagtcttaaaacttatgacggtatttagttttttggagttaggtatattattctacaacatttataaaagagaaagggaaattaacaatcatttttgaatttaaatcaattattcactcattaaaagttaataattatttaataattttcgcgtaaaaaattataagcaacatgttaatataaaaaatcaatactgatgcaattattggtgggggaaaatgaaaaaaatatttttaaaataatttttgtcaaatcataaaattaatatatgcagaaattctaaataatttaattttgaaaatactttgactcaaaaaatgttgaaaattatttttgagattattttcttcttattcattatcgtactaattgatggaattgatgaagatttatttgatgatttgtggaaaaatcttaagccatcaacctcaaaaaaagtttggcacatggcgaactgttgcaaattctctctgagccagtgccaaaaatggaaatttttgcaatttttttttgcggtgtgtaaaattttatttgtgggccaaaactctttcctcaaccgagtaatatttcttaaatttaccatatataaaattttttggaattccataattgtttttcaagggtttactatacggaaacggaaatttacatgtaaatgaaattattttttaatcaattatttacgattaaaaacaagataaattgcaattaatttgataatttctactttatgaaaaaattttttttataaattacataatatatatatatctatctataataaatataagctgaaaacaaaaatcatttgatttttttgactcaaaaaaatg

SEQ ID NO: 109996 - DNA, 171 bp, Heterodera glycines
  Promoter: Source sequence=SeqID_8397; Location=70..240; Strand=+; Gene=SeqID_67919
ttttgcgaaaaataaaatttcctttgaaatgccgaatgtttatttgcttaagcctaatttatagggtcaaattggggagtatagataattatttgcacttcacttgcattttcatcattttctcgaatcgatctcccaattcctttcgaccaaaaaaaaaacaaccaaatg

SEQ ID NO: 109997 - DNA, 812 bp, Heterodera glycines
  Promoter: Source sequence=SeqID_18943; Location=1..812; Strand=+; Gene=SeqID_83667
gtgtggtattagtgactttttgaccctttatttgattgtttgaatttgtttggcataatgtttgatttgaattgacccaaattgtttcgtttttcttcagttgtggttggtggattagttggtcgttggggataatttttaggcgttttgttgattggtcgtcgattgatttttgttttaatttattttgttgttgacttattttaatttaatttggattgtcttttaattatttgttgcataaatttattttgtttggtattggatttttaaagcaggttttgccatttcatagactatttgtgcaagatttagaagtgtggcaaagaaacccccgacaaatttcttcttcttttccaacatggcgctcctggtaacaaaggttagctcagtggcggacggctttatttttcttcagtgaatttctcattttaaaaaaagcgactacctaatttggaaaaaccctcgtgttgggtttatcgactgttttaataccctcgtgttgggttcgtcaactgctcgtcaaattttaaaaccctcgtgttgggtttatcgactttttcaataccctcgtgttgggttcgtcaactgatcgtcaaattttaataccctcgtgttgggttcgtcaactgctcgtcaaattttaataccctcgtgttgggtttttcttcatccgccttatttcgtccacgtttacaaattcgtctaaagcactcgtgttgtgctcgccaaaaaatcttttataaaaagctcgtgttgctttatacatttggattttttgttttatctcgtgttgataagacaaaattatg

SEQ ID NO: 109998 - DNA, 89 bp, Heterodera glycines
  Promoter: Source sequence=SeqID_776; Location=1244..1332; Strand=-; Gene=SeqID_46221
ttagttccagtgaaataaaccctcgcccctcaaaaaataattatttacatttggacacaccaaattcataaataatttagtgcaaaatg

SEQ ID NO: 109999 - DNA, 345 bp, Heterodera glycines
  Promoter: Source sequence=SeqID_9839; Location=890..1234; Strand=-; Gene=SeqID_72859
tacaaaaaaagtacaaataatggcattaaaacgaaaaaccccgccgagaaaacataaaactcattttcgagtatactaacaataagaattttttttgctttcattatttagttatataagaattttacgcaatatcaaaaatgtaggcaaaaaaaggtataaatgaattagataaattaaatcaaaaggtataaaaaaccatcaagtaagaaaaaaagttatgacctaagaaactgaagatgatccctaaagtgcactagagcaactttttatgttaaaatattttagaaaggacatttgcttaatttattttgtttcgccttttcaggcttagtatggccaatg

SEQ ID NO: 110000 - DNA, 562 bp, Heterodera glycines
  Promoter: Source sequence=SeqID_43038; Location=522..1083; Strand=+; Gene=SeqID_70806
attacattaaataatttatttatttttaacacatttatttattattaataaatgaaatgatgttaaaatatttttaaatcatttttttataaaaaataaaaaaatatttaatgaattatatttaatggatttatttattaaaggaggtgtcaattaaataagcataaaatttattagtcaattaaataagcataaaatttattagtcaattaaataagcataaaatttattagtcaattaaataagcataaaatttattagtcaattaaataagcataaaatttattagtcaattaaataagcataaaatttattcgtcaattaaataagcataaaatgtataattatatgaatgcatttattgtttttataatattacggcataattaatatattttttaataattaaattatataaaaaatcgaaattatactaatttattaaaaagcaacaatattttaatgaaaggcaaaaattaaaaataaataaatatttatatgaaaaccattacaaaattcaaaattttttgttagggtgaccttctgttttgtcggcaaaatg

SEQ ID NO: 110001 - DNA, 655 bp, Heterodera glycines
  Promoter: Source sequence=SeqID_12600; Location=1281..1935; Strand=+; Gene=SeqID_76263
aatgatcttattattgacatccacccttcagtttgatcggatttttctttctttgattgggatcggaatggttcgggtattgataaaaaagggaaattctcgatttagcaatttgccctggtcataaaagaattataagtgatcaaaattgggtcccgaggtttgattgaaaagtgctgggttggtggttagacaggcacaacaaatttgccattttcggtctcggctttctaaatatttctcgagtctaaatttcgcggcaagttccggtctcgagtttcaattgatggtatttgttgatttcgagcagtagcacataacattttcctctgttaaattgttttgtactagtcagtcgagaatttataataaatttttccactttcaaaaaagtttatagttaaattcaaaagaatttcaatgattgctttgagacgatggcaactaaatgaatttacattgccggaagtggcaaaaaagtgccaaaatcgaggcaaatataaatgacattgaaaggaaaataataacaatgaaatactattttcattttgctaattttccagttcttaatctccaaattctccataataattttctatttttcggattgtttttcaggggccttcctccccaactgttcaataataacgaaatg

SEQ ID NO: 110002 - DNA, 1003 bp, Heterodera glycines
  Promoter: Source sequence=SeqID_10250; Location=6..1008; Strand=+; Gene=SeqID_73403
aaaaaggggatattctcatcgtcagttcaattggtgggtaaattgtcctggtgcgctgaagggcgtcgaaggattccatattagtaggatagcataaaattttgtgtacgtattttgtgagttgcagttcggcttgttgttcccatgtaagcaagaaagtggcgagaaaaaaatccaaaaacttggtgataatgcacagaaaatgactgctgaagaagtggaacaagtgtgcatttttttgtttgccaaaatgcactgtgacacaaaaaagcattagtaaacgagaaaaggtccgagtcggtggttattcttatgtaagggatcaaccgctacagtgacgaaattattaatcgtcaatacaaatggtcaaaaaaatatttttaaaataataaaattatgaattaattaatttttaggtgtttttgtttgtttttatatatgacttgttttgatggaattaagtcaaaatatgccataattttaaagatcagaacgtaagactcactcaaatatcttttagaaagtgagcaactcaaaaatcgttgtctctgtgcaaacaaaaatacctttccatccctctgctaattgccgtttttcttgtaataatatttggcaacagcgctgacgcctgatggtaaatattcatttgattacagtatgtgaaaacctgctcaatctttgcgacattccatggttacgcggatttacccacaatgaaaattagtagtcaaaagttcacgcaaacattttttttattggagtcttttttaaatgtttttgcattcagattaacactgagtattggtgaatcaagttttgtattttcgtgtaagattttgagtataaatattcattgtggtgcaaagttggagagcagtaaaagggacaagcgtttggatttgtgataataaccaattatttttccctaattatttgtttaaataccttatacataattacataaaacatatttacaatattggtgccttatattttagtaatg

SEQ ID NO: 110003 - DNA, 61 bp, Heterodera glycines
  Promoter: Source sequence=SeqID_21438; Location=566..626; Strand=+; Gene=SeqID_52046
tttctcttagcttctgtaaatttattttagattacttataatatatacccattaaacaatg

SEQ ID NO: 110004 - DNA, 80 bp, Heterodera glycines
  Promoter: Source sequence=SeqID_2004; Location=885..964; Strand=-; Gene=SeqID_77276
gagacttactgaaaacaggaaaatttatatgctaattaacattaaaattgattaattgatcactcacataaataaagatg

SEQ ID NO: 110005 - DNA, 251 bp, Heterodera glycines
  Promoter: Source sequence=SeqID_26047; Location=580..830; Strand=-; Gene=SeqID_45972
gtgagggaaaggcaccaccgaacgcggcaaagagagaagcgccaaaagagtgccctcctaattgatcaattaattaatgtgtgtgttcgttccattgtttttttttgctttttgtacatttattttttacgaaaataaaaagcaacaaattaacaaattgttggcacttttctgctgatttcatttgatttcttttgttaattattttttgtaaacttattttaattcgctgtcttttcccttttcgaatg

SEQ ID NO: 110006 - DNA, 256 bp, Heterodera glycines
  Promoter: Source sequence=SeqID_24578; Location=1282..1537; Strand=-; Gene=SeqID_55306
cgaattaaattcaaattagggagtggagatttgtgcccttgaatcagttcacctcagcatcattgcaccccttttttttattgttttttgttattttttggtgaaacgatttgtggcgaaaatatagtcgaacaaattggtttgcgccaatttatgtatgccatttagtgcgtttttctacccccccccccctcgcctctttccctctttcccctcccctttgctcagtgccattctcccacttttttagttcatg

SEQ ID NO: 110007 - DNA, 1003 bp, Heterodera glycines
  misc_feature (559)..(559): n is a, c, g, or t
  Promoter: Source sequence=SeqID_12139; Location=1223..2225; Strand=+; Gene=SeqID_75712
ttgttgtgggtccttttctctcaaaatggcatcacagaggattaatagcctgcataataaatggccggagattcacccttttctcccctttagctccttttctttctatctccactttgctctctttctctcgtctctctctctcactcactcacttttttctctctcccttagtttctttacattctcttctatgattggccctctcacctttttcttttctctctctctctctcactcactcactcactcactcactcactcactcactcactcactcactcactcactcactcacttttttctctctcccttagtttctttacattctcttctatgattggccctctcacttctttttcttttctctctctctctctctccctttctcacttttcattgcatatgatttttctctgtttctctgctctgtacaaatttctctatgttatttcctctctctctgcctttctttctctgtctctccatgatatgccaaaaaattgtcccttttctctgttattttcattatatgtatattatatgcctcatttccctntaaaaattcttttcctctctttctctgcccccacttttcacacaaaatgcacactctctcctcccacgcataaatagcatacatttggcgcctccggcgctttctctctggcgttggcgttgtgtgcgcgcgcaattatgaaaatttgttttgtgtcgcggaatccgagccggcgtttccgcccgagcaaaaaaactttcttctccaacccaagcactcaaaaagcaaatgagcacacatattatgcaaaaagtgcggtccactcactcacccacttcagtccattcattcgtctctttggatttttttttgtccgtgcaaaatgccaaaaaatgaattatgccaaaatgccattttcagagtgatttcaatgcctgctgccttacattttgaatggcatttttttcttgaaatttgatgccatttaaccattcttaggttatg

SEQ ID NO: 110008 - DNA, 461 bp, Heterodera glycines
  misc_feature (318)..(319): n is a, c, g, or t
  misc_feature (339)..(339): n is a, c, g, or t
  Promoter: Source sequence=SeqID_23427; Location=643..1103; Strand=-; Gene=SeqID_54135
cccaaagctaaaaatttcagccgggcaccaattattagcaaatggccaatttagtaaaatcgattaatatttgttttttatttcaccgatttttcttttttttagatttgcaaaaacggaaaagccaacggaaagtttctgtaatttctgggcagcaattgtttttgacgagcgaaagtttttttctctgagctcgaaaaagtgccggggctttttctcgaattttctttgcccgttgaaaagcaccaaaaattcgcttggccaatatttggcggaactttcaaattattatcattctgcgcgactccacgttcgcgnnagtacaattgcgagggtttngctacggatgaaaaatgaaatgaattttcattgtatcaaaacttcgggccactgaactaccgtaccccccaaccttggaaaactttcgtgtcgaaaaagaatcgaacgattccaacggaatg

SEQ ID NO: 110009 - DNA, 606 bp, Heterodera glycines
  Promoter: Source sequence=SeqID_21345; Location=1036..1641; Strand=-; Gene=SeqID_51947
atttcaacctatttataactccagcctgaattcgaataaagtcgaaaagaatcaaattgtgttatggaccagtgtttgttattttaatgattcttatgaaataaagtaatgcattttttaattttatatcaaaataatgaggtaacctttcaatgaaaaaaatctggcggcgagatagccaaaaaacaaggcgcggcgagttggccgcggcgagttgggcggcggcgagatagcgccgcggcgagttggccacgcggcgagtttctcacggcgagatggccgcggcgagtttgccgcggcgaagtgaccccgaccctatataaatgaggatttaaacaattccacaattacctatatttttgtgtaaatttttcaaaaattgtcttacttagggtgtaacataagtttccgcacaactttttttaaagaatttttttatgaatataaatttagaaaaccacaatcatgatccgaaatatctgacattattattgagaatgagtttgctatttatcgggcaagggataaatcccattaggaaaagtatttaaggagttagagttgataatgtaaaaatggtcattttcgaggtatgtatttttgatg

SEQ ID NO: 110010 - DNA, 76 bp, Heterodera glycines
  Promoter: Source sequence=SeqID_2079; Location=8629..8704; Strand=-; Gene=SeqID_77741
ggtaatttgggactcggttttgtttcttttttcgcaaatttccgagtgcttttttcaggcaattcgggtgggaatg

SEQ ID NO: 110011 - DNA, 1003 bp, Heterodera glycines
  Promoter: Source sequence=SeqID_22780; Location=342..1344; Strand=+; Gene=SeqID_53475
aaaattattagtgaatttattatagctaaaattaattaattaatcaattaatcatctctattcaattaggacactgagaaaaacttttttttttctttatccaacgaaaatcttttttttttataatattaaacttaaaataaatggtttttcttattttctttttggaaattgtgataaattataaatttaaaaatctttgcagggattttaaataaatccgtttaaaaagattttttcttaaatataataaatttttaaatttaaaattattactttaagcactaaaatttgcgctattgcttctttgagtgctgtgaaaaatgtttgttcagtaaatatacaactaagcaagcgcacagttatttttagtaaaaaatttaaaagaaataatctttgatcatgccattttaaaaaaatggaaatttaaaagaatatcgaataaaagatgatatttaaaaaataaaataaatttttaatagttaaaaaagctttgcaaataattaaatttagaaatttagcaatcaaatattgtcaaaatttgatgaattatgttaggaaaacaaaaaaaaacttaaattaaaaattttcttcgaaaataaaatgctatttgtccatttgcactgcaattaaataaacgttaatatatataaatttttctcctgttgatcattaattcattatcttattatcaacgccattttatcatcgagtgtcatctgacggacaaagaatggtcagacgaaaattattatttttacagaaaagaggatcataaaatgatttttaaagattgttacccaccattttgtaaataatcatcatttgtatggaaagcgattacttttacaatttttgttcaaaatcgtgaaaaattttaatttaaaaacaaatcatagttaatgttgatttgaaaatacaaattttattggggcgaggagaatgtaaaagattcgttagttcatttaaaaattatggttgaaaaatccaatccacactgatg

SEQ ID NO: 110012 - DNA, 898 bp, Heterodera glycines
  Promoter: Source sequence=SeqID_4460; Location=1377..2274; Strand=-; Gene=SeqID_54521
ccccccccccaagacccccctcggtaagggaaaaagagaggcggtacccccccccccccaacaagaccaaccagcgccccagagagaaaaagcaatgccaaatttaaattaacgccaaattatcataacgaaagcaacatattaattttaaattccaacgccaaattacaaagaaacattttgctggcggccaggggcggagcaaaagctgtaaaaatagctaaatttcaaaatccattgtgtaaacgatggaaaaaatgctaatttatcgtttcaaatacccccctattttcccagcgtcgctggtatgagcaaaaaaaaaaaaaaacggtcgttcgggcgaaagtttttcaaaaatacacccataagaatcgggcgaagaattttcaaaaatacacccctatgaatcgggcgaaaaattttaaaaaatacacccctaagaattgacttttcggatcggtaccccccccccccccccaagcccaaatcctggatacgtccctgcgcagaccccaaaaaaaaaatccgagaaatttctccacttgagatcgggaatattgagcagccatctcgactaaaatttttttttaatttgcagtttctgtttttcaacccgtaattactatgtcaaaaaaggcaaaaaattataatttttatggaacgaaaatttcttccaaaataattactttgttttttctcataaattacgatcatttatgccatggaaatgtttcagttaaaaaaaaaagttcaatgggtattattacaaaatccaaattgaatttttcattaaattcaattaaattaaataaatcatccatcctcaatcacacaggatgagtcggcggtggacagttcgccatggcccgaagtgtccacaaaagagacaacgccaatg

SEQ ID NO: 110013 - DNA, 245 bp, Heterodera glycines
  Promoter: Source sequence=SeqID_13274; Location=1..245; Strand=+; Gene=SeqID_77107
tctattatttttgcaaaagaaacataaaacaattgcaaactgataagggggcctgtggttttttcatcgggtccataaaactgcgaatgtcctaaaattgttctggaacattcggctttatcaaaaaagccaagatctgctagccggtgaaaaaagctaaattaactcaatcatttcatgaatcacaaagtgattttccattcttctagactcaagccaatttcttactcattttcattctaatg

SEQ ID NO: 110014 - DNA, 296 bp, Heterodera glycines
  Promoter: Source sequence=SeqID_5495; Location=1..296; Strand=+; Gene= SeqID_58251
tcactgacgaaatcatccactgtcgaatgtatttgaaagtaaataggcatttaaatatttaagttttttgcggtgagaaatagttaaattttatatactagtattatggtgcttaagccaatttttgaataaaataaattctcagctattaaaagtacccaaagaaaattgagcctgaaatatatgtagtcactgacgaaaatcactgacgaaaatattaaccacgttcaaatcacttattttctttagaaatatttctgtttttcaaataatccaacgaaaatccgcgtaaaatg

SEQ ID NO: 110015 - DNA, 1003 bp, Heterodera glycines
  Promoter: Source sequence=SeqID_12023; Location=2016..3018; Strand=-; Gene=SeqID_75548
aaaaactgctataaaatttcggttttcgatttttaacttgtaagcaaattaacgatatgttttttgtaattatttaagacagaaaccccaaaaaattttttaaaataaatttatggttaattttccaataataataataaagtgccgaggacttgtcttttaatagccaaacgctaattacccccctcttccacccgcgggcgatcggcgcaattcgatcaattcaatccatcaatcggtgcgaagtgcgtagcctcctcccccctcccaatttgggtatttaacacaaatttggtccaacgtaattagcgggtggcgccgcatttattgtttgtaatgcaacgccaattggtacggcgaaacagcgcaaaacgcaaacaaatcgaacaaactttggcagagcgatcagccaaccatcgaagactacaacaaatcaacggacgacgatcagcagagaatcagcagatcagcggaatcagcatgagaagaaggatgacgcgggggggggggagagaatgctcaagaaatgtgattgagtcattaagtataattatgttataaagttagtaatttatacgccaaaacattcccacccaacgaaattcttaagaaagacttacttatttattattccaaaatcttaatatttgcttcattaattagttttatgcctctgattttcttaaacttccattaatttactctttcttttctctgctaatttgcccccttctcttcttcattttcattattatttttgtctctttttaaattgcgcttttctttgaattgctttcttttcgcttttccttctttaaatattcctgacgttagcctttcttttttttgtttactctccgataactttctccaaataatttaaaaaattccctctcaattagtctccaaatttaatcagatttttctgcaaaatttttattttatgtccacaaattcgaattcatccgaaaatgaaacagccaaagagaaattttgcagaatg

SEQ ID NO: 110016 - DNA, 1003 bp, Heterodera glycines
  Promoter: Source sequence=SeqID_13878; Location=1226..2228; Strand=-; Gene=SeqID_77823
caagcttaagcctctgaataatttttgttaatgttatgagcagttaattttttattttagttttgtaattcaatatttccataaatatttgactttttttaaattgttctttttttacaaagattttataggttttcaattaaattttggcattttttaaaatgaatcaagatttttaaattttgctcattttgggcgaaattttgaattattttctctcaaaatttttccatttgatggcttttttgactaaatgaaatgacgacaatttatcatatttttatcacgccatagttgccataggctcagtcttaaatgtgttgccattcgacacttttggttttggatatggacaaaaaatcgcgaaatatggacataaaatggcaaaaatatggacataaattttccaaattgatgggtaaatcttccaaattttcttcaaattaattaaattttattaaaatacatataaaaatggctaatgtggtattaaaaatcattttagaatattaaagctaaaatttattaattttaagcaaaaaatcaacaggaaaagcaaaatttttgtatttttgtttaattttgacataaatttattaatttttaagaaaatttaaatttattcagtattctcgagaaaatttggcgaaaaatgatttttttggaaaattttcctgtttttgggctcaaaaaggccaatttagctgccgggggccgttttaatagaggttttttagaaaaatgcaaaatatgtacaaatgtggatatagaaatccatcctggaagcttctaatcaagctaaaaacatgtttttcgtgtgtttcaggcctcccacagtccaggaaaaaatacggatttccatataattctccgccctagtcattatggctgatataaacaattgaacggtaattagcatattaatttgtaattattattatattttatttaattaaatatatttttaatgatttaatattaattattttaggttcactcaatg

SEQ ID NO: 110017 - DNA, 179 bp, Heterodera glycines
  Promoter: Source sequence=SeqID_26597; Location=1216..1394; Strand=-; Gene=SeqID_57333
ggggggtctttctcatcaaatgacaacgtcgggaccaacgccgtgagcaattggaggcgcattacaaaatttcgtgaattgctgaccaaagggtcaaggaaaaggttttgcttagaatttttaatatttttctgattccttctcagattgtccgatggagttattatttgccggctatg

SEQ ID NO: 110018 - DNA, 165 bp, Heterodera glycines
  misc_feature (38)..(38): n is a, c, g, or t
  Promoter: Source sequence=SeqID_10493; Location=1..165; Strand=+; Gene=SeqID_73706
aaaaggcttaagcatcgtgcacagaaaagaaaagaatncctgcaaagcaaaaggttggttttgctttccctcccctccccctcaactcataattagcattattagactcatttccgtgtttaaatttaagacggaggggtcgtattaccatcgaagtggacaatg

SEQ ID NO: 110019 - DNA, 753 bp, Heterodera glycines
  Promoter: Source sequence=SeqID_22975; Location=1636..2388; Strand=-; Gene=SeqID_53674
agatcttttaaccaatttaacatttttaaatattattttttaatatatatattaaaaaaataacttagttataacacacctatatagttagaaatagaagcctcactgaatcatgaattttcaggtcaaacgtattgcacataaacacactgaactttcggaagcggtcgaacacatcaacaaactgtctgtccaactggaacaacgggctttgcagacagtgtaaattgcaactttaaataaattagaaagaagggttaatttttgccaatccattgaaatttccaaaaaattttcccggcgtcgcctatcggcatcaccggactctatagaatcattatttaataaaaaaaattagacccaaaaatggcaaaacaatgtatttttttggtgcgagaaattactgtttttcgttcaaggctcaaaattttggaaaaaagtccggaaaacttgttcctgaaaaaaaaattgtttggcccggagagtaaaatttttttttttgaaaacatgaacccaaaaatgcaaaatttgtgctttttcgggcaaaaccgctactatttcctgctttttggctccgtccagcgttgaagaaaaataacactggtgcaaaaaaaaaatttggcccgaagagcaaaaaaaaagctcctcgaaactttttcctggatacgagtctgctaacaatagtataataattgttgcgttcattcatttaggccgagttccgctgctgtcgagcgggagaagggcgacatg

SEQ ID NO: 110020 - DNA, 165 bp, Heterodera glycines
  misc_feature (60)..(60): n is a, c, g, or t
  Promoter: Source sequence=SeqID_34434; Location=480..644; Strand=-; Gene=SeqID_64232
cgaaagtgccaaaatcaaaatgaccaatagggaaaattcaaatgaaaaaaaaaattttgngcaaagaaattgagaaaagacaacttttatggtctaatcaacttttatgagcccaatcaatttcttaagtattattaattttttgtgggatttgttaataagatg

SEQ ID NO: 110021 - DNA, 146 bp, Heterodera glycines
  Promoter: Source sequence=SeqID_13531; Location=919..1064; Strand=-; Gene=SeqID_77429
ggttggacggggagggcggggggtagtcgagagtcttgaatctgattacattgatcagttttgagtcggataaataaatgctttaacgcgccattgaattctcaatcccatttctaatactttcagctttatgtacactaacaatg

SEQ ID NO: 110022 - DNA, 1003 bp, Heterodera glycines
  Promoter: Source sequence=SeqID_5884; Location=3334..4336; Strand=-; Gene=SeqID_59550
ctattttagtggctaacttccaaaataagcatttctcgtcgaaataaagccgcagaaaaaatagttaaaaacctaaaaatactccctacttatgactttgttagagttgtgtttaaaaagcgaataggtataatgttcctgatttcatttgttttcctcgatccatattttttttcactaaactaatgtttttttatttaaaaatgcctgaatctacgggccgcccatgcccgatctgttgcctattcccgacgactacaaatcgaatcgtgaaaatgcaaatggtaaagcagcttgggattcatttgggtttttggtaaagggttatgaaattaagagcgattttatttaaaggagggggagactcaaaaaaaaataataattcagtggtcaaaaaacaggaaaagtaccttaattattaaaacctacgggattttatgggttttaataatagaaaatctactaagaatttagccattaatgcatattttcccttttaattccgagttgagcgcatttgttttttttcaaaaggaatgactgaaattgccgacgacgatttgcctgggccggggccgacgcccgccgactatgcttcttcgcgcactccaaattctgaacaaaagaaaccgaaaaagaagtcaaagaagaagggaggattcctcaactggctcaaatcagtcttctgctacttttagtccgatttgatagacgttgttaggtctgagcaaaaagctcattattgttgcactgtgttgttgtgaataaaacagattaaaaaatagacatccgaagaaattgatttattgtttgttgaacaatttggtcaccaccatgagtggttggtactcctctagtttgtatccacattttgggtcaaattttttcaaaaatttttttttctttttttattgtcgcaattgctttaaataacaaataaaaggagatttatgtgcttattgggtacaattccgcgatttgggtccacaaaatataaaaaatg

SEQ ID NO: 110023 - DNA, 1003 bp, Heterodera glycines
  Promoter: Source sequence=SeqID_14166; Location=566..1568; Strand=+; Gene=SeqID_78170
tttcaacttcgtttgttgttaaaatgcccggatgaactgtaaatatggaaaggctggtgaatataataattttataaaatagtccgaaaaagattcggacttatttaaaaataaatttgtaacatttttaaattaaaaaaaatttactgcattccacattgaaatttcttcacggatttgcaattcgtcgcgttccaaaatttcgcacaacattttttggtcaatttgcaaaaatccatccgatttgatcaaagtgtcggcattttcgtcaatgtaaaataaacaatggcaggcaaaattctaaatttgaatgaaaataaagtattaaaaaaaattggctcttgattgagaataaaaataagtgaaaaaaggaacattatggaaaaaaatcgatgcgataatttccgcttttaaacacaatttagaaatatcaagttaaattgagagaagtttttctctcaaatttccttactatttttctcttctctgcccgccgctaaaaatggtagcagcgacgagtcagagaagagaaaatagtaaggaaattgaagagaaaattttatttttttattcaaaacaatttagtgattaaaggaggtacaaaagtgattaaaagaggtacaacagtgattaaatttgaacaaaagttgaggccgagttgggatgggcaaaatgggaaaatgtccattcaaaatttcattacatacaatgatgaaatgttaaaaaaaaattactaaaaaagccaaaaaatgattatggatatttttaaataaaaacatttttttgcaaaagaaaaaaacaaaggcattgatgaatttaatagatacttgtctcagcaaaaaaaaatttgcggcttcagaattataaacagaaataggaaaaatggttgatttatgaaaaagatttaatatgaattcaagcactttaatttaaaattgttgaaaaattatttttaatttatgtttgtttaaaaacaccagtgattataaaatgtacaacaatg

SEQ ID NO: 110024 - DNA, 106 bp, Heterodera glycines
  Promoter: Source sequence=SeqID_22619; Location=773..878; Strand=-; Gene=SeqID_53294
ttatcaacaaattttaaaggctgtgatgcttgcggccagtgcggcagcggggggtacggtagcggggcgattataatcactaccggaggcggtggatacggatatg

SEQ ID NO: 110025 - DNA, 632 bp, Heterodera glycines
  Promoter: Source sequence=SeqID_18261; Location=1..632; Strand=+; Gene=SeqID_82857
cctatttctggggccaatttcggttttgggagttttttgagcttggtacaacctccgccccacctcctctaccgtatctgcccatttttgccttccgaatttaaattataattatttaaaaaaataaaaataaattttagaaggaaaaatggaattaacaatttttgttttgaaatatttagaatttgaacaaaattttatatttttaacatctttttatttccgtatttttaacatttctttatttttatcaatatttcaacattttcacaaaaaaaaatatatgaaaaaacaccccactaaaggtcaaaaatttcagttactctcttagagatggaaaattctgaaaaagaattcgaaattgtcgaaaattttcttgttaaaatataaacaaattttatttgaaaattacttttttttagtttctaaaaattaatggtttaattttttcaataattgaaattttttttgtccatatttctgaaatttttcggcaattttaaattaatttttgtttttgtttttgtccattaccggtgtctccattaatttctaaagaatttttaaaaaattggcacggatcagatgttacaaaatccccccccccccctcgcagtgccatcctgaacatg

SEQ ID NO: 110026 - DNA, 1003 bp, Heterodera glycines
  Promoter: Source sequence=SeqID_5812; Location=384..1386; Strand=+; Gene=SeqID_59309
aagaactgagaccactataatttttttattttcaaatttttgctatataatttttaggctaatctttgtcataaaattctttttttttgttgagtgtttgtcgtacattatagtaataaatttatactgtgggtgtattatactgtagggcgtttgcaattataattgtttagtgtaatctagggttaagccccgaccccgagccccccgaccccgacccccgacatttttgggacctattccccgacccgacccccgacatgtcgccccccgaggttcccggcccccgactttttgccccccgaccccccgacactaattcgggggattggggactccgagcgttttaaaaatttaaaagttatgcaaccaaaacatttaaattttacctatcactaagccaaaataaaagtttttttctcactcttttagaaaaattaataatatataatttgccaaattaaactttgcacagatttacaattttccaggaaatttaatagattttcacccaattgattacttttaatggcttcaaaagcatctgatatttggaattttttcacgaaaatttcttcagaggttgctaagtgccggctttgtgaaaaccaattagcgtgtaagaaatcgtgcacaaaaggattgtgggggcattttaaagcgaaacacgctaaagaatttgaaaactatttgcaaaaatccgacccgtcaacggtaatacaagcttccttttttattgaatataaaaaaattcagaaaaaccaaggcattacaaaattttttggcaatgaagacccacaaaaaaaggcggatgaacaaattgcaaggctgatgataagaacgaattgctcttttttatttgttgaggcaccggaattacagaatttgttctctttggcctacccgaaactccaagtaatatttttcacccatttttactattgtcatattttttaagcttcgccgaaaagattattttcggaggaatgtaattcccaaaatg

SEQ ID NO: 110027 - DNA, 59 bp, Heterodera glycines
  Promoter: Source sequence=SeqID_27221; Location=620..678; Strand=-; Gene=SeqID_57905
attacaatttaatttagcctaacattggcaatgccaacgaaggagaggaggagaaaatg

SEQ ID NO: 110028 - DNA, 590 bp, Heterodera glycines
  Promoter: Source sequence=SeqID_26105; Location=1232..1821; Strand=+; Gene=SeqID_56853
ttttaaaggctaaagattattacaaagtattcagtaaaagttgaagaaaaagcaaataaaaataaaataaaaatgttataacaaatatgagcatgccaaaataataataaactgaagaattcgttataaaaatttaattttcaaatatatccaattcttaggcaaagagtgggacttcgatgagtaatttattttgctttccatttgtgtgtatattttttgatcagttgatttttaaattttgatgcattttacttttctaaaagcgccaataatttttatcttcttttaacaaaaagaatatttaaaattggtttatcatttgctaaaaaatgattaagaaaaagtgccattttatgcgttccattttgtcattcgttatattattgattaagcaccacaaaagaaggggataattagccccgggctatgccccgtaattgcccactgcagtggagttaattattctggttaattaacttttaactttacataacataatatacagattgaacaattccgtttttacatacacatattcctttagattattatatttttttgaaatataattttttggccataaaatg

SEQ ID NO: 110029 - DNA, 657 bp, Heterodera glycines
  Promoter: Source sequence=SeqID_6310; Location=108..764; Strand=+; Gene=SeqID_61104
tttgcggcccgacatttgcgtcccggacatttgcggccccatttcttaagggccattttcggacatttgcggcccaattttttgctgaattttgcggcccaagccaaaatcggacatttgcggctttgccctactttcttcatcataatatttaactttttcaatacatcaattaacacacaaaattcttttattttctaatgatttgctcaatgtttaacggtcttacattttcatccaaatttttaaaatcgaaattcaaaaaaacaataaaccaactgtgcataattattttcccctattatccaattaacccaaataagtatcgcctcgcagaggggcttcatgaatggggtgaaatatgaaaaaatgatgctcgttgggccttgagcaagccattggaaatataagaaatttatgtgtgttaattggataataggggaaataattatgtacagttggtttattgtttttttttgaatttcgattctaaaaaattggataatgaataggttacacgaagccgcaaatgtcgggccgcaaatgtccgaaaatggcccttaagaaatgggccgcaaatgtccgggacgcaaatgtccgattttggcttgggccgcaaaattcagcaaaaaattgggccgcaaatgtccgaaaatg

SEQ ID NO: 110030 - DNA, 203 bp, Heterodera glycines
  misc_feature (23)..(23): n is a, c, g, or t
  misc_feature (28)..(28): n is a, c, g, or t
  misc_feature (48)..(48): n is a, c, g, or t
  Promoter: Source sequence=SeqID_39830; Location=836..1038; Strand=-; Gene=SeqID_68313
tcaattcttaaagttttcttttntaganaatcatatgtgaattttatntaaacgagttttttatttctaatgtaattttttcttttcatgtaaaatctaaagttgtttagaattatttattcaaactacctaatacaaagaatagattaaaataaatgtttttaaattttttaaaaattttattataaaggaaccattaaatg

SEQ ID NO: 110031 - DNA, 189 bp, Heterodera glycines
  Promoter: Source sequence=SeqID_44243; Location=1..189; Strand=+; Gene=SeqID_71752
gaaattcgatgaatgaactttcgatcaacgaagacctccccagaaaagtgaactattaattttacaaaattaattatttatatttaattaaaaattcaaccaattaagaaaggctcatcaacttcagcttcacatccctctgatttgtccaccaatttgacaattcatgttgatgaacagtcacaaatg

SEQ ID NO: 110032 - DNA, 256 bp, Heterodera glycines
  Promoter: Source sequence=SeqID_17670; Location=1..256; Strand=+; Gene=SeqID_82199
tatatgagaaatgtttttacgacagatgttcagaaaaactattaattaaaggaagtgaaagcagacagagaacatttcccatgcgttttgggcgacattaaaagtctgaaaatttttggtctttgaacatttatctgtttggatgaagcggcttttgccaaattaattttatacggaacaaattttgcattcggtttaattacccaagtttgagatcgcaaaaaacaacaaatttctttcctaattaatcgaaatg

SEQ ID NO: 110033 - DNA, 1003 bp, Heterodera glycines
  Promoter: Source sequence=SeqID_22780; Location=326..1328; Strand=-; Gene=SeqID_53476
atttttcaaccataatttttaaatgaactaacgaatcttttacattctcctcgccccaataaaatttgtattttcaaatcaacattaactatgatttgtttttaaattaaaatttttcacgattttgaacaaaaattgtaaaagtaatcgctttccatacaaatgatgattatttacaaaatggtgggtaacaatctttaaaaatcattttatgatcctcttttctgtaaaaataataattttcgtctgaccattctttgtccgtcagatgacactcgatgataaaatggcgttgataataagataatgaattaatgatcaacaggagaaaaatttatatatattaacgtttatttaattgcagtgcaaatggacaaatagcattttattttcgaagaaaatttttaatttaagtttttttttgttttcctaacataattcatcaaattttgacaatatttgattgctaaatttctaaatttaattatttgcaaagcttttttaactattaaaaatttattttattttttaaatatcatcttttattcgatattcttttaaatttccatttttttaaaatggcatgatcaaagattatttcttttaaattttttactaaaaataactgtgcgcttgcttagttgtatatttactgaacaaacatttttcacagcactcaaagaagcaatagcgcaaattttagtgcttaaagtaataattttaaatttaaaaatttattatatttaagaaaaaatctttttaaacggatttatttaaaatccctgcaaagatttttaaatttataatttatcacaatttccaaaaagaaaataagaaaaaccatttattttaagtttaatattataaaaaaaaaagattttcgttggataaagaaaaaaaaaagtttttctcagtgtcctaattgaatagagatgattaattgattaattaattaattttagctataataaattcactaataattttttgaactcctcccatg

SEQ ID NO: 110034 - DNA, 985 bp, Heterodera glycines
  Promoter: Source sequence=SeqID_25004; Location=1213..2197; Strand=-; Gene=SeqID_55741
aaaagagttatacatgaaaattgcaaaaaaaaaaaaatcggaaattttgaaattttttcttaataaattttttacaggcaagaaaatctttccgcgttttgtagggctaatagagctcttaaaaagctatcgaatgttacaacaatgttggattttgttgacaaacaaaaaaaaagatatagaggaaaaacattctggggcccaaacgtggaggcccaactgacagagtccgcataattagtagaaaggcttttttattagggaaaaatgttgatgattttgtaactccgttaatttcttgaaaacgacttgaaattttacagaaaaacattgacatatggactaagtacaaagtcaagattgccatccgtcctttgttccaaggacgtcctttgtttcttcggctttcaattcggaatttttccgatggacactcttctggtttaaaagtgtggtatttaactttccgaccaaagatgactgacgaaaatggaatatgtcacattaatttgtaagcatgaaaatgagacaaatcagcggagcttaaagtacatgttaagagctgatgaaacttggcttcttctgttttttgacaacaaaacaaaaaagaaagaaagaaagaaaatgattcacataatgatactgtacattttacgatgacacctctttaatttaagaaaggctaaaatctgactccatagaatgttttattaagctgttttaaatcttgtccaaattacaaatattaagcaaattaaaaaatatggatactatattgatctgctgtaagttcccggcattttcaattgttatgctttaacttcccaatcttagaattcgttttttggaaaaaacaatttcacagatcgatttggcctcttaaacattttttcaccgtcctattttggcaaaagacataataattgatgaattggaaaatattctcattaattgcgtgacaattgagaaaccgaatagaaaaatg

SEQ ID NO: 110035 - DNA, 53 bp, Heterodera glycines
  Promoter: Source sequence=SeqID_45281; Location=1..53; Strand=+; Gene= SeqID_72605
gaccggagcccatacgaaccatgtggaatgtttttaggaagaatctgaaaatg

SEQ ID NO: 110036 - DNA, 153 bp, Heterodera glycines
  Promoter: Source sequence=SeqID_126; Location=8680..8832; Strand=-; Gene=SeqID_73475
ttggagaaggaaataggacgtgaaacaggaccagcgcaactttctgacaaacaattgggtgaattagaaggtgaaaaaccgcaaaaggaacagctgcaagccactcccattgttgaacatggtgaaatatctacgatagaccaagagcgcatg

SEQ ID NO: 110037 - DNA, 154 bp, Heterodera glycines
  Promoter: Source sequence=SeqID_12911; Location=1..154; Strand=+; Gene=SeqID_76651
aaaacgatatgatgaaatgactttaaaataattgaataggaaaaaatccaaaaatcattctttgtttttcatatttctttttcttattatatttaaatattctatctttctacatatcaaaatactttttggaacacaggtcgcatcagtaatg

SEQ ID NO: 110038 - DNA, 1003 bp, Heterodera glycines
  Promoter: Source sequence=SeqID_20178; Location=280..1282; Strand=-; Gene=SeqID_84965
gctcattcttatctctttgtgtcacgcactctttctttaaacactcactcattcattttgtctctctgattactactagtactaatcggtatttgatctttctctcttactctaatcatttattttacgattactcactcccactctgatcaacttctgatcacacactcgcactctggcattgagaataataaaaattttaattctttattagtttataagacctttcattttaatgtaaataagtgatacattattttctcagcaaataattggaccaaagacaatgataatcatatttttgatccgaaaaatgattaatatcataaatataaaattatttcaagaaattctggttgctaaattcggaaacaaaataaataaaagtaataggaaattttactttataaatctaacattatttaaaactgctaaaatcgcaagaatagattcaaatattagctttttttgtatgcggaatattaaaattgcattttaagtcaagttttaacgcgttttgcatgcattaatttaataaaattaataattggttttattttactagctgtgcaccaacaagttttggtatgtattgagaataataaaaattttaattctttattagtttataattttcattttaatataaataagtgatacattattttctcagcaaataattggaccaaagacaatgatagtcatatttttgatacgaaaaatgattaatatcataaatataaaattatttcaagaaattctggttgctaaattcggaaacaaaataaataaaagtaataggcaattttactttataaatgtaacattatttaaatctgtttaaattgcaagaatagattcaaatattagcttttttgtatgcggaatattaaaattgcattttaagtcaagttttaacgcgttttgaggtacaactgtgattagaagaggtacaacagtaaatagaagaggtacagcagagattagaagagttacaaaaatg

SEQ ID NO: 110039 - DNA, 647 bp, Heterodera glycines
  Promoter: Source sequence=SeqID_1801; Location=4346..4992; Strand=+; Gene=SeqID_76064
ttttaaagaatttgaataaagaatgatttcgatttcttgctgggaatcatttggtggtgcgcaagtgggcgtggccaaagtgcacacatcgtacacccggtcattttcccgattcattttaaaaattttcatcttttttttttgcacatctgctgttttcctctccgccctcacttgtcctgtgctttatggggaccgtatcatttaattgtgattttgggaccgtataattaaattaatatttttgctgttaaccagggcggtagctataattacaaaaagctccgtttatcctggcagcaatttgccttttaaggcttgaggtcgttcgcttgacttgactaatttcccgagtcgtttaggtgccctgtcgtcttgtgcttcatgggtggcggtgtgctgctcttcaggccatagtttgtttatgttttttgaaatttttccatctccaaatgtttatttattcattcatcatttcacgccattttccatgccggcgctcgcatataaataccgagattttactcattcctcctcactccactctcagattaaaaaaatggaaccacgaaaacgatcctctaacttttccattgatcatattctctccgcgcccaaaaagccccgtcaaggcttcctgatcaatg

SEQ ID NO: 110040 - DNA, 1003 bp, Heterodera glycines
  Promoter: Source sequence=SeqID_6569; Location=1132..2134; Strand=+; Gene=SeqID_62048
gccgggacttggaaaattgacccgggcgagaccccgggaccgggactcccgtttttccgggactcctggtcccaatttagggcccggggccccgctgggaccgggactttttcaaaatttttaaaattttgattaaaaattcgaaaattttttttataattttatattttagcttagaattatatcaagcctataaatcggcctcttctgcttttcaattatcatccaacaaaattaaatcagtatttgtagtccaacattgggatggccttgttcaaaaatatcaacatttctgcggttttcggctttaatctcgaacgtcgataatcataaacaggctaaattcatatttggactttccattttctttacattctcggcactccgccattttgccatcctttgatttttcaaatagacctatttcgagattgatgcattcatttctaaaaaattttattgattaaattttctaaattctttgggaaataaaggttcgggccataaagaattttcgaggttttacaaaatctaggtatgttgaattaaattctacaaattttcaaaaatctaaagtcatatcttgaaattttgaattaaagacatttcgccaaatgttattaaatttttcaaattttgggcagtttcgctggtgaaatttaagcccgttttagcccggtcaaaatgaccgggcccgggctcgggccgggcccccgggcccgtccggtctctaacagattcacaccaaaaaatgacaaagttttgccatttaaaaaaatatatgacgccaaaaatgtgttcgcgtcaaaaaactttcatttttaatttaattctcatctcaacttattagttttctttttaatgaatttgaaaatttggtagtgggatttctttattttctagctaatgagaaaatccctgaacctgctccagaaatcccgtttatttttataaatgttataaataattaaaacttttaagtaaatttagataacggaaaatg

SEQ ID NO: 110041 - DNA, 141 bp, Heterodera glycines
  Promoter: Source sequence=SeqID_5960; Location=458..598; Strand=-; Gene=SeqID_59839
tctaaaaaaattcacaaaatgaatagctaataattcgccgattattgttggtaagtcatgctcgggtttgaagaaagtgtttagtgtgtcatcataatctacgataaacacatcagcagaacaatatgctttctcaaaatg

SEQ ID NO: 110042 - DNA, 93 bp, Heterodera glycines
  Promoter: Source sequence=SeqID_1455; Location=1207..1299; Strand=-; Gene=SeqID_73645
agagtttcacaaccacactcatccatacaaagcaaaattaggtcaatgtcaacggcaactttcggagggacaagccaaaggaagggagcaatg

SEQ ID NO: 110043 - DNA, 921 bp, Heterodera glycines
  Promoter: Source sequence=SeqID_10067; Location=1255..2175; Strand=-; Gene=SeqID_73134
ttttaaatccacggggatggagtccaatggcaaatgtactctcattttaacattctccggcggcgcctacttaaaaattcagcattttatgtaatatttgtctgtccgttttgttttgtgtgccgcttcaaaagcaatggctttgagaacaaatgactgaattacataatgaatattattggaagtgcctttaattaattgattgtttcctaaattacataacaattattcttttattggtcattaattttgcgcttttccattaatttttgtttattttttctctttttttgctcttcgccttttctgccgcttttcgttgatgagttggggttggggtgagctcatttccctcgtcctttcgtcacaaatgaacacagcaaagcgagacggaagagacaacacatcacaacacgcgaattattggacttgcgtgccgcttttctcaccgcgtcctccccccccccccccgtttttcccctttgctctccctttttttgcccctcctcccattttcccgtttctcgtttccgttctttttgcagttttttgcggtcggtcaatactttcctttcctcccctttctctccttccgtttttcctttcttttcgtttcattggctttgcctttggcttcacctccaacggctccccccacgatgcatttgcctcttttcgtaccttttcccgtccttttggacttacgtcggttggcccttcgccggaactttggcgcttcaaatgatggcaccaccatccatcaaactcaaatttccaaaaagagaaagaccaccacttcctgcccttttttattttgaaatattttgtccgtaaaataacctaccacactttcatgtttattttaagtaaacatggtttttcaacatttttagttttgttttcatttctttcggcaaaatg

SEQ ID NO: 110044 - DNA, 562 bp, Heterodera glycines
  Promoter: Source sequence=SeqID_30914; Location=379..940; Strand=-; Gene=SeqID_61285
taagaaaagcggttcctccaaaattgggagatgaccatataaaaagtaaatagtaatatatttgaaatttgcatcaaacaacaattcgccaaataaacaaaaaaaacttttgttttatttttcctacataggtctcatttttttgcagtttaatctttaatcaagaaattccgttgtaaaaacaggctttcaatcgcttttaattttatttttatttccaaacatgcgcagtattgtcaatttatagaacattttcttctttgtttggatcgattttgtgcaataaatatgcattttggtgaaaaatgaaattttgattttttgttcgaattcgggtccggggttcggaattggttgaaatggatgtcggattcgtgatcagcgaccccgaaaaccccctaaaacctgtttttaagcacttttaaaaattttaattttttttttgaaaaaggggggggataaactttactattacccccctttttggtagaggtgaaattttgcatatttttttacatgtcttatttaatttttgtcctttttgttaagtttctgtcatatg

SEQ ID NO: 110045 - DNA, 655 bp, Heterodera glycines
  Promoter: Source sequence=SeqID_37825; Location=497..1151; Strand=-; Gene=SeqID_66823
ttttagaccttatcatgaacaaagaataatgaaggtaactatgtgtctatgtaagcaagactatgtgaacttaagcctaagatttcacgaccgactaacgaatcagtgtgagtcagtcggaggaagaaaatatttttagttggcattttgtacgtgttaaattagtcacatccatatcaaatcgttctattgtaattggcccgagaaaagaacgtatttacatagacattaattagcaccttttataaattatctctctttaattgtaggtcaaatattcacatttaattaaaaaagatatggcactctctctattccttctgttggtcggaacaatcattgctaattgcaatggtgacccaaagatgaaatctgttgaagagaaaagtgtgccgcctgccgccttttggccttacattttgcatccaaaaacacctcggcataaatcagagtgggtttttaaatattatgccattttgagttttgacaccaaatatttgtatgtgtcagggataccattccaaggccccaaaaatttttgcaaatcggaattccgagggtcaaaaattttcgaaatcggaattccatgccatccctggaatatgttattcacaatataataattaaatttttaaattttccgacggcaccaatg

SEQ ID NO: 110046 - DNA, 601 bp, Heterodera glycines
  Promoter: Source sequence=SeqID_649; Location=724..1324; Strand=-; Gene=SeqID_58112
tcctttctctattaatctttatattttttaattttctgtttcttttcctctatgaaaacaaaacaaggcacaaaatgtcatcataaaaatgacctaaataggtttagaatcacattttaacattttaaaaattaatttttgctagttttaggagtacattttctaaaaaagttttttaatttttttagaagaaatttctataaatttgcaaaaattctcagaatacgtatgtaaaaaatgaaaaatttgccgaaatttttgatttttttttaaggaattttaaaaattcccgtaaaaaatcctcaaaatatgtaccaaatatgtataaaatcccgaaatatgtaaataaaagtcccgatttttgtacgcaaacacagaaaagaaagtgtttttcctactatttagagcatggggaatcaaggaaaaaaatatgtatttacattaaattgacatccctagtgattttcgttaaaaaagattgttttccgctttgtttctcattatataaaaataaagtttccaacgcaattacctaattattctgctatatatttgtgtgactcgaaattcaacagcaaattgtgctaattgccaaaaaatg

SEQ ID NO: 110047 - DNA, 778 bp, Heterodera glycines
  Promoter: Source sequence=SeqID_14594; Location=1486..2263; Strand=-; Gene=SeqID_78671
tcagcataagtcgtaatgctacgctaaataaaaacaaatgtgctaaattatagccacacattaagcggaggggggggggggagcacgcttattccagccacggaaagggacaactgggcaacacgaactaggaatgtgggtgatgtcattaactaaacctagatgaaaaaaataatttaaatccaaatttcttcgagtttttttcaaaaaggacggaaaacctttcaactatcttaaaagggataatcatgaagaatggttcacccatattttcatttactattttggaataaaaacttcatttaactttttataagtaagtttatttttcaaaaatcttaatagaaaaattttttaaactcatattaactttttataagtaagtttatttttcaaaaatattaatagaaaattttcctaatcttttacgtcagttattgacatgataatacggagcactcgcccattccggcttcttctcaaacgctggattaaaaaattgacctaggtaaatcttttttgtcttttttttcaaaaattgttagtgaaaataaaaaatcaataagaaagatatatggtccgctttaaaatgtgctattaaattctttcccaagtcgattttttttattataaatttttaaattgattaagtcaagaaaattatcacgtaaaattgtttcggactttttaaaaactatttttgtataaaaaggatttattttttatgatatgattttcaattagtacataggttttgaagaagaatttccaggaaatg

SEQ ID NO: 110048 - DNA, 87 bp, Heterodera glycines
  Promoter: Source sequence=SeqID_27049; Location=447..533; Strand=-; Gene=SeqID_57773
tttttcagcgtccgtgatagagctttcggatgcagctcaagctggaagcgaccacggttcaaatagtgcacgtgtgcagcgagaatg

SEQ ID NO: 110049 - DNA, 142 bp, Heterodera glycines
  Promoter: Source sequence=SeqID_10754; Location=1190..1331; Strand=-; Gene=SeqID_74004
atttttatatatgaccatttaatccaaaatattcactttttgccattgcttaaagtcgaaaattaaaaaaataaattttgtttcattttccttaaattttagtcagaaaactaaacaggtttattaagcgattttcttaatg

SEQ ID NO: 110050 - DNA, 442 bp, Heterodera glycines
  Promoter: Source sequence=SeqID_2613; Location=3078..3519; Strand=-; Gene=SeqID_80720
attttaattgaccttaactttttctagaagtgtcataattaaaatacttggtaaatcattcgacagctctaaaagtcctctattagactactaccaaatttcaaaaattttgttgcgtttcaaaaaagttatggtcaaaaaagtttcaaacccgtttttgaagtttacaggcataatttttttgaaacaacacagaaattttttaaattttgtacactaatagaggactcttagagctatcgaatagttattccattaaatttgccaaattattttatggtcgtgtcttttttcatggtcgtgtgaactgcaatagagcccaatcgtcgagcataacattagcagctaaacaatatatgccaatttgtcagtgagcgattggaaaaatgatgaaaatgacgacaacacggagccgaagtcgtcatcactgaccacaataatg

SEQ ID NO: 110051 - DNA, 132 bp, Heterodera glycines
  Promoter: Source sequence=SeqID_17457; Location=721..852; Strand=-; Gene=SeqID_81944
gatcattttctgatcagaacatagcgtagattaaatttttggcccattttatgccaatttttttaattgtaaaatcaattaattttaatttttgcaaattctctgatcactttttacttctgatcagttatg

SEQ ID NO: 110052 - DNA, 1003 bp, Heterodera glycines
  Promoter: Source sequence=SeqID_13156; Location=1179..2181; Strand=-; Gene=SeqID_76968
aatgctaaaataataataaaataatgtaaataaaaatactttcacgattgattaaaattccagtcctactgatcacaaaaactgatatttttattaattttacatttttaaactgggcttaatttaccagtgaaattaattaaattccggcaacgccggtcttcagatcccacttacacagggatgggcgcaaggcgcaattacgcattttggaaatgatggcgtttttggacactgagattaaggattacggaaatgagggcgttttaatttcttgaaagcttcttggtaaaccacacaggcttttcaactgaattcagcggccaaaaactagagcacgaaattttgaaaaaaacaggacccggaaacccaagatgaacccgggcaggattccagattaaaagggcttaacagtttttttaaataaagaaaaacaggagccagactagggtctgggaaaatcctgtacaagatcatgccctgtctgggctctaataatgcatatcctcaataatgatttaatattttatacttgagtttttaaataaatttaaaattataaaaatggtaaaataattttttattttcaaaaagtacaaaaagcaaatcaacaaatatcgtaagaaaaaggcgatcaaagaatatctctttaattttcagttcttcttaattacttctccaaattgtttcttccaaataaaaacggttcgttgattaattttcaatattttgcaattttctcgtcactaataaaaaaataattaaaatatcttactttttgtgatcagtaggattgaatttttaattatttaccttattattataatattattaaatgtgagaaataagtagagagaaaaaaatcagtatacaatttaatgagtgttgtaataatgtcaatatttccacataaaatgtttaagaatttataagagaaaaataagaaattcatttgagaaattatatttaaataaatattcattttagaaaaaattcagcaatg

SEQ ID NO: 110053 - DNA, 70 bp, Heterodera glycines
  Promoter: Source sequence=SeqID_19239; Location=1542..1611; Strand=-; Gene=SeqID_83984
aataggcttacatgacccaatcgtattgccgcttcgaccgccagaacaaaacagctgtgacacgctgatg

SEQ ID NO: 110054 - DNA, 256 bp, Heterodera glycines
  misc_feature (9)..(9): n is a, c, g, or t
  Promoter: Source sequence=SeqID_36712; Location=1126..1381; Strand=-; Gene=SeqID_65964
cagaaaatnttttgaaaaaataaataaatgtcaagttctctccctttgtcagacagcagcattttcgcaccagcagaacggcgtgagaaaagttaattggcaaagaaatgggtgaacaaaaataaaaattataattatgatacgtatttattagttacaaaaattcacgagttggaagaaaataatttttgagaattatgatagatgcaatttttctttctctgtttttttagttcattattccttttttcagatg

SEQ ID NO: 110055 - DNA, 1003 bp, Heterodera glycines
  Promoter: Source sequence=SeqID_18900; Location=1179..2181; Strand=-; Gene=SeqID_83610
aaataattttattttcatattatttataaaattataggaatcttgtataaatatttaaactaaatttaaaataacaagcaaataaggaataaataaatcgcactgtcagcgaatgtgaccacttattcatttagatgtgtgtccactcagcctctagtgaaatcacttgaaaaactataaaaaataaaaattaaattatactataaataccctggattaaaattggaaaaattttagtttccagataatttataaatcagttaaaaaaagataaataaaaaaaattaaactttttatcaaaatattgatttaaaaaggtattaaataattccttataaaaattttaaatatttttctttttttaaactataaattatatggatcaacatatttttttttttggaaaaagcgcgcctcaaaaaagcgttttattgatttttaaatttggaataaaattttaaaaaatgatttttgctttatgattttaactattaaaaagttgtagaaaaaatttcgcatttcgcattttcgcatattttagcttttcgcatttcgcttttttttgatttcgcatttttcagtttcgcgaatttcgcttttcgcatttagctttttatttttcaatttggcccatccctgctgtttagccgttttctctatctatcgtccatcggcctttgctttggctgtttagcctttttctctgttttccttttcctctgatctcaacggagattaaggctgctaagccgtttgcttacaaaactttgcttgactgtacactctcgcccccagggatggacgaaatttcgtttcgttttcgtttcgtcctacattttcggcactttttgagtttcgttttcgtgtttcgttttcgtctaccaaagttttttcgtttcgtgtttcgttttcggtttttaattttggattttcgtttcgtgttttgttttcgtcagagcaaaattggacgaaaaagacgaaaatatttacacccttaagaatg

SEQ ID NO: 110056 - DNA, 101 bp, Heterodera glycines
  Promoter: Source sequence=SeqID_4185; Location=1..101; Strand=+; Gene= SeqID_53509
tgtattggtcttcttcgttgggcaactttccggtggtcacaaaatcgcttcttttgccgatgtatgtgcagagttccaattttggtccgcattccaaaatg

SEQ ID NO: 110057 - DNA, 831 bp, Heterodera glycines
  Promoter: Source sequence=SeqID_38545; Location=1..831; Strand=+; Gene=SeqID_67329
cttccccggggggaaaaaagggggtttgaaaaattttattgggaaaaaaagtctttacaaaaaataatccccctgggagaaggggagggggaaacatgatttcaaaatttttcaattttttttagttttatttacccaaaccggttcagaattctataaaaaaaaacatttcggggtgggaaaaaagggggtttgaaaagtttatgggggaaaaaaaagactttacaaaataatacccctggaagaggggagtgggaaacatgatttcaaaattttcaattttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttatttggaaaaaaagactttacaaaataatacccctgggagaagggagtgggaaacatgatttcaaaattttcaattttttctagtctaatctactcaaaacggctcagaattcaataaagatgctatgcacgcagcgatacgaaaatg

SEQ ID NO: 110058 - DNA, 201 bp, Heterodera glycines
  Promoter: Source sequence=SeqID_10367; Location=2375..2575; Strand=-; Gene=SeqID_73545
cgattaaaaaattttaaataatttttttcgaaaaccgctttattttttgtatttcacttaaatttagaaatcaaaaaaatttttggtttaaaagccaatattttgatttcattgttttttaggaagtgattttttcctctatttctgatcccgaatcccattcttcaaagcaacccgtcccactctcgaccgtctaacatg

SEQ ID NO: 110059 - DNA, 285 bp, Heterodera glycines
  Promoter: Source sequence=SeqID_5569; Location=4825..5109; Strand=-; Gene=SeqID_58511
ttgatggatcattcgatgggcaaaggtcggtctttgggtcaaaacaattgtcatttctcgatggcgaatgaggacttccaaattccatgcgcgttttaactgtttcaatggactgactcttagcaccactgacccgtttttatggtggaaaatttttatggaaaaatcacttttcgtttctccgatcaccaaaaatatttcttcccttttcttgcacaaatttcttcgattttcctttaattgccttacaaagtcacttttccttcacctaacagtgtggaaatg

SEQ ID NO: 110060 - DNA, 307 bp, Heterodera glycines
  Promoter: Source sequence=SeqID_15733; Location=953..1259; Strand=-; Gene=SeqID_80059
tttcgaccaattcggaacccggagccgaaattcgaacaaaaaatcgaaaataaaaaatttcaaaattctctttttgtttctaaaatagattaaaacaaccaaaacgtttttgcgccgacgttttggcgccatgtagggaggaggtagaaatgatgaaatcgttataatttttctgacgaagtctatcaaagagccggatttaattcttcattctctttttcgctttggcttatgttctcttaattttgtatttaggtaatgaatcgtcaaattgatacgaaaaaacaaaagcctaaaataacgcatg

SEQ ID NO: 110061 - DNA, 164 bp, Heterodera glycines
  Promoter: Source sequence=SeqID_45525; Location=290..453; Strand=-; Gene=SeqID_72806
ttcctaagccagatgaacaggtccaatttgtgctttgacttctttacacattaaatttccattttattgtttttaatacctcatcacttcttttagagtcgagttcagaccacacaatcgcttccccaacactcagtccggtcgtagccattgagccagcgatg

SEQ ID NO: 110062 - DNA, 147 bp, Heterodera glycines
  Promoter: Source sequence=SeqID_38964; Location=307..453; Strand=-; Gene=SeqID_67642
aaaataaagcttcaaatcccctttttaataaattataatcattataataattaatttaattaaatcattttaaataaacaaaataattattggagggaattaagtgaattattaaaaaaaacaaaaatatctttttttctagaaatg

SEQ ID NO: 110063 - DNA, 126 bp, Heterodera glycines
  Promoter: Source sequence=SeqID_9217; Location=3116..3241; Strand=+; Gene=SeqID_70650
gacgtggagccgaaatagtcgctatggccaataagcgccagcggcaaatttgtccttgtgtctttatagacataagtgcaaatgtgggcccatgacgacccttaagggctcatggtcccaaaaatg

SEQ ID NO: 110064 - DNA, 121 bp, Heterodera glycines
  Promoter: Source sequence=SeqID_16378; Location=1..121; Strand=+; Gene=SeqID_80770
atcaagccaaaattttttgtttcaccagtattattttacaaaattttcagcaccgggcaaaaaagcaggaaatttttgcagttttcgccaaaaaaagagatcaaaatttaaaaaaataatg

SEQ ID NO: 110065 - DNA, 117 bp, Heterodera glycines
  Promoter: Source sequence=SeqID_19441; Location=160..276; Strand=+; Gene=SeqID_84164
agtttgggcgaaccgaggttggaaaaagttggtaaattagtgggttccttttcgggccacaaattgaagttgttgggaagtttcaaatgtgacgttctgttcagaggagtcacaatg

SEQ ID NO: 110066 - DNA, 265 bp, Heterodera glycines
  misc_feature (245)..(245): n is a, c, g, or t
  Promoter: Source sequence=SeqID_26317; Location=1262..1526; Strand=-; Gene=SeqID_57068
gatgaaataatgcaccaaatgaaatttttgtgcttttatatatgaattatccgaaaaatttgactcttccgactaacaaaatttgctatttaaggctcacacattttgcttttccacgttcattccgttcattcattccatccacttaattattcgtcctcctccaccgccacttaaatcgtcagtttatttaggtaattaattgttttgttatgtgcattttcattgtgctaattccccccccnccccccattttcagcgaatg

SEQ ID NO: 110067 - DNA, 630 bp, Heterodera glycines
  Promoter: Source sequence=SeqID_5632; Location=1463..2092; Strand=-; Gene=SeqID_58711
caattccagtacaaatttttaaaaaactactcataacttttgtcaaagtcaaccaaattaaacattcttggaaacattcgatagcctatgggttctctattagctcactttaattttaaaaaatttggtcaagtttgagcaaagttatgggtaaaagtagtcaaagaaccagtttttcagacatttttggtcataacttttttgaaattgaacgaaataattttcaaaatttatcaattttcttgtctttcatcaaaatcccgcaaaaattggggcaaattaatgttgcatttgtcgttttctttttgaacctctgaattcgttctgccacttgccacttttatggtaattgtctcattttactgttttattaatcacatttaccatttttaattattgccatcgtttggaaactattcattttaatcagcagcggctctcacttaatttgttaaccgtttcacttaaagattctttaaatcgcatttcaatcaaatttttgaagaagttatattcaatttttgcttcattttctttgttttattaaaagtaaattatgttcacgccatttattaatacataacacataaaacttgaaaaaacgcatcaaaaccaatttgttaaaaaatg

SEQ ID NO: 110068 - DNA, 91 bp, Heterodera glycines
  Promoter: Source sequence=SeqID_41729; Location=1364..1454; Strand=-; Gene=SeqID_69794
aaatgtaattttattagagaattgaaatacccgcgcctttgacgaaaatggtggcggcgatttggatggcattgtgccggtgccgccgatg

SEQ ID NO: 110069 - DNA, 520 bp, Heterodera glycines
  Promoter: Source sequence=SeqID_35168; Location=1..520; Strand=+; Gene=SeqID_64790
tcgtctgagtcttgaggttccctctcctcctttttgtctcctgattcttgagttttcaaattttacagccgaatataagtctcgatcttctattagaaattatgattcatttaatttatatttcttgccagagttttggtataggttttgcctcgcttgattcatcacatttacccatgtttcttgggtttttaaatttgaaactgtctaaacaggagctccgggctcattgaagttatgatgattttttggaatctaagcaatgaaacagcactaattacccagcgttcttgatacagacaaaatctttgtgacaattatgggcagatgatttggtttgttaatgaattcagggcccataatcttagtttcgtgagcactcagaagtttcggggcccatttataaaaaaaaattcaattaaaacccaattaagaatccattgtttttctacttatcgaaaaacctccgctcggtgccggtggtggtccaccgccgccaccgcctgcgcaattaacgatg

SEQ ID NO: 110070 - DNA, 1003 bp, Heterodera glycines
  Promoter: Source sequence=SeqID_346; Location=3772..4774; Strand=-; Gene=SeqID_83549
ggaacgtctaaaaatatctaatttataataagaatgtattttaaaaccatttaagcattttttgaaaacttgaaaaaacatcggtcagttaaataatagatttaatcacaccaaaaaaatattattttaatatgtacttgtaaaaaaaaaagttgaaaaaattttgaaacggattttcaattttttataggaattaatagtttttcgaaaacatttagaaaaaatcgctgaaaattttttcaaaaatttaatcttgaaattttcgtaaaaaactttttgattttttttttttgcacttttttcaaaaaactttttgagaatgtgtgagggaaccgctaggcgccgccggaaaaaatttgtaatttttaatgcgatttcttaacgattttgttcaaaaaatgacaaaattttacgattttgagccaatttaaaaaaaaaaatttcccatcccctggaactttttacggtacctacccctgtatttacggtatttcgtcactaaaaatgtcaatgaaatggaatgttttagaacataaaaatattatatttttgatcaccgttttttcaacactgatcacaataatgccgaacaatttacatattaataccaaaaagaaacatttaattgtccatcacatctttcgctgattaatactttaagctccaatcatattactttttttcaatttttgcataaaagcattttccctctcccattttttaggtcatcattttgctcaacagcccaagccaaaaaaaaaagaagagattattataaatttctaaaaagtattctaattgatgggtcataattttgcccaaattacttttttgccgtcaaatgccagcccataaatagaggggagattcagcgcaaaagatcaaatgttcattcattcatttacatgcgaagatgaattttatttccaattttcatattttttttatttaaaaattttaatttgtagccagtccaattaataccttattaattcgaaaaatg

SEQ ID NO: 110071 - DNA, 704 bp, Heterodera glycines
  Promoter: Source sequence=SeqID_40866; Location=1..704; Strand=+; Gene=SeqID_69105
taatcggggttaagattattggactggagtcccggcttttggctccgttcgcgctccatcgtcaattcccgaaaattctggcctctctctcttctttacacccattttttgcctcattttcttgagaaatcgtaaagggaggaaccgacaatgccgacatgcaccacataatgggaaattaaaaagttttcttcaatttcttacaatgactcgaaaccgatcgaatttttgcctcatttttcttttttttttgtttacaaaaatcagaattatttttattttcggtaatttatgtaaatgattttttccatttatttttttattcgttttcattgcatttttttttgcttattcaacaaaaactgctaaatttgcgttcgtttttcccatttcttttcattgatcggcaaaataatttttttataactttaaattaatctttttattctttgaagagtacggctctgctggtctctttctatggcaatttaatctcttttttcgtacttttaaatttgtcctatggtaaattgtcgcattgcctaccgtaagaaattcttttaatttttttgttttttttaaatttttccttaaattttaaaagtttttatctgacgaatatcattgacggagtgcaagagataaaaatttgcgcatctgaacagtgcccaacgggacggataaagccaagaaaaaggcctatg

SEQ ID NO: 110072 - DNA, 748 bp, Heterodera glycines
  Promoter: Source sequence=SeqID_7217; Location=142..889; Strand=-; Gene=SeqID_64175
acgccacccattagcacattatgcgggttagggggcgcgttcgtaaaatccgccagcaatttttttcactaaacatggtataactttgcttaaaagcaaccaaattttacattcttggtaccattcgatagctaagctttttctctattttgtttgcaaaatttcaaacaaaattatcaaatttaaactaagttatggtagaaatagtacttattttcatacaactttttctaaagatgaccaatttttttaatttggcaggctaatagagaaaaagctgggctatcgaatgatactaagaatgtaaaatttggttgattttaagcaaagttatgacatgttttgtcgaaaaattcgctaaaatggcggattttacgaaacgtcccagcacacattatgccagtaccgtaacaaaaactgcgcaaatgccaatgaccggagattccctctgctcataatgcttggacaataccgtggccaaaactgtaacagaaaaattaatgcgcggagaatggttcggtaccgtattttacccctttcgacagtcattggtacgataatggtgcgaaaatactgtagaaaaagtgaatcaaatttaaattatttcttcaaccataacggcgatttcgtggccaaagacgagccaacggaagtgatcaatgtaaaaaatgcccgtgaaagcgtagcaaatttgggtgggaatgcgagtgatggcaatctgaaaattgtgcaacaaaatgccaaaatg

SEQ ID NO: 110073 - DNA, 1003 bp, Heterodera glycines
  misc_feature (473)..(473): n is a, c, g, or t
  misc_feature (493)..(493): n is a, c, g, or t
  Promoter: Source sequence=SeqID_12782; Location=528..1530; Strand=+; Gene=SeqID_76495
agcagggacagcgtggagccacccaaacatagcaatttgtgctgctcacccagcgcattgtaatcggcactctgtgcgaattttgagggaattgcaccaacggcatggggaaaaggaaaagccatagaattttacaatactatgatcactgattctgatcagtgatcattaaacattagcctaaatgcataagcaatcactaatcagtgatcacaaagggcaaggctgatcacaaactgatcaaactaattggcataattaccaaatcagttgcacgacaaatcattaaactgtctgtccattgtctgtcacctgaatggtcagtgatgagagaacggcggtgtaaagagaacgccaaaagctttcgggaattgcatttgtaaagagaagggcgctgaacagaagcagccaaagggagtgaaggccgagcagaagcaaagtgagaagcaaatggcgatgagccaacggacggnccaactgaaaaatgggcggngggaattttgatcaaaaaagtacgtctgggaagacggtatttacggtaatgagagtttgtgattacggtaatgagtaagcaccttttgctcaacaaaatggagcccaattcggcaaaggtcgatcagtcggtgggagacgacgagcaaagtgacgacgaaaaagggcacacccaacagacaataaaagagggcgaaaagctaatcaaaatagatgggatcaatttaaaaggatttcgacgatgcgattctctggtaatcccaactcccccctcccatccctttgccatttcccccgtccttcccaaagtgccaattccctccctcccccctttggcatcactcccatttacaaccacccctttttttactttcccacggcttcctcccaattttcacctccctgccccattaattaattaattgttcgtccatttgtcccacttgtcctccccgtgttttcggtgcccggtggccgtgtccgatggtcgtcagcagtccccacgcgtatg

SEQ ID NO: 110074 - DNA, 591 bp, Heterodera glycines
  Promoter: Source sequence=SeqID_11718; Location=674..1264; Strand=+; Gene=SeqID_75205
tctgtaaaaaaaagaaaatgtttttttaaacgaatattgcaattaaaattaatgggttacaccaccaaaagttcgccgccgaaattttctttatagaaacttagaaaatttccaagaaaaaaaaattcaaaaattaacagcgatttttttgtgttaatggcaactcgtagtacacaagcaactcttacaataaaaaatttcaaaaagcctaaatttaagcctaaggctaagcaagttttcaaaaaattttttttcatcgaaatttaaaaattgtgcccatttttttgcagtcggctcgatggccttcagcatcgattgttgttgatttttgaatcacgcggcgtattgacgacaaattgtttttgccaatggtccacacaatcaatcgcaaaaagttcaaatggcaggcgacaaaatatttggcatttacagcacttcgtccatccaatggacaaagtgtcgaaggatgacagctgaacaaaattttaatgatgttggaaaatcttacaatttgaatttcctttttaaattaataattcatataaaatcttgaaaaaatcgctaaaaaatgggtgccgaaaccgaaaaatg

SEQ ID NO: 110075 - DNA, 85 bp, Heterodera glycines
  Promoter: Source sequence=SeqID_12556; Location=1..85; Strand=+; Gene= SeqID_76209
gcatgagctcagccgaaatgagcttctacactacctcagttacggacgactgggaacgaatttgttcgagacttattttgtgatg

SEQ ID NO: 110076 - DNA, 106 bp, Heterodera glycines
  Promoter: Source sequence=SeqID_32196; Location=1282..1387; Strand=-; Gene=SeqID_62522
ttttaaattgtggcacattggccaacgaatttgtgtggtagggcataacaattaatgcagaatatgacatttaatctattaatttgatgagattgtgtacaaaatg

SEQ ID NO: 110077 - DNA, 374 bp, Heterodera glycines
  Promoter: Source sequence=SeqID_101; Location=5377..5750; Strand=+; Gene=SeqID_68296
tccgcgtttgctgtgtgcgttgaggttgaaatgcgcggcagagcgttgttgatcactgtaaaaggggaaaaaaattaatgatgtgcaaatggagggggtgaggggaaaacgggcgatggtgaagaaggcgcacctcagtaattaggcgcgaggcgtgtcgaaaataataggcgtgaattgaaggaaatggaataagtgagaattttgggcattttccgtccttttatatcaatttttttccaaattccttccagcagaattggatccgtataaaaggggtcgtctttccctccgcttcacatttcttcttcttcttcttcttcttcaccacactccaaccaacgaaccgcttcagtgcgcaacgcaacgcaatg

SEQ ID NO: 110078 - DNA, 960 bp, Heterodera glycines
  misc_feature (757)..(757): n is a, c, g, or t
  misc_feature (911)..(911): n is a, c, g, or t
  Promoter: Source sequence=SeqID_16604; Location=2599..3558; Strand=-; Gene=SeqID_81020
ccaaaattgctccatttggcgcttgagtaaaaaaaaaataatattaaaaacctaaaaatcgcattcttaattatgaaacaatgtttttagtccatattcggacatttccgggcttttttagtcagtattttgggcttttttattccatataatttacaaccctaatgatcaattaattctgagctgggatgatcacatggtcatcaagatcaagatgctgctgctgctaatttgatgataacaaaatgaaggaacactggtgatcaaaaaaacaaaaagcacaaagcctgttcaatttcccatatttgtttttttttttaatttgcttcgccaaccgccgccgtcgccgccgcaatttttgcgataatccgccgccggcgccgcgccacacacgcggaagtaaaaagcgtttaacacaaacgcatatgttgtgtgtgtgtgatgcgcagttaatatgtatatactattaaatcaacgcgctaattagccattcattaattgaaaaaaaaaaataattatggaatgcggcggcgaaaacagttagaaaaaggggtaatttttggcgcgtcaggaccagtcagcttgggataagtcagttgatggatagataactaagccttacgataaattacaaaaattacaaaaataattaaataaataaaacattttaccattttttaacagattttcattaaaaatagtaattttatgatttctgggaaaatttagcaattttttttttcaaaattgaatgagngggggaggtcttggacgtgcggtgctaataaggaaaatcgaaaacagtttcaacagcatttttcccttaaaaattacgctgcccgcgcacgccgtgaatttttcttttttgttggcaaataaaatcattttggcttaattaattacctaattanattaattcatccattctttaattatcttacacacagtttataaaaaatg

SEQ ID NO: 110079 - DNA, 637 bp, Heterodera glycines
  Promoter: Source sequence=SeqID_1325; Location=2692..3328; Strand=-; Gene=SeqID_72559
gaccaagtgatggaagtcgaaaatacgatcattgattttttaataataatgataagttcgataattataatgataaattcggtatttcaatatttgtaatgataatttcgataattataatgataatttcgatattaattgtatgcagctaattgataaatgttttttttataagatcttttttatttggtcatctcgcaacttctcgcccctaatctccattacctcccaaaccccctaaaaaaaaaaggcaaaattttgttttgtttgcatagcaacaaaaaatgccgagcgcggaagcaatttgaccttttgctcattccttacttgatttaacggctccgcactgcaagggatgtgcttattcattgccttgttggggtaattggcggtaacctaaaagaaattgcccttccaacagttcaagcactttaatcgtcccaatattcccccccccctaaatgcacaacggagaaatatgagatgtggcgtaaaatgttatggactgttggtgggcgggattaagatcttcatttattctgtgagccccttttggcatcttcctttttccctttttttttacctgctttatattttttattttttttttagcaataaaattaattctgaaaacatg

SEQ ID NO: 110080 - DNA, 318 bp, Heterodera glycines
  Promoter: Source sequence=SeqID_344; Location=500..817; Strand=+; Gene=SeqID_83242
aacacattggacaagcagcagcttcaacagaagaagctttttccgccgcatgagtcacgacaaccggacgtcatgctcggaatggacgtctggcatgacttgcacgttcagccaattgaacaattgcagagtggatttacgatttgtcagtcgaaaattggcaaaatcatcagcggcaatggacgaattgaactcagtcaaccgtcaaatgtgacattcgtcctcacggtcacagactaaaatgtcttcacaacggaagaagacttgaaggccaacgaaaaactcaacaagttctacggcctcaacatcattggcatg

SEQ ID NO: 110081 - DNA, 382 bp, Heterodera glycines
  Promoter: Source sequence=SeqID_3533; Location=1733..2114; Strand=+; Gene=SeqID_85056
ttcctcctaaattgggggggggggcaaatgtcttggttttgttggaataaattgagaaatttgaggagaatgggagtggcgggtgcgggttttgtgctgattttggtggttggcacgacagcgtcggatgggcaagggaagggattggtggtggacggaggggtggagtgggggcactctccggaaggaagtgagggcaaagccaacttagccaagcgggaaacggattttattccgtttgttcttcaaaaaacgaatttgacattttataaaatttgcgattgtttgcatgaaataatggaaatgaaagtgaaagaaaaataatggaaaaatatttaatgggatcaacagaatgatgagacaaaaagcattttgacagatg

SEQ ID NO: 110082 - DNA, 252 bp, Heterodera glycines
  Promoter: Source sequence=SeqID_16501; Location=2225..2476; Strand=-; Gene=SeqID_80904
catcacaaatgggaaaatgccataactgttcatctcagccctcttagcttttgcattctatgtaaacagctgtttgtcttgtcaggagttggaccgctacggagtctttttgggatgttgcaattcatattaccaccgtgactgctggtagaaataaattaatgaatcgaaaatattcccttttaaaggtacaatagtaatagagacgaatgactgaccaatacacaacaaacaattgactcaatgttaatg

SEQ ID NO: 110083 - DNA, 391 bp, Heterodera glycines
  Promoter: Source sequence=SeqID_9917; Location=1..391; Strand=+; Gene= SeqID_72944
agggcacaaatggaggagggacataaagcctaatgggggagggaggaaaagcagataagccagcgaatgggtaataaagccagatgggtggaaaaaagggagtgaaggagtggataaagcataaagaaaaattgaggaaaagccaaacagagggaggaaacgcggataattcaaggaatgggtaataaagccaaatgaggaaagaaaatagtggcgaagaagtggataaagcataaaaccaaacgagaaaggaaaagcggataaagcaaaaaaaaaaaagggagaaatgaggaaaaacggacaacaccaaaagaggacgaaaagtagaaaaatggaaaaagaaaaaatgggctgccaaaacaaattcttccgcttccaggcacttcacatg

SEQ ID NO: 110084 - DNA, 534 bp, Heterodera glycines
  Promoter: Source sequence=SeqID_8722; Location=2894..3427; Strand=-; Gene=SeqID_68987
taattaatactgttgttctcttatacctaaaaataaattttgaactcatagcggcggtaatataaaagagaaaagcaattcagtaattaggtacctaaacgattttgctcaaactttgtcggaaaactgtggctaggtgatgccaaaataaaatataaacataatgccaacaaaataaattttaaaaattccggttttcgttcggcttattcatttatttgttagctcttgacctaaaaccatcacggtttctttcttaattaatgcttttcgtgtctttttcatatgctttaaattcgattagattggttgactgctaatgactcattttctctttatttttactgcctttaagatcttaaattatttcatgacaatttccgaaaggattaattcctttggtgctaattcgttgcttctccccgtcgttttatggggtccaaaagcgccgaagagccgaattgtgcgcatttcatcggtccaaaatgggcggattattttaacgggtagcattgatggtcaagtgatgcaatg

SEQ ID NO: 110085 - DNA, 531 bp, Heterodera glycines
  Promoter: Source sequence=SeqID_24444; Location=1808..2338; Strand=-; Gene=SeqID_55180
agaaaacaagagaattctaacattccaagaaagtaacaaacgaaaataatcagcaattacttaattaatcaaatcttttttggtaattgcctgaacgctgcgattttatatattttagcttcgtagattttgtgctttcgaatgataccaaaaagatagggtttgttcgaacatgaacaaagttattgtataaaaacccaggattgtcaatcgattggactcataaaatacttttggactcataaaagtcgattggactcataaagtgcattagagccgaaaaatcttagtaattcaccataaaaatttctcgaaaatttttttcttggaattttcttatgaaaaaactctaagattttttttaaaaaaaaatttcggggggaaacgatgcggggaggggggggggaatgaagtgcaccctcctgatacttcgccacctcttctatatcccttttcctcattttatccccctgtttccccccaacagcgctgtcctcatcatccacctcttctgcctcgttggccagcatg

SEQ ID NO: 110086 - DNA, 416 bp, Heterodera glycines
  Promoter: Source sequence=SeqID_16874; Location=1496..1911; Strand=+; Gene=SeqID_81303
tttaatcgattcaacgcaacataccgtaattaaaatgataagggtgaattatttggaatcattaggtgcgtgatcgcaaggaacaaatcaagcagagagccgcaaatcatgcagatgctcccagaaatattaattttttaaaatgacgctcgttgggccttgagcaagccattggaaataaaaaatttatttttgtgtattaattgatgtattgaaaaagttaaatattatgatgaagagaataaaatatcttattcttaaattgataaaatctaatagtaatatttattcaaaattacataaaataaatttaaatgaaatgtagggcaaagccgcaaatgtcgggccgcaaatgtccgattttggcttgggccgcaaaattcagcaaaaaattgggccgcaagtgtccgaaaatg

SEQ ID NO: 110087 - DNA, 253 bp, Heterodera glycines
  Promoter: Source sequence=SeqID_2226; Location=2694..2946; Strand=-; Gene=SeqID_78579
cctggaaaaatagaatttttttcctaaaaaagagatatgaaattattatttttaatggattatattcttattcacgcttttctaagaactttttgtcaaaaaaaaatcctaataaataataatattttggtatttaattgggggctttgtatatatttatttttacgtattctttatttaagcatttttaaagaattttttgaaaatccgaaaagaaattttaaatgctcaaagatcctgagccctaattatg

SEQ ID NO: 110088 - DNA, 192 bp, Heterodera glycines
  Promoter: Source sequence=SeqID_8423; Location=1284..1475; Strand=-; Gene=SeqID_68005
ggtttttactcattccaattacgcatccaatgtcttttaggcgtccaatccgctagtaaagtttatttattgactgaaactgtatatatcaaactaaaacaaaaataggctgtaattccgattgagtcgtattggacgcacaagctagatattgtttttataattgaattttaattttatagttggacgatg

SEQ ID NO: 110089 - DNA, 146 bp, Heterodera glycines
  Promoter: Source sequence=SeqID_30609; Location=831..976; Strand=-; Gene=SeqID_61007
ttttaagaatatttaagagcgacattaaaatttgtaatgcgaaaaatgaccacccataaatttaaaaaaccaaatctattgataaagcagctatttaattatcttctcatcataatcataaaataaaaaatttaatttttcagatg

SEQ ID NO: 110090 - DNA, 63 bp, Heterodera glycines
  Promoter: Source sequence=SeqID_20184; Location=497..559; Strand=+; Gene=SeqID_84978
atcggtaaaattccttctgaggacaatgaagcacattccatttatttgttaggccttttaatg

SEQ ID NO: 110091 - DNA, 274 bp, Heterodera glycines
  Promoter: Source sequence=SeqID_11201; Location=429..702; Strand=-; Gene=SeqID_74553
ttttggcgccgcacgctatatcttttgtcaaacagaatttattttttctaatattttgcaggctaataaagaatacttaggcctatttaatggtatcaaaattattttatttggttggataagaaaaaagttataacactttaaagttcgcggcgccaaaatggcccgcgccaaagtgaccccgacccatgcgccgaaggcgctaaccccgctagtaaaacacaaatgacaagcgtactaatttccaattaatctttttataagcatgaaaatg

SEQ ID NO: 110092 - DNA, 1003 bp, Heterodera glycines
  Promoter: Source sequence=SeqID_25507; Location=1095..2097; Strand=+; Gene=SeqID_56252
actctttcatcaataatcataaataaaaaattaaattaggcgcagtcatttgggcatattattttgcgctctagcagcacaactaccccataaataataagtctacaaagatgcttcttgatggtaaataacgacgacagagcatgataagtcagaagatgtacacaatgtgggtaaataattagtgaaaattagcaaattaactattcattgcccccggcgtctctttcgccgcccattataaaagcgccactttcgctctcagcgacgacaaacgcgcatttttgcggtggccgcggagacggcggggaatgcgcggaatgaatcaatcattggagaaagttcggatcggcagatgagccgaaggatgggaggagtggtgaagagcagccctttgctgtgttcttcgctgatcagtgggatcaaaaatttacaaagaaaggaccaaaaatgggggaagagattcttttctccgatgcttttctcctcctcccgcctaatttgaggcgcttattattaatggaaaatgagctatttgtgcacaaaagaagcacagcaaaaagtctgtctgtgctggaggttccattgatgggaaaaaataatgtcggatcagatcagaacagcagaacgatggtcgaataatttggtggggggggcggctaatctaatgggaaattgttgcttaatcaacagatcgttgctaattgtataactctgatcaatatttaaaattgatgatgccattcgataatcataaatgattatcaattagcctgaatttcaaagaaatttattaaaattcaaaaacctatgagcagaagggttttaatttttgtccaattttttgaaacctaatctttttttttttgaaattttgcagccaaataatgaacccatgtttttgctaatgctaaatctatcgaataattcaagatctaattagttattatgaaaaattttaattataatagaatttagataaccacacaccaccataagaatg

SEQ ID NO: 110093 - DNA, 1003 bp, Heterodera glycines
  Promoter: Source sequence=SeqID_4067; Location=327..1329; Strand=+; Gene=SeqID_53042
ctagtttgcccccccatttttcaaaaaattcaaaaaagtgatataaaacattcttcctagggttttcggggtcgctgatcacgaatccgacatccatttcgaccaatttcgaaccccggacccaattcgaacaaaaaggaaaaaatatttttcaacaaaagtcacatttattgtccaaaattttgcgtacacatcccaaaattttaacatcctctgatgacatattttttaaaatttgggatgtgtaccaggggatggcacggaatcccgatttctgatttccgaaattggtaatactgtcgatggtaccccccccctttttgaaaaagttttttttttgttttcaaaagacataaaagcatgtttcctaggggttaaggggccgctgatcacgaatccgtcatctatttcgaccaatttcgaaccccggacctgaattcgaacaaaagttcgaaaattcaaatttttcgaactttgcatttttagttcaaaaccggttaaatacgcgtaataaaacaggaaattattaatatttgaataaaaaattatttaaaccattttgtatcaaaaatctgaaattcgaaaaattgaattttcgaacttttgttcgaattcaggtccggggttcgaaattggtcgaaatagatgccggattcgtgatcagcggcccctaaacccctaggaaacatgctttcatgtcttgaaaacaaaaaaaaactttttcaaaaaaggggggggggtaccatcgacagtattaccaagttcggtcctggaaaaaagcttgagccttaattacgtgtgatctttttccgagccgtaattcttctttattccattcgggcaattattttgcatttgtgcagaaactcttgttatttctcattgacaaattgtggattttctggcaattaatctgcaaaattttcagctaatccttcctttttcccctcttaaaacaaaaacggcgttatcaatttgcaccaagttttttcggcgcaccatg

SEQ ID NO: 110094 - DNA, 950 bp, Heterodera glycines
  Promoter: Source sequence=SeqID_2046; Location=545..1494; Strand=-; Gene=SeqID_77490
tcagcgcatcctctcggcccaacacctctttccctcattggtagcaccggatggttggtgttgtctgccctttcaggatgacaacgttactgaggatgggagcttcgaacaaaaggaaaatggtggaatgaatatgccgcgcggcgctctcacgagagctatatacggatccgataatttattttgagaaaaaccaaaaaggccaggccaaattaatttattttgagaaaaagaaaggccaaattaattcattatgagaaacaaagaaaggccaaactaatttattttgaaaacgcaaaaaaaaaaaaagaaaaaagaggcaaggcccaaattatttaacaacataaagaaaggccaacttcaaattttaagcatgtcttaggcaaaccaaattcaaatggaagcaaaatctaaatgttggcatgcaaatttacatattacgcccatattcatatgacattttaacgaaaatttttttttgcctttcaacggccattacaatcattcgctcgccattcctttctcaccgtaggcagtcataagagaaaaattttacataatcgctgttcacaatcataagcaagccaagcgaacaaaaagcattagcggcctacattaagcatttctcacgctttaaattttacaaatttgcgattatttctcgcttccgctcatttcttagcgccattagcgcttgatcagattaactgttgaaaggattaactgaaagggagaaagcaaataaaaaacagatgaaccatacatagccagccattcatttgcttcagcttactaacattaacaaaggctaaacatttaactaattgctctctcattcaagcaaatcaaagacattggacaacccagcgttcttctcacattcctcccaattttctttatttttcccaaatttttatctttttggcttttgagccacatatacgaaaatg

SEQ ID NO: 110095 - DNA, 176 bp, Heterodera glycines
  Promoter: Source sequence=SeqID_13217; Location=2217..2392; Strand=-; Gene=SeqID_77045
aatctcttcgtgccgctggactttctttcctgactttgaatgtttttccgcttttggacgtgccccgctgtgttttgcttggcgctgctttccattgcatttcttatcttctccgagtttttcgctgttttcatagctctgccgactccaatcgtccgattggatggcgcctcatg

SEQ ID NO: 110096 - DNA, 914 bp, Heterodera glycines
  Promoter: Source sequence=SeqID_12999; Location=737..1650; Strand=-; Gene=SeqID_76770
agagttcgccgacattcatgcctttgtccaaaatcgggcctcaaacttaagttttttcaatccctgatcgcctaaacagctttaaaacaacttataatcctattaaattactaatttgtgagtattaaattcatgaatgtaacaattaaaattgtttaattttaatcgtaaatttaaaaaatttgacacaatttcttccattagataattcagctgataaagaaaaaaacatatgaaaataaattcttccgcaattaacccacttttctgtcattgttttgtactttaaaacaatcagcgaaatcgacgccatctctgaaatgtgtagcagagagctttcgcgcaaatctcacatttattctacaattttttgtatttaatttttatttcaacaaatttttaccaactttcaaaagtgtcgagaaaaaaattcttgaatcggttggataagatttttctcaagtcaaaccttttaagacttttttaaaatcaaccggattttttatatatattttgtattttgaattctttttgcgttttttcccgtatatattcgctatttttttaaaggcttttttaaggaaattttttgaaatgtccaaaaaatcaaaattttttcaaatatattttcatttttttttaatatattttgagattttgagattaattataaattcttgaacaaaaattcaaaagaatttttttgaaaaataatcctcctaaaaatcagtctcaaaataattttttaaataaataaattgttattttaagctgttttgttcctttttataatattttattccttattcacccttttctaataaattttgtccaaaaaagataatttaaaaaaattttatttacatatccagacatattaataacatttttttaaatttaagcgcactgacatg

SEQ ID NO: 110097 - DNA, 987 bp, Heterodera glycines
  Promoter: Source sequence=SeqID_37274; Location=1..987; Strand=+; Gene=SeqID_66379
aaataataaaatatgtaagaatttgctatttgacatttgatttggttatgttttttgtcaaattgcaacgagtgggaattgaataatctaaatcctttatctatttattattttatagcttggatttcgaaattctcatatttaataaggtaaatattatacatttctatttatttctccaaaaaaaaaattgcattgctttcgaattttattatttttagaattatatctttagggattaactggctttttcaagaatttttgaataactatacaatcgataaacagtcattatagttatatgttctaattgcaatattttctatacactgacggaataaaattcacaatttaattttcaattaacttttatattgaataacaaatattcagaaaatgagacaaaaaataaaattataaaaaattaattaaaaataatttaatattttacatacttttttcgtcaaaatattaaaatatggtaatataagataattatcattgaaaatatatccacgaaaataaatcctgttcaataataaataaaaaatgtaattaaaaagacctaataaaaaataatattctaattttttcaatcaattataccaaataaaactatttacaaaattaattagttcaaaagaaactcattatttaataaatttattttttttataacttatattcacaaataattttttgtttttcaaaagctattttagaatgaataataatagacaatttaaataaaatttaaagatgaattaataatgaaaatacgcactgtcataataaattatttgtttaatttattttctagaaaggtcattttttctctattcatagccattttcgatgatctaattaaccgacgattttatcattcgaatcaaattaaattgcttctgagatgataaggattatcatataatttcagtttatgaataaaccctcaattattggtatgaacgatactttcctaacatg

SEQ ID NO: 110098 - DNA, 442 bp, Heterodera glycines
  misc_feature (15)..(15): n is a, c, g, or t
  misc_feature (23)..(23): n is a, c, g, or t
  misc_feature (54)..(54): n is a, c, g, or t
  misc_feature (91)..(91): n is a, c, g, or t
  misc_feature (289)..(289): n is a, c, g, or t
  Promoter: Source sequence=SeqID_5040; Location=1113..1554; Strand=-; Gene=SeqID_56686
tgtggagggtatgtnttggacgnggcggaggacaatagcgccaaatcagttganaataatgaatcactatttcccagtaacaaccaaccanaaattaaatatttttggtggatttgattagtttagccttacgtgttcaatattgtttatttgccagtaaaattttgaaaaattttttattaaccaacaaaaagtttttttaacagattttcattagaaattgttaattcattaaccttgcctcaacttagggttaaggactttccaaggacgggtataattattattntaagtttttatcaaatttattatattttaataaaattttaaataaaaaaattgtttgtttatttttggatgatttcagacacgccaaaggggcaacggacgcgaagcggcactgctccggggaagtcgcgtcggctcgcacctgtcaacaatg

SEQ ID NO: 110099 - DNA, 119 bp, Heterodera glycines
  Promoter: Source sequence=SeqID_1554; Location=300..418; Strand=+; Gene=SeqID_74443
ggtgcttctcatattatttttaatcaaattttgaaaaaaaaaattcatgaaattgttcggtccgtaaatttcagggcctcggttttttttctaaaatttttggtttttcaggtgccatg

SEQ ID NO: 110100 - DNA, 573 bp, Heterodera glycines
  Promoter: Source sequence=SeqID_17089; Location=1795..2367; Strand=-; Gene=SeqID_81520
aattaaaaaaataataataaaatacaaaattatttaaaataatgctcaattcgcgctaaataatgaactatttctgtttttttgtctgcttctctcttttcgctctctctcttctgaaaattttttgacatttttaaaatgagtgatcgaaaaaatattttcttgccatttttcagggtgttttattaaaattcatcaaagaaatattaatgaaaaaaataagtacaatacgtatcatttcatttcatttattttctttttttttaatttctttcattgcatttgcaaaaatctttaaattattttcatttttgccaaaaactaataaaattttattgataaatggcatttatttgttatgtttatttaaaattcacatataaaatcccctccacaacaaaatccagtaaatttactagaacctccggaatttttaaattgccggtgccgggacttggaaaatggacccgggtgggatcctgggaccgggactcccgtttttccgggactcccggtcccggtggtttgtccaaaaataacgggaccgggaaaaattttcacatttagcaaatg

SEQ ID NO: 110101 - DNA, 1003 bp, Heterodera glycines
  Promoter: Source sequence=SeqID_21046; Location=947..1949; Strand=+; Gene=SeqID_51635
atggggggaaacgaaattatctacttatatatttcaaatattaaagctttttgattatcatgtgtgtgtattagggttgagcagtactggtacctgtaccggccggtaattacagggtttttttggtaccggtaccggttttttcaaaaatcaaagtaccggtaccggtttgtctagtaccggtaccgccggtaaaaatttgcactggtaagatttgtgagaacttaaatctttaaattgattttttattttaatttattagaatttttgatttcatattaaacggtaaaaaaattgaaatttttaaggagtttttattttaatttaaaattttattctgtaaaataaaaatttggaacttttaggttttagtttttttaattaattttattgtctgtcatttgaaataaaatattctaatttttttttttcattttaaacagcctagaaatcgaaaaagtaaccaaagatttggtcatttttttgtaaaaaacaacgtgaaaactgaataaaaattttgtatttgaaaaattttgtccaaaaatttttacgttggaaaattaccggtttttaccggtaccggtggaaaaatttggtaccggtaccggtttttgcattaccggtcagtaccggtaccggtggaaaaagttggtactggtaccggtttttgcattaccggtcagtagcggtaccggtggaaaaagttggtaccggtaccggtttttgcattaccggtcagtaccgtaccggttttttaaaaattaccgctcaactaaagtgtgtacacatgaatagaataaacaaaaaagaactacaaattttttgtgtctgtcgccaattttctcattggcgacgagaaggcgggtgccaacccgccacggcgtgcgcgagtgctcgcgttcaaccagggcacggacgggcagcgaatcgggaaagaacttgacacagacgaggaggaccgttacggggagtccgttttctcgggaccaagcacgagcacatg

SEQ ID NO: 110102 - DNA, 71 bp, Heterodera glycines
  Promoter: Source sequence=SeqID_6705; Location=513..583; Strand=+; Gene=SeqID_62567
ggtgtgattggaagaaatggttttcattggctattgagataacaaaattcagttctccgctcgccaaaatg

SEQ ID NO: 110103 - DNA, 161 bp, Heterodera glycines
  Promoter: Source sequence=SeqID_21360; Location=2291..2451; Strand=-; Gene=SeqID_51964
atcctttgcttcttccctttggctgtcagtgattgcagtgtccaccaccaaatcaaagcaatggataaaaccaaaagccccaaaagccccccccccactcatcgatcacttctcatgtgtcaatttccctttgctttccaatcacaccgcttaaagggatg

SEQ ID NO: 110104 - DNA, 197 bp, Heterodera glycines
  Promoter: Source sequence=SeqID_1614; Location=1..197; Strand=+; Gene= SeqID_46957
gagaggtgttttttctctggcactctccctttattggttcatctctcgttttttgaaacgctgtctaagtgtataaatatgcaaaaatttgcagtcaatgcatcattattttcttcacttacaaattctgccttctgtgactgttgttcgcctcccctttgctcatctgtgacgacgacacttcgtgaacgaacatg

SEQ ID NO: 110105 - DNA, 715 bp, Heterodera glycines
  Promoter: Source sequence=SeqID_6079; Location=1..715; Strand=+; Gene= SeqID_60236
agattttgtaaaatcactgattttatctttgatttttcatcaagtacttgatttttcaaaatttttaaaatcttctttacaagaatttgtggtgaaaaaatgttctaatcatgaatatgaactcagattttacaaaagccatcagtttgtctatgattttcatcaattttcacaaaagaataaactgctgccaagcgggctcgaaccccagaccccgtctcacatgacccgtaagggcttcgtaattaaatttcaaaaaatcgtaaaaaacaaaaaacaacttctccaaacattcaatagctcattcgaaagctctttttgagctctacaaattctgtatatgagttttttacgcccgattaatttttcttatttctatcgggaccgcaattctacacctttgtcgatatctgatattctatgatcctctcaatgtttacatcgatgaattttttgtggagctcgattctcttgtactaccgttttttcaaaataagaaaaaggctaaatctggatttaaccacaaaaaagacaaaaaattggcacattatacactttgaaaattgataacattaaaaaaatttccaacactcaaaaataaggacagtcttattgttagaagttagggtatttaaatttctgattcgggccatccaaccaatactaatcttggatttagttattacatttacaagccctgaatccagtgaaaatg

SEQ ID NO: 110106 - DNA, 396 bp, Heterodera glycines
  Promoter: Source sequence=SeqID_4485; Location=2803..3198; Strand=-; Gene=SeqID_54626
atttagaatttctatttttataataattaattttgaatattccatgagagttaatccataaaaacattcaaatcccatttaatccaaaccaatttatatacagaaatttgtactcataacaattttttgtttcgatttttgatttttcgatttaaaaaattttctttttttatttttattccgtgccgaatttctttttcatttcttttgagaatatttcaggatgaagcaatttaacgtattttaggctcatttcgacgtcacagaagagcattttcacttttaaatgtggctttagtaattttactggcacttttggtcacggtttttgtaattactctcggatttatatttttccatgcgcgaatcaaccaattttttaatcgggcgccaatg

SEQ ID NO: 110107 - DNA, 478 bp, Heterodera glycines
  Promoter: Source sequence=SeqID_26917; Location=751..1228; Strand=-; Gene=SeqID_57654
tgcatcccgaccccgccccgaccccgaaccccgacatttttggccattttcggggtttaccccgacccgaacccggacgcttccaaccccgacgaccccgaacccctaccctaaccccgactcgggtcggggttaaatatacgtcaattagtcacgcgtttttccattatgaaatcaattagtgatggcatgaataaacttggcaattgtttagttatgagttaattaagaaaataacgctttttgtttttctattttccttcatgtcttttattcttttcacatgtaaacaaatcatttgaataaacaacgtttctctgaccttaaaaatattgatcatggaattgcatttgcatctttttaaaatgttttccacatttttaattatcaaaactttttctttgaaaatttgttttgttttttattgtcaaagttttttaataaaatattttttttaattaaaagcacataatcaatg

SEQ ID NO: 110108 - DNA, 505 bp, Heterodera glycines
  Promoter: Source sequence=SeqID_33478; Location=511..1015; Strand=-; Gene=SeqID_63531
attcttaatggtgtattttcagaaattttttcaattcttagggatgttttttttgaaaattttccaggttatttcttaggtgtgtattttcccgattttattccatttttaatggaattttccggaaaaaaatgccaaaaaaggcaccaaaatcgaaaaaaaaacgcctaaaaaggcatttaaggcacgaaaatcccgaaaaagacaaaaaaaaggcataataaaagtcaacgtagaagcctcaaagcaagtggaaaatgtgttagttatgcttaatatatcgaaactagtgagcagaaaaaaaggcttatgcctcaaaatgcggtctctaatcataatgtagattcaatcaattatatttttttcatttaacaataatatattttttaaatcctcctttcttctttgcgcagatgatatcgaaaagattgaagaggatttgcataatgaatatgatcagcaaataaaaccgaacacgtggtactcgaacgttgagcaacgaatg

SEQ ID NO: 110109 - DNA, 135 bp, Heterodera glycines
  Promoter: Source sequence=SeqID_5524; Location=924..1058; Strand=-; Gene=SeqID_58337
ttttacaatataattaactaattgaatttcaaaaaataaaattaaatttttattaaaaaatgaaaatgacaaacttagagaaagtgcataaaaagcgtcagcagaaagtgccaacacaaacaaaaatgccaaatg

SEQ ID NO: 110110 - DNA, 247 bp, Heterodera glycines
  Promoter: Source sequence=SeqID_24765; Location=917..1163; Strand=-; Gene=SeqID_55501
ctttcgtcactttgtcctggtcttcttttattatgtccttttatttgtatcttcccagcaaaatgatcactttcaggactttgtcaatggcataatgcatgatgtccttggaatcgaatcttaacttaagcctgatcgccgtcctaattctgtcactcggttgtgttaatgcctctaggtcgtctaagacccactgactgccttcaccaattgcgtattgaacttcgaaactatattcctcgtcatg

SEQ ID NO: 110111 - DNA, 1003 bp, Heterodera glycines
  misc_feature (192)..(192): n is a, c, g, or t
  Promoter: Source sequence=SeqID_17531; Location=783..1785; Strand=+; Gene=SeqID_82034
tggctaatagtgggcgggtgggggggggggcaatttgtccccaatggagggttaattaaattctttaccatgccaaccccgcaaaatgctccttaaaattcccgcggcccacccacacctttcgcggggggctataaatttgcagacaatgttctcggtgatcaacatcatcatccatccattattgtcatntagggcatcgaattatatgcacatgtctgtcaattttggcatttttcaaaaaaaaaccctctcgattaaagcagctctttggaccctaatgagcgaacaattaaaaaaaaaaaatttaatttcatgtaattttctcaataatattagtaaaaaatttgcctttctaaaaaataggcaaaatataccaaaaaaaaagtccaaaaatgaaaaaaattcgattttttttatacacaatctcttatattaaaaatttttagctttatttttttattttcatctaaataatatcacaccaactattttcgatttttgtattttcttacattaacgaatttaaagtttggccgtcaatttggaaaatttatatgcatattttttactttttatatgcatatttggcaatttttcatgcatataattgtgtgtcctaattatcattatccatatttccggaggccaaaaaatagtgaattcgtaaagaaaaaatctgcccaacctggaagccagaatttcagacaaaaaaacgcaccgggaccaaccgaaatcctccgcaatactgaaccacccctggatatatttaggccatttcttttcaccttaccccctagaaaatttcaaaagcacaattttttggctacccaaccctcccagggatgtcatttattttacagcgcggaaccctatggaattttccggatttttttttggccggggggaggggaggcgagggtttggctagaaattcatcagcatccaacaaataaatttgcaaaaaaatcccgggccgcaggtatatatttttccaaaaatg

SEQ ID NO: 110112 - DNA, 654 bp, Heterodera glycines
  Promoter: Source sequence=SeqID_42320; Location=98..751; Strand=-; Gene=SeqID_70236
cctgaaaatgttttaagatcaccgttttggtagctgatcagcagttttttgatcaaaaaataggccaaatgatcagcctgaccataacatcgtccgtaatcactaattaggaccgagccatacaaattacataggtcaatcaatcaatgtatgtatgacctaatgtaccggtcataagactaaagtggaaatttttgagaggttattaaagttagggggtgagagtgatgagtgagcatggtccagcataaagggaggggccaaaaaaatgacaaaaaatcttgcaaagtaaccaaatttttaattcttgataacagtcgatagctctaaatgttctctgttaggttgcaaaatttcaaaaaaattttaatgggagaggaactcaaaaaaccagctttttcgaaatttttcaacttaacgaaattttttgaaatttggcaggataatagagaaaatttaagtctataaaatgatattagggattaaaacggtaacttttttgtaaaattataagcaaacattttcatttggtggttttttgaggaataccaatttgatgtttttgagtaacgtcacaaaacgactgtcattcgaaacatttaaaaaaaaaatttattccataaacaaataatattatagaatgacgaggcgatg

SEQ ID NO: 110113 - DNA, 269 bp, Heterodera glycines
  misc_feature (16)..(16): n is a, c, g, or t
  Promoter: Source sequence=SeqID_13898; Location=1..269; Strand=+; Gene=SeqID_77848
aaatatagatttatantggtctaaaaaccttcagtaaaccctaaaattttaacctagaaaagcttttttagtccctttcttcgtaacatataagcaaaaaaaaaagtaaaaccatacaatttataattctatttataatgtccggttttggccgtaacgatcattgtcgctgtccaagagcagcatataaaagtgtggctgcaataattagtgtcctccgcccgctaccttcctttggttctatgttaaatgagcttatattaaagatg

SEQ ID NO: 110114 - DNA, 67 bp, Heterodera glycines
  Promoter: Source sequence=SeqID_749; Location=1018..1084; Strand=-; Gene=SeqID_60391
ggtgtgttttaattcggactttcctttccattctttactatttccaggcccaaaaactcgtgccatg

SEQ ID NO: 110115 - DNA, 261 bp, Heterodera glycines
  Promoter: Source sequence=SeqID_840; Location=4234..4494; Strand=-; Gene=SeqID_62546
tcttgtacacttaaacaaatgcgctttttcatatggagcaagcttctatttcggaacagaggacaaaaaatcgccggaagcgagtttttggatcataacttttttttcttttgagaaccataaaaaggtataaacattcatagtaacactgatgtgtcggaatgccgatttcctataatttttgggctcggacttacgatttccgaaattttttgagtccaccggaattccgattgccaaaattttttagtcgtcagaatg

SEQ ID NO: 110116 - DNA, 426 bp, Heterodera glycines
  Promoter: Source sequence=SeqID_38413; Location=689..1114; Strand=-; Gene=SeqID_67230
aagaatggtttggaataagaaaacaagtccaacatgtacttctagtgaaaggaacggaatttgaatggatttgctaattctgtaaattttgagattaacttttatcgggcgctggcgcccagaataggcacttgaatttcccaaggttcgttcgtgaattgttattgatcatttaaattaatcaataaaatgctaatttgacgaaatataatccttaatttaaatttcaaatgtaaagaaaagtttttgtttcgcttcgcgtttcggaaagcggagtttgaaagttgggaatgctgaattacctaggtattttttcacgagaatagcccaataattgaagtttgaggcctcgatcattcatcaattactaattaagcaaatgccttcagattttgtttaatctttggaaatgtcgccgtgcgaatg

SEQ ID NO: 110117 - DNA, 82 bp, Heterodera glycines
  Promoter: Source sequence=SeqID_40561; Location=1..82; Strand=+; Gene= SeqID_68854
ggaatcccggaaggtcgtcgaagacccactggcaaccttcaccaagtggttgctgaacttcgaaacggaagtcctcggcatg

SEQ ID NO: 110118 - DNA, 231 bp, Heterodera glycines
  Promoter: Source sequence=SeqID_14959; Location=1..231; Strand=+; Gene=SeqID_79118
tgattcagtgggaaaaagtttcttcggatgttcgggtatcttcgcttaaaattggacttggcttccaaattataagacaaatgaaagaataaattcacatttagaccaattaaattttattgtaccaaatgaaattaaaattttattttttttaaagattaaaaaacattttcaaggcaaattggacttcgttcaccacttcgattgccgaaattgaaaaatgttcagatg

SEQ ID NO: 110119 - DNA, 124 bp, Heterodera glycines
  Promoter: Source sequence=SeqID_18682; Location=920..1043; Strand=-; Gene=SeqID_83349
aaaaaaaaaacataaaatcaaaaatttgacatcagatcactgaattacggaaatggaattaggccccacccaagttgcgttttgttaattgtgttattttcagggtggggttggcccgaggatg

SEQ ID NO: 110120 - DNA, 1003 bp, Heterodera glycines
  Promoter: Source sequence=SeqID_3325; Location=1845..2847; Strand=-; Gene=SeqID_84222
atgtgtgacgcatagttttaaatgaaatgaaaaaagagcatcaaaagcgatgatggcaaaggcaaaaagcattttgtacccccggggcatttgaccccccccccaccctatttaattgttgggaagccgatcgccgcaacacagaggttgatgagggttctaattcccttccagtctaccattttttatagagttgagcgggaccgggaattttgggcaaacccgggaccgggaccttttcgggttgaaaaaccgggaatttttggctgggaaaaccgggaaaaaaccgggactagtcccggtcccggtcaaaaccgggacttcggtactcagttgtccgtgttcaggtcccggtcccgctcaactctaattttttacaatattttccaggaaatcatattgaatgttttgtgttttgtttggtttcctctctctggtatcacttgctgatagtccgttagagcagcagggcttcgggttcggtctagacaattttcaagaatttggcggtttttggatttcttcggaattttttagtattcagatagtttagtgcctagccctcatttttaaattttccatgtttttatgcacagacaagagaccggcccgtccatcggcattctttaatatttttcgggctttaaaaaaatcgatcgagcaaaaatttgagtttttcattttcgaagtgatcaagccatttggggtcctccggtctttaattgacagggacaaatgctttaatgataccaaggagcatatattagaggtaagcagcagaagagagtaaagatggggcccaattggtcctggggcccaccgcaccggtgactgtgcaaagcgatcaaaaactgaaggaatgggaggggagggggaatgaatggaagttggaacagcaccaccaccaccacaaaatcaacacagcaaccaaccaactcgtttgtttgctgattgatgatgataaaaatgcataattaaggcatactaaatatgtataattatg

SEQ ID NO: 110121 - DNA, 120 bp, Heterodera glycines
  Promoter: Source sequence=SeqID_1274; Location=4640..4759; Strand=+; Gene=SeqID_71246
aaggcatttaaattgaaaaattaaccaattatttaattaatttaaaaaatcaaatattagcaaaacgcactccccgtccagcggaggagcgtcctcttcctggcccggcacacaaacatg

SEQ ID NO: 110122 - DNA, 454 bp, Heterodera glycines
  misc_feature (43)..(43): n is a, c, g, or t
  Promoter: Source sequence=SeqID_5911; Location=1491..1944; Strand=-; Gene=SeqID_59647
aaaaagaataaagccgcagatttcctcgcacggtacaatatcncaggaaccgaagacgaaatagaaataaatttaagtgaaaagaaaaacaaaaaagaaaataaagcgcaaaaaattctgagtactgagaatagtgaaagcaaaaaagaaaatcaggacaatagcaacaaaataactttaaaagaaataattgaagaacagcggcaagtaaaggaattagcaaaatttttttatattttaaaaactggaaaatatcccaatgaaattttgaaatggaaaaaggtaatttggaatactgcctgataaacggcgcgatttataaccaaaaagggacagagaattctgaaaatccaaaattaatcatacctcactcattaagaaaaagaattttttgtgaaatacacgacaaaggacattttggatttgaaaaagcagattttattgggtcggaatg

SEQ ID NO: 110123 - DNA, 174 bp, Heterodera glycines
  Promoter: Source sequence=SeqID_5827; Location=3006..3179; Strand=+; Gene=SeqID_59356
atttaatttattaattgttgaattccctaattagccaaaaagtacaatatccctggccttattcgtccatctttgcaaattcccatctccgaattgcgcaatgttttctttgcgtatgcccaagctctccttttcgacttggaggtgagaaaaacaaatttatttttaataatg

SEQ ID NO: 110124 - DNA, 53 bp, Heterodera glycines
  Promoter: Source sequence=SeqID_19556; Location=350..402; Strand=+; Gene=SeqID_84286
tgtataaaaaaaatagagcaatttagcgtaatttttaaaatgttttagcaatg

SEQ ID NO: 110125 - DNA, 52 bp, Heterodera glycines
  Promoter: Source sequence=SeqID_14185; Location=1251..1302; Strand=-; Gene=SeqID_78201
atcaattttgtttgttttttaaatttactcaaaaaaattttagaataatatg

SEQ ID NO: 110126 - DNA, 966 bp, Heterodera glycines
  Promoter: Source sequence=SeqID_2653; Location=1..966; Strand=+; Gene= SeqID_80907
tggaaatttcaaccaaacctttccacgaaaatgtctctcttcaccaattcgtacacttaaacattgtcctttccctagttttctgtcaaataatcatctgtccaaaggcgaagtggcggccaatcattctcagaaagaaaattgcgtaagacaaatggatgcatatgaagaaataaaataagcaaagcaaggctagtcaacgaaaataattcttaggcgtctatttcgtgattttcggaaaaatccttagcaaaaaatgcaacaaagacgaaaatatagccctaagaaacttgaaaaactttcagaaaatacacccaatgaaaaactcaaaaattcatcactctattcatttttacaaatgccaaataattgatttggatgttggaacatttggacttttatattctttttaaaaacggattgaataaacggaaagatggtttactgtaactcaatcttttcactttctgacagttggtaaattattacttatttgactcgttgcttgtcattattcattgttgattttcacttactcttctgaattttttaaattctccaaccattcccgacaaattctgtagggaaatttcctctatgatcccttaattgtacttggagcccaaaattgaatcgccgtgtttgaatacttttaagaaattatgaagcgttgaagttgtcatgttttttttatattcctttaaactgcaatagtgccaaatctgacattaaattctgcttattcttcctcatccttaacccggattagaacgaagatttaaattttctaaaattcataaataatactccaaattgatttcaaaaatttcgactacatacagtcgaatccgggttacggatgcggaattgactttaaatcttcttatcttcaacaagcgacctagtctgcatcctaaatgtaataaatgctacttagaaattttttagagtaaataagcaaaaatg

SEQ ID NO: 110127 - DNA, 51 bp, Heterodera glycines
  Promoter: Source sequence=SeqID_18609; Location=2900..2950; Strand=-; Gene=SeqID_83260
tatcgacgggtcgctcgaattgattgctgacgttgaactctactcaacatg

SEQ ID NO: 110128 - DNA, 429 bp, Heterodera glycines
  Promoter: Source sequence=SeqID_24025; Location=730..1158; Strand=-; Gene=SeqID_54728
tttgccctctaatttgggttcattaacactctttaatcgttcctcttttacactttcaattttattctctttttgttcatttcatttagtacattttctattaatgaatattatttttgttcgtttttatttttataaattaaatttattcattcgcttttttatctcttttccatcagtggatttgcacagtttttacatttgtcatcgctaacactttccgcttctatcaaaaacccatccggcaaaaatcggctctgattttgctaatgaatcatttatcgtccattataatgaataaaataaaggatgcaaaaaaataattatgttaattcaatactaaattatcgaaaatattgataaataaataaataatattggaattgaaaaatgaagaatttaaaaaatatacagtaatcacgataaatg

SEQ ID NO: 110129 - DNA, 708 bp, Heterodera glycines
  Promoter: Source sequence=SeqID_13640; Location=1260..1967; Strand=-; Gene=SeqID_77543
catcaaacaaaatatggccaacaatcgaagagcaaacgatgctaaagcaaatgaaagcccataaaatatcaaataattttgttaggcttggaaatgaaagaaggattatgtattattaaaattattaaattatcaattttttagtaaaaaaaaattcgaatataaaaaaagtgggaatttgttttttacgccaaagagaaaaaacattaaaaacaggcgggcaagtagcgccgaaaaaaagtcaaaatattttcattttttataactttttttttgcaggtagtcaaatctttgtgaatctggatatgctaatagagtttttatcttttaagattttctatgaacaaaagaagtgaagttttacgattataccgacgcataattcgcctttcaaaggattgggtggcccaagaaccgacgaacacaaacgaagaacaaaaatacatcagagaagaggcccaaaaagggttcaaagcgtacaaaaacgtaattaaagagaaataaagactaaaaaacccaatcgtatcatcttaaggagaaggaccctgaaaagattagtgaattgctgaaggaagccgaaaagcgtctggaaatcgcctgtcattaccaaattccctacgaccgtcccttttatttgcctcctcgttcttccttcggtcggttttagtccgtttttggaattgagcatcgctttttgcccgtcagatg

SEQ ID NO: 110130 - DNA, 280 bp, Heterodera glycines
  Promoter: Source sequence=SeqID_20653; Location=1281..1560; Strand=-; Gene=SeqID_51209
tcttacgcacaaagaattgtaaaagaaacaaaaacaaataagtaaacactcgccttaatttttaattaaacaataaaaaatgaaacaacaaatgtttaattttttgtgaggatactcacctcacatcaaataaattttgttagacaaaaaatgagatgacatgcaaattcgtgaagcgttccaaaatttacttcgtgacgtttaacttttttcctgcacgttaaatccacaccaaaatcttgtcgaaacggaatgggcgaaaacaatttgccaaacaatg

SEQ ID NO: 110131 - DNA, 95 bp, Heterodera glycines
  Promoter: Source sequence=SeqID_40424; Location=1020..1114; Strand=-; Gene=SeqID_68766
ttttgttcttattttaggattaatttgtttttgtttggctaaaatagccaggtcttataggcaaattttaatctatatttgcgtagcttcagatg

SEQ ID NO: 110132 - DNA, 233 bp, Heterodera glycines
  Promoter: Source sequence=SeqID_8947; Location=1490..1722; Strand=-; Gene=SeqID_69766
attttacaacgttttcccatttgccccaacaaattaactgatttatggtgaagctggagcaaaatgagtgcagcagaattagaagttggttgccgaaacatttgttgagcaagaattcggaatgtataaaaaggcaatttaaaaaaaagtgaattctataaaatataaataaaattattttttattatttttattaatttcaaaaattaatttgaaggtcagtcattaaaatg

SEQ ID NO: 110133 - DNA, 188 bp, Heterodera glycines
  misc_feature (2)..(2): n is a, c, g, or t
  Promoter: Source sequence=SeqID_19982; Location=2196..2383; Strand=-; Gene=SeqID_47623
tngatttttaaaaattttaatcgattttttctgttattttaaaaaagtttatggttcaatcttaatccaccatgctaacaggataaaaaggttctaatgtgatacacatttcaatacgtttctttgtaagtttgttatattcttcaaatctcttgctttgaggtacaattgttggcggcatcgatatg

SEQ ID NO: 110134 - DNA, 414 bp, Heterodera glycines
  Promoter: Source sequence=SeqID_28027; Location=1..414; Strand=+; Gene=SeqID_58686
agtacagtttaatttttccggcaaaagttgaacaggaccctcaaaattatttcaaatcttagaaaacacttaccagtttccgaacaaagtgccaaaatttccgtttatcgaaattttctgaaaatgggaattctgggctaagaattttgccggaaatcatcaattggaaatcggcattccttcacatccctggttagcaccacagacccatgaattttacaagcaattaagtaaaatcacgttcaaattttcagaaaatttactggcctgggtatttttctctcaaaagtctaagaataagtattaaatggctaacttatcaaatgaaaataaacgcaaaaataaatcaggcttttaataaattttttgtacgtggaatgaataagtgttttaacagacaaattaaataaaatg

SEQ ID NO: 110135 - DNA, 390 bp, Heterodera glycines
  Promoter: Source sequence=SeqID_3909; Location=20..409; Strand=+; Gene=SeqID_52380
aaaatggcacaaatgattcatcagcaaattgcaaattgtaaagaaaatcagttcagttctgcatcttactgataattttgagttctattgtaaattgaacaaaagaagaccattcggtgtccatgcgccagagccctcaacgttttgggaaggaaagttgaaattgaccggtcaatggcaattgcaactgagacggcttaactcaccattaaaacttctaatcactagcgcggaaagcgtaaaggcgaaatgggcagtcatagggattttgtcatgagaggcacttaacgaaagaggacaatgccaacaaatgcccaaaattgtactttctccattgatttggtcatcacctccatttaggttgaagtcactgagttgtgtgtgaatatg

SEQ ID NO: 110136 - DNA, 374 bp, Heterodera glycines
  Promoter: Source sequence=SeqID_3202; Location=2906..3279; Strand=-; Gene=SeqID_83671
tcgcagtgttttttcaatttttttgtgatcaatggcagaaaaaaacaaaaataattatttaaattaaataaattttccgtgttgtccaactaaattttgattttttatctttaaacgggtcaaatttggtttaaaatagtacaagataaagaatatcagaaatagttgatagtaaagaattttgtattacaaaaaatgaattaaaaaaaaatttaatttaatttaatggacatttaaaaagtgaatgaaaaaatattaaaaaataaaacaaattaaattgggaataattaaaattgttttgcattcacttttcaactcacaacaacaaaaacaacattaacaacaaataaaaaataatctctcgcgcaaaaatg

SEQ ID NO: 110137 - DNA, 513 bp, Heterodera glycines
  Promoter: Source sequence=SeqID_9712; Location=2483..2995; Strand=-; Gene=SeqID_72452
tgtattttttttctctgtaagaaaggtttaatatttacctaaatgcctctaatgagggcataaaaatgacctaatccgttgccaataaggctgcaaaatttaatataattattttttagctcatagctaattgacttaattaatactaagaattttttcattttataagcgtcaaacaacgtcataaaaaacacattaactaatgttcatttttactaatatattcagtaattaatttaaatttaattaattaatttacaataattgatttaatgtggcctgtatgtgttaagcaattaatacaggtgattatttttaattaagactttaattttaaattagattgcactcttataattccatacaaatttagttggatttttgttcctcatttcaccgacatttatgtgcccgttaattgtaatttttattcatctcgaaattttagctaagccattcttagcacctttattccatcaattatacaccaattaccacgattagtaacccatg

SEQ ID NO: 110138 - DNA, 506 bp, Heterodera glycines
  misc_feature (44)..(44): n is a, c, g, or t
  Promoter: Source sequence=SeqID_41282; Location=1..506; Strand=+; Gene=SeqID_69449
caaagatgaattgatgatttatgtttatggctgatcatgagcanaaaacaccccacaaaaaaagacagtgatcaatttaattttgaattaacgaaaatatactttttttggcgttttgaatttctaacaccggacggagtgtgccgatcccacaaattttattcttcgacgggatcccgttccgcttggttttgtgttctaccccatggctggatcccaagcagaacaaaccctactttattgttttattcggtgtttttttttattttaatgttttcgttaatagaagctttaaaaattttcatttgacattcaaaaacataattttgtcaaataaaaaaaacaggtattcaaagtcattatggcggatgtttggcctaagacggttccaaaagagcagcaccctttttacatcctccaccccgagcctattcgaatctctccgctgctccgatttgctcgttggtcggccctcggcctaggcattgtgtgagtaaaaaacaatg

SEQ ID NO: 110139 - DNA, 241 bp, Heterodera glycines
  Promoter: Source sequence=SeqID_7130; Location=4888..5128; Strand=-; Gene=SeqID_63927
cagccttgaggaagagcaccgattggtgaacactgttcgctcgttgatccgcattaagaatccgaatgatcgactctgtttggccagagctgtgttgctaggtcttcacgattggcgttcacggtcaccaggcggaggcggaccgacagcattcaaaagtttcgcaaatcgccagcacacccacgggcctgaggcacgtaacttattgagacgtgccgcaattccccgcaacaaacacatg

SEQ ID NO: 110140 - DNA, 1003 bp, Heterodera glycines
  Promoter: Source sequence=SeqID_12929; Location=192..1194; Strand=-; Gene=SeqID_76676
tacagtgtaattaattggtaaattaattaatgtcactcccctctttttcgtcataattctagaaaataaccaaacaaattttagaactgaagaaatagtacttatttcaagttagacagacagcaaaagaaataatggccgccgtgcaattataacaaatcagaacatgaaaaaccagaattcgcagaattaaccagaataatttcagaactgttaaaaaaatcaataaaatatcagaattattgcagaaattaccagaaaaaataccagaactgttttaaaacacactagaacattctagaaattaaccaaagaaatttcagaactgaagaaatagtacttatttcaagttagacagacagcaaaagaaataatggccgccgtgcaattataacaaatcagaacatgaaaaaccagaattcgcagaattaaccagaataatttcagaactgttataaaaaatcaataaaatatcagaattattgcagaaattaccagaaaaaataccagaactgttttaaaacacactagaacattctagaaattaaccaaagaaatttcagaactgaagaaatagtacttatttcaagttagacagacagcaaaagaaataatggcgtcgatgtaattaccattatgacaaatcagaacatgaataaaataatagaatatgctagaaattaccacaataatttcagaactgtaaatagaaaaccagaacatgaataaaattccagaatttgttagaaatgaccagaattaataccagaactttttaatgaaaaatcagaacacaaatagaacactaaattatcgattgaagaaattaccagaataaaaagccagaacctttaaatacacgctagaacattctagaaattaattttcaccagtcgtttcgtcttttacgattttcacaatttttggttttaaatttaccttattaaatttgtttattattttattattttttgaatttcccgtttgagttttatttgttatg

SEQ ID NO: 110141 - DNA, 214 bp, Heterodera glycines
  Promoter: Source sequence=SeqID_28199; Location=499..712; Strand=-; Gene=SeqID_58842
ttttggaaaatgcctaaatttgaaaggggatgtcaatataagtgacctctaatccgatcattcctattttattaccttttcaaatcataacactgttgatcagccagtctaattgcggtgtatctcgctttcagatcacctcattccgctttaagcaaagtaaattaaccccctctccattctttcttattgccaccaaatttatgccaaaatg

SEQ ID NO: 110142 - DNA, 406 bp, Heterodera glycines
  Promoter: Source sequence=SeqID_480; Location=5700..6105; Strand=+; Gene=SeqID_45769
tttttaaaatcaaaatgcaaacttaaaatgcttaaagaagcacacagaagattgtaatgtaaacaagagcaaagtaagtaaacaattggatcggacccatcgatcccacgatgagtcaccgtcggtgtcgttttaaaaaaagttaaaacggatcgccaatctaatgtcagattcgagattagcgtcctttgaaaactccaagttgttatccaaaaataacaaaagaaaacatgggaccctattcttcacgattgtcgacatttcatattatttgccagatttaaattctaaattttgtcagaaatgatatcctttaaataaaatatcatgaaatggaaatgttgatatgaacagcttaaaaaattaaatagattttaggatgcaagtatcttaagtattgaaaatg

SEQ ID NO: 110143 - DNA, 945 bp, Heterodera glycines
  Promoter: Source sequence=SeqID_8662; Location=720..1664; Strand=-; Gene=SeqID_68801
tatttgtatgtttttgaccaatttcccctgataaaaaataccaaattcacattttttgtaagttgccatttgattacagtcttcgaaagttgtaggaaggagaatatggtcgggggcttcctcaatttcgtatccaaataaatctgttcggcatttatgagttttccgtatttttatacacctccaggcatcaaatttgaaatcatcaggattgggccggaataaattaagaaccagtgagtttgaaggttgttttcaataaatttacttatcaaaaaatactttattttaatggttttttgagtaacgtcatagcacctgaaggcttagaactatggtgctagaggccttttcttaaattccgcccactaagggcgtttcttaaaccggacaaggggtaggaaaacaaacaaaaaatgtaaaacacataatttcataactttgctaaaattcaaccaaattaataatactttatgctatcattcaatagattacattaatagttttctaactatcaattaatgacattttttaaattcgtcagtgccaattttaatttttttgatttttatgattttctaacgaacaaaaatggggaaaaaatattttttataaagtgaagaaggaatttgactgatcaactttaaattgattttttaaaatttttctactcttctgatgatggtctttttcaatgataaaatgccaaattattggcaaatttattttttcatatttacataaaaagaaatgtttatccaaatttttattatgtaaatgaaaataaaataaatatttcttctgcctatgatttaacaaaatatattttttaaaaacttccgtaattaaaaaaggattattaaaatatttactaagattcttttatgcttttaataaaaccaaatgaattttttaatttttaaaaatctcaattttttagagatg

SEQ ID NO: 110144 - DNA, 379 bp, Heterodera glycines
  Promoter: Source sequence=SeqID_6202; Location=209..587; Strand=+; Gene=SeqID_60692
ggtgtgtcgcttctcttttctcctaaattttctctttttttcattgcgttaattaattttaagatttaatttagtaaatgtatttatttgcttggaataaacaaacatcttttgtttcttgccattattttttcgataaggccatacgccaaaatttaagaaatcgaataaaaagtgcaaaaaagttaatttaagcggaaagactatgactgtgtaaatttgcgtgtttttgttggttttttaaaattttaggcgggtccataacgggaaacggaaagcaccattaccgctaatattgttattcaattagaattgtttttaatgcttaattgtgacttttaaggctgaaccgcttctgaacgcggcactgtccgaaatg

SEQ ID NO: 110145 - DNA, 441 bp, Heterodera glycines
  Promoter: Source sequence=SeqID_19813; Location=396..836; Strand=-; Gene=SeqID_84553
ttttgaggggggaggggcaggttcggatccggacggtgtacattaattttctgtgcattttttgattacttttacatgtttaatttcatttcaaattaaataaatattatattattaattttcattttaataaatataaatagttttgtttaatccataaaaaataaaattttttaatttaaattaaattatttttttgtgatgttttaaattaaaataataatttatttacttttattaaagaactcctgtattttttaaattagaatttgtaaaattaatttcaatttaaataaatattcaatccctgtacatttcaaactctctttttaattaataaaaggaaatttattttatttttaaaaatttattaattacattcaatttttaatcttactttttaataaacgatttccttaattatttaattttaaaaccatg

SEQ ID NO: 110146 - DNA, 1003 bp, Heterodera glycines
  Promoter: Source sequence=SeqID_13610; Location=1390..2392; Strand=-; Gene=SeqID_77518
tcgtattttttgttaagtgtttgtttgctcgtattggcctcaagccttttgctggctccgtgatgcattacaaattagctcataaaagcgggtaatttagattaaagaaataaaatgaataatatttttgtaaaatttgtctgtctttttagccgatggtttgttgaacacatggagcttttaaaacggaattattttggctgacaatgcattccatcacaattttttgacattttcgcccaattgaaagaggaaaaaacaatggcactgacaaatgatgaattgatcatcggcagatgtcaaaaacttcaacagtttcagtgtaaagttttttatttatttatttattacacataaccaatgtctttgaaaggcaacaaatcctgctgattctttttgttggcacaaccgaaaaggagaaactcccttgagcaagcattcttggagggtaatccaattcaaatttcaattaaagtccgtttaatttattccaatcaaatgttaagatcttattattgacagagaatggcatttttagagatggcacaattattttagtgataaaaagtccgaaatggtgtattttcaaattacaaatagagtgacattcaaattaagaattttcgggctaaacattgtttttcatcgttcatttctcattgatgaaaaaagatgcagaaaaatagtaaaaatgatccgtttcgtaacttattaatttgcaattttaaattaattgatacaatttgggaccaaataaaccaattaaaaaataaatttgggcatacaaatttaaaattccacgaacctcgctaattttaaaaactcctttataaaaagcttttattaatttaattttgacaattacatattcatatgtctgttgtcaaaaaggtacaaaaatatatatggaattagggagagttaaatattatataaatatttgtttgtatcatttccctatttaatgtgcctagattgaacgatgtttgccggaaaaaatatg

SEQ ID NO: 110147 - DNA, 71 bp, Heterodera glycines
  Promoter: Source sequence=SeqID_8513; Location=5682..5752; Strand=+; Gene=SeqID_68349
attgcttttaatttgcgtttccctttgtttagacatttctccgtgccacttcttcagtcagttacgaaatg

SEQ ID NO: 110148 - DNA, 648 bp, Heterodera glycines
  misc_feature (43)..(43): n is a, c, g, or t
  Promoter: Source sequence=SeqID_10091; Location=1..648; Strand=+; Gene=SeqID_73155
tcaatttaagtgcattaagatgaaatatagaaaaataaggatnttatggagtttattttggaatttctattacgaaagttaaaagatattctagaaatctggaaaacttgaacactctatccctcttgtaggttgggggggcggcttctaccagagggactttgtattgttgaatcccttcggacttacggtactcatcagattcaacgaaggataaatgctgaatttttttctcatttttaaaattggaacttatttgtcaagcgccttgaaaatttgaaacaaaaatccaaaaatgtaaaggaaaattaaatgaatttcattgtcgtgtttaaatttggcatcttttcaaaatattgtaaatgttagcaaaaattcacttaacgttgctccataaattaacttataaaatttttttttattccaaatagaaagattgacttttgctaagtaaatatggacataaaataccattaattattaaatcaattaagcataaatttattttcatcaatttgttcagctttccaattgaacccttttattcaggcaaatggtcggattgatgttgagaaatattaccattaaaatcaactatatgtttagtaattgacccaattaataataaatgaatttagaaaatcgatg

SEQ ID NO: 110149 - DNA, 1003 bp, Heterodera glycines
  Promoter: Source sequence=SeqID_15982; Location=243..1245; Strand=+; Gene=SeqID_80341
catttcttagaaacaagaacataaagaaaccctgtattaatcagaaaaaataaataaattaaaggaaaacgttagccggaatcgaactcatgacaaaagtactgttagtattgaagcactatccaccaatccacaaataaaataaaaaacaagtaaaatttattttatttcataaaaatttctcgatagttaaaaaaaatcaaaattgtctaaattttttgccttatttcccacgaatatgccattcttaggggtgtattttcacccccgtgcccccgcgggggtgaaggtcgcgggggcgggggttgcgggggtcagagtcacgggggcgggggcgggggcggggctcgaaccctaattttaaatgttaaaattatgattgaattcccattgaaaaaggaatcattttgaaaaattagaagaaaaaataattacttggagaggaactaattcaacgcaaaccttaggaacagaagcaagacacaacaacccactggaccacgcatatgagtaaagcaatgaagcaaaaagttaccaaaaatacattaattttaaatttgcaaaaagccaatcattaggggtgtaaaaaagtctcggtatagagtctcgaagacaggctcagggatttatttgtctttataagcgaagaattggtaagggaagagaaaatggaaataaagttttcgtgcttctctcgtgaaaagttacctgtaaaaaatataaagcccatccgtggtaatatatttatacgtattataaaaatagacataaattttatattgtatatataatttttatttaaaaaaaattgtcgatagtcacatttttgccatgcttttgattgcgtggcagaaacacctaaaaaaaagaatgatttccttttcaaatgccaaaattttattataggcgaattattatccatttactccctaatcatttgtaaatttttaaatgtaaattattttaatttttgccttttagcaaatccccgcttttccaaatg

SEQ ID NO: 110150 - DNA, 287 bp, Heterodera glycines
  Promoter: Source sequence=SeqID_24870; Location=672..958; Strand=-; Gene=SeqID_55620
ttcattcgctcattttacatccgttttatattcccaccccaaaaaatcattttttgttttcgatgtacgataattacgacggcgattcttccaatgatgaacgctcttctgctattgccgaatcaaagaattcatcaataagtagcagaaaaactaaacaaaggcaaaggatcagcaaaagagaaggggaaaaggagagagcggcagagaaagaagaggcgacgaaatatgtagagaaggtgagaggaaacggcgagagagaggaaggggagggaaaggagcaaatg

SEQ ID NO: 110151 - DNA, 238 bp, Heterodera glycines
  Promoter: Source sequence=SeqID_35727; Location=1..238; Strand=+; Gene=SeqID_65211
aaagtccaagtaccttattggacatctacgtgtcaatgagcacagtgacctttgtccagtaatgtatcggaaaaatgtgaatatcagacaggatcccttacaattctaaaaattcctcttttcgtctaaccatccctcccttttgtgcactatttcgtttcaaaattgaatcattttttttgtctttttgaaataaattgtgaaaaatatacgaaaattattttcgcttttaattatg

SEQ ID NO: 110152 - DNA, 285 bp, Heterodera glycines
  Promoter: Source sequence=SeqID_39695; Location=766..1050; Strand=-; Gene=SeqID_68205
ggaatactgtatgcgttacgggcactaattattatgtggtactattgtatgagcacgaattaattaacgggaacgaatactaattaatgggtttactgtaggagcactaattattttggtgggattattgaacgaccactaattatttaaccgggaacgagcagtaattatttgagttactgtagagcaataatttattttgctcgggttactgtatgcatgcgtttttttttgcctaattaataatttttcttttctcatcagtggcaacgtgaacaggcaatg

SEQ ID NO: 110153 - DNA, 310 bp, Heterodera glycines
  Promoter: Source sequence=SeqID_2408; Location=597..906; Strand=-; Gene=SeqID_47286
aaatcaaatctttttggcacttatatagaatgaggggtcaaaaacaaattgggggaggcgagctttttggattcatttttcgaccctcccctcccccccacatttatctgagtgcatttcttttcgttgttatttgtttgtacgatctctgtggttttcatgctgttatttttcataccgtttttgcataacaatttcaattttaaatgttccacggaacaaattttcctattttttgcatttattttgattattcgtcatacattttccttttttgttattgatgcaattgccaccgatggacgacatg

SEQ ID NO: 110154 - DNA, 299 bp, Heterodera glycines
  Promoter: Source sequence=SeqID_13173; Location=1..299; Strand=+; Gene=SeqID_76995
attactttatacgagttcaaccttagaaagtcttgttttatatttttcgtatgtttttaagtttgatcatcctcggtctagttagatttaaaaaattaaaaggttttaacaaaccataagaaaaacaactataattttaaattttagtaaaataaaaattgtgccaattttaatcaaaggattcagaaaattgtgaactttgtcaacttttataaatttcaatgtttgtacggataaacaacaacaaaagccattagcctcagtttattatgttttagggttccgatgccttgccaatg

SEQ ID NO: 110155 - DNA, 362 bp, Heterodera glycines
  Promoter: Source sequence=SeqID_34040; Location=1..362; Strand=+; Gene=SeqID_63937
aaatttttgaaaatttgattaaaatttgttgacagatttcaccaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcggcggtgccgataggcgccaccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatg

SEQ ID NO: 110156 - DNA, 151 bp, Heterodera glycines
  Promoter: Source sequence=SeqID_38008; Location=474..624; Strand=-; Gene=SeqID_66958
taattttgctgaatttatttaaacaaataaaaaaagaaatattttttattttaaatttatgaatttcgatttatttggatcattttaagtaccaattgataatacgatgaacagataccgtaaagtattgggaaaaatcaaaagaaaaatg

SEQ ID NO: 110157 - DNA, 293 bp, Heterodera glycines
  Promoter: Source sequence=SeqID_6954; Location=79..371; Strand=+; Gene=SeqID_46336
tcttctcattgtttttcctccgtctttctcatttctttcaataacatacatcatctttaccagaaatggacacaccattacatgcgttgttttctgtactgttttctttctctcattttcctctttattttgcaattatttttctgtttaattaaattttattttttcccacgaattgttcattctcagaattccgaaagtaagtaaaaatatatgtattcatttagggaaattcgtcagcacatcaccaagcgacagtgaatagtgtggggacagtggcgagtggacaaatg

SEQ ID NO: 110158 - DNA, 125 bp, Heterodera glycines
  Promoter: Source sequence=SeqID_32905; Location=1462..1586; Strand=-; Gene=SeqID_63132
ctctcaatgcaaacatttcgatggtggtcagcacatagtgcttatccgtttgcgggctgtctcctgtgaaaaaatgatcaattaataatcgcaaaatttaaaaaaaatttaaaattttcaggatg

SEQ ID NO: 110159 - DNA, 770 bp, Heterodera glycines
  Promoter: Source sequence=SeqID_19169; Location=1678..2447; Strand=+; Gene=SeqID_83918
agaattaaaaaaataattctcttgacacttttcccgcacaattaagccctccccctccctttgatgtccccgcccaggggaaaaagcttcttttttttaaaatgtgcttatgttttacataagtaatctaaaagaaaaaaaaattgtcatgaattacataaatccctaattttaattagccaatcatagaaattaattatttgtaaaattgcgtcatcaaatttttaattagcatttttagatggaagaaacaatttggagacgaaataatggaggaatgaaaaacggatgattctaagaaaataaattgacaaattttgcctaaaaatgactgatgaaagtgtgatttaatggaactaaaagaatttctttaatttgtaacaattaatgttgagtagtgaacagggcttggcgtaattatggattacggaaattacggcattttttgaaatatttatctcaatacttggcatttattttgttgctttttggataaaattttacaaaacaggcgaaaatttttctaattaaattaacgtcatcaaaattatggattattaacaattttaataatattttttattaaacattatagaaattctgccaaattatgcattttattatcaatttaaagcaataaattttcatttgcctcatttgtgatgccaaataattcataaagcttaaaatttcctaatttccttcatcaaaattattaaactgccaatttataagtttagcaaaataataatataattaagaagaaaatg

SEQ ID NO: 110160 - DNA, 379 bp, Heterodera glycines
  Promoter: Source sequence=SeqID_5263; Location=1166..1544; Strand=+; Gene=SeqID_57505
agtgaacatttttgctaatttaattgtttttttactcttaaagtggaccccaaaagcttcacggaaatcaaaattaaaaaaaacacctaaaatggggatacaaactaaaatagtccgaaaaatcggtatttgtatcgatggcccctcactttgacgaaaaaatatatgcctaaaaagtagtatagatttgaatttaggttcagaatttttgaaaatttatgtatttttaccgccttccgttaccaacaaattagaaaaaaaagttacgttttgtcaaatatctcaggttttggacatttagcgaatttaaaaatataatttgtttttaccaacaaattttccctacattatgcaatcccttccccggattaggacaatg

SEQ ID NO: 110161 - DNA, 615 bp, Heterodera glycines
  Promoter: Source sequence=SeqID_41597; Location=552..1166; Strand=-; Gene=SeqID_69679
agaatttgccagtgtttttttaaattttcacggctgcgtaaagcagggatttgtagccgttttttgtccccggtcaccctccctgaatttttgtttttaacaattttttagggtaattttatgcgctgaacacgaacctaacaccagttttgacgaatttttaaacccgaattcgaataaaaagtcgaaatttatatttttaatattattatctgattaattttatttgttttaatcattttttttgcaaaagataaatttttttttgataagtttgagtttttgattttttgttcgattcgcgttcagggttcggaattcatagaaatggatgtcagattcgtgcatacatatacaagggttgtctcgacacccccccccccccctcgtcgtaagggggcccggtgtaaaaacgcataagagctaaaaacaaacatcatattcgtgttagggcataaatttgcccttgaaaaaaatattacaaaattttgcaggatagggttaaggacaccggataatttttataatttaattgaatctttatccgataaaaccccatcgttccatttctattccgagtttttttagctttttaaagcacacaaatgcgtgatg

SEQ ID NO: 110162 - DNA, 649 bp, Heterodera glycines
  misc_feature (7)..(8): n is a, c, g, or t
  misc_feature (16)..(17): n is a, c, g, or t
  Promoter: Source sequence=SeqID_12617; Location=2175..2823; Strand=-; Gene=SeqID_76286
ttgcatnngcctgcannggtcaaattgattgaaattataattttaaattaaaaaataatttctttaagattttcatttatattttgaaagaaataaaagtgcatcagggattggaagcgcgcacccaatttgcatttttctcatcgtttagggcgttctaaatcaattctgaacatttaatatttaacaaggcctaatcaatccgccaaaattttaacgttaattttattttaatggtgaaaaaacgactttacttttctccgtctaacatttttttctacacgttaaacccatttcgaattttgaaaaaatttctgcatcgaaagatataaaggttttttcaaaaatgaggctcaataaaaggttaattgatgaaaaaaaattgtgaattctttttctctcgttttggcgtaagatgaagcatgttatggctgaaaaaatgcagtgataaatatgtttttgaattagtgtaaaacattttagaattggcgttatatttcattgcctaatctaaccgaaaaataggtatgcaaaatataccatgaaaaaccttatttgttaggctgaatgtttccgatggtttacaaaaaaaattgtaaacataaattccgattcctttccagtcctttttaagcattagtcaattatg

SEQ ID NO: 110163 - DNA, 1003 bp, Heterodera glycines
  Promoter: Source sequence=SeqID_9247; Location=47..1049; Strand=+; Gene=SeqID_70740
acttcggtttttcatgcttggaatttcacaaaatgcttacatatttctaacaaaaaattgctcaaattgatcattagggccgcaacttttagtgacgaaaaataccgaaatagttaactaaaatagtgagtaaaaatcccaaaatagtgaagaaacagtgacaaaaagtccgaaatagtgacgaatagtgacataattttcagccaaaaattaagcaaaaataatttttattcactggttgcagttgcaaaagagctacattttctttataaaattctcttagcaaatattgacattttttaaatcaaaaattttgtcaagaaaaaaattttgggggagaatttttgaaaaaattttccaattaggggtgtatttttttttaattttttaggtcgattcttaggggtgtattttttgttcttattgcatttttgttaaggaattttccaaaaaatgtcgaatagtgaaaaaatagtgacaaaaccccaaaatagtgatttttaactattttagtgacgaagtcgccaaaatagtgatttttaactattttagtgacgaagtcgccaaaatagtgatttcagtgaccgataatgacatcagaatcgaaaatttttaatgcagaaatgcgttttttgagctcctttcttcaaaacaattgagcaaaaaaaaaagttttttcactaaaagttgtggccctattgatcatggacaatcaaaaatataacatttgaatattttaaacgtattttgaataaatttcgtaaaaatgaggtttttttgcgtgccaaatgaggctttgaaaatttaatctggctaccctgattatgttcggttttctcaaaaaatttttcaatccttaggaatttcttacgaattattgactgcgtaccgctccccctccactctaattgaagtgactcttttaacccctaaagattaaaaaaatttccgtaaattatatttatttaagatttttactcattttttcatttatccaacaatg

SEQ ID NO: 110164 - DNA, 427 bp, Heterodera glycines
  Promoter: Source sequence=SeqID_16395; Location=2210..2636; Strand=-; Gene=SeqID_80794
ttctaacataaaagcaaattttcaaaaattcaaattttcgagttttggttcgaatttggattcggggttcggaattggccaaaataattgtcatagtcgtgatcagcaagctcgaaaagccccggatatttgtttctaggatcttttaaagcaaaaaaaaaaaatatttaaaaatttcgacccaaaagggggacccaaacccgactagtaccataataataataattaatgtgcttttaattctcatttgataattaatttattatgaagaaaaacataatgtgttatttttctttatctccaatccctgtttatattataattcatcattttttaattcatatttcaaatgcattcccatcagtgagttaattaatcaaggtagttgatttgtctaatcatttttaattagggagatgaccaaatg

SEQ ID NO: 110165 - DNA, 1003 bp, Heterodera glycines
  Promoter: Source sequence=SeqID_30305; Location=233..1235; Strand=+; Gene=SeqID_60718
ataatgtaaaccccaaaaaaccttcagcataaatccggattaaatattcatataaaatttctaaaattttcgatatttttggcattctgtcctttcatattcatcaaattcctttgctattttgtcacattgccaattctttctcataaaatacacaatgccaaggtatcatatttttactttgaataatcactaattttctttctgatcatttctcagaaatgcaatggtcgtctccctaattaaaaatgattagaccaattattaccctgcttaattgactgcaaaagataagcacgaaaaacaggttttccgcttggtttgggatgtctacgatgacttttaaaatgcctatttttgcctattttgggtttttgtgcataatgtgcctattttaggattttcggaaaaatccttaacaaaaatgcaataaaaacgaaaaacacaccccctaagaaatgacccaaaaaaaaatttcagaaaatacacccacccctaagaattgaaaaaattttcaaaaaaataattccaaaattatttttttttctcaataaaaatttttgttttaaaaattgtccgtatctggaaaaaaactttaaattatttaataatttcatttacaattaaaatatttaaatttttacgtgttttaatacctaaaaagcgttaattaaaattttttttgcctatttgatgcctattttgcgatttttttctgcctttttaggtgcctatttcgcgattttttgtgcctaaaaaaagaatccctaattattacgctattaaaaacacaaaaaattatactgactgtaccgaaggcgtcgggaaaagcgcatctcattaagtttcaaaatttttaaaatttgccaatttttcctggggaaaaaaggggtgaattccccaccctttccatctggttttcagtctttcaaattagatctattgcgaatttatttattttttaaaattgaaaaagcatttttgtttacagcccccaaaaatg

SEQ ID NO: 110166 - DNA, 195 bp, Heterodera glycines
  Promoter: Source sequence=SeqID_2531; Location=2864..3058; Strand=-; Gene=SeqID_80224
gctgaaattttgatgaataaaaacattcaaacactatttggacgaaaatgaattgctcggggcccggctttgtctcgatcaaatttttaaatccgttgttaatcccaagcaatcctaaaccttagcggatatacctaatccattgttatgtaatatgtctgacattctcgaaaagttattattatttaaaatatg

SEQ ID NO: 110167 - DNA, 98 bp, Heterodera glycines
  Promoter: Source sequence=SeqID_19009; Location=1786..1883; Strand=-; Gene=SeqID_83746
gacccttgttctttggcattttttcgaaattttttttcccgacagatccttcgccggctcgtcgaagaaactctttccacgacaacagcagtgtaatg

SEQ ID NO: 110168 - DNA, 143 bp, Heterodera glycines
  Promoter: Source sequence=SeqID_10091; Location=3304..3446; Strand=-; Gene=SeqID_73156
agcaattcccccttaagagtccatcaatgagttcgctgacggaaaacaatttcactgacaacacaacgtgggacagccgacttttggactgcggctcgatgatgacgcggtccatttcgcctcttaagggccaatcggcaatg

SEQ ID NO: 110169 - DNA, 163 bp, Heterodera glycines
  Promoter: Source sequence=SeqID_2343; Location=1..163; Strand=+; Gene= SeqID_79233
agggaataacgaatgcacagaacacaataccaccgaatgcccagcgcgggtctttcctttccaaactcacgaaactaacgaaaaggtacacaattcgcttattgtcagttctgtttactggcaattgccaaggtttcttcatcccattttcagaactggcatg

SEQ ID NO: 110170 - DNA, 1003 bp, Heterodera glycines
  Promoter: Source sequence=SeqID_8513; Location=3899..4901; Strand=+; Gene=SeqID_68350
taccttagttctggtttgagaccaataaatttcacgataaaagctgattcatttttggccaattctatttttatcaggatagggatcgcccaaactctctccccctgtacaggtttgtcaagtacataacgggagaaatttatgaaatccaagtacatatacgatttttatctaaatgtaattaaaaagttgaagtttctttaaattactatttttggtaatgctgtcgatggtaccctccttttttgaaaaagttttctttattttcaaaagaaatgaaagcatttttcctagtggtttcagctatttcgaccaattttgaaccccggacctgaattcgaacaaaagtttcaaaattttctaatttcatatttttaattaaaatggtttaaataattttttattgcagtattaatgagttactggttgattccgcgtatttagccggttttgaactaaaattcaaagtgaagattttgaattttcgggcttttgctcgaattcaggtccgtggttcgaaattgtgtcgaaatagatgccggattcgtgatcggcgaccccgaaaaccctaggaagtgcaatattttttttcactgatcattttcctcattttcacaccgcttttttggcgcccttaaaggaataaaggggtaggtgatgccgatacatttgatggcgtccggagggagcaatgcgttttttttttgttttttttattcacaaaacttcgaatgaaacaacaatttcaaagaggtggtgaaacgacggagaatgcatggaaattgatgcgatgtctattgtttgacgaagcaatgccaaattaaagagacggcggtccattaagaaaacttgtgaacatttattttttataaaaagaaattgggagaaaaaaaaattccaaattataagaaaacccataaaaggcagagaaatttacagataatgtcattttttgcaataataacttacgacaaaagtgtgctcagttaattgccacaaaatg

SEQ ID NO: 110171 - DNA, 57 bp, Heterodera glycines
  Promoter: Source sequence=SeqID_9626; Location=1..57; Strand=+; Gene =SeqID_72124
tatatatggtcaaattcgttgtcaaaatatatatattttaggttagtaggcgaaatg

SEQ ID NO: 110172 - DNA, 966 bp, Heterodera glycines
  Promoter: Source sequence=SeqID_7247; Location=161..1126; Strand=+; Gene=SeqID_64246
ttgcaacttaagttttttgtttataataaaagagaaattttttcatttgattatttttaatatatttcaaattatagcatatcttatgattgttcttttgtttaaaatcaaaaaggcattattccaagcgtctaacccaattttttacctgttaaaaaactcaaaaatggtcaaaatttcatattattgcactcactcacttgtgaaacatttgccccttttgatctatccactgagaattgattaagccgctctaggttatgggaaacgcaagtgagatcgggggggggggggggacaagaatgtattccgtatactactaacgttaaagccaaagttatcgcgttacttaagatcataacgaaattttatttataaccttgctcaataataatcaaatgtttagtcttgatatcattcattttctctattagaatgcaaaatcaaaaaaattcatgtacttaaaactctgcacttttttatcatttgtttttttctttttttttgttattttaatgctttttcaattatttttaggtcttatgcttaatgttttttaccttatatgaacaaaaattatttatattttttagtgttatatgataagaaatatcttattcctatttaatcttataaataatgttgattaatttattgttttttttgatttgttttacattgtaaaggttttttgtaatgtgaaccaaatataaatgtcttgtgctggtcaaaatttaattatgtagatgaatgaatatcaaattaatgaactactcaagaaaaaatcattattaagtatttatttatctcttttaaaaagtgttaatttatttttttatgaattcttttaaatttttactttaatagattgcttagtagtatatgtccacaaatgtggccccaaatgtggtcccttttcaccgaccccattattacccagattgattaatgcgaaagtggaaaatg

SEQ ID NO: 110173 - DNA, 74 bp, Heterodera glycines
  Promoter: Source sequence=SeqID_11741; Location=1333..1406; Strand=+; Gene=SeqID_75225
ggtcatttctggcaacgaaaaatgcgtataaatgttcattaatatctttttttttagcaattttacgtgacatg

SEQ ID NO: 110174 - DNA, 110 bp, Heterodera glycines; identical to SEQ ID NO: 99093
  Promoter: Source sequence=SeqID_7034; Location=186..295; Strand=+; Gene=SeqID_63638

SEQ ID NO: 110175 - DNA, 413 bp, Heterodera glycines
  Promoter: Source sequence=SeqID_34864; Location=1..413; Strand=+; Gene=SeqID_64565
attttgtgttgtttttgttgaaaagcaaacatttgctgtaaaatcatctgagattcgacatcagcaccctcccagaaaccccaagatttgtgtttttattgcgaggtatcgtttgtgattccatcaaataggcatacaacaatgacgtttggaatcagaatttggacaaaaccatgacttcgcgttacgcggtcgctcgcgtttcatccttgccctatcttctatggattagcttctataaattagcttacatatgataagtttggtctaatgaaacgagggtgaatgttatcgttcatcgaatttatttcttatttaaaaatcattgtattacgaatttatttagcttttcctcgtttaacttttcctcaaccttttgcctctctttcctcccaatttttcttttaccaatg

SEQ ID NO: 110176 - DNA, 823 bp, Heterodera glycines
  Promoter: Source sequence=SeqID_25372; Location=765..1587; Strand=+; Gene=SeqID_56117
aacaataaaagaatgcaagaataatggaaattggggagcagttatggtggatttaaatatttcattagttttgcggtgagtgggattcaaataaatttaataaacttcatattttgaaattaaaatttttaaaattttaaaaaagaaagtgacaaaaaattgaatagaattttttgaaattttttggttataactctttgtaaatttttttctagattttaaaaaattaaataagataggatttgataggatatgtaatgcatctcgtaataccaatttttattaattgaactaaatttaagctaagttatggtttcttattagcaataaaattaaaactaataataaatttaaatgtttctatcattgacacttttgtaactttggctcaccatgattttatattacataattgatttaaaattaaagttataatcggaaacattgctgattttcatgttaaaaaaaattaattacaatatttgtcaaatttttgcatctccaaattcaaaattaaggaattgttggatccgggcaaaggattttacgacaaagatgaggacaaagtcacattggccattgatggaaataataattattttttctataaaattggtgtaattaattattgaaaagactcatgtaaacatttaacataaaattagaagtgattttttaaaggaaatgcgttaaaatataaatttgattattatttaatttgctttaagatggaaattggagccgcaaatgttcggcaacatttcgaattgtctctcaaaagagcggtgtggaggattttaagagagaatccagtgaaaaaatg

SEQ ID NO: 110177 - DNA, 621 bp, Heterodera glycines
  Promoter: Source sequence=SeqID_5475; Location=189..809; Strand=+; Gene=SeqID_58191
tgctgtggatgaattatgtatggatgagttcggcatgactcatttgtactacataattcaataaaccctaatttttaaaaattaaaatgcaattatggccagcaattaaaaatggggagaaaatacctaaaaggcaacaattgcctcactaaaattagatgtaccaaattgttaggtctccatatataaagctgattcctttgagaacatttctcatttcctttctcttcataaatcataaacttttttatttgttcgacccttttcattttttcatcttttattttccattaattctaagaaacaaaacaaatattttttatcttttaaacaaatgcatcgaactaaaaagcgatcgcgcggcggaagaggtagaaacgcgggacaaaaactgctggcagcagcagcgcacgcagcttttcccgggggaaaaaatggtcagcattgggcacgatttgatggcattggcattatgttactatttttagtttcgattttaaattaaaaaaaacaaattttcttttctcacttattcctatccaacccaattcttacgtattcccttttttgtttttgtacttcaaattcactgctaatttcttagaattgcttcacacaatg

SEQ ID NO: 110178 - DNA, 236 bp, Heterodera glycines
  Promoter: Source sequence=SeqID_10775; Location=866..1101; Strand=-; Gene=SeqID_74031
attcatttggcaatgtctctctcccctctctctctctctctctttttctttctcctctccccatctctctctctctccccttctctctctctcgctctctctctctctcctcccctctctttcttttctttttctccctcctcctccttcttcctctccccatctctctcctttctctttctttctgtccttaattacttccgattttcgtttcagttctcaaattactcaaaatg

SEQ ID NO: 110179 - DNA, 677 bp, Heterodera glycines
  misc_feature (12)..(12): n is a, c, g, or t
  misc_feature (61)..(62): n is a, c, g, or t
  misc_feature (66)..(66): n is a, c, g, or t
  misc_feature (142)..(142): n is a, c, g, or t
  Promoter: Source sequence=SeqID_30448; Location=1..677; Strand=+; Gene=SeqID_60856
gctactcgctcncgcaaaaagttttgaaaattttgatggttttgggtttggagaaggcacnncctnggttcgagtgcacaggtcgagttcattattctgttcaattatgtagaattttgaaaaactcttccgttcttgttgngagtattaagttcgacaattttacggaccctagttaggttagtcactgggctttttcttattttcctatgccaactttgtcggtacaaaaaataccaattccgacaatcgcggaaatagcaacagaatacgaccaacaaacatcacatgcattttaagaataaaagacaaatttatttaaaatttaaagctagaaattatattaattgtttgtgtaagttggtcttaatgaaataatttcgtaattattattttttatctttaatgatgtcatgaataaaaaattttgaatgcaaatagaaattatatgttggcaaataaatgaagaaatggccggaaatggaaaaataaaaataaatgataaaaaacattaaaaaaaatcggattctgtcgatgtcttttccactctctctctttggccaactatttactctaatatttcaaaataaatttggcatcggagcatataaaaagcaattgaaaatgccgaaaaaatatatctatcatattttcatttaaattatcctcccaaaatg

SEQ ID NO: 110180 - DNA, 92 bp, Heterodera glycines
  Promoter: Source sequence=SeqID_36146; Location=1..92; Strand=+; Gene= SeqID_65541
ttaaaaaaaattaaatagtgcctttcattttacatgtaattaatcctttatttatttctttttatttccaggtgcttcctgccgatttgatg

SEQ ID NO: 110181 - DNA, 85 bp, Heterodera glycines
  Promoter: Source sequence=SeqID_11591; Location=1..85; Strand=+; Gene= SeqID_75037
cgaacttaaagctattattagccgcttaactgctattgaaaaattaatttcaaccaacaacaacaacaccttggcaaccgaaatg

SEQ ID NO: 110182 - DNA, 126 bp, Heterodera glycines
  Promoter: Source sequence=SeqID_2973; Location=1679..1804; Strand=-; Gene=SeqID_82579
tttgattgaatcttttttctttatttatatactttccgacagatttgattgtattattttctttaattatatctatttttaataattttgttattattaaattatttttagctcttctaagaaatg

SEQ ID NO: 110183 - DNA, 307 bp, Heterodera glycines
  Promoter: Source sequence=SeqID_10390; Location=1..307; Strand=+; Gene=SeqID_73578
taaggaggtgtcctccggttctgctgatgatcagctttttgccgttttgtacgtgattgtacctcacaatatgcttttaattttacagtttgacagttgtctcaaatacactattagctattaataattgatctcttatgtctttctaacatttctttaaaatgtatcaataaatttttaatttatatttgcacgaaattaattatttggtaacataaaaatcagtttggtataccatattatttggtaatggaaattctctattccggccatatttgttttcgcttgaatatttccaccacgaatg

SEQ ID NO: 110184 - DNA, 108 bp, Heterodera glycines
  Promoter: Source sequence=SeqID_33174; Location=385..492; Strand=+; Gene=SeqID_63320
ttttataattttctctttcttttcatcagtttcccaaatttttctgattatttttaaaatacttttataattaataatttatttttaattttaaaaagatcaattatg

SEQ ID NO: 110185 - DNA, 1003 bp, Heterodera glycines
  Promoter: Source sequence=SeqID_24456; Location=183..1185; Strand=+; Gene=SeqID_55189
atggattaggtaaattctctcaaatggacacttttcttcctttcgtcgcccattgcctttttctctgtctaattgcccccccccactttttttggctggtgggttttatccaattatttttatgtctccaaaaaaccaatgccttttctgactcattaatccctccctccatgggccattccttcacggcgttatctttcaaaggatttctcttaatttcttttttctctctttcttctctctttctctctctcttaatggacaagcaactgaggaggagaagcaattcattggggaattcggcataaattttcggcttttgggaagattttttggaaaagcgggcggggaaaaagggggagggaaagacgcaaaagagaagtggaagagatggagtgaatgaagatgggaaaagggaaaaacaagaaagagagatactgggagataagagagagagagaggaaagaaggggaagaagagcgaggggtgagagagaaatagacaggaagagagaaagagagggggcggaggggggaaagaaaaatgccacgggaaatccctcgggcaaatcgccgcggtccgctttttctctgtgcgctttccgtctttgaattttgagttgtttctgtttgtccatttttagcttcttgcaagtccaaattagcctccaaactgtccctccataattcgcttcccaatttgcccctcccattgtcgtcagaagaggcatttcttggcccaatttgtctgtcttcctaattagggccttcccccaatgacccaataatttaagctcccccctccctctgcttgtcaaacgcacattcttccaagtcaagcccatatcggacttaaattcgatattttatttatttaaattttattttggtgacatttttaataacaaaaaaggcagaattttttcatttacatatctaaaatatttttaattaattttaattagtttctaattatttggtgcctttttctgatattatcaatg

SEQ ID NO: 110186 - DNA, 312 bp, Heterodera glycines
  Promoter: Source sequence=SeqID_30620; Location=878..1189; Strand=-; Gene=SeqID_61016
acggtaatggaaaaatactcaaattttaaagtgattaatttaaaaatggaaagacaatttgctaattttgccggttgaattttgcgaaaaaattgtgttgtcctcagcagcgaatagccaaaaagatttgatggattggatgaaacaatttttcaaaagcagttcgaaagttggcaaaatgttttgccggagtttcggccagagttcgtgccgaagtaatggaattttccaagaaatataaaaaaaatttgtgatttaaaaaaagttctcaagcaaattgtacaatcttttgaagagaatgacaaaagaatg

SEQ ID NO: 110187 - DNA, 1003 bp, Heterodera glycines
  Promoter: Source sequence=SeqID_7400; Location=3367..4369; Strand=+; Gene=SeqID_64710
aggttttttatttaaaaaaatgaaaaatttcatattttttttcttgtcattttaaacggtgcatttcaatattgtaaaacgtattttttaactgacccccacttcgtacgaaaccaattgcttcggttgtcctcgccttggacgtcgcgggtcatcaccaacaagatggacacgcaaagcgggatcctcctaaaaaaatgtgccaacaacagcaaaatatacataatgagcaatatattgtatttctatcattatttacacttatttgcttttcaatttaatcggaatttcaaaaaaaaactgttgggtttcgattcagttcagttttcattttggatttttcggacattttcccttttctcatttttgcccaaaacatttcctttgccattcatccacaaatccatcactcaatttgacccattttcccatttctctttggccaaccattttgtaatgtcactcgcttggcccctcccattatgtcagtatttaagctccccaattgcctctcgcttttaaccattcttttcccattctcatcctgacccttactcatctcacactaaaccaatttactttacttttcatcctttttcctttgcttaattcttaaacacaaataaaccaatcgcattcccccttttgtgggcatttggaaaagttaatatttggtgaaagttggaattaaataaggcacatcggagtctaagcttagtcaaatacacaacaatttttggtgccacgacccgggagaaggtcaaaaggctaagcaagactagatgaagcagttcagctgtggtaaaggctctgtgcctaaaccaaatccatcaaatttgagctggtcttagttgtgtactaccagccaggctgtttgtgccaatcaccaaatttaaaggagctggtcaagtgtgttttctagccgagctgttgtgctgaaaaaaggactaaatgtcttcaaaaaaaagtgttttaaaacaaaaaaaaagaattttggaaaatg

SEQ ID NO: 110188 - DNA, 220 bp, Heterodera glycines
  Promoter: Source sequence=SeqID_15178; Location=754..973; Strand=+; Gene=SeqID_79378
atccttcactttctaatcaatttgttaaaaatctttttaaaataattttcattttaataaagattttaacttcccgattattattgtaaataatgtaaagtgattaatctcaaagcattgtatgaatataacatttggccattttatccacaagcggtggatggttggaaatgatgactaatcctttttcgacactttgctttaacaaaatgttgaaatg

SEQ ID NO: 110189 - DNA, 1003 bp, Heterodera glycines
  Promoter: Source sequence=SeqID_20711; Location=264..1266; Strand=-; Gene=SeqID_51270
tcaacattaataaaaaaaataaaataaaaattatgaaaaataattttcttatttttatctttgtattcatttatctttgcaataaatttttccttcatcaatttaaaaaaacataaatgaaaaaaaatacccaaaaaataaaaaataattggatgatttattttttgaagaccattagaatactttaatgttttaaagtttattttattagaaaatccaatttgtttttctgagaattgatttcacgaataaataaatgctcattaataataaaatttaatcatttgggttttattaaagaaaattaaacaaaatttcaagaatattcaagaaaatgaaattatttatattagtctgtttaattttcattttaattgctctaatttatccaaatgaaacagctaatgataaattggaacaaaagtcatttggcgaaatatttggaggaaaatgggaagaaaaagaagaagaaaatatagaagaaaaaagagaaataattgaaaaataccaatgaatgaataaattttcgacttttagtcataaacaaaattttttttcgaggccgagggcagaaagtcctaagcttaactaaattataagaattatttataatttcttaaaattaattaaaaaatttaaacgaaagtacgctaattcaaaatatttgacagaaatgaaaatttttagccaaagcattaattttcttaaatgcaacaaatattttctttcgtattataattttaaataataatttatgctaaaatatatgaaaatgaagacgcgacgctaaaataatattttattgcgtcgataaatcaattgttatgaatttatgaataaaataaaattacaataatttttgcgtaaaatattatagaatattacatcaaatttaattacatttatatttcacatcatgtaaaatcataaattttttgtatttcattcgaataattatcatcatttttaaaatttatttatatttagcaggaaaattaaaatg

SEQ ID NO: 110190 - DNA, 98 bp, Heterodera glycines
  Promoter: Source sequence=SeqID_19456; Location=1254..1351; Strand=-; Gene=SeqID_84176
gaaaagcaacaccatccattaagattttaaaggaacttcaatcagcagtaattggcacaaatctaaccattttactggggataggcaagtggaaaatg

SEQ ID NO: 110191 - DNA, 63 bp, Heterodera glycines
  Promoter: Source sequence=SeqID_13802; Location=1100..1162; Strand=+; Gene=SeqID_77732
ggttcaaaaattatcgaaaatttaacttatactttttgtaattttacaggttacacgttcatg

SEQ ID NO: 110192 - DNA, 439 bp, Heterodera glycines
  Promoter: Source sequence=SeqID_40257; Location=497..935; Strand=-; Gene=SeqID_68655
aatatgtaagaaaacagcgtagtttcgcttaagaaagcaaattaaaatattcacatttttttttgaaaaattaaatgttagttatgcattcgggcaacttttgatcattttttgtacagaaataaattgagcctaagcttaagaaaaaaaaaagcaataaataattggttctcattttttgatttcggcgcttatttctatggctttttggcgcttttttaaaattttatctttactttttgacttatttattttagtcttttttattataaggtaaaacttgaccgggatcgaacccgggaatcacggttttccaaggtccaggtcccagtttttgaaaatccaggaaccaataaaagtcccggtcaggtttttctggttccggcaagtcttatccccacttttttgacacattcttttttagagatttatcaaaatg

SEQ ID NO: 110193 - DNA, 113 bp, Heterodera glycines
  Promoter: Source sequence=SeqID_411; Location=1118..1230; Strand=+; Gene=SeqID_51750
attactaaaaaaataaaatttacaaaaataaaaaataaagatttaaaataaaaaatatatatttttaatttaattattttttcaatttttaggtggcacttcgagaaaggatg

SEQ ID NO: 110194 - DNA, 455 bp, Heterodera glycines
  Promoter: Source sequence=SeqID_5068; Location=2781..3235; Strand=-; Gene=SeqID_56787
tgtcgagggaacaaagtgagcagcagccgatgcagcagtagtcgtaccatatttcctcttggcattcacatactgtattagaccgtattcccccgaataaagtcttttccaactgaatacagcaccaaatttcaaaaaatcataacccacgggctctcttctctctctcacctctctctctctctctttctctctctctttttatctctcttcctcccccctcccctctctctctttctgtgtaatacggtatacaatgcacatgggatacggtaatgatgcacatttaattggatgatattttaatttatcaaatgctaattgcttttccggttgactggcttgattgtggcgagcgaggttgtgcccatggagaacagcgcgatcggcactttttggtggtcgattcggcacggcaaaatcaaatgctgaccggccgcatttacccaaaaatg

SEQ ID NO: 110195 - DNA, 419 bp, Heterodera glycines
  Promoter: Source sequence=SeqID_45131; Location=1..419; Strand=+; Gene=SeqID_72499
aattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 110196 - DNA, 654 bp, Heterodera glycines
  Promoter: Source sequence=SeqID_18205; Location=1580..2233; Strand=+; Gene=SeqID_82802
ttaaaacggtacaaaaccgtatgattttttcataagaatagccctaattagacaaaatatttgaattagcgcgttcagcaattgtcccagtgatcatctgatcaccgtacaatgacatattttggtaaaaaatatagcacaaatttaagccgaccatacaacaaaaaattgttaccatagacaaatagagtcggattttccgtgtgttctgcctgtattctgatttaattaattaattaaaattaatttgctttttaattttcgctatttttccgctatgccgcagccccctataaatggcatgattcaaacaaagaaaagcacgtttctagcataattttaggcactaattaagaatcgggcgccaaaactgcaaaaactctatgattttagctatgaatcatgaaatttttagaggggggggggggtgcggcataacggaaaataccctttttttcttacatttcatcaaaaattattccgatcaatcgatcaatgccagtgaaaaacattgtcgggtaaattccaccttaattttatcaaaataatatatataattttttgatttttgaaattatttgccaagtccaaacgctgagacaaaaatcagttttgtggccaaacgaaattcgatgaaattttggccagaaaatg

SEQ ID NO: 110197 - DNA, 291 bp, Heterodera glycines
  Promoter: Source sequence=SeqID_17104; Location=1..291; Strand=+; Gene=SeqID_81536
tgacaggacggagatagagagaaagacgacagacaaattaccgattgattttttaatgtattgattgaccagttttgtaccaaaaatcttctcttttttctggattgatgcacaacgatgggaattgttcaaaaaatttcttgcagcttcgcacttcaaaagtttggacttaaaacgtagaattaaaaaaattatgcttcatttcgagcgataagccttaagatttttcaaaggtgaagggcactgatccggaatttttcaaaatttgccattttccagaacagactgatg

SEQ ID NO: 110198 - DNA, 367 bp, Heterodera glycines
  misc_feature (28)..(29): n is a, c, g, or t
  Promoter: Source sequence=SeqID_26506; Location=1..367; Strand=+; Gene=SeqID_57236
agatgtcccgaatttcgaacagaatatnnttttagtgtctttttgcaaaaatgcttcaaaaaaaaaattgcgacccctgctgaaggggacagtggaaaatttttaaatttgaaaattaaaacaaatcataaaaattccaaaaaatttccctccccaccggcccctaaaaatccttatttttctttaaacagatttattgagattcaaatttttgcaaaatgaacgaatggaatgctcatgggggcgaaataatttccatttttggattgactgaattttcaaaaccatcaaacaacaattttttcctcatcagcaattgtacatcgcggtgggcatcagcggtgccatccaacacttggccggcatg

SEQ ID NO: 110199 - DNA, 58 bp, Heterodera glycines
  Promoter: Source sequence=SeqID_34313; Location=1368..1425; Strand=-; Gene=SeqID_64140
ggtttttatttttgtttttttgtagatgattaatattttttgtggagaaaaattgatg

SEQ ID NO: 110200 - DNA, 97 bp, Heterodera glycines
  Promoter: Source sequence=SeqID_42159; Location=712..808; Strand=-; Gene=SeqID_70119
gagacaaataattaactgattaattaccgattaattaattaattgcagttttataatttacaattagcatttggtctgtggcgacggcttcacaatg

SEQ ID NO: 110201 - DNA, 390 bp, Heterodera glycines
  Promoter: Source sequence=SeqID_21373; Location=1696..2085; Strand=-; Gene=SeqID_51979
tggctaaaaatcgcaaaaatttggcagtttttggtgaaattctgttaacaaatgacttttttaaattttttgcttgataaatttttttaaatatggaaaatttaaaacccccgaaccctgaccctaaattctaaaggttggagcttttttgaaaacctttacagtcgaagaatgtatgttcgttgcaatttatgcaaaagggaattgaatcgaggcgatacatcgactaaaagaatgtggtgccaaacatatctttaataaaattgttttagaacaaacttatattgcgcatgcaaatttatgtttttaaccgttgaattttatatttgaattttttgtatatttttatttttagagtaattaaaggttaattataattgtttgcagatg

SEQ ID NO: 110202 - DNA, 337 bp, Heterodera glycines
  Promoter: Source sequence=SeqID_19599; Location=1..337; Strand=+; Gene=SeqID_84340
aataattttcacaataattgaatcccccgctcgcggctcccattggcaccggcaattatttttaaaatataaaatttacttttttttttgccccttaattcaatttaactttcaaacccataaatttattagccaattaaaaaaaagaaaattaatggcaataattaaaaattcaatggaggaaataaaacaataacaaaatggttaattttcaatgatctcattaacaaaatagaaagaaattaaggcagtgataacaaaagggggaatgaatggagaaaacaaaatgttgaggaaattgtaaaattggcatggaaataaatccatattttagatg

SEQ ID NO: 110203 - DNA, 173 bp, Heterodera glycines
  Promoter: Source sequence=SeqID_4890; Location=4023..4195; Strand=-; Gene=SeqID_56104
tggcaggagaatgaaagtgggatgaggttgaagaatttcacttttatatgcgtaaaagtgtggccacgcctacaccatttgaaaagagtcacggttttagacacgcccactaaaagccaaaacagtttgtctgccaaaaacacaaaatcattttaacaatttttgtcaaaatg

SEQ ID NO: 110204 - DNA, 57 bp, Heterodera glycines
  Promoter: Source sequence=SeqID_8047; Location=1468..1524; Strand=-; Gene=SeqID_66824
tttgatttgggggaggggccattcaattgccaatttcttttgctgttcagcttaatg

SEQ ID NO: 110205 - DNA, 60 bp, Heterodera glycines
  Promoter: Source sequence=SeqID_18745; Location=1812..1871; Strand=-; Gene=SeqID_83418
tcaactgagcagtcgacgtcgtcgagcagttcggatgagagtttggaggagtcggatatg

SEQ ID NO: 110206 - DNA, 1003 bp, Heterodera glycines
  Promoter: Source sequence=SeqID_5553; Location=2445..3447; Strand=+; Gene=SeqID_58435
gtgcgataatttttttcattaaaaaatattacaaacacgtaaattttttgtcttttccggttatattaaatcattttttaattcaaaaatattttaataattaagtataaatatataacggagcactgggacggaaaaacattgagcatttaataaaatggatataactaaactcaaaaatatttgcgaattttcaacgcaattcatccgattttcttacttttttaataattttaacatatcaattctttctttttgttcaatttaatttaaaatatttagttacaatcgaagattggaaaactttttgttcgggtttcacaacaaaagacaaatgtgaaggtgaaaaagcaaagaaaaaaatttcaaaaggagagaacgctggtaaatacacttgtcactggatcaccaatacggaagaatgctgtcattatataatattataaaccgtaactgttgcatgatttgcacggatttttgcattttttttcttcggttttcgattttcgtttctgatgctttttggctttctgtttcacttttttacaaaaaaaaaactttcacttgctttgtatttttatatgtattgtataaacaattctttacaatttcaacttagtgtcaacttctggccccctcctttttaaggtagcaaatataaaaagtgactcataaaaattaaaagttaaatttaattaccaaatttaaaaaaatacaaactaattagtaattactattacacatgtacaaagtcctgatttatatataattaaatgactccaatttttcaaaataagctggcaataatcatggtatctgggaataataagcaccgtaataattagagctacgatttttaggtgctaaaaaacccccaaataggtgctaaaaatgggaaagtaggtgccaaaaagtttcaattttaggggggggggggggtgtaaaatcataaaatcaggaatatatgcggctggaggttgtgcgcgagcgaggcggacggatg

SEQ ID NO: 110207 - DNA, 773 bp, Heterodera glycines
  Promoter: Source sequence=SeqID_18478; Location=1..773; Strand=+; Gene=SeqID_83089
ccaacgttctcatgattcgaatcgccacattttttcaaatttaaatgaaatgaaaatgttaatgcaaaaattaaacgtttttgctaatgcacaatttttcgatcaattttataacctctcttccattgtcattcgaattctcgaaaattgggaaaatgacggacaaaagtaaaaaatgataatttacaatattggaattttaatgggtttttttttgtttttttttgcatgttcagtccgactccatcatttctcagctcaccggcggacgacgatttgaagggtgaaattggctacaattcatgcaatttagccaaacccatcattttggaggggcggttatatccaaaaactattttatttgtttatttaaccaaattcattaacagagtgacccaatttcggaggcgaaatctgacttgtcgaaaaatattcaaattttactatttcaaattattttcaaacgttttttggggaaagaaatgctgtaccaaaaaagatttgctttgaagcattagaaaaaagatataggcgttcaaaattttgttttttgaataactttttagctaaccctttttttttgctcttaaaaccccctaggttttgttcgtaatttttttctttctcggtatgaaaaattaaaagaaattctgcccgaggaaaaaaagttatgctgttcgaaatgtggataccctaagcagaaaataaattgttttttattttgtattaaaaatcgtttcattttccatagccaaaaaaaaaaaacaaaaatg

SEQ ID NO: 110208 - DNA, 216 bp, Heterodera glycines
  Promoter: Source sequence=SeqID_26365; Location=811..1026; Strand=-; Gene=SeqID_57103
ttatctctcgtccattgatttcttttccttcgtttgccctgaaagtgtgccgttctcctctcttctccctttcaaaatttattctcaaaatttgccaaatgaagcttttctcttccaacaacgacacagtaaaacaatttctattcggctctttccacaatttatcaacaacgtttttatcattatcacataaaaatgcgtttttgagccaaaatg

SEQ ID NO: 110209 - DNA, 1003 bp, Heterodera glycines
  Promoter: Source sequence=SeqID_9023; Location=1431..2433; Strand=-; Gene=SeqID_70034
ttggataatttaaacaaatttgatcaaaaaagaattgtgaatttgaattttttggaatttcacattgccaaattgtccgcttttcggggtgcccgggcacggaaccgctcagttgggcgcttacggttggtcgcgctaatcgcgaagcaatagcatagaaaaagctttaaacatgttaagctttcgaatgatgcgaatataatggatttggatgcaaagaaaaaagttatagtcgaaaaacatgctggcgcccaaccgtgcgtgcccaactgaggtagaccggcccggcattcagtctgagtctaattacataaacaagaaatcgtcaaacaacataaaattcaaggctttaaaaaaataattaagctcggccgcaaaagctgacatgaggatattagtgatgctcggagtctcggtcccgactcgagaaaagtcactgttttggattcaaattctcagttttttggttttgactcgagaaaagcgcctcggtttttggtgtcgagtctcgggaaatttgggtctcgagcatcacaccaaaaggaatgtacaaaagtgttaattgtaagcagaaaactttcactacattttatgaagtccaatcaatttttttttcttttcgctttttttgcccaatcgccgcctcggcacaaatgaaattggcccaaagcaatggcacctgaaaaagtgtgtggaaatgccaacaaaagtgcataattaggcaactaattaattagcaccggaattgaaaagagatggaaaagcgcgtgggcgtcgacaagccaaaagagaggcggaaaatcgaagaacacatcgaacgaagcggagaaccagccgagaaggaacttaaaacaaaaacaaaacaaatcactgataaaacaaagaatttaaaaaacattaaaatttatgcgattagcaaacttttttgttcaagagtctcggggtcgtgaaatgctttgggcccgccccggtgggttttgtcaagttttggtctcgagaaatg

SEQ ID NO: 110210 - DNA, 451 bp, Heterodera glycines
  Promoter: Source sequence=SeqID_37428; Location=1..451; Strand=+; Gene=SeqID_66508
cccatctccccatctattccttcctcataaaattgttctatttactcgacgatggcaaataaaaaatgcacaaatctaagaagcactttgacctttttttgaccttcttattcgaattcacgagttccatgagcaaaataatatttgcattagacacaggcttggggttagttgcggcatgataacagagatagcggatcaacagttcaggcactgcgttcctatattggtcgcctttgagatttgagaagattttggtgattgttgcaaatatggaaggtttaggtcttagcgggcggaacgaacggcgagaataattcttgactagagcaatagctatggtcgctcattcagtggccttttaatatgtttaaattgtcattttatatctgcttattttatattttaaaaaataattaattaagaatccattaatcaactgatcaaaatg

SEQ ID NO: 110211 - DNA, 1003 bp, Heterodera glycines
  Promoter: Source sequence=SeqID_3486; Location=1888..2890; Strand=+; Gene=SeqID_84871
agtttataaaataagggtactatcacttaaccggaaacaataaaaaaatattaattgttcaaagtgtaaaaaatattgtaaaacttataaaaatggctataaatatggcattaaaactattttagaagaaaaaaacatgatacaactaaaatttactcatttttagcgaaaaatcaacccaaaaagcgaaattttggcttttttgcttatttttgacataaactaaccaatttaaaaaaaaaaatttaatttaatcaatattctcgacaaaatttcgctaaaaatgactttttggaaaattttctggtctttaagggtcaaaatccaaatttagatgtttttcgtgcgtttcaggcctcccacagtccaggaaaaagatatagatttccatataggtaattggactccctacttattaggtatattgcaacttatgcaataggcgaaatactttttttaggctgaaattagatttttcagcatgatcgattttttttctcttgcagtgtttagaagaatccgtatttttttcggccgatacggattttttacggactacggatctttaatccgtaatcctgatcccgatccgtataaattaagacacggattacggattttttaaatttataaaaaatccgtatctgtatttttcctggatacggatttttacggagtacggattttccggatttttggtccgtaaatccgtatgtgtgcctagtccgtaatcccgatcctgatccgtattttctcaaaattccgatctctaatttccgcattttgaaccaattcaaaaactgttttaaagttgaagcgctttacaatttttgatggcttaatagttttatcagtgtataagaaaacatataaaagtgaatccatattttattgttttattggaatccttttcatccattccccttcaatgatccgtcattcggtcaacaaatgtttgctgccacaaattacaaatcggttgacttccaatttgtccgccatg

SEQ ID NO: 110212 - DNA, 1003 bp, Heterodera glycines
  Promoter: Source sequence=SeqID_9592; Location=2343..3345; Strand=-; Gene=SeqID_71993
taaaattttttattaacgtttttaggtaacaaaacacgttaaaacttaaatatttcaattgtaaatgaaattataaaatattttaaagtttttttcgaatatgaacaaatttttaaaccaaaaaatttttattaagaaaaaatatttaattttgtgaacaattttttgaaaaattttttcaattcttaagggtgtattttctgaaatttttttgggtcatttcttagggggtgtgtttttcgtttttattgcatttttgttaaggattttttcgaaaatccttaaataggcactttaggcacaaaacccccgaaataggcaaaaataggcattataaaagtcatcgagacacctcaaaccaagcggaaaacgcgtttttcgtgctcatctatgcgtatcaagtgcgcaaaaattttaggcatttgcctaaaaaaggaagccctattaataattaaaattttatgctttaaaaaaggctttcaatataaaaacgcaaggaaaaactatttttgaaatttttgttcataatttttaaaattattcttcttttagagaacccacacttatttgttagtaactatttgaagctaacaagaacataaaatgtcgtaaattgaattttatttttggttttttgaacatttgcatatttataaaaaaataattacattaaattaaaagaaatgaaatgttttaaatctaaacatttaaattattttgtttaatttattaagcaattaatctaaaaatcaaaaatgttttgaattttgcataaagtgtcctggttttgaaataatgaataaacaggcgaaaattttctaattaacgtcatcaaatttatagattaatattatttcaataatatatattcgatattaaacaaattctgccaaactgagtaatttttttttgataaaattattataattcaaaaagaattcatttaattgtataaattttgaaaatattttaaaaccatttagactgtcattgcataaaaatg

SEQ ID NO: 110213 - DNA, 324 bp, Heterodera glycines
  Promoter: Source sequence=SeqID_23860; Location=591..914; Strand=-; Gene=SeqID_54550
ttagtttgtcggtgaccgacaggcgctgccgaagaaattttgagaaacgtaatctgagctaaaaaagaccaattttgtggattttagtcaaatttttaattttaccgccgcaggggaaatttttttgaaagtttagtcgaaatttgttaacaaattttcactaaaattgccgaatttttcttattttcatcgaccattttggcaatcggaatttcaacggcctaaaaattgtcaaaaatcggcatgtcgcatattctcgttacgagctctccggtgtttcctattttttagttggaacaaaacctacttgcccctggcacaatg

SEQ ID NO: 110214 - DNA, 690 bp, Heterodera glycines
  Promoter: Source sequence=SeqID_5409; Location=1226..1915; Strand=-; Gene=SeqID_57925
acagccgacgaccgatgaaccgatgagccaccgccgaaggatgaagcggatggacgaatcaatttttttaagggggaaggtgttaggccggtacccaaatgtccgccttactttatttattttgtatgtttccctcgtcccccttatctctgtctctccctccgtccataaatagcccgctttttgaccttccctcgtcatttgtctcattcgcatcattttccccaattttgttatttctttttatttgctccataaatattgatttatttgtttgccactcaacggcataacaattggcgacgcccgagcagatatttgtttgtttgtaatttgaaattacgtctctgcgggcccccttcaactgatttgaatatttattaaagctgcttttggaatttattggagtgctttcagcatccaataaatcattccaatttcgacttctttttgggaaagagtcgaaggcatttgtttgaagccgattgtggattgctttgtttattgtctaggcgacattaaacattttcgtcgttccctgttaacagtttggcactgtttaacagttgtaaagtttgcgccgctgatattgtgttttggcaacataatttcagttcgtccacgcgcacccactctgataatatcttggcgctattatcaatagagtggtgaacgacaaaaataaaaatg

SEQ ID NO: 110215 - DNA, 128 bp, Heterodera glycines
  Promoter: Source sequence=SeqID_18696; Location=1385..1512; Strand=-; Gene=SeqID_83363
ataataaattaattaattaaatcaaataatattttaaaattaaataaaaaagtattcaaaaaaccaaagaacaaccataataaaaaaaaatttcattgatttgtttctattttagtgaacaagaaatg

SEQ ID NO: 110216 - DNA, 77 bp, Heterodera glycines
  Promoter: Source sequence=SeqID_10320; Location=1119..1195; Strand=+; Gene=SeqID_73500
ggtcaaaataattaaatttaacaataataataatttaaataatctattttattgttcccattttagcaatcacaatg

SEQ ID NO: 110217 - DNA, 266 bp, Heterodera glycines
  Promoter: Source sequence=SeqID_9419; Location=1238..1503; Strand=+; Gene=SeqID_71346
ataatgaagcaactaattgcccaattagaaagggtccggaattcaatgaaaatttcaacaaaagtttttttagcgattttttcaaagaattctaatgaattagtatttttcaaaaaaattttcccaatttttttttgtataaaaattttgtgtactttcactaatgacagttttatttacttattttttcatccctttccctttcaatgcgcagcgtaaaacctgatcaaaaattgtcacatttgttccccgacaatttcggcatg

SEQ ID NO: 110218 - DNA, 150 bp, Heterodera glycines
  Promoter: Source sequence=SeqID_5937; Location=1..150; Strand=+; Gene= SeqID_59737
acgacgactcgtatgaccaaaaaatgccacgacgacgacttgtatgaccaaaaaatgcaacgacgacgactcgtatgaccaaaaaatgcaacgacgacgactcgcacaaccaaaaaatgccacgacgacgactcgtatgaccaaaaaatg

SEQ ID NO: 110219 - DNA, 78 bp, Heterodera glycines
  misc_feature (17)..(17): n is a, c, g, or t
  misc_feature (33)..(34): n is a, c, g, or t
  misc_feature (59)..(59): n is a, c, g, or t
  Promoter: Source sequence=SeqID_32528; Location=1348..1425; Strand=-; Gene=SeqID_62841
aagagtgatttaaaatntatttccaattaattnntagaaatcttgaaagcctaaatttntgataaaacttcgaaaatg

SEQ ID NO: 110220 - DNA, 696 bp, Heterodera glycines
  Promoter: Source sequence=SeqID_2684; Location=1..696; Strand=+; Gene= SeqID_81076
cacataatgatcgatactaagtattaacaacacaattatggtgaataaaatgtatattcacgatttttatccaaaaaaaatttacaaaacaatagggtcccccctatggtttttgataaaatacaaaatttatcactttataactagcgccaaatttgcttaataggcccaaataattgtcatgttcgtaatcaatgacctttaaaacccccgggtatttggtttcaggactttttaaacaaaaaaaaattttgaccaaaaaaaagttgaaaaaattttcaaaatacacctctttgtaaatagtgccttctaattcatttaacaactatttagtttgatgtaaaacaatgcttaaattgttaattggacaaaaatgcgcaatttgcgtcctaaatttgaccgattttaacgaatactttgcaaattttgccccgccccgactccaaaattgtacaaagttatactcgattgctgacaatccctgttattttttccactcttacacagggacaaaaccattgtttatgcgttaatttgtgtttttgtttgtgcggtttaattattggcgttttaatctattttgaatttattaaaatattttaaaaatcggaaaaatttgtaaaccaaattccaaaccaaagcaaaaactttattcatcaaattttcttctattacaatattttatccttcacaatg

SEQ ID NO: 110221 - DNA, 878 bp, Heterodera glycines
  Promoter: Source sequence=SeqID_15497; Location=1..878; Strand=+; Gene=SeqID_79779
ttttttcatccccccccccccaattgctcctcaggttgtgctgcgccgtttgccgcccggcatcgttcccgccgatttacacgcgcagttcgccccgttgccggccggcgagccgcacgccttttggttctgcgccgcgcccggcagcgccccggttggcggtggcgccaacggcaataccagcggggacggaacgaacgcggccacaccggtggtggaggacgacgcggacgaagtggcggcgacgctgcggcgcgcccgttgcgccttcgcacgcgcctatttggtgtttcgggaggagaaaaatgtgcgagaaaagttgtaaaaatgggataatttttaaatccaaaaatcaaatagaaaaaaaggaaaagtcggcagcttggaaaatttgtccccctattaaaagttgcatttttaaaattaatacaaaataaacatttggtgggactctttttgtttggaattttcgggggacaatttaaaacaaaaccaaaaatagcctctttctgaaaaaaaaatcaaatacaattaaaaaaaaattgcggcggggacaaatttttaaaattatttggaaattttttttttttacattttttaagcactcaacatttatagtaccaaaatgttttttgtacataaattgttttggtttttgttttaggctttgtctttcgctgaacgtttcaacggctatgtgttcgtggacagaaacggtggcaccgaaatttattttttagattttttttttttgctatttatttttaatgctaacaaaaaagtacactgaaattttccccctctttttcggcattgaatcgatggccatcgtcgaattggcgcccaaccaaacggtgccgaaacactccgccgaaatg

SEQ ID NO: 110222 - DNA, 77 bp, Heterodera glycines
  Promoter: Source sequence=SeqID_28862; Location=1815..1891; Strand=-; Gene=SeqID_59440
ccaaagattataacttttaaatttacactcttttgatgaaaaaaataattattttattttgagctttattattaatg

SEQ ID NO: 110223 - DNA, 121 bp, Heterodera glycines
  Promoter: Source sequence=SeqID_7505; Location=2780..2900; Strand=-; Gene=SeqID_65043
tcactcgtctcgtataaaagccgcccaaattcactcccaatcagttcaaccaaaagttggatttttgctaaaataaaattgtgcgtaaatatttagaaattattaaatattattaaaaatg

SEQ ID NO: 110224 - DNA, 858 bp, Heterodera glycines
  Promoter: Source sequence=SeqID_1019; Location=1738..2595; Strand=+; Gene=SeqID_66207
aaagggggaggtgttgggtatgactaaagtccatttcattcccttccttcttttattgcatttctctatcctttattattgattgtgtctgaccatttcattcgcatataagcgcatgcattttcccccattttggttgttcgctctcattcattcatttcattttatgtttttcatctctctcttctttcgcatttattttatttgtgttttccaaacaataaatatttgtcgccaaactatcggacataacaaaatgaaaatggggaaatggagggggaaataactttggcatatacaagttggcctgaagccaatttaatttcattaacatcattggttccgacaaatttaataaaagatcactgggaagtacacacaaatgaatttggaaaaagatacattacggcatggctttttgggataagttttgaattatttttgagcgatgagcctgacagggttgtcctaggaattcaggcacaattttcaataaatgacgaatggcactcaaaaactgagggggaaagtgaaacatattgggaacaattgggtgagattgacggacgaatcctcgaaattcagagaattcccgacataaccattacttattccgaaaacccattaataattgattatgaatttgatcaaaatgatgatcagaataattcaccgacaattaatgttatttccgaaggggatttattcatgagcatattggacataaatacagaaacagagaaacaaaaagaaaaatgtgcggagatttcaaaaaataaaacagaattaaataaaaaggccgaaaacccaaaaaaaattgatcaaaattttgctgaacatacatcaaatttagtcatg

SEQ ID NO: 110225 - DNA, 53 bp, Heterodera glycines
  Promoter: Source sequence=SeqID_6732; Location=3611..3663; Strand=-; Gene=SeqID_62668
tttcggacgacatcccattgatggaagtggccaaaggcaggggtccgggaatg

SEQ ID NO: 110226 - DNA, 300 bp, Heterodera glycines
  Promoter: Source sequence=SeqID_21927; Location=892..1191; Strand=-; Gene=SeqID_52563
aacgaacggtcagtcaaatgaaatcaccgaatcgaaattgggggaaatattttttcattagggagctatgctgatgtcgccttttagtgctaattgaggtcaacgccagagaatttcatttagaacatttcactctttcccctcccccgggattttttataaatatttttccgtccccccccccccctttaaattcaggcggaggatgaacaaccgttgcaggaaacgcccaaaccgatgaaggcccctcccccgtccatcccaacgaacatttcttcgccaatcgacaagaaaacgatg

SEQ ID NO: 110227 - DNA, 1003 bp, Heterodera glycines
  Promoter: Source sequence=SeqID_9734; Location=1504..2506; Strand=+; Gene=SeqID_72525
gttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacgtcatttcatttttcccaagaataattggcaataagaaagaatttccaatgttttttggcacacctgggcaaataataaatatgcaaaggttttataattttcttattaaaatacttaattatataatggaatttgtttaattcgtttttcctttttgttgaaaggaatgaatttaatgatgatttcagaaaattaatagggtttatttctaaaaattcacacttaaacagttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacgtcatttcatttttcccaagaataattggcaataagaaagaatttccaatgttttttggcacacctgggcaaataataaatatgcaaaggttttataattttcttattaaaatacttaattatataatggaatttttttaattcgtttttcctttttgttgaaaggaatgaatttaatgatgatttcagaaaattaatagggtttatttctaaaaattcacacttaaacagttttgaatcgcttaaatataataatataaacgcagtttctcattataggtttttaattcatcatcaaaatataccgcccgaatttctagagagaagcttcagagttttccaaaaaatatgctggtacccaaccacaggcactaaaagaatctttttacaacgtcatttcatttttcacaagaataattggcaataagaaagaacttggaattgcaatg

SEQ ID NO: 110228 - DNA, 251 bp, Heterodera glycines
  Promoter: Source sequence=SeqID_3897; Location=3011..3261; Strand=-; Gene=SeqID_45670
aaaaaaaaaaaatttttacgatttttttgttcgaatttgagtccgggggttcaggaattagtcaaaaatgaatcccgtatttgttctcggcgccccgaaaaccttatacaaacatgtttttgtgcaatatgtataattattttttatcagttttttgttgctttgcgtgttatttgcccaaaaatggatatataagcaaactttcccccccccctcacttcattattattatttgtgtcgtcccaacaatg

SEQ ID NO: 110229 - DNA, 108 bp, Heterodera glycines
  Promoter: Source sequence=SeqID_38501; Location=188..295; Strand=+; Gene=SeqID_67289
ttttttatgtcatttgaattccaatttctctaattaaatgtaataaaatgctttaatttcgatcagaattccttttgacaagcaatcaattcgtttttattaaaaatg

SEQ ID NO: 110230 - DNA, 982 bp, Heterodera glycines
  Promoter: Source sequence=SeqID_12948; Location=1588..2569; Strand=-; Gene=SeqID_76702
aaaagtgcgctgaggccaaattcggacgaaggcatttacaaattatgcttctcctccggtgaccaactaattacagaacattgataaaccattgttgatttattcattacaccaattagcaaattgttaaaacctaaggctaaatacaatctcacccaaaatggtaaaatgccctatttgctggtcagcattgagcagttttgtttacattatatttataaaaacgaatatttaaaaaaaccatagttaattactttttcatctgatttttttaatccatttgtgtatgtatgttgctctggtcctcattctttgttcaatctaaaaaattatgatcaatcacattttttcaaatttaaaacaactttaataaaatgtcaaaaaaaagtcagccaatttttttaataaaattaaacgatgttaaaaaaacttaggtaaaaaatgtcttatatgcaacggttttgatctgttatgatttatcaagaatgttctgattttgattaatgtcgtattttatctatttttatgaaaaattggttaattttatggtaaaggatatatttattaaaaaattttgtccctccctcataatttttattgtttcacactttaactttaacattgcgctcactaataataacaccgcccatcttttataaaaaaggttgaatgtttttatccgccatggttttaatgtggcgtggcgttttgttattattttgcgttaaaaaatgatttgaaaaatgtaaactttgttttactttttttttcattttggttgacgtcgtttttttatccatgcctattaggtgttttttagggttaaatggtactaggctgtttttcgctaaaaaaaactgtaaaatattttgatgttttgttaaaattcaaattttatttgcaactttgtctcattttatgtatattcatatttatagctatacaatttttacaaaaattacaattttcatctacgcaaatg

SEQ ID NO: 110231 - DNA, 96 bp, Heterodera glycines
  Promoter: Source sequence=SeqID_28210; Location=1900..1995; Strand=-; Gene=SeqID_58851
tttcgctgtctgcgccgccccaaaaaaagccaaggatagtggccaaggcaattaaccttcgccagctcagatcgcacgcggacatcaaagtggatg

SEQ ID NO: 110232 - DNA, 133 bp, Heterodera glycines
  Promoter: Source sequence=SeqID_33908; Location=529..661; Strand=+; Gene=SeqID_63831
ttttcattttctgatttttttctctcaccatgctcgtttatgaacatttttcccctcttcttagatctaagcaaaaattaattccaacaattctcctatccccttagcctgcgggcaagaaacagaaaatatg

SEQ ID NO: 110233 - DNA, 55 bp, Heterodera glycines
  Promoter: Source sequence=SeqID_8694; Location=2714..2768; Strand=-; Gene=SeqID_68871
tagttcaccctaatttaggttcaaaaaaaggcaacacaaattgacaaaggaaatg

SEQ ID NO: 110234 - DNA, 1003 bp, Heterodera glycines
  Promoter: Source sequence=SeqID_9116; Location=1506..2508; Strand=+; Gene=SeqID_70300
tttgcgtcaattttaatttttctatgataaccgtaaaattctaattttttgaaaaaatcaaaaataaacttccgaaaacttccaatcttttttcaaaatttcagaaaaagataatggcatccgacacccaaaaattttccctcgattcatagggattgattgccccgcttttcccccgctttaccacaacaaatcattcattcattccttccttttcaattgttcaattgtctcaattcattcatcgcaaattccactttttccgcgcttttcatcgccacaaatttctccaatcggttcaccgatttctcagattcgtttcaattggattggctttttcacccctctcccgctttttgcgactttccccgctttgcgtagtcctaaaatattttcgcgccacaaaaatccgtttatttttagccctttcaattctttacgacctttgaattttttaaaatttataaacaaaaattatactaaaatgattctaagctttgtgcttatttaaccctttacaaataatttttccaaaaaaaaaaattttttttaattttattaacatattttaatacctctttgttggtttttgtgcatattttatacacattttagcatttttttatacatattttatttacatattttgtcatcgcttcgcagagcgatgacgaagcacgaaaaaagaaagaaagaaatgactaatcataaagcgaggacggaggccaaattgactgttatttaaccgccacccttttgccttttctgtcagttgaagcataaagagcaaatttgttgggcttttcaatcaataggcaaataatttaatattgttcatttaagcttgtaaaatttcgggttcctctggcggctataccagagaaggttcacttaatttattataacagtaaataagacgtaacaaagtggtgcaacggccgaatcctaaggcaaaaagtttgtgtaaaataaaaagagtgtagtgggtgaaccgttataaatg

SEQ ID NO: 110235 - DNA, 137 bp, Heterodera glycines
  misc_feature (32)..(32): n is a, c, g, or t
  Promoter: Source sequence=SeqID_11690; Location=1..137; Strand=+; Gene=SeqID_75172
ggatcagccggattcataagcagtgaaatttnaacttttgttaattggcacaatattaattccaaaaattagtcccgaattgtgattcttaatgtttcaaaaaattttagtttcttcccattttcttccctttgatg

SEQ ID NO: 110236 - DNA, 276 bp, Heterodera glycines
  Promoter: Source sequence=SeqID_37847; Location=702..977; Strand=-; Gene=SeqID_66832
attgttaaaatttttgatatgatattcaacattttaaaataagcaataccccgcatactacatggccttttggacacattgttaataccaattaaaattttaattattttctacatttttctcgacttaatcacccatccttccatcaatcactaattaatgtcttggaaggtttaaattaaattgagatatctttatatttttgtatggttttgttttctcctaggctttgcccagcgtccgttgcctgcgctgccggtgcgcaaactgagcatg

SEQ ID NO: 110237 - DNA, 142 bp, Heterodera glycines
  Promoter: Source sequence=SeqID_733; Location=681..822; Strand=+; Gene=SeqID_60092
tcgccgccgactcatttagcctcacccaacaaggggagacacaaacggccaccagcagccgaatcttcgagtcttcaccaacaagggttaaaggactccggccatcagcagccgaacctcccaaagcaggagaatcaacatg

SEQ ID NO: 110238 - DNA, 469 bp, Heterodera glycines
  misc_feature (81)..(81): n is a, c, g, or t
  Promoter: Source sequence=SeqID_5512; Location=2734..3202; Strand=-; Gene=SeqID_58291
tcaaatcaaaaatgggcatgttcaaatgttgatactgttttggttgtacttttaacataacatttttttaaatgttatganctcggcatagttaaaaagatttctaatagatcccactgaaaaaccattaaaaaattgcattgagcgattcgttatttgaaagaatttctcatgcaaaattgttcacttttaaatattagtgggggagggcaaaaattaaggcaaaataatgatctaaaagatgaaagaataaattatcttttttttataatttttatttgtgcaaaaattatccgataaaattttctcacagagagagagagagagagagagagataaaatttaaattgaaagaattgtttggctacttgcacaaagtcgtgaatcattcagacccggaaaatcgttttgttggtatttaaattaatattaaattatgatttatttgtgtaaattatagctgtggatg

SEQ ID NO: 110239 - DNA, 425 bp, Heterodera glycines
  Promoter: Source sequence=SeqID_2155; Location=439..863; Strand=+; Gene=SeqID_78140
agcaattctgattggattttggagttaaatttcgactctattgcttcattttcgaaccccgtctcggaaaaatttcgaggaattttttgaatgaaaatgagtccttcatagattttgctccaaggtgttattttataacatttggctttttaaaaaattttacggttttaaaaaatcattttttataataaaaattctcggagagaaaagttcccgccccctattaattaattaccttgctaaaattgttctaagcactaataggggccggcttcaccttaataaatccaatatccaattgaactctgccgttattactttggtatatcattcaaaaaacaaatttgttcattttgtcagatgactattcacgctcttctctcctgtcctcaactgctgactcgggcacggagtctccgccaatg

SEQ ID NO: 110240 - DNA, 235 bp, Heterodera glycines
  Promoter: Source sequence=SeqID_8937; Location=2901..3135; Strand=-; Gene=SeqID_69715
gcgaatgtacggtacgataaattgggaaatggtgtaagagaaagagagagagaaaaggaaaaaatgagagaagagaggcgagggggaaagggatttttagcatgtgttattaagcgatttaacagaaatcgaggagctcgaactgtggcgcgtcagctgttcgggccacaattgcagtcggcgctgttttggcttagaagagtgggaggagcccattctgtgtgccgatgacatg

SEQ ID NO: 110241 - DNA, 478 bp, Heterodera glycines
  Promoter: Source sequence=SeqID_13193; Location=373..850; Strand=-; Gene=SeqID_77015
cctgataattatgatttgattttttatctttatcttctatggagtggatctaaaatccagtgggtactgtattgtccgtccgagaatgaacgacattcaactagacaactcgtttttattgactttttttatctttggaaaatctaaaaaaatacaaacaaaaagtcgaaacgaaaaatttatccggaacgcaaaacccgaaactttcgaaaccgtacccgaaaataacgaatctaacactcattgactattcgcgatctctaacccgaatgccgaattagtagtccaaaatggttttatgatttgtgatctgcgactccataacgctagcccctagaaacacgttttcgcaatttttaagataaaaaaaaccctttggtttttcataattttataaagaaattagactatttttaagcagacaaacgcgcaaattctatttgaatatgtctggacacgttaatatgcagcaggaatg

SEQ ID NO: 110242 - DNA, 515 bp, Heterodera glycines
  Promoter: Source sequence=SeqID_42194; Location=371..885; Strand=+; Gene=SeqID_70148
tatgtaaaccaaaactagccactcgaaggacggcgaatctcaaacgaagggggcgcaatactcacaatcaacttgtggtgtggccaacaaccgatgggatgttgaaggggaccggaataccctcgctcacttctctcataactcggaagagcatcgaatttcatttcaattttccatttcttacctaatatggttgtccattgcgagagtcgtctgcttgacttatgctggccagtctgcactcattttggaaataggtaaacaaaaataaattacaaaaatgtttttttttaatttaggtttaaggcgttttgctttgtttggtggtgaccacctgcagctcactaaaagcgtaaaattttaaaaactggaaaggtcagcttttcaagctcggctcattcgcagcacaaccgaattcttcttaatttcctataaaggttcgtatcttttatcgtaaaatacttaaaaaatgtttttagctttctcaaatcattcagcgacattatttcgaaatg

SEQ ID NO: 110243 - DNA, 112 bp, Heterodera glycines
  Promoter: Source sequence=SeqID_11158; Location=2234..2345; Strand=-; Gene=SeqID_74510
gtcactggaaaaattccacttccggtgtttttcgtttctaccatctcggccaaggttcggttactcctctcatgtggacggggtcgaccacctcccggctcttcatcaaatg

SEQ ID NO: 110244 - DNA, 148 bp, Heterodera glycines
  Promoter: Source sequence=SeqID_31903; Location=780..927; Strand=+; Gene=SeqID_62213
aggaggaagaaaataggaggaggaggaaagggaaggaaaggaagaaagagtgacaaaagggagacggaagaggagaggagaaagaaaagagtgaaagggaggaaagaggaaggatgaggaagaggaaaagaggtggaggaggaggatg

SEQ ID NO: 110245 - DNA, 552 bp, Heterodera glycines
  Promoter: Source sequence=SeqID_44580; Location=1..552; Strand=+; Gene=SeqID_72054
aacggacacttgaaaaaatcgatttttttgttttcggggcagtccccccgagccgatgcgcctagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 110246 - DNA, 344 bp, Heterodera glycines
  Promoter: Source sequence=SeqID_6978; Location=1825..2168; Strand=-; Gene=SeqID_63465
ttcgtcgaccatgttgttttacttctaaaataatcaacccgggccggccttttttgaaaaattctgtccttaacaggcactacaaaaaaaatttttattttctgccccgacaacgcttctctgagtataagagggatgagagaaaacagcttgaaggcgtgcaggctctgggccaggggtgcaacattgacatgcacctgcccttatattccatagaggaatatggagaaataattcaggcacaaaattttttattcttcgtaatatttatcattaaggactattatgaggtgctccatcccggaatgtttcggcttttctgctttgagacgtttggaaaaatg

SEQ ID NO: 110247 - DNA, 67 bp, Heterodera glycines
  Promoter: Source sequence=SeqID_4250; Location=1013..1079; Strand=-; Gene=SeqID_53760
gctgtaaaaaaggtgaggggattacgcatccaaagagaaaccaggggagaaagaaatttcaacaatg

SEQ ID NO: 110248 - DNA, 130 bp, Heterodera glycines
  Promoter: Source sequence=SeqID_16149; Location=1..130; Strand=+; Gene=SeqID_80514
cccccccccccttcagattttctccacctttctgatccccggtgctccgctgcaattgtcaaacattgcgcagcgcgacattcagtccattgacaaagtgttgcgcgcaattggccaccaccagccaatg

SEQ ID NO: 110249 - DNA, 484 bp, Heterodera glycines
  Promoter: Source sequence=SeqID_25347; Location=1..484; Strand=+; Gene=SeqID_56096
ttttttgagttctgtgaaatttttcagatacattttttaatgggtttcaccatgttaacaggcgggaatttttgctttgtgaaaagtgtcatggtaaaatttaatccgaaaaaattgcaaaatttgaatgaaaatggaaccgaattttgctattgagtaaaaaagcaagcaaagagaaaggtcatttcatatttgataaaatgagtttgtaaaaaaatagaaaatatcgaaaatttatgggttttatacgcattgcagaaacaatgaatgatgattgaccgcgctgttttatgcatttcttaaaaaatttcattttccgctttttgcactataaaaatccttcttcttcccttcctctcattcattcattcactcatttttatttttttccttttttatgccgcaatgttttccgttttctgccccaaattcttttacgctttgagcactatttaaaggtctgggaaatttcgatctaaaaatg

SEQ ID NO: 110250 - DNA, 94 bp, Heterodera glycines
  Promoter: Source sequence=SeqID_35842; Location=755..848; Strand=+; Gene=SeqID_65311
ggttggattatgacagacagaactttggatgaataatcacgacgaatgctgatgatgggaggatgaatatgaatgggatggaggatgatggatg

SEQ ID NO: 110251 - DNA, 211 bp, Heterodera glycines
  Promoter: Source sequence=SeqID_10216; Location=894..1104; Strand=+; Gene=SeqID_73348
tttttctggaatatctattaaatataaaaattatttgcaacataaaatggccatggcgcaccgcacttagtttcatgttcgagagcgtttgacgcatagaacatttctcaaaaaacacgataaccatttttctgaatctctattaacggtaacgtttcttcgtacgctagtatcaccagtggcggcagcccggctggcacccagcggaatg

SEQ ID NO: 110252 - DNA, 234 bp, Heterodera glycines
  Promoter: Source sequence=SeqID_3039; Location=4106..4339; Strand=-; Gene=SeqID_82906
tttgctctgctgtccaatgtccttccccctaaatgctcgcccttcctacgctcactccgtcattcactcacttcgtccttcatatgtttccgtctctccccttctgtccttacccgtgccatcttttcgactgtccacttacctttctccctctctctaatcatttttattcgttaaatttatagtcatttttcaattgctaaggtcattttcaagtgaataacatcgctcatg

SEQ ID NO: 110253 - DNA, 549 bp, Heterodera glycines
  Promoter: Source sequence=SeqID_2545; Location=3725..4273; Strand=+; Gene=SeqID_80313
ggggcgttaggcgccgcaacaacagcagcagcagcagcaaaacgaatcgattacaaaaacaacaacaacaacaaccaccacaaaaacacaaagggccaaggccgagcaaatacatttcgcgcaatcttgccttcttcaaactgttgagcaagtgtcgatcggcacgcgggcgggcctatcgaaagctggtcagaagtgcgactggtgagcaactgctgtgtctggtggaaagtgcattgaacatcctacgctcccgggtgccgcttcgtggaaagcatttggacggactgcgtgcccaggcccagcacgtgcgtgcgctcgtccgaacccggagtggacacggggcgcgccgagtgctgttaagacaacaaacgggcaggggtgtgccagcgttggctggcctcctggccagcgtcgttctgcccctagtggttgataagctgatcaaaaaccagcagaagcagcagcagtagcaatacatcaacctcgacaagaaggacaacaacaacaacaacaacaacaacaacaacagcactcattgacagaatg

SEQ ID NO: 110254 - DNA, 310 bp, Heterodera glycines
  Promoter: Source sequence=SeqID_9273; Location=496..805; Strand=-; Gene=SeqID_70830
atttctatattttaattgtttgatttgtaaaccaaaaatgaaaattttcgttttaagttaaagggctcaaaatcgcatttttacgataacattttttgttttatgaaggtaaatttattgaatatttggcatttttcgggttttgagcatatttgagggatttttaatgcatattttatgcgcatttttagtgcatatgatttatagcccatgtgacaaagagagatttttgtatgggctgccgtaaaataaaaaaatttcattagttaatttatagaataatttatgcaaattttagactaattcaatg

SEQ ID NO: 110255 - DNA, 785 bp, Heterodera glycines
  misc_feature (32)..(32): n is a, c, g, or t
  Promoter: Source sequence=SeqID_16412; Location=1..785; Strand=+; Gene=SeqID_80816
ttttgatcttttaaagtctgaatattatttancacactttcattttaagagaatttgacagatttaattaattttcaaaattccctgtacaactttgcatgcgagattttatttggccaaattttaatcttttaaagtctgaatatttacacactttgacattaaaagaatttgacagatttaattaattttcaaaattccatgtacaactttgcatgcgagattttatttggccaaattttaatcttttaaagtctgaatatttacacactttgacattaaaagaatttgacagatttaattaattttcagaattactatatttgaaaaaataatgttttttaaagtagttttttttcaacaatttaaagtggttattgacctccataattaatatataaaccaaaacattttaaaataaaatattaattatttaatttatcgaaaattagtaaaattacactttatcaagcgcatggggttatatttataaaaaagcccttttaaagaaaatatactaaatttggcaattttgatttattatcttaattaaacgtatagaaagagataatagctatatttactcatttgagtctattgtattcgttagattttatattctcattcgctttttcattattttttttataatgtttttatgtgcctccctactaaaaaaatatttttttaatgctaaatcactaaaattcaaaaaatgcgcagaaaaacgtgcttttcgtatctttctcttaaaatatatctgaacaaatatttagcataaaatg

SEQ ID NO: 110256 - DNA, 84 bp, Heterodera glycines
  Promoter: Source sequence=SeqID_26340; Location=807..890; Strand=-; Gene=SeqID_57085
ttgtttcaaattgatagaaactctccgatctttccaaatttgacacaccacagcaatcatggattgattttacagccacaaatg

SEQ ID NO: 110257 - DNA, 482 bp, Heterodera glycines
  Promoter: Source sequence=SeqID_32046; Location=1301..1782; Strand=-; Gene=SeqID_62357
taaaatttaatttgttgttttttgatttattgaacgaattattaatttaaattttaaaaatttaaaagctataaaatttttaaaagtgaaaattttggacctatttattaaatggattacattatttacttcaaataataaatctgttttttaaagaattaaaagaaatttaatatattaattaaaaataatataaatattctgtgttttagtacaaagaatttgagaaaataataagaaatttaattttataataaaatattgagaaattattgaaaataaaagtaataaaaactttttcttcatcaatatgaagataaaaacgcattgatgaatgaaaaaaactcgataatgatcatgaaaaattaattaataaaaattacttcaaaagaattaaatttgaaatccggcgagaatactaagtaaaaaaatacattttatatcccttttttgtaaattattatttatttaatttaagaatg

SEQ ID NO: 110258 - DNA, 166 bp, Heterodera glycines
  Promoter: Source sequence=SeqID_1537; Location=2602..2767; Strand=-; Gene=SeqID_74332
acgataaatttttggggggaatttagtatttttcgccatttaaatggtgatacaatatatgaaaattaataaacataacataaaataatatttaatagcaataaaaaacatttcccgtcctcaacccgtttccccgcacttcccccaatcccctgctggggatatg

SEQ ID NO: 110259 - DNA, 389 bp, Heterodera glycines
  Promoter: Source sequence=SeqID_17605; Location=235..623; Strand=+; Gene=SeqID_82111
acttttggtggattgtaatatatttaataaatttatagttttttaaactattttaaacttttcttatttagaaattaaaaaccactttagaaacaaattacacgaccctaaacctcgcttattgttttttataaaagtcaataggccgtaccatgattaaattgttttacatgatgaaagttagtaaaagtggccaatttagttttccctaattacgcatccaactggcacatcgttttcttgatcaaatacatttttttcggctttttaaacaattttttaaataataattaaaactgattaatttttattggcttcccccgtcaccactgtttcgccgtcatttttgcgcttgtgtcgcatttgccgactgacggccatttgtcatg

SEQ ID NO: 110260 - DNA, 592 bp, Heterodera glycines
  misc_feature (7)..(7): n is a, c, g, or t
  Promoter: Source sequence=SeqID_5685; Location=1990..2581; Strand=-; Gene=SeqID_58903
taacccnttgtgactcaaacggacagacagaagacggacagacgaaagaggtgcttcttttaatgttgatgataagaagagatgaatcaccaatattatgaaagaaaaatgtataatatgagttgttttacccttccgagactcaagaaatgaggacaaaaactcaagagtctcgcaaagccaatgagcaatggatgcctcataatttgaaggtggaatataatattgaaataatgatttaattggcatgaaaaaagcaatcaaaaagtgaaatttgaaaaaatagacatttacagacggtggaaaagtggcaaaaggagtaaataaatataaattaacacaaaagacactaatgattaatcaatcattcgttagtgtgttattctataagtaataaatgcacatacaataattatattgtatatacaattagaaagtaaaaggaacacatgcaaaatgcacgcccaattagcattctcattaaaaagatcattacaaaagcattacctaatcaaccggtggtgaacaagcaacgaataaaacagaacaattaacggagagggagcggagggggcgagggggggggggaatg

SEQ ID NO: 110261 - DNA, 455 bp, Heterodera glycines
  Promoter: Source sequence=SeqID_22040; Location=1534..1988; Strand=-; Gene=SeqID_52680
cttaggcttaagcttaggcttgcttaagcctatccccccctaggtgtcaacaacctcgaaaacccctaaaaatatgcttttcttttaatttatgaatttagagtttttgttcgaattcggttcgggattcggaattttgcaaaataaaggtcatattcgtgatcagcgccacaaattaccctagaaaattctttaaaaagaaaaagtcgtttgagtgctttttatagtgcggtcacttgagtcgtcccagctgagtttggcactccaattccggcacttttcagcctgaaaaagggcaagcgcgccactaattctatttttccaacccatttcgaacatttttacatgattctgcctgtttttaagcatttttgagtttggggactaagatcaatattttccacatattcagtacagtgatcaaactaattgataaaaaacaagtactaattatg

SEQ ID NO: 110262 - DNA, 90 bp, Heterodera glycines
  Promoter: Source sequence=SeqID_39953; Location=1..90; Strand=+; Gene= SeqID_68405
cgctccaatgtccgcgggggggccgaagtcggcgcccataagcacttccaaagcgcggtattggcgcgtttgaatattttcagtgtaatg

SEQ ID NO: 110263 - DNA, 91 bp, Heterodera glycines
  misc_feature (73)..(73): n is a, c, g, or t
  Promoter: Source sequence=SeqID_9653; Location=1160..1250; Strand=-; Gene=SeqID_72206
tttagcatatcgtttcttgggtcgctttatgctggattacatatggaactctgattacccggagcatgtgtgnaagagcctattcttgatg

SEQ ID NO: 110264 - DNA, 321 bp, Heterodera glycines
  Promoter: Source sequence=SeqID_26517; Location=828..1148; Strand=-; Gene=SeqID_57250
attttattttaattaaaaatgaacataaagacaattgaaaatagaatttgaatggggattatattcagctgataaactaattttgcaatttttttttatcggtttacgatttttattcagaaattttttgtctatattttcgtatttcttggccatatttcagcgcttttcgtctattttttttggccatataaatcttcgccctatttaggaactgttaactattcgggatttttaataaatataattctcagccctaaaaacaaattttgctattttacattttgcaaattattatttttttcatatttcaatgaaatg

SEQ ID NO: 110265 - DNA, 335 bp, Heterodera glycines
  Promoter: Source sequence=SeqID_32218; Location=1061..1395; Strand=-; Gene=SeqID_62540
aattttaaatgcgggatttgcgggatttcgggatttgcggtattaatcccgcgggatcccgtcccgaaattttgagttccagtcccgcagcgggatccgcaaatttgaaattttcggtctctactcgtaaccacagggggaacggggatggaaatggtggatatatgcttcagctaatttacgattaaaaaattgtcataattttaataaagaatcgattcacttttattatttgagtttttaaatgtcttttaggatttaaaaatatatattttttaacatttttttattattcataattatgtattaattttactaaatgcctttaggcgatg

SEQ ID NO: 110266 - DNA, 332 bp, Heterodera glycines
  Promoter: Source sequence=SeqID_25384; Location=1738..2069; Strand=-; Gene=SeqID_56123
gtaccgggtaaagatatagtgaaaatttaacgccaaatttttaccctattaacacacctaattaattttttctaatagctatattatggggttgggtcaagaaaattatcacattttacaccaaaattacttccataatcttttttcattttaattatcttcaaaatttttatttaactgtatctatctttttcatttttttatttaataattcatcctgtaaattcggttcgcaaatgttgattacccaataaacgtttaattgtgaaaataaaaagcaaatttaatcaaaattttattattttatttctttagttgcattgcatgggatg

SEQ ID NO: 110267 - DNA, 541 bp, Heterodera glycines
  Promoter: Source sequence=SeqID_16638; Location=596..1136; Strand=-; Gene=SeqID_81047
ggtgtgtattaacattattttaatatttatgaattggttttgtaaaagggggctgatcagagcaacacaccgccgtcgacgtacgcataatttattttctgtttgatttttgaggagccatttcagcgcgggccaattttgtacgggatgaggattagctatagatcaattttggcatgggccaattttgtaattttgtacgggacgagattagcggttaagctattctggcaagggccagtttagaatagaccatattagtacgtgagacaatgtccaccattttggtgcagttccgcttcagcacgaggcccattttattacggggcctcgggcactttcacaatgggacccatttttgtacgcaattagcctatggctattttggcatgggccaattttatttaccatattactaactgagaccgtgtcctttttagcatagtgccgtttcagcgcgggcacattttattactaagctctacgtccatggccatcggcgttttagtgtgggacataaatttgtacgggattagctatg

SEQ ID NO: 110268 - DNA, 1003 bp, Heterodera glycines
  Promoter: Source sequence=SeqID_8077; Location=287..1289; Strand=-; Gene=SeqID_66913
atgatgggatatcaccaccacaaccatttatttgtctctcgtccgaaaattcgggacaaatcaaaaagtgtagacaaaaaggggggaggacgcgaaaacccagggatgtaagagtaagccccgctaagattttgggaatttcaaatttttttttcaagggaatatgcaccagggatatgtgccgatgccctcaaaaatttagccaaacggaaatcggaattccgacggctcaaaaaaaaatttttggaatttttaatagttaggtaatgtcatggcaacctctgagctgttctgcatattaatttcaggaagaaattagcaaatttttagttgattttcacccttgaatctattctaagtgtttccgatgccaaaaaaatttgtaattttccccgaaatttttaaatttcatgaacctttgtcgtggaattttctccccaatctccgactttttaatccccgccgaaggacggggagtaaacctaccagaaaatcatttcagggcgtaaaaaaaatattgcaaattggaatttcgaaaattgcgagaccccaattcggaaatcgaaatttttaacacaataaaattttacaaaatgtccaatttaaaagaaacggaaaaattatttttatttaaaaatttttgaagccataaatctgttgagttgctgtttatttatcttataataaataaaaacacttttccattgttacaattttctaatgaaaatttttccgataaaaattttttttaattttaagagcaaaaaaatttcccatcgccacatccccaaaagggcgggcgacgcaaatattcgacgccaggcataatgttggacaatgacaacaataatgccacaccgagcacaaattttcacaacagcatcacggcaccgtcaccgttgtgccaaagtgtgtgcaaaaaaaaaaaaaatttgaatttttttcggcgaaaatccaatttttttttcaatttttcgtctcttttggcactggcccagcaatg

SEQ ID NO: 110269 - DNA, 764 bp, Heterodera glycines
  Promoter: Source sequence=SeqID_34051; Location=1..764; Strand=+; Gene=SeqID_63945
cggcgcggatgggagggggtagagtgggtaaacgcgtgcgggtttcacgcaggattgaatgcgtgcgtttttgtgtgtgtgatgcgtgtataggagtgggtggaattagaagttagagaagaggaaaactatagagaggagatgaaaagggaagcgagagaggggatagaacgaagattcagaaagaaaggtgagagagacagagaggaagagaagagagatagaaaagataaaggaaaaaagcgagaatacaattaaaaagagagcaaaagataaagagcaatcgagaagtgggaaatgggtaacgatagaaagagggggaaaattgatagatgatagagagagagcagagaggatgggaaatagaacagagggagagcgaaagagagagagaagagaaaaaaaaacagagaagggagaaagcagtgagagagagagcgaagagagagagagagaggtgaaagagagcagagagagagcgaagggagagagagagaagagagaaagagggagaacgaaagagagaaaacgaaatatagagtgaaaaagggagagagaaaaagaaagagcggttggcgccgctcgtataattttaagaagcaaagggttaattttttttgaagcaatatacatatgtacatacatataatgcaaattggcaaaatttaaaaagaaatgaattccttagtttgtctgcatctaaaaaactgatcaaaaagcgaaaacagttatctaaattaatcacactttccttttcatagatg

SEQ ID NO: 110270 - DNA, 956 bp, Heterodera glycines
  misc_feature (17)..(17): n is a, c, g, or t
  Promoter: Source sequence=SeqID_15625; Location=1..956; Strand=+; Gene=SeqID_47304
acaacacttaccccccncccctccccctgcaactgtgcacacccccgcaactcattttctgcatcggcaatgacgccttgtcaacaaaacacccccttagcagaagagtaattccctcccccagcaaattcagtcggaaacggaaaccaatccttcttcacatgtgaaaaaagagcgtattctttccctcaatgagagtcctcctattttttcttctgccgccgccgccgccgtttgatcatcggcggaaagggagtgatcggacgacggacagagtgattgatctgctgcccacccacagatgggccatcaaaatgagaaaggaggggagagccggccgatcacatcacttttccgcccacaactcaatccctcccccatttccatgcatttcattcatttcttcccaaaatagcgcccctttctccgctttttccttctgtctatcagtttaattgctcatcatctaatcactgtctcaattcatcaacagcaaaacatgcaacattatttcccccggggtcttttaatttattttcctttcctttaatccgttgaccccccccctccccatttgtcctctttttcccttctcccattacccttattaggtttcgtttgttgggaaccacctcagctgatcactgatcacctgcgggaggagggggagggaattctgcgtttccattatcatttggtttaaaagcgcacgtgtgggacgaacgaacagtcgagggagaattatcatttaaaattttgggaagttcaataaattggtatctgctattattattatatcatttagctgaatacattccaattaatttgttttatttttattgcctgacacagcgcaacaaaaaaaaacaggagaagaacaccacaagttggagcagttcgaaccgactatgataactatcagcagtttgggggacagtggccgaagggaaggaatg

SEQ ID NO: 110271 - DNA, 116 bp, Heterodera glycines
  Promoter: Source sequence=SeqID_217; Location=805..920; Strand=+; Gene=SeqID_47180
aaacgacatgggggtgtgccaacacacgcacgcgcacacaaaaagcctataaatagacagcgcatacctgttctaactcactttgcaaaacatttagcacataataacataaaatg

SEQ ID NO: 110272 - DNA, 77 bp, Heterodera glycines
  Promoter: Source sequence=SeqID_13890; Location=1842..1918; Strand=-; Gene=SeqID_77836
aaacaattagaaaagaagacaaagaaatttgcgattgatgaggaaacattgaaaaaaagaagagctcccaaattatg

SEQ ID NO: 110273 - DNA, 627 bp, Heterodera glycines
  Promoter: Source sequence=SeqID_3783; Location=262..888; Strand=+; Gene=SeqID_51857
attaattaattataaattattcattaaataatagtgttattataaaattagccaattataatttatttatttaattaaaggttcgtggtgacttggaactgttcgcggaaccttcattgctgaacgatataacagtctgattttggttttaaaactaaaaaattaaaataaatattatggtacttatttgttagctagtttaatgggttaaatgccaataaatgtacaaatataattaattttttaatgtgtcaacacacaaatacttaactcatgaataaataatatttggttttttttataaatttattataatttttaaattgtataatatgtatttgtacattttataggcatttcaaaatgtaagatgtgaatctgcttcttaaattaggtaaatgacagaaaatcatacgatctaaaagaatatttttttaattttcacaaattcataattttttgcttagcatcccattcttcccgtgcttattttgcatcggtatcacctttactggtaccggtagttcattttttcgctaccgtaaccctaaaaaccgtaacctttaccgtccccgcgccgtgaaaccctttcaaatttagaatgacgagaacacggaaagaaaaatg

SEQ ID NO: 110274 - DNA, 838 bp, Heterodera glycines
  Promoter: Source sequence=SeqID_13513; Location=955..1792; Strand=+; Gene=SeqID_77408
attaataaattataacgcgccgacttttttttgccatttttagcccaaaatggaattttgcaattaagcgcaattagtggttcaaaagagagcttattagaacatagataatatattgggcagaccccctaattagcccttaatgtatatttaatttatctccctaattaagccgtgtcctaattaataatcgcgcgccgactatttttttttgccaacaaaaatggaatttgtgttgattgacaaaaacgggaacttacccgccataaatcgatcagtctgtcagttggtccccgtgctcattcccagccctcccgccccccgcaatgatacaaaataaatatagtacatacatacagccctcaaaccgtaagcgcccggggcgtcagtgtcggcggtcggcggcccgtccatttttgggtgctctgtgccccccacccccgccccgttgtccctctcccctctccctccccaacaacactcctcgagactctcgacagcaactaatgatgatgatgtgatgtgatgatgaggggacggatgatcgagactgttatcactccgttcgctgccgccaaacaaatcgcacaaaaattcgcaaattatgaatacgaatgaatgaatgtggcggcggcggtgttaaaatatgatatgtaggtgctgattggtgatgatcagcacagcagatcagggcaatcattcacgccatcccatccccaatcactcctcactcacaacacatcacaaacacccgccgccgatcgccgcctcgtcccacccctgggcgaaattcgggggggggggggggggggggaacctgtcgatcggtcggtcgatg

SEQ ID NO: 110275 - DNA, 545 bp, Heterodera glycines
  Promoter: Source sequence=SeqID_3620; Location=1..545; Strand=+; Gene= SeqID_51146
ttggatttgattttaatgtcctgtaaatgcggaatttttttccattttttgaaatttcttgattcagccgatcctactattttgactatttatcagttcaacaatttcacaaattttgtttgatcgatgaatgaaagcaataagcagaacatttgcttgccatctactggagatttaatgaaagcagcagctgttgaagaaatacgtataaagtcaaaggaacatttattttcagtttcatctgtttattaattattttaattttgaacaatggataaatatacatattatttttatatgtttttccacatatttttgtatgagaatgcacaaaattcatttttgaccgaaatattttgtgtaaaaacaattttaaattaaaaaaaaattgtactccgtggtaaataaatattaattcacaatatttattattattatttatttccctgttttgtattctaatacgggaatcattaatttttgattacagataatattttaaggtatttttactaaaaaaaacaattaattttttgtgtaaaatg

SEQ ID NO: 110276 - DNA, 1003 bp, Heterodera glycines
  Promoter: Source sequence=SeqID_14289; Location=493..1495; Strand=-; Gene=SeqID_78312
catttcaacaaaaacacatataattagtgcagttatttaaatttcaaatgaaatgaaaaaatcaaagaaatattaattaaatcaagaaaaataagcatgaatgttcaaaaaataaagcgatactatatgcgtttaaatgatgaagcaaagtaggtaccttacggtttggggcagtcacatgtgagttttaaaacctcaatgaaaagcccacagaatatccaaaaatagcgcttcaactatttgggaggtataaaaaagtaacaatttgggcattttgcagtcctcacgcaaaaaggatccgcacagataggagttaacattttaccgaaaagtctcataaatttactcccttatgtgcccatgctaagtaatttatgccgctaccgatggtgaaatttgggtgaagccgtaaatatcgggccgcaaatgtccgattttggcttaggacgcaaaattcaataaaaaaaattgggcctaaaatgttccgataatgtatcttaagaaatgggccgcaaatgtccgggacaccaatgtcgggccgtaaatgttgggccgcaaatgtccgattttggcttgggacgcaaaattcaaaaaaaaaaatggcctaaaatgttccgaaaatgtatcttaagaaatgggccgcaaatgtccgggacaccaatgtcgggccgtaaatgttgggccgcaaatgtccgattttggcttgggactcaaaatttaaaaaaaaattgggtcgacaaggtacgaaaattgcccttaagaaacggtccgccaatgtccgggacgcaaatgtcgcgggccgcaaaagtccgattttggcttaggccgcaccaaaaaaaaactgggccgaaaatgtccgttaatggatcttaagaaacgtgccgcaaatgtccaggattcaaatgagaaaaaattaccaagaaaatccaatgatgaaaatgcaaaaaaaggaaatattaaataaaggaaatttggatttttaaaatcctttttttagaaaatg

SEQ ID NO: 110277 - DNA, 1003 bp, Heterodera glycines
  Promoter: Source sequence=SeqID_13375; Location=219..1221; Strand=+; Gene=SeqID_77256
cactatatagtatcagcataagatttacttgtagccgcattcagaaaattattcagataccagaatacaaaaacccagaaaacatattctttggttccgggcattcttgactattttaggattcgtgaagccttttgtttttgctaaatcacggttaaccggataccggaacttcctgatttttttgggtccggaagccctgaaggatttaagtacgggtatttgacataaattttttggagaaattggcatgttttcaaacgcaaaaaaggccacatttaatacataaattctactttctaccggtggcaattaccgtaaaacttgcctaatccaatctcatgtacaatgttccaccaatttttataacgttcatgaagcagtttggtgtcagaaagttcgtagtttctttcatgcagatacttggtcgttattttgttaaattgttgtacaaattgctcgtaaaatgtgtttaatttggacacataatcctgctcttcaccattgtccagtgtctctttgatagacgccacagtaagcggcggtgctacagtatcttagaaagaatgatcaaaatgaattgcgagcgtgttggaaaattgcaaattcctacaccctgcatttttcgtaaatcagcaacttagatactgtaaggaagaagctggctgggcgattaaaacgcggaaagcgggggttgttaagatccataaaagaaagggcggatgtgcctcggtagcggtagagctgcccacggaaagggtgcatgagtgggttcgattcccacccgaggtttaacattttgcccatttcttattatactttacccaccaaaaattggcgtagtttttcagaaaaattgagtagcaaatagatatcattcattctagccctatgtattctttattaggaatttcaaaaattacattaaaaatcaaattaaaaaacaacaaattaaagacactctcattcggtttgaaatgcaacagacgacttcaaaacaatg

SEQ ID NO: 110278 - DNA, 473 bp, Heterodera glycines
  Promoter: Source sequence=SeqID_28454; Location=1094..1566; Strand=-; Gene=SeqID_59069
atttttaagatttaaaaatttcaaggaaaatcctaatttttgtaaacaataaatcataactttttggtgagatgattaatcgcttagcttctgcttaatgatagcttttaaacacatgagattagaatgataccaatcttgaagaaattaactgaccaacaaaaaagttatggccattcccatttgaaattgtacgaaacgacattgtacgaacctgccttgtgaacctagaaatacgtcctataggcttcaaactaagctaaaaacatgtttttcgtgcgtttcaggcctcccacagtccaggaaaaaaaatatggatttccatataattacaagccctagtaatttattgtcaattttatattgtaataattttttgatttaaaataatgttagtttgactgatcctttttgcttaaatttaatcattggtctagatttgtgacgttttgggttgctgaccttttggaatg

SEQ ID NO: 110279 - DNA, 104 bp, Heterodera glycines
  Promoter: Source sequence=SeqID_1908; Location=967..1070; Strand=+; Gene=SeqID_76708
attctttttttgtatttatattttgaactgacttttcaatctattggttccatcggagaaagcgatttccctcacattttccctgtttttaagacccaattatg

SEQ ID NO: 110280 - DNA, 95 bp, Heterodera glycines
  Promoter: Source sequence=SeqID_27780; Location=1..95; Strand=+; Gene= SeqID_46068
acgaaatacctaaaatcgatacggtttaagtcttagataatttactaatcaaataattactgttggtttttgacagcaaattgtctgattgaatg

SEQ ID NO: 110281 - DNA, 727 bp, Heterodera glycines
  Promoter: Source sequence=SeqID_6262; Location=3464..4190; Strand=+; Gene=SeqID_60918
aacaattttatgcgccatgaacagatcaaatagctttcgcctattctcaagtgttggcagttgcaggtattctaatcgattttggtatggaattggcggaaggctacatttaaaaaatactcttttggtgaaatattaaaaagtagcaatgaaaagaaaacgattcgaataatcccaacaatacacctgccaattaattaatgaaattacaccttttcttcaaatcaactaaatgaattataaaaattgaactcaaaaagggcaaacttcaagggattttttgttcaaattaaaataaaataatttaactgacatagaaaaatgaaagaaaagttcctttttatgcaataataatataattttattttgctcatttcatcttaatcaaattttgcactttttgttatgtaatggcgtaattaaataaaatgcgactctgagaaaattattttgattaaattttgtaatggaatattaaatgaagcaattagtgaaccagcagcttacactttcagacgttaatttatctgaaaacaaattaaaaatgaattactaacaaatgaacatgaaagcgagtcattaattgaattttacataattccaaggttaaacacctgtattaaaggaaatattagccgaaattcccactttattttttaacttttcatttaaaattataaaatttctatgaaattttagtttctgaagcatttaaatatcaaaaatg

SEQ ID NO: 110282 - DNA, 366 bp, Heterodera glycines
  Promoter: Source sequence=SeqID_27630; Location=1..366; Strand=+; Gene=SeqID_58311
tggcatgggtttccctcccctgcgccgccccttccgatgctgtccctccctttccgcaaaattattttatgctttgcttgcataagtcttcccgcccggagaaggcgggcgaaaagggacgaaaattggctttgaagccccgaaaagcctttgccgaaaggcggggggggggggcgagggtcgcggaccgggtcccttagattgggctcaatattagcaattccccgctcaaaacgagattagccgctggcccattccctctgccgtgccctcccccccccattttggcattcccctctctcactcattcattcatccgtccaattgttgctgagttagggaaaatcaaaaacccgtcctaaaatg

SEQ ID NO: 110283 - DNA, 875 bp, Heterodera glycines
  Promoter: Source sequence=SeqID_5482; Location=314..1188; Strand=-; Gene=SeqID_58205
ttttttaagtgggacgacggcactttttactcattaacatcaaaattcggccgatgggaaagccaaaaaggcaaatatttgctctttttgggtaaatttaagccaattttttgattaaatttgacgtgatttgattattttaaggaaatgctaaaaaagtaaatgaaaatgacgacgaaaaacatagcaaattaatgacggaaaaaacgaagcaaaggaaaggagcattgccaaatgccaaactgaccaccctttggactggtgctgggtcgtttcttaaaaactgccaagttgtaggaaaataaaaaatgtaagacatataaattcgtatcttggcttaaattctaccaaataaatttgaggacacatagggttatcgactaataacaaaaaaataaaaagcgaaaatacttactaactaaaatttattattcatcaatactctaattttgatcatctaaaattccgaccttaacatgctcaaaacgaagaaaatacactgatgttgtatatcacatctctactccttatgggtccatccatataaactgtaaaatttcaaatatatcgtaaggaattaaccttaaatattaaatatatggtggattattcattattaaataaaattgcatttattatttcacactgactgcttttactgggcatgtcgcttcaaaatgtgttaattggcttagtaacgctgtccgacgaaatttaaggctcggtgaagcaaatgagcctaatccaacaccatttttgcgaacactaagtgcttcagaattggtttcactacatgtaatgaattaacaattaatttatttatttattactgattttcgcttatatatttgaaattgaatttttagttccaaatg

SEQ ID NO: 110284 - DNA, 1003 bp, Heterodera glycines
  Promoter: Source sequence=SeqID_18308; Location=528..1530; Strand=+; Gene=SeqID_82900
tccttccgggaactttgaaattcagtgttaacacagcgtttgatttggctgctttaggcatttaaatatataaagaaattttctaaatgcttaagaaacgtaaagtagtcaatttttagggtgcattttcagattttcttgtattttttttacgatttttctcaaaaatgccaaaatatgtgcaaaatatgtgccaaaaccccgaaatatgtgccatatgtttttatgtgccaaaacgccaaaatatgtgtttttatgtttttataactcgctctaaatcaaaaattgttcggagaaaatgctatttttgggcttctctcgccataactaagccgcaaaaaaaatatgttaaaacataaaaatcccagccctactcattagtgttaattaaatttggcataatgtcttttttcgcgtttttctcacttaaaattgtattctttgtttttttccacctttcattccaattttattatctggtaatttttattgttttgtgccgtccaatttcttttgactttaaaattgatattcgtcaaattgtttctcatcgatatttgtcttttggaattaaagtgtttggatttgacattggcctactctgtgtttggtataattgcgtccctgtcttaagtcagtagcaaaagtacaatttggcgctcccgaggaaacaggtacaaaagcggcgatttttaaagagtttgagggtgagatcgggaataaaaaaattttcggacgggttttaatttggagtgtattaagtatcagtccggaccggacgatatttaagttctcaagtggaaattgactattccggatcggaaagttaaaaaaagcgacaaaaaactccagcgcaccgaaaaatttattgtttatcagaaaatttgagttcgggccgaaccttttttgctgtctacatcgccgtataaactattgacaccgggtcggtgcttagtttttctccgtcttctcgccgaatttttacatttgaccttgttggatg

SEQ ID NO: 110285 - DNA, 1003 bp, Heterodera glycines
  Promoter: Source sequence=SeqID_10603; Location=88..1090; Strand=+; Gene=SeqID_73836
acatattttggcgttttgtcacataaaatatgttagcacatattttggggtttggcacatattttgcacatattttggcatttttgagaaaaattgcaataaaaatacaagaaaattgaaaaatacaccccctaaaaatcgacttttttcctaattattaacataattttcaaattaaaaaattttttcttcgattgtagaaactaatgaaatctcgaattcattaattcgtcattggatttagaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgggccctactaataactcgaaaagtagcttaacaacagcccaaaaaaacatgtttttcgtgcgtttcaggccacggggagctcaggaaaaaaatatataaaaacctaaaaatcgaagccctagtccacacaaaaaaaagttttaggctgcgcctaccgggtcccttaaagttgattaggcagctgatccctcctccatctattcaaatattattatttttgccacaattttttcctctctctttaatttgggataaaaattagtttttgtcatttttgtaatatttttcctatttgcttatttctgaaggcacggattgtgtgatgtatgtgctaattgtagcggaaaagccaactattgcagaggaaatcgcaaaaattttgtcaattggcaaatacgaaatacggagaggtgaagaaattcattaaaaataaaataaaactgaaaactaaaatattaaatttttttttgcaggatg

SEQ ID NO: 110286 - DNA, 416 bp, Heterodera glycines
  Promoter: Source sequence=SeqID_9664; Location=2572..2987; Strand=-; Gene=SeqID_72257
cctttctgttcatcgctctgatcactttctgtctgctcccacacagtgacccagtccggcggcgtcttctgccacttcctttattcattcgctcatttgccccccattttttgttatttctctcccccccccccattgatccgtcttctgatcactttttctgctgctcctccccctccaatcactgcttcatcattttccgtttttcatcgtccgctgtccccattttgccttttgcccctcccatttaaagtgtcaggcgaatggcgcatcttcgtcagaacaccgccgccattctctgttccccgccccctcccttccccaattttatttctaaattaataattttatttttttattttaatttgtttccgttcttcctttttcagtttctctctctctgtgcctttaccatg

SEQ ID NO: 110287 - DNA, 94 bp, Heterodera glycines
  Promoter: Source sequence=SeqID_20392; Location=2323..2416; Strand=-; Gene=SeqID_50913
ttttttaataacgcacttttttgatggctttttttataagggctcggcaccctttaattaaccttcattaaaaaaaatattcagaattcacatg

SEQ ID NO: 110288 - DNA, 1003 bp, Heterodera glycines
  Promoter: Source sequence=SeqID_6758; Location=3186..4188; Strand=-; Gene=SeqID_62770
agtgaattattggaaagaattttgcacctgaacaacttttaataggcgcctcgcataagcctggaatattcttaaaaatatctgttggttagcatagttggtaaaatattataaaatttctttgcatgttcagcttgagcttgctgctcaactaatagtgagtcagagcaacatcgaaaacgtatgtacataggaacattcgacacggcgattcaattttgggctccaagtacaattaagttggtcttttcgtcttagtggtctgtgagttagtcaccaaaaggggggtcccaggttcaagtcctccctatgttgtgtgttaatttcaatttcttcttttaaagaagaaggcagaattattttttcattaatagaaaattctggagaatattgtaaattttatttggtttggccttaaattgtggacttggctaaaaaagaattaaaattattgaaatgtttgccctgggaaaaaatttttcctgtgggtaacttttcttgaaattttgcctaggctagttttttggcaccatctgtcgaattctattttgttttttgaaagtatcccttactctatactaagtgagaggaagctccgcccctttttgtgtttttgagtttgtttggcgttatgttttaaaggaagagaaaaataaaataaaagattatgtatgaagggaagagaacacttcattattttgttatttacgtttttgatttcatcatttgttttttcgtttccccttccgaatggatttcttttcctttgtgtgtccttcattttaaaggaactttttatcattaatatttttcttttaaattattatcacatttttgtgaatgtccatttttttctaataattcattattatttttgttttaatcgttttttgatataattttttttgaatttcataattttttaaggtgtttttaatcttttatgaaatgctctcaatagctataaaaatatattcaaaaattattttttagatttgcaatg

SEQ ID NO: 110289 - DNA, 330 bp, Heterodera glycines
  Promoter: Source sequence=SeqID_13572; Location=4148..4477; Strand=-; Gene=SeqID_77476
ttttcatattttgtgacaacttttgagtttgatcgacagaatttattggtgcaatactcatgctctgccaggagcagtttgggccttggaatatttttttcaacgtcaacataactaaaagaagtagtttctggatcagtgctccgacagaggaaattgatgctgaaatttatcctttgaatttttaggatcagtaagttgcttattcttctttttgttgagaattatggtaatatttgggtgttatgtcattaattaaaaatcatcataatcaatattagcgcaactaattacatgatttaattgcaggaaatacgtcattaaaaaatg

SEQ ID NO: 110290 - DNA, 411 bp, Heterodera glycines
  misc_feature (96)..(96): n is a, c, g, or t
  Promoter: Source sequence=SeqID_132; Location=1..411; Strand=+; Gene =SeqID_74199
atgcagaattcttttctctatcgatatgcaactcccccctggggtttaacgtatagaaaaaaagttagacggagacatgtaaatgttgttttttanataattaaaatgaagagatagtacgccaaagtgagagaaattacaaagaaaaagaaaaacgacgagatagtactaggcttttctctgcacagtggggcgtacccatagtgtatttacaatcccttctccatcttttcactttttgctcaccttctctttcttaaaaaaacatcaagaaatcgacaaaaaaattcgttctctgtgtacaaaacgcatacgtctctttatttcaattaatttgcttataagcaaagtttcctaaaatctgataactgaattgtcgttgctccgcatttgacaaaaaagaagaaaatg

SEQ ID NO: 110291 - DNA, 493 bp, Heterodera glycines
  misc_feature (77)..(77): n is a, c, g, or t
  Promoter: Source sequence=SeqID_3723; Location=1201..1693; Strand=-; Gene=SeqID_51624
tctgacaaatgaatggcccaaccaatgcaatattttatttttttatattaactttaattagggaatgtgccccgtgngtggatattagtattatgaaagcagaaattatcttatttgttccgttctaattatcttcattttgacaccaagagttaaaaagtagagcgccccagcgaccgcgcaaaatttttggcaggatttctggtcctgttcctgattttgttccggcattttcaaaatcttgatctttattaaaaaaggtttgaaccgatcagtgatcactgtaaaaacagttttctccgtcccttcccccaccttaacactgttgtcatccgtcggcgtgtattgtgcgtcaaaatgcagcgcctgcgtctcggccggaccgccttcgccttgcgtggccaccgtcagctgcttgacaatctgcggcgcctgcttctccggctccgccggctcttccggcagcggacgcggcgcttccaactcggcgatg

SEQ ID NO: 110292 - DNA, 394 bp, Heterodera glycines
  Promoter: Source sequence=SeqID_12207; Location=1244..1637; Strand=-; Gene=SeqID_75780
aagggggggaggtcgaaagctaagggaaaaagaggaaaatttctgaaaaactggctattttcttaacaaaattcattaaaaattctgaaaaattttccccggcggcgcctatcggcaccgccggcccccaaaaaaatagctctacaattttactcagaggtgatctttcgctttttctattgataaaaatggtttattgttttttttgggaaaagataaaaaaattcaaaaaaaccgaaaccgaaacggtataccgaaaatttttcttcggtttttttcggtttcggttttttttggtttttaaccgaaaccgaccgaccgaccctcttgtccggtctctaattttaaccgcctcatttcctcctttttttttgcatcgcaggatgaacaaatg

SEQ ID NO: 110293 - DNA, 502 bp, Heterodera glycines
  Promoter: Source sequence=SeqID_21385; Location=410..911; Strand=-; Gene=SeqID_51998
ataaattattttaaaaagtttaattagcgtcgcgatttttatgtgttaaaatcactgtcacctgaacccgtcagtttggtcctcacgattggacccctcgattggccctcatgttgggccccacacatttgggcccaagcatgtttttccacttataacttttttctttggcaccaaaattcaacattcttggtgtcattcgaaagctcttaacatgctctatttaccttacaaaaaacgagaaaatttcaaacctggaaaaatttattaaaaagtttcaaaatttttgatttttttttgcaacttccatgtataacttttttggtaattgtgtaatcgcgaagctatacatagtttagaaattattatttttgttccgagagttacaataaccaactttcccaaccatctaataacacgtaaaaatcgcttccatatattaatatatcaatgttcaatgtatcaattttatcttttactgaagcaaaatatttgacagatg

SEQ ID NO: 110294 - DNA, 428 bp, Heterodera glycines
  Promoter: Source sequence=SeqID_18492; Location=2912..3339; Strand=-; Gene=SeqID_83111
tttttagcctaggaatttcacacagaaaaaaaatttgcaaaaaaaacaataaaaattctgacttttgcggttttcaagcgattatttttttgtgagttgtttaattgcttacaattagcattagcttaaaaatatcttctaaacacaagagctttcgaatatacaaaatatcttacataggttttatcaattaagaaaaaatatatggctcttaaccttggctgagacggagttggcccgacggagtttttaaataaaaattaaatagttttagtttatttattttaattcttattttcatattgattaaataaattgtttaacattgcatttttttaaaaattgtatctttccttatttattaaattttttcacattttttttagtctgaaactccttcaaagtcaaataaaaagaaagcatcgatg

SEQ ID NO: 110295 - DNA, 1003 bp, Heterodera glycines
  Promoter: Source sequence=SeqID_29593; Location=310..1312; Strand=-; Gene=SeqID_60070
gagaaaaatattttaaaaagcattgaaatacttttgattggcatgtgcttgcgaaatggataaagaatgtgactttcttgaaaaattcactttttgagcagttttgtttcgattttttgcaaatattaaatgcctattctttataatgaccttaattcaaataaatgttccaaagtttgaaaaatatttattctttttgggtttaaaatattttattccatttttttctgatttgtcttttgatggcacatgagaatacatatgtatgtggaaggccgtaataaatagtaacagtgcaaaagcacaatcagccaacagaattttcgaaaatttccattttttttttgcgaaaatgctgattaagcttttggtactatgtattacaaacaaaaatatatctgtgatttgtattttgaagatcattcatatataaaatggaaatgctttgaagaaaacggattttcacatctttgaacggcaaaaatggaagataatttgctttttgcgaaaatccatttcccagcacttttgcactggatgtggtgtggtggttgaggatcataatgagaggtgtggtggagggggcgggaagggatcaacaattgaaaaatattttgaaatttttgttttttgaaggcagagagagcgagaggaatggggacggcacgaaaacatcttttgattggtcgaggaacggggacggcacggcacgattggtcaacattggcaaatggggcgtgatgtggtgcggtggtaacaaaatgaggagagaatgggggacagagatgtgccataaagtagatggaggagaagctaatctcggaaactaattagtcttttctatttgaagggacatggcggcaaggctttcgtctgttggacttcggcgaaaactgccgcggcaaatgggaaaagtgattcggcaatgtgcggttgacagagtggatatgcgtcgatgaactgttggacgagtcgggcggcgtcaatgcgtccgttcaaaatg

SEQ ID NO: 110296 - DNA, 70 bp, Heterodera glycines
  Promoter: Source sequence=SeqID_19521; Location=2206..2275; Strand=-; Gene=SeqID_84253
gacccgagactctcgaactatttaagagataattggaaaaatgtcaaagtcctgcctaaaaataacgatg

SEQ ID NO: 110297 - DNA, 213 bp, Heterodera glycines
  Promoter: Source sequence=SeqID_9048; Location=931..1143; Strand=-; Gene=SeqID_70102
tttttgtgacttatttattatttatctcctattatttcgttgctatcttactgtttatcaattaactgaactcatttaacagtgtcacaccaacgcaacgacaaattgaataattttgcttgttttatttaattgtttagtttttgttacacgatcaaattattaattgccttctttattcgtatttttccttgtaattctattttttagatg

SEQ ID NO: 110298 - DNA, 1003 bp, Heterodera glycines
  Promoter: Source sequence=SeqID_2327; Location=1740..2742; Strand=-; Gene=SeqID_79142
aataacgacgagaaaaaatacattagaatggataagaaaatggggggggggatacgaaaatacattaattataaggagaaaggtatgataatacattaattagggatatatacaaagaggggagggacatgaaaataaaataattataggcggggatatgaaattaattagaacattaataagaatgggggggataaattatatatttatacattaaattaattaatgaagggggggggggatacatatggaattacattagaattaatatgagaaataaggaattacattagaattattatgagaaatatggaattacattagaattattatgagaacagtatgttgagaactcatacagaatacagagttttttttaaatattgcaccagaatttggcaaaatgttattttaaatttcccagaccaaaaatatttatccattagtaaaactctgcattctgtatgaggtgggcgtataaattagtgaaacgggtaagttccagcgtgtgggcgccgggccccccggtgttgttagcgtgttggagggaggcattatattcattacgcctatcctcatcaagaagtacagtgttaaatcccttccgggccagtacaaaatttgctaatagccgcgagcagcgtccgttgccgtcggcaaagggatgaatgaaggtctaaatattgaatgggtgaacaaaagagacaataaaactaaacatttttctatttatcattcattatttgaattatatttttatgtgtgtatagcttattttgccatttgtgttatgcatttaactaaatttgctttgcagaacagaattttggcttttaattacatattttgtttttaaaatgtctgctaatctaataattaaactgcattactagtcgataatgcgtctccgctgttagtgtaataatgtcagtagtgttctcgtggcagttgaaccaatcgagaaattccattagtttttccgggacttcctcgtaaggacatg

SEQ ID NO: 110299 - DNA, 386 bp, Heterodera glycines
  Promoter: Source sequence=SeqID_13938; Location=1905..2290; Strand=+; Gene=SeqID_77889
tagtttcgtgtagttattgtcctccgaggcataacttcacgagggacgtagcggacttagtgtttaccctctgaggaagcacttcgtccgaacagagggttgaaaggtgttgtgtagtggacgaagtacttgccctccgaggaagtacttcgtacaaaagggtgttcaagcgcgcacaaggccactgacaaataaggaaaaaggcaaactaacagtcctccgaggctttagtttagccataaggcaaaaggcaaacaccttgtcctccgaggcagctgtttagtcacaaaaggtccaggaccaaggccagactgatcccggaaaaagacacaaaacaacaagtgcaccacaacacacacacacgcacaaccaaactgcacgcaatg

SEQ ID NO: 110300 - DNA, 520 bp, Heterodera glycines
  Promoter: Source sequence=SeqID_4695; Location=364..883; Strand=-; Gene=SeqID_55432
gcatttttgactcactaccactcgaaatttttgattgatattcattcccgaaattgcacagttttgtgcgaaaaatttgttcctttcccctctccaagcttacgagtttgaagggtatcaattgtttttcccacaaaacatttttgcttcaaattgactggcaacactggtggatcacttttattttgcttattactgatttaatttattactttggtaaagtgcattttaataaacaatgttcaaggggtgtgtaaagcgttttttaaaagggcaaaaggcaccaaaaaaatatttctaggcattttcagtccaaatgttgtgtagaaccatacaaatttttccttccaatttaaaccaaattttatatttcattatttatttttatctctaccgaataaaaaaattgtacgtaaaaaatgagagagtaaaaaataataattttattttcccactatttttgtttggttcacttaatttttaaacaaattacataggggtattcattttttgtgcaatg

SEQ ID NO: 110301 - DNA, 186 bp, Heterodera glycines
  Promoter: Source sequence=SeqID_3522; Location=1128..1313; Strand=+; Gene=SeqID_85016
aattttacaccaaatcacaaaaaaaaacaaaacacttttacaaaaagagtagattacactttccggtcggaagaagaaaattcttaccaaaatataaataattctaattcactaccactaaacaaaggggatattaattctttagaaggttttatctgttgcttaactaatattcgctctataatg

SEQ ID NO: 110302 - DNA, 234 bp, Heterodera glycines
  misc_feature (58)..(59): n is a, c, g, or t
  misc_feature (79)..(79): n is a, c, g, or t
  Promoter: Source sequence=SeqID_28769; Location=793..1026; Strand=-; Gene=SeqID_59340
gaaaaatgacatatcaattatagaaataaagaatagctttataataaatcaatttcannaatgataatgattaaatatntaaagcatcgatttgggagtagtgaatcgaagtcattttttgctacgttttgatggaaatctgaaggattccttcacatttatttcaccacaaattagtggtttgttttaattcgtttcaattaatttaatttaattataaataattttcagatg

SEQ ID NO: 110303 - DNA, 125 bp, Heterodera glycines
  Promoter: Source sequence=SeqID_8467; Location=2110..2234; Strand=-; Gene=SeqID_46600
ttgttaatgccttacatgtttgaaaaattttttgttatagtcctcttgacaattttccccctattttgcacccacaaaattttttttcccctccctttttttcgaatttgccggccctcggaatg

SEQ ID NO: 110304 - DNA, 1003 bp, Heterodera glycines
  Promoter: Source sequence=SeqID_27906; Location=244..1246; Strand=+; Gene=SeqID_58570
cagcatcctttttgccaatttcgaacccctgacccgaacaaagataaaattagaaactttcgtatgtatgatatcctcattggcatcttgctcatgagggtactcttggtattggaagcctatcaattccttgtccctgtacagctcatgtagtgaacggtagcgctgacctgggcacggattcatgatcagcgaccctaaaaaccccttaaaacttattttctttaattttaaaaacacatttatgtataggcatttgaaaatctatgttaaaactgtccggtaaactgcaaaagtagcctggtttttatgaaaaatttaacaaaattttttggaaaagttggaagaaattttcgttttgacgctcttttaaaaacccaaattattaaaatgattgtcaaacattatgacaatttatcaaaattcataaaatttaacagattctgacgattttccctaaaggcctcaaaaatcctcaaaatttctcaaaaatccctcattttgaaaatttatcttcactgaatattaaaaaacaacaaaatgaggctaaagcctcagacctgggaaccctgattaataacaagctaattatgagcaactttctgtgattaaacattagggcttccattttttctaagaaactgctaatttttttttttgaatttggacctaattaaatttgttttacaataacaaacggacattctaaagacaattttttaaaatgaaatgatattgtttgacctcataaataattctttttaatttctaagattatgcactagttagttttttaatttcatttaatcgccatctctcagtttgatatatttctttaataaattagttgacattcttcctttaaaattaaagaagaatcggcacaaataataacccaatttgatatttaaatcaattagttgatcattaattaatcttctatatattattaataaaagtattaagctatttttcatcctcaacaaataattataaaactatg

SEQ ID NO: 110305 - DNA, 385 bp, Heterodera glycines
  Promoter: Source sequence=SeqID_14994; Location=450..834; Strand=-; Gene=SeqID_79150
tcccagcctgattaacaattcctgcctgtgaaaatcgggatcctaaacctaaaattttgggctggaatttatggtcttaagatttccattaaaaatgccaaaattttttgcattttcttattagttttccaaaataattgtttattgaaatgttttttaataataattcatgaccctttagaataatgcatatgaaaatcacaaaaatacaacaatttccgtttttcgataataattatttattcgatttttaccaattttttgcgccacttcctttgcattataatgttgtcaattacattcaatttagtaaatgcaaatatataaatgtaattgcgttccattcattttattaatttaaaaattaaaaaaatagtgaacaatg

SEQ ID NO: 110306 - DNA, 304 bp, Heterodera glycines
  Promoter: Source sequence=SeqID_4147; Location=1359..1662; Strand=+; Gene=SeqID_53372
attggggagcagctcgttttaaaaaaattattaacttcgaaatttttcaagaaaaaaatattaggttttttatatgaaaattcttcgaaaatttttttaatttaaatttctggggggtggggctgatacggggtggagaaacttggtgccgatgatttcatatggcatggatatgttgctgttctgtccgttttcacctcctcccaccattgtcagaagccctttgattgtcgcggttgaacatgaaaacattgccgtcattgacttacttctgcaacagctgcccaagttggacgtgaacatg

SEQ ID NO: 110307 - DNA, 214 bp, Heterodera glycines
  Promoter: Source sequence=SeqID_39479; Location=721..934; Strand=+; Gene=SeqID_68043
ggtaaaccgggaaaattctttgtggttttaaataaaattttaaaataagatcacttacaaataaaattaaataattaatttataaataataactccattaaaaacaattattctttgatgaaaaaagagaaattgttgaaaaatatataaatataaacattcacgaaaggaatggaatgaatttagagcaaaaattaaacaaataattgatatg

SEQ ID NO: 110308 - DNA, 326 bp, Heterodera glycines
  Promoter: Source sequence=SeqID_20469; Location=311..636; Strand=+; Gene=SeqID_51004
taatgattttgttttgcattactaaaaaaaatatacctatcacataattttaaaaaattaataatccgatccgaatgagtgctatcatcgatcaacgatcgcgatcagaggatcaggcaaatattaagaaaaaacatattgccaaatcaatgccaatttaaattattcccaacccaaagggcaccaaaaacagctaatttgtaagagcgcgcccataggcgtcggtgtcacccagcagctacagtcagctaaatttttttccatggaatataataatttaacatgagaatgaacgaatttatattttagcgaaaaaattgaatatg

SEQ ID NO: 110309 - DNA, 59 bp, Heterodera glycines
  Promoter: Source sequence=SeqID_7847; Location=3634..3692; Strand=+; Gene=SeqID_66145
aattcattttcgttaagactttcggaattcgcctcagaatccgacggggaagcaaaatg

SEQ ID NO: 110310 - DNA, 242 bp, Heterodera glycines
  Promoter: Source sequence=SeqID_32539; Location=728..969; Strand=+; Gene=SeqID_62847
ttttgagaatttggaagctacaattttgaaaaaaattaacgaatggaagagtgcaatttatagaggaaaaatgcaatattaatgagatgaagacaacaaaatgaaaaaattaagggataatatgctatttataataatttttaatggtccaatttattttataggttaaataaacattgaaaggtataaaatgcaaaatttttagttctttgtattattattcttccattttcctaaaaatg

SEQ ID NO: 110311 - DNA, 441 bp, Heterodera glycines
  misc_feature (7)..(7): n is a, c, g, or t
  Promoter: Source sequence=SeqID_24047; Location=1530..1970; Strand=-; Gene=SeqID_54740
taaatantttgattgggactcataaagtgcaatagagccaacataggctaaattctgacttttctgcagttttcaagcccatctttataggttaattaggtgcttagaaaaaagacatacctattaaatatctttgaaactttagagtattcggagacacaaagtttattttgctttttacgaacaaaaaaattatgctttattaaagttgtcttcatacactgttaaaaaaagtgagtgaatgaaaaaaaatgggggagggagggagggcttttatagtcgagaaaaaattggaaaatgcaaaagcgtacaaatgagcataaaaattagtataaaagtggttgctcctcatcctccaccttccattattattcattcgccatttatttgcttcgtctctctctctccaactttttctctctgacaattcctttaaaaatg

SEQ ID NO: 110312 - DNA, 350 bp, Heterodera glycines
  Promoter: Source sequence=SeqID_7531; Location=2284..2633; Strand=-; Gene=SeqID_65132
ttttttattatttattattattgtctcttcgtaaataaatatttgttggtcttattcactcggacaaagacacaacaaatttggcgcagtcagcagtcgtcttcaaccaacaagaagacacccggactgcacaccaacaaaaaaaccaatagtccctagacgggtgaggtctgcaaatactgcagtttttcgccatcaacaaaaccaatagtccctaggggggtgaggtctgcatatattgcagttaatttgccgaaaaaccaacagacctaagaaaggttgcggttccgcaataagcggtttttcaactttggactctcaaattcggcaccggcaaacaattcggcatg

SEQ ID NO: 110313 - DNA, 453 bp, Heterodera glycines
  Promoter: Source sequence=SeqID_20006; Location=1..453; Strand=+; Gene=SeqID_84779
tttacaaggcaaagtatggggttcttcaaaactaggaaccaataatggattatttgatttctgaacgccttccaatagctgcacgtaagtagtgtatggcaccttaatccggtgtaaaattccccccccccctgccctccacccttccacatcctttctttctgccttttcacattccatttcaatttcctcctcgcaccacttttcacccttttcttccgcgcagtttgttagttgttgccccccaatttcaacgcctaattgcgcacaaatcgattgctgtccttcgcaacaccccccccccccccgacgaatatccttcacaaatacaataagttgcggagatgattctccttttacattttacgttttgtaggacgtttaatctatgtattataatttttttattttagcatcagaaatgttttaaactctccaattgtcttcaacatg

SEQ ID NO: 110314 - DNA, 51 bp, Heterodera glycines
  Promoter: Source sequence=SeqID_21664; Location=1087..1137; Strand=-; Gene=SeqID_52271
cctaaaatatattttttaataaagattcttttgcgcgacattgtgacaatg

SEQ ID NO: 110315 - DNA, 114 bp, Heterodera glycines
  Promoter: Source sequence=SeqID_8311; Location=1171..1284; Strand=+; Gene=SeqID_67657
tgttcgtgccaattaactccgaccagtttcatcagatttattattcgctttcagtttctatttaccattcgattacggaaaacggggggccgggcttttcaatgagctgaaatg

SEQ ID NO: 110316 - DNA, 1003 bp, Heterodera glycines
  Promoter: Source sequence=SeqID_23719; Location=500..1502; Strand=-; Gene=SeqID_54415
tttgaatttatgggttgatttttgaaaattttttgaaagtctgatcattataattggatttatgtatatgtatataattatttcaacattttaatagccagaaaaaaaattacgggggggggggggggaatccgaagaattttttttggtaaaatttatttagtgttttttaaaaaagttcagcgccggacagcaaaaacaggaattgtaaccatttttagccaaaaaaagactactttttgccattttgtagtcaaaattttaaaaaataaggtaaaatcgagtaaatcgtggtccggcggtgccgataggtgccgccgggcaaatttttttttttttaaattttaatgattttattaagaaaaatcgacaaaaaaaaatttaaaagtcccaatttttcctgtaaaaatttttaatttttcatttcgggcgggggagggggggggagggaattcctcccctcacctggctaaggttttatgaattttcataaaatgcgtgaaaaataggtgtgacaaaaaagtgatgcctctattttctaggcgaactacccaaatagccttaacaacaaataataaaaaattataaatctattttaattcttaaataaatcgaaatacgggtagccctttaaataaaaaatagaaaaatttgttttttataaaaataatcttacaagaaatcgtctcgaaaaaataatccaaaagtcaaattacggatcaaaattacggaaaaatcccaaaaatccgtaatccgtaatccgtaattgcgtgcagccctgtttccaacacaaacataattatctaatttgttatgtaatggaaaacatataaaaagcgacgaaagaaattttcattattattttccattcgccttcgtctctctctctctgcgactttttcgccctgacaatgtctttaaaaatgattctgtacgtttttcgtatttcttcacaatttcaccattttccttttcattttttagtctgtttggtgtgccaatg

SEQ ID NO: 110317 - DNA, 104 bp, Heterodera glycines
  Promoter: Source sequence=SeqID_25037; Location=654..757; Strand=-; Gene=SeqID_55770
ttcggtagttgtttttgggccaattttctggccaatgcctttatcttttcctaaaaaaacccccactaattgaagttaccgaagaggaacaaactgtccctatg

SEQ ID NO: 110318 - DNA, 1003 bp, Heterodera glycines
  Promoter: Source sequence=SeqID_9761; Location=27..1029; Strand=+; Gene=SeqID_72607
tcacttgttctcgacttgaaaattcttaaaagtttgattaatgctcaattttttttaaatatttgaaagttttagcgcgccgaaaaaagtgataaaaacaaatctgaatttctaataatattcgatcatttgagtcaaaaaaagattaattgtttgaataattgaagaaaatttgatttgaaaattttcattgatttaatttagtttagttttggatttataaaataaaaaattaattttgtattattttgagtagaaaaagttttaaaatgtgaattttaaaatttccggttggtcccggccctgaagaaaaatctaggtccccggtcccggcttctcaggtcccggcaaatcacggtatcggttttgcccaaaattcctggtcaagcttcactctaatttttaatttgaaagtcaaattatttcttatttcttaattaactatacgaaattaattgttcattcatattaatttctaacaaaaaacttttaaactttgaaacgttcttttatattttcagcaaattccctcttttttcttttttttttaatttgccactcaattagcctccaaatttactaaaataattttattgaaataaatttgtgagataaatagacggtataaacattttaaaatttttatttgtttttttttaatttttaaaaattattttgctggttgttattcataaattgatattaattaaaaatgtttttaaatttatttttgtgcttattcatcttttttcttcattccgacattttattttattttttattttttggttttttcatcttcacatttttaaaactatgaacataaacattttttgctgaattaacagcaaatttctcaaatttctaaagatgaataatttatgaaaatgtttatttttttctatttaaacaaaattataatttcttttataataaaaaattaataaaaatatgaagataaaatttattttaatttaaaatttgttaatttaagttgattatg

SEQ ID NO: 110319 - DNA, 242 bp, Heterodera glycines
  Promoter: Source sequence=SeqID_36891; Location=1000..1241; Strand=-; Gene=SeqID_66097
tttttcattttaatttcgaagcctcgagacctgtccttggcccaatggaaccccggaaaattcatacatcccttttatgctcgtcttgttaatttcgcgcacgcgcttaaacctccccagcgcttcatttcaaaacataattttattttgtgccttggatattaaattttatttaattcaaatttaatgtttactcaatagcataatagacataactactttgaatcacacattgacaaatg

SEQ ID NO: 110320 - DNA, 245 bp, Heterodera glycines
  Promoter: Source sequence=SeqID_41304; Location=882..1126; Strand=-; Gene=SeqID_69462
attttttttttaaaagggcctttattttagagatcaaaatccttttttccgagcatattatgaatactatcaacgacataatccgcgcgttatgtcgacctacacatggaggcttacctgaagcacgagagggcggctgcagaacatttgaaggttttcgaaggcaaatacaaaaaaggagaaaaggtttttttacaaaattttaaaaattttatacttttgtgttaaagccccgggacactatg

SEQ ID NO: 110321 - DNA, 225 bp, Heterodera glycines
  Promoter: Source sequence=SeqID_1171; Location=1..225; Strand=+; Gene= SeqID_69232
tagagatcggtattttgaaaaaaacctggacctggatttcctggacaaaaatccaggtccaggaaaaatccaggttgccaaaaaatgacctggacctggatccaggaaaaatccaggcctggatccaggtccaggccaatcttagtgatttagtctctttttaatatgcggaattttttttttgaatttgaccaattttagccgcagttgctttgccgcacaatg

SEQ ID NO: 110322 - DNA, 639 bp, Heterodera glycines
  Promoter: Source sequence=SeqID_2408; Location=2025..2663; Strand=-; Gene=SeqID_79568
ctcggctgtgcccaattggcggatgatgacaaattattgttattccgccataaccaaaggaagaaaatgagcgagtaaatgaacagccaaaacaatatgaggacaaacataattaaaatgcgctttcttcgcatcgtaaaagcagaagcacattcatgcctctaaaagaattttgtagacaaatgtacaagcaaaatgagtaaaagaatcacagggtataacaaaatatagagtcagacttatgaaaaattggaattcggaccccggatccccaaaatatggttctggaattaaaagccagagaaggacccggatacggttccagacttaaagtccaaccaagattcacaaaaaagaaccctaacaaataccgggctgaaaagatccggagacggacggttccggacaaaagaaaacaggaaagcaaacaaaataatatattcaaaaaaagaacattatgccaacacataaaataaacattggcataacgcgggaaaatttttttttcccaataatcgagaaacgacaactgatcgaagaattcccgtattttttcttggtcttgaaatattttagaaatacatttttagaatttttagtgctttctctttttaattgctattttatacaacaaaaatg

SEQ ID NO: 110323 - DNA, 178 bp, Heterodera glycines
  Promoter: Source sequence=SeqID_28221; Location=1..178; Strand=+; Gene=SeqID_58861
cagcccattccaccttccgactgggcagagatcgtgtccctttgacaaacttccaagcattccacttgagagcttctttgcccgacggattcgtgaagcacaactcatcatcattgatgagatcaccatgcttcacaatacggtgattgaggtcattgaccgtgtgtgcaaagaaatg

SEQ ID NO: 110324 - DNA, 740 bp, Heterodera glycines
  Promoter: Source sequence=SeqID_33919; Location=206..945; Strand=+; Gene=SeqID_46365
ttgtctgtcattcgttctttcactccaatttctctccgtcagccattggaaaatccacgggtgtccgtctattctcgaatttaatatttagaacaacttcgcgagagcctacgaatccaaaagcctctccaagtgtattggcccagaaattattatatggatacagtaggtatatattatgttgaattttttttgctctctgcctttttggcgttttgtttgcgtcccgccccctttttctctgatctctcacagggaaattaatcaatcaaatgctgacgtgttacgaaatacaaaaaagaggaggatgtgctgtgttacactttgcacctgtatcagcgatcaatgatgtgcgaagcaccacccagctcgacaagcgttgtttaaagtgaaaaaatcatacgaaaattccaaaaaatatatttttacggtaggaattctaaattttttatattgatttttatggtgccctcctcgaatttccaaattcaacaaaaatattaaaatgattgatagtgagtggactgttctttagcaattacctaattcgataattgttggtgtcctggtactccccctcccccgttgcaaactaactacctaatttgcataattaaattggggcctcttttcatgaatgccgccgattggcatgtcctaccaaaaatagacattaattaacacaaaaattaacgacagcaccaaatctctgttataataagcattttgagtgcaaaatg

SEQ ID NO: 110325 - DNA, 1003 bp, Heterodera glycines
  Promoter: Source sequence=SeqID_5054; Location=1527..2529; Strand=-; Gene=SeqID_56739
ttggcattataatgagagggccgaaataaggcatgaaacaagaggaaagaggcatgcaaaattgacaacaaagaagcaaaattatttgcacgaaaacatggggagaggcaaaaatggcatcggggagagagcgagagaaagggagagagagagagagaaagtgagagagaaagggagagatagagagggcgtgaggcaaaattggcatcattgtggggagaggcaaaattggcatgaaacatggggagaggcactttgagagggccacaattggcattattcaacaaatagagtaggcttaattgacgtgttttaatgaagcgcattatgtgcaaatgacgtatttactatacaatttagaagtatgcattgattgcattgattgatttttacattacaatttaaaaatgcaattttaaataaataaaaagattgtacaatttatgtacaggaatcccaaaaaatttctattctataaatttaagttgcgcagcaaacaaatctgagtgactgacttataggctctaatcatctaataacagcacataataaaatatggatgaagctggatgagcatttgaaaacacggaatgcgggattgatattatccataaaaagaaagtgcggttcccggatattttttctcagtatagtgttttcgttggtgctgggacgtttcttaaaaaccgccacattgggcgtttcttaaaaccgccagggcgtttcttaaaaccgccaggtgtgcgtttcttaaaaccgccactttgggcgtttcttaaaaccgccaactcatatgattatgtatataaatatatatatatatatatatatatatatatatatatatattagaagtttacataacaataaaaaatttaaaatacatatgcatatctagtgacggtaaaataaaataattatttttatccttctttaaaacgttctccaaaaatatgaactgaccagcataatatattctaaaaaataaaatatttaagatatg

SEQ ID NO: 110326 - DNA, 61 bp, Heterodera glycines
  Promoter: Source sequence=SeqID_8719; Location=417..477; Strand=+; Gene=SeqID_68956
ttgttaggttttcgatgccctcgacaaagatttggcctcctcaaatgctggcgaggcaatg

SEQ ID NO: 110327 - DNA, 224 bp, Heterodera glycines
  Promoter: Source sequence=SeqID_40303; Location=81..304; Strand=+; Gene=SeqID_68679
tgttcgatcagtacatacactattccaactcagcttcaatggagtcctgtgtcggataataacaatggattattgagagattcgtggtcagtctctgtattttttgcgtgatgagtgatcgatataaacggataaagcggtcataacgatataataaacaatcataccgcacttggaaggtctgcatgaaccggcgcagttccacttgaatgcgcgggaagatg

SEQ ID NO: 110328 - DNA, 241 bp, Heterodera glycines
  misc_feature (9)..(9): n is a, c, g, or t
  Promoter: Source sequence=SeqID_3094; Location=1..241; Strand=+; Gene= SeqID_83162
ggaaggcanttgaagaaaaatttatttaatttatttccttcatacaatttcgcaacacagaataatggcacttggataactggatttttaaaaattaaacaaattctgggatagaaaaaaatgtgataaaagataagaaaatgatcagcattaaattgctcatgatcagagaaacaattaagaaaggactgatcaaaaattgtacgcaattttcctgatcaaaattgcttatgggacaatg

SEQ ID NO: 110329 - DNA, 177 bp, Heterodera glycines
  Promoter: Source sequence=SeqID_11708; Location=128..304; Strand=+; Gene=SeqID_75197
agtgagcaatttgatcactaatttggcataattaacacttcatttcaacatttagcttgaaaatgtcagttttggctataaattgcattggcaacgcaaccacagagtaattaaatattccatttaacttaatttaaataattttcaatttttttcattttgaggatttggactatg

SEQ ID NO: 110330 - DNA, 1003 bp, Heterodera glycines
  Promoter: Source sequence=SeqID_88; Location=7316..8318; Strand=-; Gene=SeqID_64509
agatttgacgaaatttaaaaaaatggataaattttgcaattttttaatttattcgatgtataaatagcgacttaaaaattttttgaaattttctagcaataaccctcaattaacgtttataattcaaaaaattgaccatttttgatcaaaaaaattaacaattcttaacttttccggtgtaattttttaaattataggcaaagcttaaatttttttttgcctttttagttcgaatagtggtacagtatttgtttacgaaatgaaaaagcatttaaaaagcctattttttcgtggacgggacataatttcgccgccgaaatttcgcagggactaaatttcgcggaaaaatttaaaaaaaaattaaatttagaaattttttaagaaaaaaatattagaattttttataagaaaatttcaagaaaaaaatttttcagcgattttttttgaaatttatggtaaattataagtttttcgaaaatttttcccaaaaatcgttaaaaattttttttctaaaatttaccttgaaatttctatataaaaaagttttctaagatttttttcttgaaatttttcaaattaaaaaaaaaatttcttcggcgaaattttggcagcgaaattatgtcccggcgaaattttggccggcgaaatttcagccggcgaaattatggcggcgaaattttggggtgcacccattttttcttgctttaatttttcaaaattactaggcaaggcgaaaaatagaaaaagaacttatttcagctcatactaaatataagcattcattttttgaatacagttttaacgaaatttgctactaatgcatttccctcccacccttccccaaatttatggccagatttcattaatcataggcatttgcttttacagcctcatcggcctatctccaacgcctcgacattgtcgggattgactttcgtgccgtggacatccgttggtttggcatgcgccgtttgcaacaactttcgtttgctgccaacaaatg

SEQ ID NO: 110331 - DNA, 297 bp, Heterodera glycines
  Promoter: Source sequence=SeqID_29188; Location=1..297; Strand=+; Gene=SeqID_59723
ggggaaaaaatcggcgataagagtaaataggtcaacagaaggcaaaattggggatcaacaaaaaatggacgcagaaaaagagaaggagaagaaggaaaaaggagggggcgccgtgattaaatagcccccgagcagaatatgcaaaaacacgtgaataaggagaaaagtgggcatttttgagagacaaagggaaaaaggcatcgctgaatatgttggggggaatcagagtacagaaaatggatgaaaagaggggatggagggcaaaaagataatggtaaacattttgagaaaaggatg

SEQ ID NO: 110332 - DNA, 192 bp, Heterodera glycines
  misc_feature (73)..(73): n is a, c, g, or t
  Promoter: Source sequence=SeqID_35749; Location=1..192; Strand=+; Gene=SeqID_65232
cagtgattgtaccaaaacaatttactgaatgattacctcttactgatcagccgtcattttgtcacacaatttntgtgcactctttctgaaacaattagtgtattttataaatttattcaacaaaaaaaaaaattcgacgaccatttcatttttgtatcaatcggactttgagtttttcgagtatcataaatg

SEQ ID NO: 110333 - DNA, 325 bp, Heterodera glycines
  Promoter: Source sequence=SeqID_527; Location=5154..5478; Strand=-; Gene=SeqID_55417
tctccaaaaagtatttatttattgttattatttgtgaccctttcattttggtaggtaaacaatttgtttttgttcatatatatttgttctaaggcggatctcttccggactctctgggtgcatgtccacgagaaggtatccaaaattttttgcgcatgcgtcccggtaggcctcaataaaatgggcagtccttgacgggaagaggtgggtggcgatggtgcgtatctgcaacgcccccgcaggattacgcattaatactaaatagtgtgaattagtgcgcgccacacgcagctctttgttgaacaggtgctgagttaccaaaatg

SEQ ID NO: 110334 - DNA, 77 bp, Heterodera glycines
  Promoter: Source sequence=SeqID_15516; Location=2681..2757; Strand=-; Gene=SeqID_79795
tcgaaaaagacaacgcaaagatatggacaaaattgttgagcattgaccaaatattgagcaaaacacaattcaaaatg

SEQ ID NO: 110335 - DNA, 256 bp, Heterodera glycines
  Promoter: Source sequence=SeqID_8957; Location=1191..1446; Strand=-; Gene=SeqID_69806
aaattttttgaaaaaaaatttgaaaatttgagtgcactttgttacgaaaaattgcctatattcaaaaatgtacccataaatttttttaattctcgtttgtggggagaaattcgaagaatttttccattatgcaattttgagtgtaatatgttaacagaaaataataaaatgaagcattcgttttaaaaattaaattttcaaatatattcatttcttaggggtggaaatttcgcatttcgcgccaaaaagcgaaatg

SEQ ID NO: 110336 - DNA, 296 bp, Heterodera glycines
  Promoter: Source sequence=SeqID_22016; Location=1361..1656; Strand=-; Gene=SeqID_52652
tcggcccaacagactcaaacacctctaggagcagcgcaattgttggtgtgtaatgtacacaatttacaattaatgtatattcagctgctaaaagaaaagtgcccgggatttcctgttaaagcacttttataacctgagaaatatataatttttcagaaaaaatataaaataaattttacaaaaatctgcaaatcaggaaataaaaaaaagtgaaaatttttagagtcgagggaaaatattttttattttttgaatccgcgatttctatatatcacatatttttaccagaaaacatg

SEQ ID NO: 110337 - DNA, 246 bp, Heterodera glycines
  Promoter: Source sequence=SeqID_4655; Location=4764..5009; Strand=-; Gene=SeqID_45873
tcgccctttgatttcacaatggccggcacatttccatttgtgccgttctcaacggtgagccaatgtcgtgccgacccgagtgctggggggggtcgagaatttggccctgatcacctccgaatgttgggaaatatgcctaaatcagacattttggttaggaaccagatcttattgataaattccccatcatagaatgggatgatgtgtcatgggtcgatgcagcgctattgccacccgggaaccatg

SEQ ID NO: 110338 - DNA, 62 bp, Heterodera glycines
  Promoter: Source sequence=SeqID_7002; Location=1623..1684; Strand=-; Gene=SeqID_63546
aactaattatgcccaattaattaatgtagatgggcacaactgtggtcaatggaacacagatg

SEQ ID NO: 110339 - DNA, 154 bp, Heterodera glycines
  Promoter: Source sequence=SeqID_26764; Location=1..154; Strand=+; Gene=SeqID_57526
aatttttaacttaattgacattttttgccatttttctgtcccatttcccccgcccccttttttccgttttaatttcgttttccctttcccttaggatcgtcccccgttcgttcccccgcagcaattcgtcggaagtgtcggccccgaacagatg

SEQ ID NO: 110340 - DNA, 697 bp, Heterodera glycines
  Promoter: Source sequence=SeqID_30155; Location=1..697; Strand=+; Gene=SeqID_60588
cccgcccattcaattagtagttcatacttgccagactaaccgctccagagaaaattccaaaaatttggaaccaattctaggcgaaaaaatgttatccacaaaaatgtaaattccaattatttattctctttttgggagccggtgaaatttttttattctttcaaattaaccatgatgtttcgctaacaacaactttgttttgctgctagaaaaactcaaatattcttgattttttcttcaaaaagattatttgaaaaataattgtaaaatcaaccttaaattttttttttaatttttctaataatattttgattttttcctagaaaaaattctaaattttctttgaaaattaaagagaaggcccaaaatatatggggatcgagagctgggagctcggcgtcgtggcttaacattaatacaaaaactcattaccgtatctcgtttttttcaagaaattctgattaactccgcattttccaccggcccatttccggtcacacaccgaaagtaatttacgacgaacgattagggtggggggggggcgaacagagctcgttttctcattaaataattgttaatgctttaattttttaacccaaccgccgtccattttaatcaacattttttgttttcacaaatatataaattaaaattgaaattttcaatttcatattttctgttcagactaatgctaatg

SEQ ID NO: 110341 - DNA, 63 bp, Heterodera glycines
  Promoter: Source sequence=SeqID_18842; Location=2415..2477; Strand=-; Gene=SeqID_83537
aataaaatgacgaaaaaacgagtgttccatctaccaaatattcaggaacttttagacttaatg

SEQ ID NO: 110342 - DNA, 193 bp, Heterodera glycines
  Promoter: Source sequence=SeqID_13345; Location=562..754; Strand=+; Gene=SeqID_77212
aatggctgaatgacattgttttgctcttttctaacccttcccatggccacccttcctcccccagggactgtcgttcaccaacacttcgcccatcattttccccactcgctcttcccaaattggccttggcaccaacccaatcagttgttgtgccaattcacgcgaaaaaggcgacggattcattttggacatg

SEQ ID NO: 110343 - DNA, 116 bp, Heterodera glycines
  Promoter: Source sequence=SeqID_14890; Location=1732..1847; Strand=-; Gene=SeqID_79051
tgttggatgatgaagcaaaaaagtatttggcagtatgcacgcacaaaggattgttccaatttacgagactcccttttggcgtagcgtcagcaccggcgattttccagcaggtcatg

SEQ ID NO: 110344 - DNA, 1003 bp, Heterodera glycines
  Promoter: Source sequence=SeqID_17717; Location=818..1820; Strand=+; Gene=SeqID_82249
tctttttttctctgttttctctcatttctccatgctctctttgtttgggtggtcaaaaagggggtcaagaataccccccccccttatactactattgtgtatatgtattatagaataattttctcatgaaatttctttgttcttgtagttttttaattcaatgactatattttagttttataaattattatattgtcattcttttatttataatttatattattagcattaggattttaataaatgattttcaatcaaagaaaaaaagactaagtaaatacatatttatattattcgagaaagagaatagaataaattatatttatattttgaaaactctttttggcaattaaattttggactatatttttaatgacgttttttggcaaataaatgggataaatttaaaatactaacaacatatgtaatatttttacaaaggcagaaatgggtaataaataatattaataaataatatgcaaataaaataaaaagggtatttaattttagaattttaataacagtttcaattttaaatagtttcatttttttattgaaaaaacccattcacatacaaccctgggatgttaaatagtcgcaaatcattgatcattcgggcagctgattatattacaaataattgaaaaaagaatgtaataattcaatttaaaaataaaatatatcgatagttaattattaattaaaatcttaataaatttcatttcttttgaaaataaaactatttttagtccatccttacgcctttgcgccgggagagtgaggaactggttcaaagtaatgaatcacaaaaaataaaggtatataaaagcatataagtgaattgaaaaaattttggatcaacgcaagaaaaataaaagagaacataaagcccactggagcaacagtactgcaagcgaaatttagaaaaagctaccgctaccggttattgtaattcgcatttttaaacaagaattttaaagtctcagaaattgaacacagcatg

SEQ ID NO: 110345 - DNA, 116 bp, Heterodera glycines
  Promoter: Source sequence=SeqID_29331; Location=238..353; Strand=+; Gene=SeqID_59837
ggttggcgtcgtcgtcaaacatcgccacactgcctttttgaggtgccaatgcctcttttccccatccgttattattcgctttcagtgcccgaattcaacggttgggtttcaatatg

SEQ ID NO: 110346 - DNA, 97 bp, Heterodera glycines
  Promoter: Source sequence=SeqID_45558; Location=322..418; Strand=-; Gene=SeqID_72831
tgcacgtggaacctgaaaacatttggaaatatttgtttttaaatgcttaaaatttgattgaccaagcaaattcggcgagagtgatcatccattgatg

SEQ ID NO: 110347 - DNA, 506 bp, Heterodera glycines
  Promoter: Source sequence=SeqID_3931; Location=34..539; Strand=+; Gene=SeqID_52491
tgtaaaattttatttaaatgaaaaaatcagcaaaaatgttttttgtggcgccctttttccaaaaaaacttttggggagaaacaaatgagttgcaaaaatcagcaaatcagcacctcaaaaaaaaaatcagtttgaccccttgaaacagcaacatgctgataaatcagcagagttgggaattatggttatgggggaggggtgaaatacgtatccctagagaccggagaagtcattctcgatattttaataaaatctcaaaaaaatttataacgaaaagtatcgaaaaacacgaaatttctcataactttttttggtgaaatatcgaaaaatatttatcgaaaacggtggtaaattggaccaataaaatcccttaccctcacacaaatgcaaaatttaaaggaagatggtaattttttaaattgaatatgccgtaaataatgttatgatattcttgtttaaatcggcaccagtggcagcctaattagtgactcattaatcagctaatg

SEQ ID NO: 110348 - DNA, 233 bp, Heterodera glycines
  Promoter: Source sequence=SeqID_38997; Location=1331..1563; Strand=-; Gene=SeqID_67668
taaagtttatcataaaaatatgggtggattattaaaacttttttttatgggcaatatttggcgttaaaatgggtcttgaacccaaaattagacaaaaaatttaacgatgagatacagaaaagtttattaatgaatttgaaaaaagagaaaaagaaaaaattcaaaaaagaaaaaacagaagactatatagacttggaagcattgtaatattactatttttatgtttgacaatg

SEQ ID NO: 110349 - DNA, 300 bp, Heterodera glycines
  Promoter: Source sequence=SeqID_18763; Location=1733..2032; Strand=-; Gene=SeqID_83441
caacaacaacggccaaaactccgttgatgagttttactacaacaaatccaaaacaggaaaaaactcagaagaatatttcggatttcgtttttgagaatgaaaagttaaaggagggaaataagacaaaaacagagataaaagcgaaaaaggaagaaagacctcccaaaacggtaaaaattggcaaagaattaaacggaaaaacaatgcctaggaggaaaagattccaaaaataatgaccacacaaaaaccaaaagaaaaaatggtaacaaaaacataaccacaacacaaacacctaaaatg

SEQ ID NO: 110350 - DNA, 834 bp, Heterodera glycines
  Promoter: Source sequence=SeqID_9300; Location=2837..3670; Strand=-; Gene=SeqID_70906
atatttttttgtgaatttctgctggctgttgcagtgcaggaaaaatatgcataattccgaaccatttttattatcaattatcacaaatcctaaaagtgactaaattttaaacatttcttttcttcttttttgaaaaaaaattttcctacaaatttatttttttttttgctaaaaaatgtgtttttttatttttgtgttgaataaatttccccaattttgataattccagcttaattatgcagtatagcagcagtgcttatgattttttcgagagagaatgatgattagctttcgttttcattatgtcgttccatttgtaatcccaaataaaattgtcggcttcgtcatcattggaagccatcagcagcaatcagcggcagaacacagcagaagcacatccatttcattttcaaaacgatttacgaagaacacattttttgtatattttttcattaccgttaatggataaagtctaaattattattttttgtttttacacattgcattttttattatatacaattcgttttttctttataccatcgtttttatatggtccggtttttcagaaaggttccttttgggaataattgttaacattttgtcttgattatctcatttcttaattcaaaaattgctaaatttgttaataaaataccacaaaattactgaaaatgaaaaatattttgcgaaaagattttaataatttctttccacctgaaatgctgttatttttcataaatcttctgaattattaaaatccattttttcaattgaattttctgagttggaaaattttagatcgaacccttttcgttgtactgcttgaaaatg

SEQ ID NO: 110351 - DNA, 885 bp, Heterodera glycines
  Promoter: Source sequence=SeqID_14841; Location=1059..1943; Strand=-; Gene=SeqID_78996
tttttaacaggcctttcgccaggccgtatccagaggggtggggggggggggggcacatgcccaatgaaatttgaaaaattttcaggaaaaaatgggcaaaatcttgaaaatttaaaacattttatgtgccatatttccattaaaagtttcaaaaatctttcccgccggaggcgcctatcagcaccgcatggaccccattgagccgaaattttttgaaaaattgacccaaaaagggcaaaaatgtgtcttttttagcgcaaaacagaaacaagtttatccactattacccaattaaaacaaaatttaaaataataaattcaaaaaaaataaattttcataccagtttaattaatttaaaaaaatggtttagaaataaatcgcataaaagcatacagttgcatacaattgtgcggatttacacatttatagtaattcttttattatatttctccgaaatatttcttccataatattcttaatcaatgtccttttatctatgcgatttttttcttcgttatacgctttaaacaactcgttgccacacattcatttctctccctttgctaaataaattctcaactaatggcccattaataaataaatattattttctaaaaaatttcatttaaatattttaataaattttgtttgccaaaaaaatatgattatcattttcctggggaattttgtcccatttgagaagagggctaggaagagaggctggagagatggcatacgtatagataaggatggcacgcccaccgcgcaaaacctcaattaaaatttcccagcctaattatcttatcagcataaggaatcatcttttcctaattactaaaaatgctgaccaaataataataattttgcattttcccattaaaaatg

SEQ ID NO: 110352 - DNA, 966 bp, Heterodera glycines
  Promoter: Source sequence=SeqID_16069; Location=1343..2308; Strand=+; Gene=SeqID_80430
ttttccaaaatttgaataaagaatgatttcgatttcttggtgggaataattttggtgcgcaagtgggcgtggccaaagtgcacacatcgtacacccggtcattttcccgattcattttaaaaattttcatctttttttgcacatctgctgttttcctctcctccctcacttatcttttgctttatggggaccatattatttaattgggaattttcgggaccgtataattaaaattaatattttgctgttaaccagggcggtagctataattacaaaaagcaccgtttatcctggcagcattttgccttttagggcttgaggtcgttcgcgtgacttgactaatttcccgagtcgtttaggtgccctgtcgtcttgtgcttcatgggtggcggtgtgctgctcttcaggccatagttggtttatattttttgactattttccatgcccaaatatttattattcattcaccattttacgccattttccatgccggcgctcgcatataaataccgagatttttgctcactcctcaccctttctcagattaaaaaaatggacaatcatccctgaaaacgatcctctaacttttccattgaccatattctctccgcacctaaaaggccccgacaaggcttcctgatcaatgaactcttgggcgtagtccacttccttggatctgttcaacaaggcgaaggaacatcaaaacaggccaaggactacgttaaaaaattggacaacagcattgaacacgtggccaaattccactacgtaaaagtcaagtcaaagttcaccattacggatttgccaagcacgcctgaggcactgttggccggaattttccaacactgcatcgacgaggctattgctgacagccgtgagcgcaacatcgaacctacacacctcggctgtatgatcagcagccctctgttgaaaggcggcgacatcccaactccagtgcgacagatg

SEQ ID NO: 110353 - DNA, 83 bp, Heterodera glycines
  Promoter: Source sequence=SeqID_40899; Location=890..972; Strand=-; Gene=SeqID_69132
taatgaaaaagtcagaatttcgaaaaattttaaaaacaacaatgcgttggcattttttcaggttaagttagtcctttacaatg

SEQ ID NO: 110354 - DNA, 69 bp, Heterodera glycines
  misc_feature (64)..(64): n is a, c, g, or t
  Promoter: Source sequence=SeqID_17870; Location=3255..3323; Strand=-; Gene=SeqID_82418
ttccctcgtaagtgcgctatattttaataatgattttatgaatttttagaagaaagtgcaaaanttatg

SEQ ID NO: 110355 - DNA, 508 bp, Heterodera glycines
  Promoter: Source sequence=SeqID_27326; Location=1035..1542; Strand=-; Gene=SeqID_58016
actgaaaaacgaaagaataatgaatggaatgggaaagcaaagaaagtgccaaggccaggaaagccaaatgtggaattttaatttcattttgaagttttaatgggcacactggggtaaattctcaaataaagttatgaaattcattgaaaattttcatcttggcaaccctggccaaattttggagtaaaagaaatgtgatacgatgtaaacgtacggaattctcgaagacattacggcaataaaataaccggaggaaaattataaacgaattaatgaaatggaggaggaggaaaaaggttattttatatgaaaaatgattcatttttattcattcatttagtaattgctcctcctggcaattcaaatttttcgtaaattatttaaaaattttaattccgtttttatgactttaaaaatttttggtttttcaattttcgtttcgcggaattattctgctctttgtgtaatcatttggaaacggcaaattgtgctaattgccgtaaaaatg

SEQ ID NO: 110356 - DNA, 86 bp, Heterodera glycines
  Promoter: Source sequence=SeqID_39717; Location=345..430; Strand=-; Gene=SeqID_68214
tgcgctcggcgggaggcaacgagacgcgcagtgcgggcggctgcagtagcgccggtagcgctgcgcgacgcacatttcgcacgatg

SEQ ID NO: 110357 - DNA, 349 bp, Heterodera glycines
  Promoter: Source sequence=SeqID_26210; Location=857..1205; Strand=+; Gene=SeqID_56962
gctaaaattttacttctgtaaacattttctatatattttaagagttatgtcagtaaaaatgcagggtgccccaaaagttctgagagcctattaaaattgttaaaactttatactcatctgtctgtcagccaaaatttccggttgcaaactatctttttaactttttattatcctgtttaaatgctaacctatatagctggggttgtcagttaagcaaacaaaaaaaaggaattaaaaaactttttttttttcaaactccacaaaaaaaatgtccattgataatttcctgcttaaaattataagttaacaaatagaccacacttttcatattgatcgatttccagacatg

SEQ ID NO: 110358 - DNA, 399 bp, Heterodera glycines
  Promoter: Source sequence=SeqID_4229; Location=2450..2848; Strand=-; Gene=SeqID_53693
tggaaatcgtctatatgaaggtgtggtctatttgttcactaataatttaagcagggaattatcaatggcccctgttttgtggagtttgaaataaattcttttaaatttcttttttttttttggttaaatgaccatcccatctatataggttagcatataaacaggataataaaaagttaaaaagatagtttgcacccggaaattttgtctgacagacagatgagtataaagttttaacaattttaataggctctcagaacctttggggcaccctgtatttttactgacataactcttaaaatatatagaaaatgtttacagaagtaaaattttagcgttttttggaatggcgtaacagaagaacaaagaatatttgaatatgcccaagaattgcctatg

SEQ ID NO: 110359 - DNA, 1003 bp, Heterodera glycines
  Promoter: Source sequence=SeqID_6516; Location=1558..2560; Strand=-; Gene=SeqID_61867
ccttttgaatggtgcgtctatgacttacatccgctgagatatgggtacttcaatttctgtgtcttcaaaaagtactgtatttcttaagaaaatagtgcattttacagtaaaatgaccaacactgaaattgaagtgcccatacctaatttggtttaagtcttagagacttgcggtttttgcatatcgtagcaaattttgtcccctttccaatgggctggttaaaattttccaaaaaatttcacaaccccctagggatttttttcgaaaatttccccgattttcactgtatttttttttaatttgggcccaaaacgccccaaaaagcgttcaaatttgatcaattacggagtctttaacaaattgcttctatttttcaaaaatgcaaaaaaaaaaaaaaattcagatgcggtgaaattagcaaagtgatcaccaaaaaaaatattggaaaaaattcattccagcgaataatacaaattcactaatttttcccattattagagcacgactaaaaaggcaccaaaaatcgagaaaaaggcactaaaataggcaccaaaaaattgaaaaaaaggcatgaaacggcacgaaaagcccgaaaaaggcatgaaaaaaggcatttaaaaatttttattaaggatttttagataagcgttacaggaacccggaaattctaatttttagcaggatcctgtaacagaatcttatatttttaaatattgcaaacattatgccaaaagagcatttttaagctagagtttcgcaaatcgttctaaaatttcagaaaaccaatcttagcatttttataattctgcttaaaaatcccccccccccctccccgtttacacacacaataaataataaatttgtcgaatttttgcatttgtccgctgacaaatgaacatgaattatgttgatagaaagaaggctcgtggatgatatgattgttgttatttataaaattaaaccatattcactttactaatcgaagtttagcctaattataatg

SEQ ID NO: 110360 - DNA, 107 bp, Heterodera glycines
  Promoter: Source sequence=SeqID_16654; Location=1137..1243; Strand=+; Gene=SeqID_81066
cgtatatcattattaatccgcatagttgcatagttaatttggcgcttattttcttctttttttttgttaaaggcacaacaaagtgctgtgaaaatttgttgcttatg

SEQ ID NO: 110361 - DNA, 524 bp, Heterodera glycines
  misc_feature (264)..(264): n is a, c, g, or t
  Promoter: Source sequence=SeqID_32777; Location=293..816; Strand=-; Gene=SeqID_63024
ccccccccccccccaattctcgtcattttccaccaaattcgccgaggttgtctttcaaaagtcaacatctgcaaaaacattatttactgccggggtcagaaaaaggacaattttttttttgggatggactcaccagacaaagaaaataggaaatattgctctcgttttttgaacttcctttattgctctttaaaatgtgggattttttccgttaattgtcgtaataattgacccctccccctcagccccctcccaatttccccnccccccccccctccggcggtatttgtcatcatcactcttccaccagcctaccgcccactgacctaaacaaccgctgataatccatcccatcatcacacggccgaaaccctactaaattgcccgtgggatggtttttggaaggaatctttgggaagtgatcaatgaaagtgtccacctaatgggactaattattagggagggattctcaagttgatttatggggtctttcttaaattgcaattttcgagaaaagccaaatg

SEQ ID NO: 110362 - DNA, 528 bp, Heterodera glycines
  Promoter: Source sequence=SeqID_24302; Location=1912..2439; Strand=-; Gene=SeqID_55025
ttaactatactaatttggtctgtccgttcgtgtgtgtgtgtgtcacacttttttcatggatttttgaaatatttttcgacacgaaaacattgtcttttctttctttcctcatcctttcatgtaaacaacaaaaaatatttagttgatgaaatacgtaatatattttttaatgtcgcattcagacatacttacttatttctaaattgctttatcaaagttttaaaaccctttaaaaaaacaaatttttatcattatttttttctcaattacttaaccaaaaattgagttttatataaatttgttatttaaacaaaagctgttgatttctaattttcaatttttgttgtagtcctatataccaagaaatgtttctttttattttttaaattgtttttttcaattctttttttgaaaaattgggttttatgttaaaaataatttttcaagaataagagcacaattttccttcgtttatcttcaccaggaacatttttttaattgaaatgatttataattacttttcagatg

SEQ ID NO: 110363 - DNA, 54 bp, Heterodera glycines
  Promoter: Source sequence=SeqID_30470; Location=1468..1521; Strand=-; Gene=SeqID_60872
gagagatgaatgtattaaagtatttattatttatgctttaataaaaaataaatg

SEQ ID NO: 110364 - DNA, 579 bp, Heterodera glycines
  misc_feature (24)..(24): n is a, c, g, or t
  Promoter: Source sequence=SeqID_2230; Location=1..579; Strand=+; Gene= SeqID_78613
ccctcacattcctcaaaagttttntggaaaaaagggccgcaataaaaattgttaaaaatctggttttttttatccccattgcactaaattacacatataatttgctaatttccttcccctaaacaatttttgcaaaatgttctgattctcgacccctaatctgattttttgcccgatgttctgattttgaaaaattttcgatccgaaccctgaccctatcggcaccgccggaccctccccctgcacctcaaaagtttttttttcattccggcgaaaattacaaattatttgaattaaaattaataatttttcattgcttatgacaaacttttaagttgtccttgaatttagtgaaattttcccgttatgtccttggtaatcagtatacccgtcctttgaaagcgagtttttcgaaaagattacattttttgctttaggacacgcaaaaaaaggtgtgaaatttgaataaaacaattaattaaatcttgttaaatggcacgcgattttttgtttaaactgcgctacggatatttattcttttagaacaaatgaaaaaaaaagaaaaaactgaaccaaatg

SEQ ID NO: 110365 - DNA, 207 bp, Heterodera glycines
  Promoter: Source sequence=SeqID_23445; Location=1..207; Strand=+; Gene=SeqID_54154
tccgtatgttttccttcgtcccttttcagttctcacacaaacattcgcccgttcgcctgtttgacttgcaatttctccttcaaaaccaagggtaacaactcattgttattttgttggatgaattgtccatttttattcgtccatttgtcctttttaggcaatctcaccaaacatttggtgtccaaagcgcaccgacgcaaagtgatg

SEQ ID NO: 110366 - DNA, 1003 bp, Heterodera glycines
  Promoter: Source sequence=SeqID_20987; Location=113..1115; Strand=-; Gene=SeqID_51567
atttgtcttttttgatctgagaaaaagattgaaccggaaaatgcagagattttgttttttttgcatcacaacctcaaaatctatgattttactattggtaaaaaattttgaaaaaaatttcgcgtttcgcttttcgcattttcgcatatttttggcttttcgcatttcgcttttttttcattttcgaattgtgatttttttttgttcacagttgatgtttccatacatttaaaaataaacaattattttttaattgccctttaaactttggaaaattttggtttttgggctttataacaagaaattataattcaaatgatccctttattaggctttatcaatttaattatagtcattattagcattttgtccttcagaataaaaattgtgtacaaattgtcaccataataatagcattgaaaattttgttaaaccctcgtaattataaaaaaattactttttccgtctggtcatttccgtcagtttcaaaattggaccttcttcagcatgataattgaagtttaggttacccttaactacaaataaatttaattctactaatcaccaaagaatttgtttaaatttgcatggtttttcggtacttttgcagtttagagggcaactttcacatgaacttttaataaataaataaaattatgtttaaaaattatgaaaataggttttaagcacttttcgtggtcgatgacaacgaatacggcattagttttaaccaattccatatcccttgcccaaattcgaacaaaatgtagtaaaagtcaaaatttttgaatttgcatatacgagaataatttaattaaaaaatggcagctgaattttacattcccgttgacggccaaacattgttcaccattcttttttaccctagcaacaaaagaatgtaatcatttcttggcatttgaaaaaaggttgttaaaagtgcacaatttctaataatattttgaacaaccaattcaaatataagcaatggcagatttaaacaatg

SEQ ID NO: 110367 - DNA, 1003 bp, Heterodera glycines
  Promoter: Source sequence=SeqID_9376; Location=2280..3282; Strand=+; Gene=SeqID_71165
atagtgaaaaaaaaactattttcaattactttggcgttttgcccaaaattattaacaaaaatgcaataaaaactaaaaatacacccttaagagatgaaaaatttctcaaaaattcatctccaaaatttatttatttactttcttgagaagaatttttaattttaaaatttattttctcaatactggtttggcttaattttgttttgtttttttttgaataaattttgtcatttgacaccccctaaatttgaaaatttttagcaattattttctcatttttagcacccattttggagtttttttagaacctaaaactaactattttggaagtttttagcaactgtaaatattagagtgccacgggaccgggaattttgggcaaacttattaaaaatttaattttaaaagttataaaaagtgatgtcattgcaaattaaaaaaaaattaaatatttttcatacattttttacacaaatttgttcaatttatgccatggatgtccaatgcttgagcacatttgatgcttaaaatgggacaaacaaaatgcatgggaattagcagtgattttgtgctgttaattgctgcaatttatgctgaacagaagccgagacgaagccaaatttgggaataaaagcactcatttttattggaaaataatcacatttttaataattttattttcgtaataaaattatttattttaaatattaaattaaatgccacaaaattccgatgcacaactctttctggtccaaaattaattgtgtgtatacattacaaaaaatttgtggttccatttttttttgtagtaaaattattaataactaaaccctacccaaaatttcaaataaaacgcaaaaatttttcaaatttttctgttaggcttaggattccgacacgctccaattctatacaccgtaaatatgaaaattaaatctttgaaaccattacctcacctatttaatcataaaatttctcagaagtatactctctctcaaaaatg

SEQ ID NO: 110368 - DNA, 86 bp, Heterodera glycines
  Promoter: Source sequence=SeqID_33196; Location=1..86; Strand=+; Gene= SeqID_46330
cccccccccctttcaggtgatcaaccctggggacgaagcgcatcggctacgccttcaagaccaccaaaccgaagcgcatcaacatg

SEQ ID NO: 110369 - DNA, 71 bp, Heterodera glycines
  Promoter: Source sequence=SeqID_45010; Location=1150..1220; Strand=-; Gene=SeqID_72402
ggtgatttttttttgtaataaacagctcatatgcaacttgagtttaataagtttgttctctttccaggatg

SEQ ID NO: 110370 - DNA, 856 bp, Heterodera glycines
  Promoter: Source sequence=SeqID_18067; Location=1673..2528; Strand=-; Gene=SeqID_82658
tcattattagggctgggatttttatgttttaacatattttttttgcggcttagttatggcgagagaagcccaaaaatagcattttctccgaacaatttttgatttagagcgacttataaaaacataaaaacacatattttggcgttttcgcacataaaaacatatcgcacatatttcggggtttggcacatattttgcacatattttggcatttttgaaaaaaatatctaagaaaaacacaaaaaattcaaaaatgcacccctaaaaatcaactttcttgccatttttataggccctttcaaaattttctttatttatttcgtgtaccgaaaatcgaattcttcattaattcgttactggatatcgtagtttcttgctggcacttactcaactgatggaaaaattatctttaaaaacaatttatcaaaaaaggactaattttacccccaaacacctccaaatgttttttatttgcaattgtgcgggcaaaaatgataaagaatgagttttttggaatttttatgcaaaaataccattggtttttccaatttttagcacatatttttgcattttttaaaaattgaaatgctcaaaaatacgtggatttctcaagaaaatctattccttttttttatccatttcactagcataatttgcaaacaaatgatttcaatgctttttggggtaactctttttttcgctctctaagattgaattattttcgagattttcttcgctaaaattcaaaaatccggaatccgacccaacatgagtgccatcatcacattctgctttcagtttcattgacggcgctgtgctctcatttctacgccgctttaagccactgtttgaaatg

SEQ ID NO: 110371 - DNA, 105 bp, Heterodera glycines
  Promoter: Source sequence=SeqID_7454; Location=3156..3260; Strand=+; Gene=SeqID_64867
atactgtatttattcaataaccccctgaggggtgaaaaatgatttttaattttcaattttttttttaatttgaattctcaacttttagctaaaaatgtgctgatg

SEQ ID NO: 110372 - DNA, 373 bp, Heterodera glycines
  Promoter: Source sequence=SeqID_12980; Location=4208..4580; Strand=-; Gene=SeqID_76740
ggccactttcatttcattttgtccaatcctatttattaaatgaaataatatttctatttttttgtttgattgccatttctctttcttcggattgtttttcatttgtttcgtctgctgatgaatgccttttttgctatttgtggcctttccccccgaggcttttttccgtcgatgcgttagtcaatcggcgaaatgattcagcgcataaaatggtgaataacgtaaaaatggcgtatttaagtgacttgcaaagatcatcgttgcaattgatgttcacaaattgtcgttggaatgtctcccgtcttccgctgccatttccccgcctttgccaattcgctgaccttcgctttggcaattttccgtcgataaaatg

SEQ ID NO: 110373 - DNA, 468 bp, Heterodera glycines
  Promoter: Source sequence=SeqID_254; Location=2837..3304; Strand=+; Gene=SeqID_79772
cggcacagtcgtcatcagaatcggtgtaaaacacttcaaacggatgccgatcatcggaggagccttggccggaaaccttttggtgttgacaaatgcattgaaaagccgccaatttttagaaattctgagccgaggctatcaaaaaattttcttggggcaggtcaaagtccacaggccacttttcctcaacctgggtttttcctgggtgggattttccttggtttttgttcaggaaacccaggtccaggctttcaaaatatcgaactctagaaattatagtgaaaactgctgataattcccctcgcaaaagtgtttttgtcagggtttctacggtaaaagtaaatggttccaccaccgtaccatgcgccagctaccctaccgtatgctcctcatctgattgcgaacattccctcgcctgctgcttttgctcctctgctgctgctgtttctgctgctgctggcggtgatg

SEQ ID NO: 110374 - DNA, 265 bp, Heterodera glycines
  Promoter: Source sequence=SeqID_42833; Location=354..618; Strand=-; Gene=SeqID_70643
ttctaaattattaaaatatttaaacattttattgataaaaaataaaatggaaatgagcaattgtcgtaacggataatcggaaaattttccgccggaaccattaaaagcctttttttttgcctttggactttacaacataatcgcacggacatttctcgcgagataaagatttaatctagtgtttttagtaatcattaaagatgagatatggtaaggccctactgtatccacctcataagtcaaggcccgcgtgcctttagaaatg

SEQ ID NO: 110375 - DNA, 675 bp, Heterodera glycines
  Promoter: Source sequence=SeqID_13394; Location=1..675; Strand=+; Gene=SeqID_77281
cggatgagaagggaagctaaacattgaatacctctcagtgccaggaaccaatgagtgccgatggggactctttcattttcggcgaatagtatttgccaagagagagagcaacgacctttcgcttccatataataggtgaatgttgattggctgaaggacagggattaggacgatgatgatgattggttgaatgaccattcctctaggtttaattgttggaaaaaatagagttcgggagcaaataaaataattctcctttggaaaatgtttaaaaatgaagaaaactcttaaattttattcataatttggaaaattatttttttaaattaaagaaaatgtcaaaatctcctccgtctaaacgcgctcgtcgttttttcattgaagagctacttcgtgagccatacaatgagctgtcaccaccacataaatcgcctaaggaatttgttaaaaacttgctccgaagttgaacacgttccaaaatttcaatggatgaaaaccaaatcaatctaagacgtgcctgctgaaccagaagggcttctaatcggcattttccaacagtgcatttatgaaacgattagtgacagccggttgaggggagttgagccgacccacctcggctgcattgtttccagtgcgctacttacatcagatatttggatcccacttcgacaaatg

SEQ ID NO: 110376 - DNA, 357 bp, Heterodera glycines
  Promoter: Source sequence=SeqID_28465; Location=177..533; Strand=-; Gene=SeqID_59080
ttgctaaaagctttggaaaacacagttttattcgtcagactgaaatttgctggaattcaattcaattaaatttgaattaaaatcacaaaaatttgtgtcatattgtatttgccggaaatacataagctctcgtggccctatttttcaagaactctcgaaggaggggggaggctttattagagggactcaaattcggcaagcacagtaatcgaataaaatttttcaaatttttatgggattttgcggttgaaatgtaaattgagacagagacgggtagtggatgggtgctctccattatcccatgaatttggggattgggaataaataacggattatttgacccttcccctccaaatg

SEQ ID NO: 110377 - DNA, 310 bp, Heterodera glycines
  Promoter: Source sequence=SeqID_32057; Location=479..788; Strand=-; Gene=SeqID_62366
ttcagcagagagaaaatgaagacggaataggtaaataacacatattcattcaatgaatgaatgaatgaagatgtcaaaaaatggttaaagatgtcccccccccctcccttctctttttcctccatctcctccgtttgtcccaatcgttcattttcttcttctgctccctccctcctttaatcgtctatcattttcctaattccaattatcccaaatggacagcaacgaaaccgatcgaccaccgcttccgttactttttcagctgttttcgcccaacaattattcccattccgctgttttgcctaaaatg

SEQ ID NO: 110378 - DNA, 53 bp, Heterodera glycines
  Promoter: Source sequence=SeqID_34163; Location=1..53; Strand=+; Gene= SeqID_64028
caaacgcaaatggaattggtggtcatttgagtgcggaacgtttagacgaaatg

SEQ ID NO: 110379 - DNA, 428 bp, Heterodera glycines
  Promoter: Source sequence=SeqID_15875; Location=135..562; Strand=+; Gene=SeqID_80206
ggcaagtccaccccgaaataacttagtccaagccatcattgtaccagttttggttgggcagcaaatccagtctaggctttagcagatgcgaattctcagcttttttggggccttcttatgttggcagcatttaaaaaggaatcaaaaatcaaaaatttttgtaattttttaataaaatttgtccatgtctcaaacaaaaaatttttaggagtaatttaacgtaatcaaaataaattaaaatgttgatactatttattttacaaaaaatatatgtagaaaaattgaaataaaattaattgaaaattgaactgctttttggaaattttgaacgggtccatccatatttttaatatttacgccctatgccgggtgagcaaaagattttttgacgcttttgcagcttgttctgcgatttttgtcgccaaatg

SEQ ID NO: 110380 - DNA, 581 bp, Heterodera glycines
  misc_feature (74)..(74): n is a, c, g, or t
  Promoter: Source sequence=SeqID_17797; Location=1546..2126; Strand=-; Gene=SeqID_82331
gtcaacccgtacacattctcatattcagcaccgatttatgtgagagaattggggatcggatgacattaggggangggatcaggaattgtgcgcgatacggggatacggttgagtacagtatcaaaatgaacaaaatttgcttggtattttacaatatgtataaattaatgagatgggcgagattgagagaatattgctcgatcatataggatcgattaatcagcgtctcaattgatatcccccatccattaatctcttcttctataattgttggttttaaatattttttgagtggaattatcaatttttaaagtgttgtagagagcatttttgttttggataaagttgtaatgagttgcttcttcagggatatccctcaatgttcctcggcacacaacatcaaacaattgttggacgtgcctacggtcaagagcaggtaatcgggatttgctccaaaatgccgaaagccggaatttcacaaaaagggccgaaaccggttggttttcgggctccaaaatatgtcggaaggcggaaccagggcaccaataatgccggaagtttgaattccgggctaaaaaatg

SEQ ID NO: 110381 - DNA, 937 bp, Heterodera glycines
  Promoter: Source sequence=SeqID_14075; Location=726..1662; Strand=+; Gene=SeqID_78049
gggaaatacaaattgtaaaagttgtcgtttggtctccttaacccccgggtttatctcctctaaactcgaagacgagcaacagcaggccccaaatgccgcagcattcaatcacaaattaattttaataattgctattaattattattatttatttctttccatcttccagtgactcatcctcggcccgaaaccgacattagtgaaatgtaaattgaaaaaagaatcatatgtcggcatttcattatcaatataaaaaatgtaattaatcttttttattattttctttttagattcaattaaaatttttgtcgaattaactggcataaatgcgaaaagtgccgctgttcgtcgacaccattttgatttgaatattctgctgttgttgttgttgatcagctgttgtttttttagaatgattgtgaggaggaaggaataatttttgtgatttaatttcaaaggaattgaaaatatattaattaataaatattatttataaaatcagtcaccgaaaaaaaatttgcatcaaaaaagtttaagtaccaaagaagccttttggataaaattgagtcaaatccgatcgaagagccaaagatttagaatttaaaaggtacaaaatcatttttaatgataaaaatgcaaaaattataacaatgagacgtccagtaaaattcagtcctctttcgacaacacaacagtattgaggacaatttggacaaatagcaccgatttttctggaaagaaataataaatgataaaaagcaaataagtattaaagttctaaagattttactcataattgatttggtttagttatcaccctttctacttttaaaaatcattattttcaaaatgaaaataaagttaattattattttgttgcttttccctcattagtcccatcccttttgctaaacgaccgtttatccgctcaaaaatg

SEQ ID NO: 110382 - DNA, 139 bp, Heterodera glycines
  Promoter: Source sequence=SeqID_27641; Location=1341..1479; Strand=-; Gene=SeqID_58321
cgatggtttttcattttttaattttattttttgctcattttccaacagtttcccatccgccgattgttgccttttcttctccgatgtgcaactcacctttttctgtccgtcctccgctcctttttaaagtgcggcgatg

SEQ ID NO: 110383 - DNA, 350 bp, Heterodera glycines
  misc_feature (20)..(20): n is a, c, g, or t
  Promoter: Source sequence=SeqID_25462; Location=1149..1498; Strand=-; Gene=SeqID_56195
tgattgccaaaaaggaactntttgaaaaaatttacaaactttctcaaaaaatcgccaaatatgtgccaaaaacgaccaacactccaaaatttttgagcttttcatacgatagcatatgcgcaaaaaaaacatataaatccgttccctggacatctcaaatgaaaattttcaaccgttttttggggctcttttcttcgaaacattttttttaaattttcgagcaaactccaaaaacgattttaatggataatagcgttgcttcgtctgctggaaattcgctgtatgatacgccgcttgaaccatttttggtcaacgggccgatgagtctttctcagttcgtccaaacaatg

SEQ ID NO: 110384 - DNA, 457 bp, Heterodera glycines
  Promoter: Source sequence=SeqID_18319; Location=1..457; Strand=+; Gene=SeqID_82917
atatttaaatttgaccatttcacaccaaatatttgctctttcaattgcatagcaaaatgaacaaaaaaccgttcatttagtgacaaaattaagcaaataaatcaaaaattaattaatgtccaaatgaatggcaaatggacaaaaggcattccgccggaggaaaatttgcaaattaattaattaattaatggaaaaatctttctcatatcatttcctgttttgttgtctggccaaacaacaaacgcttcttctcccttatcactttttctgtttggcataataaattaaccaattgtcactttttggtttatcagtgagtgattaaaatttgttatatttttttgattgctttctcacattttttcccattatttttcagcttttccttttttttttatttctccattagcttccaattgaatgatgttttttttctttttttttgtcggcgaaaatg

SEQ ID NO: 110385 - DNA, 185 bp, Heterodera glycines
  misc_feature (12)..(12): n is a, c, g, or t
  Promoter: Source sequence=SeqID_39175; Location=105..289; Strand=+; Gene=SeqID_67809
tagaggcagttntaaattaacaaattttaacattttaagggtcaaaaatcaatacatcaacatttttcgatgtaaaagaaaatggaagaattgtggtcaaaaattcagacaaatactgtcttttttatagtgttgttttgagtcaactatatcaaacaataggcactgaaatttcgtactcaatg

SEQ ID NO: 110386 - DNA, 681 bp, Heterodera glycines
  Promoter: Source sequence=SeqID_5281; Location=1513..2193; Strand=+; Gene=SeqID_57546
aatgaaattcagtcggaaaaccggtacgatgatgaacatgtgcaaattgcagtgaccgtcacatttttggccgcaataattcaggcaaaattttattaatatgatttgcattaataattaaacgttggcacaaaaggcaaaaattaaagttaaggaacttttttaaacgcaataaaacccaaacagaaatgatgcagaaaatgcatttatattaagactgttatcttaccaagtctcaaaaaatgctcagatatgaaaggattataagggaattagcatatttttaagtgaaaattaattattaaaaatacgatttttgtaatcaaaaatctaaaagaaaaatatttttaagatgataacccatatacaggtgcaaattcaatgttttttccattgaaatgatttaagttataaaatcatcattttcctgactgaattttgtgcctttttctgccggctctatcaataataatttattattcaattaatcaaattaacaaacaaataatatgaaagataaaggattattttaaatttcaataaaaattaagaatgtttagtcagaaaatattttaaaatttttagatttattcgaaaatcaaattataagcaaagactgaatcgtggattatttagggtctggtctatttgtttcacgccgacttcatcttcagcttcatg

SEQ ID NO: 110387 - DNA, 1003 bp, Heterodera glycines
  Promoter: Source sequence=SeqID_2198; Location=137..1139; Strand=+; Gene=SeqID_78459
catagaaattgatccccaaaacttaattattttttcttgttaaaaatttttggtttaaaattgtccttatttgaaaaaactttaaaataattgaaatataagcaaaattaaattttaaattaagttcttatgtatttttctacctaaaaagcgttaataagaaatttttttgcctatttttgtacctatttgaggatttttgattgcctatttaatgcctattttgcgatttttttatgcctttttaggtgcctatttcgcgatttttgtgcctaaaaatctcagccctaaatattagcataaatataataaaatatttctcgcaaaaacaaaatattaattaattaattggtcaacaacaaaacacagcaggggtaatctttgatgcattaatcattcggctggatgagttctattttttggcacctcaaagtgatgagtatcggcgaagcggaagtatttaataaccgaattcgtacatttgatgaatagtcctcattttgtggcggctttttgatgggtcaatgaggtttttggaaataaggggtttatgatttttataatttttttgagattttcctttgtctatcggtaagtggtaaatttgtcgggtttatttttcttttcaattttaacgagttgactttcattgtgcctaccattaatttgccataaaatttgatttatttacatttaaatttgaattgagttattttgtttatttgttttcccctctatccattcaattcactcacttttcttttcgtcctttcacaattatttttcatcactcaaaagaaagaccaatttattctttcgttaattgtgtaaaataaaaataagccatcggcgaaagacaaatatttgataaggaaatgaaaaagtcattcattcattcaaacattccatttcacttcgtacaatttaattgtattttattttgaattttataaaacaaatattttttagtatttttttaaaaagaaaatttcaatttgaaatg

SEQ ID NO: 110388 - DNA, 396 bp, Heterodera glycines
  Promoter: Source sequence=SeqID_1857; Location=1474..1869; Strand=+; Gene=SeqID_76394
agctaatcaccaacaattgtccgcaatgacgttaaactagcctaagccatcaacaactgtccgaaacgctaatcacccggctgccacgagtccggaatgacgttaaactagcaaagcatcggccaacccacacaacaatcgtccgcaataacattaaactaaagaaccaaccaaacaacaaatgtccgcaaagacataaactagaaaagcaaacaaaacatgtccgcaatgacgttaaactagagaaacaaaccacgcaaagtccgcaatgacgttaaactagcaaagcatcaattgtccgcaatgacgttaaactagcaaagcaccggccaccaaacaaccattgtccgaaaagacgctaaactagcaatccatccgacggtcagggccgaaatg

SEQ ID NO: 110389 - DNA, 87 bp, Heterodera glycines
  Promoter: Source sequence=SeqID_37307; Location=716..802; Strand=-; Gene=SeqID_66408
ggtttataattaaaataaaaataaaattttcatatttttttttagttttaataatttttcttttaagttttcttccctccgtggatg

SEQ ID NO: 110390 - DNA, 141 bp, Heterodera glycines
  Promoter: Source sequence=SeqID_21911; Location=1..141; Strand=+; Gene=SeqID_52544
cgcttgaggatgggacggggacggaataataacggttggttggaccggaggagggggggggctgttcaatattttaggtagtaaaaaatagcattttcatccctatttttcatttattgctcacattttttgactaaaatg

SEQ ID NO: 110391 - DNA, 223 bp, Heterodera glycines
  Promoter: Source sequence=SeqID_12629; Location=455..677; Strand=+; Gene=SeqID_47061
tttaaaaatgaataacaataaattttgtgtcttttcagcaagaatgaattatttggtgttaataataaaatgcaaatttaataatttttaaaattagtttcattagacatcgacattttgaaaaaagttggacctgggttccattttggacctgggcctgaattttcgggagaaaaactccaaggaaaatacaggtttaaattgaaaaaaaattggtcaaatg

SEQ ID NO: 110392 - DNA, 248 bp, Heterodera glycines
  Promoter: Source sequence=SeqID_11003; Location=3275..3522; Strand=+; Gene=SeqID_74322
atttaacaattattttaaaaaaatcatttatttagcatgaggaccgcaaaagaaaaattattatttttgatcgttttttgctaaaatttttagaaatcatataattaaaatatttattaatttttgtaaaattcaaataaagtatttgttgttattataattaaattactttcattattatttttaatatgcttatagagctattgttaaattaattaattaattaattaatttcttaattaggtatg

SEQ ID NO: 110393 - DNA, 1003 bp, Heterodera glycines
  Promoter: Source sequence=SeqID_24623; Location=512..1514; Strand=+; Gene=SeqID_55362
tctgggtcccgactcgaaatccttccggtcccagttggccggtctctactacaaatctgtcagcaaaaataaaaattttgtaatttttaaaaattagtattaaataaatcttagaatcgcttgacctaaagttcctttaaattttaagggtttttacgtgttcaactaaaaaggcagaaaaaaactgcaaaataggcactaaataggcacaaaaatcctcaaataggcaaaaataggcaaataaaattttttgttaacgctttttaggtagcaaaacacataaaaattttcagttgtaaatgaaattattaaatattttaaattccaaaaattttttaagaaaaaatattaaattttctggatcaattaggcacattaggcacaaaaaccttgaaataggcaaaaaaaaggaaaaaaaggagtccctaattattaggtatttgtattataaaaatatttcatttttttttattgccatttattattttattgatcgattcaatttacaattagcatatgcataatccatgccattttcttatgatattgggcctatttctttgtagtttatgcaatttgatgtctttttgacaactacaaactggataagaagatcagaaacaaaatacaaatatttgattagaaaagtgccgaacaaaaaatgatcatttaaatgctataaaatataacatttgaaaagtgccaaacaaaagtgatcatttacatgctacaaaacacgaaatagacgttcggcgttaaagctgatcattttttatggtccatgcagaataattttttgcataatgatcatttaaatgctacaaaatacaatttttttagagtgccgaacaaaaactaataatttaaatgctacaaaatacaaactttgaataaaattctgccccataaaaggggtcccttgacctcagtccccacattcattcattcatccccaatttccccctccccattcgttcaaattaccaacatatttccctcaatg

SEQ ID NO: 110394 - DNA, 1003 bp, Heterodera glycines
  Promoter: Source sequence=SeqID_1671; Location=1408..2410; Strand=-; Gene=SeqID_75227
ggatcccgtcccgcaaagaattttgagttccaatcccgcagcgggatccgcaaatttgattttttgtgcgggattatgcgggattttattgatttttttgaaaatttttctaagacagaatgccaaatatttttaaataaattaaataataaatttaattaaagttaactcatttttcatcgcaaatttcattcaaaatttgtgaaatttccccggcggcgcctatcggcaccgccggataggcttttcttaataatcctgtagaaattgagtcaaaaactgcgtcatttggtcaattttagacaaaatctgttaccaaatcgctttaaatttcataaaatttctcgcagatgtcgataggcaccaggtatggcacggaaagacttccgatttccgacatttttggggtaggaattccgacttccgaaatttttgatgaaaagtcggaaatttttttaatttttcttttcaaaaaactagcaagttttgtacaatttctgttaataaattgaactgaaatttttaaaaatttcccggcggcgcctatcggcaccgccggaccctaaaaatccctatttttcttgcaaaatttgctcaaaatcgcaaaattttgtaattttttggacaaaatctgttaacaaaattttcccggcggcgcctatcggcaccgccgtaccctcctccaagttcccaaaaagtttttgaaaaaatcgcgctgtataaaacgtgtaaaaatagtcactccttttcccaaaaatgttctaaaataatgaaaaatgacaaaaaaaaaatttgataaaatattgaataattttttcaagcgtatactaaaaacatttgtgaaataccttttacttggttaagaattaaaaaatttagcctattaaaatatttagaaattttttattatattgtatattttttgaaaaatttccgatttccgacgtttttggggtcggaattccgatttccgacttccgaaaatttttggggcctcggaatg

SEQ ID NO: 110395 - DNA, 210 bp, Heterodera glycines
  misc_feature (41)..(41): n is a, c, g, or t
  misc_feature (73)..(73): n is a, c, g, or t
  misc_feature (78)..(78): n is a, c, g, or t
  Promoter: Source sequence=SeqID_4011; Location=1..210; Strand=+; Gene= SeqID_52794
attttactcgataaattcttcttatttatttctcgaggttnacacaaataattaatcattttaaatagaaatntaatnttgttaggtaccctcaaattccaattcaattgtcaaaaggcaatgccatttcgccaaatgccaatttgttcctgtcagatgcccgcgagttagaaatgcctgttcttactccaacttctctcgtgcaaaatg

SEQ ID NO: 110396 - DNA, 522 bp, Heterodera glycines
  Promoter: Source sequence=SeqID_21400; Location=601..1122; Strand=+; Gene=SeqID_52011
gctccaaatctgttttttgaaatgaaatgccaatatagagattaaaagctaaatttctaaaaaaaaattaaaaaaaaatggaaaaagtcgaaaaagtgcaatgccaaatttaaaatttacagccatattttgctcattattagcttctatttggcgcctgttatccctttaaaatgggtgtgtacttttgatggaaaaagttaataaaaaaaaggagaaaaatttaaaaaaatatttgtggacaggcaaagtcaatagagcgagggcacatctaaaatccttgaaaattttcaaggattcaaacccaatgaatgatacattctcgagtcatatatgcaaggacgtccttgagatcaatgactttgtgaactgccaagaacaggagttttgcgtgggccgccacagatttcaaaataaaactgattgagtattttgaattcccaagaataggaggggggagttgattttaaggactgtccttggcactcaagggcagagcggagtgagtgccgccgagtcatg

SEQ ID NO: 110397 - DNA, 403 bp, Heterodera glycines
  Promoter: Source sequence=SeqID_43972; Location=549..951; Strand=-; Gene=SeqID_71533
agggaaggggaggacaatgaacggcagaaaaagaacgagttgtgcatcgacgacaatccatccgccgtttttcgctttgctttttcgaatgatggatggccggggggaggggagggggagaaggggcgtgggaccgttcccatcgccacaacagcagcaattggtgtgaattacgtggctaatgagtgtggcggtatgtgcatcggatcggtcggtcgctgatccgtccaatatccaggccccgacgaggcgaacaaccggcttttgtcctccgatcgatgtgtaaaggcaccgtcgggtgggctggggaagtccaaatgatcggcggagatcgcccgcccgcggcaacagcaaaaagcccccgggctgtgggctcacacactgacctaattccccaaaaatg

SEQ ID NO: 110398 - DNA, 599 bp, Heterodera glycines
  Promoter: Source sequence=SeqID_9079; Location=1285..1883; Strand=-; Gene=SeqID_70188
gctgcaaaaaaagagaaaacattattacaattactgtaaagattactgtagaaactatataattgagggattgttgtatatcaaaggatttattacattgtagcaagtcttattgtacagaatttgcgtatcattttgctaattactatcactaattaattggttatgtggtacacacagatcagtgctgttcttgaaccaaaagtccctgagagttggtcacatgaattggtacctagactccaaaacagccaatttttgtcgagaatttcgaacaaattaatcttaaggttactgtgtccataatttttaatagacttacatgtaagcgcggtagaaaataaaaggaaaattgggctgtattttttaaaagtgaacttttcggaaccttggccggacgaacgcaaaaaaaaaaaaagaaaaaaaagctagaataagaaaaattcgtaataacaatgaattttatattctggataaaaacaaaactcgtcgcatctgtgtgcatgggttttcccgtcaaaagctgcttttcctatccaagtaattaatcacatgatccgggccataaatcccgatcggtttttcatccaaaataaatg

SEQ ID NO: 110399 - DNA, 316 bp, Heterodera glycines
  misc_feature (73)..(73): n is a, c, g, or t
  Promoter: Source sequence=SeqID_37450; Location=1..316; Strand=+; Gene=SeqID_66522
atacatatttgtctcccctttctctttcattcctgctctgttccaatcgcaatttagaccaccactgatctgnagtcttaaatagagatcggacatggagcatgcccgtgcacgggttttacggaccccgtaccccgtgttttttaagggctgacacagatttcacggggtcacttagttttagcctgtgacccgtgtcgtttccaaccccgtagcccgtgtatgtggaaaatgccgatctctagtctaatctataatttaagtacataattcattttccattgtttttacagtcacctcttttcaggttattatg

SEQ ID NO: 110400 - DNA, 120 bp, Heterodera glycines
  Promoter: Source sequence=SeqID_35302; Location=539..658; Strand=+; Gene=SeqID_64883
cctcagattttcgttgtaatgaaaagaaaaagtttttgaaataggaacctaatcccccatattttttttcatcagcattaaaaaaatctaaaaaaattcaggtaagcataactttggatg

SEQ ID NO: 110401 - DNA, 839 bp, Heterodera glycines
  Promoter: Source sequence=SeqID_14623; Location=1751..2589; Strand=+; Gene=SeqID_78706
atctttttttaatattttcccatctttcaattcaatagctttggcacaaacttcgaattgaaataaatcaggttatttgagtttaaatggcaagcaacacaatttatttcttgcttattgatggaaaaaagcataaaacctttgtacttgatttcttccattgactccattacggaaatttgtttttggaaaatttaaggtcaaccctacccatttaaatttgttttgagcaaaaacttattagctggcacaggcacatcctcattctctatctaaaattggctctctgctctaagagagtctcggctcggtgccaaataggaccagcacggtaattttacagtaagagcacgggaattttcgccggaaagtttccctcaagtttttcggtcaactagatcccgccggcaaattcccggtaaaattttcacactatttttgaagaactttttatattttacaatttgttctcgcttaatttaaccagaacaatttcttcctgataattttttttacttgttttccaaattttgtatttatgagcaggattttgcgcttctggcgtgagagaaagtttagaattttatcgtgtatctgtgcaatcgaaaactctttagatatttttccattggaaaaggggcaataattattgaaaatgaaaaaaatattttcaagagcgtaaattctcgagaaattttgagtcgctctaatgccgttaagcaacccttcgttttcagagcatttcaactttatttaattaattttcatttttttgacatctttgcaaacacgatgtgctacgaggtcgccctgaaagcatcagcatcagtgtgataatg

SEQ ID NO: 110402 - DNA, 129 bp, Heterodera glycines
  Promoter: Source sequence=SeqID_25541; Location=897..1025; Strand=+; Gene=SeqID_56282
ttttttctttgattagccaaaatccgcttcagttaaactccgaactgtgctttgggcttatgtcacggccaatgtttggtcggaatttggtaattaatattttaattgaaaaatatttatgtcaaaatg

SEQ ID NO: 110403 - DNA, 849 bp, Heterodera glycines
  Promoter: Source sequence=SeqID_7126; Location=987..1835; Strand=-; Gene=SeqID_63907
aatgaatatgtattgttgagaagtgatcgatcaatttaataattatggaattattaaagtgctcataaaaattgtcctttttttcgttggactgatcaatttggatttgtgttatgccatttgaatatttgtcgttttctgaaatgaaaaaaatttgttaaaaaaagctcaatcgtttccaagattgtacttggaaatcgtgttttttgagtatgaatgtaaatacatatgtacatttataaaagtttaaaatttttggcattttgtcaaaataatgcttctctcgccataactaagccgcaaaaaaatgtacagaaatttctgaatcagaaccagtttttgcggtaccgttgaaaagattggtatccggcttctttgaaacaaataattaagaaaattcaattttattagaaattttttatttttatccattaaattaaaaaatatatactcgatcattttacacaaagaaatttttaacagtttcaattataatagtttcacttgtcgggaatcccgtttcccgtcccgatcaatatctaatctgcgctggtagcacgccggacccaaataatcattatgaaggggtcgcttttatgcttttaagggaccagaagaccagcagcatatccggctttttcaaaaatttttaatcactataaaagcccttccttctctcttttttttcatttaggtacttacttttcctatttgtttaccttacgtcgtctttcatcgtcgaggctccattttgcccttcttaactgttgattttacaaatttattttcagttttgctaatttaatttaatccaccaagaaccgtcttaataatttgccccacaaaatg

SEQ ID NO: 110404 - DNA, 215 bp, Heterodera glycines
  Promoter: Source sequence=SeqID_25782; Location=1145..1359; Strand=-; Gene=SeqID_56520
tcccctcctcccccgacccgtactgttcggcaaatgttccgaccttttgccggtgtggcacaaatttttgcaacacgccgaataatccaggctttctgttagcactgaacaggttgaaaaagtggggggagggcaattggaattgttcaagagcaaaattagcaacattcagtactctaagcaaaattgtgaagccggaagagccgggcaatatg

SEQ ID NO: 110405 - DNA, 174 bp, Heterodera glycines
  Promoter: Source sequence=SeqID_20481; Location=1160..1333; Strand=-; Gene=SeqID_51020
tttttgacccaaataattgagaagagatgtaaaaaaatttgaggaaacgcatcagctgaatttttcgaagtttaagctggacaaaaaagctcgactcttacatacttttcgtttggtttcagattttccaaacaaggatatgtttcaaaaaatctgcaaaatgacacaaacatg

SEQ ID NO: 110406 - DNA, 97 bp, Heterodera glycines
  Promoter: Source sequence=SeqID_18909; Location=798..894; Strand=-; Gene=SeqID_83621
ttatggtcacaaatctaattaatagattaaaaatttctattattaattgatcattagtagggctggtaaaaatatggatataaaatcgcgaaatatg

SEQ ID NO: 110407 - DNA, 144 bp, Heterodera glycines
  Promoter: Source sequence=SeqID_15481; Location=1986..2129; Strand=+; Gene=SeqID_47296
cgttcgcctcctcagcgcttcacggaagaggtagaaaaatttttgagtttttcaaaaattaattttcccccctttttcccccaacagatcagtgacgatgaaatccgccagctctgcaaagcggccacggacgtcttccgaatg

SEQ ID NO: 110408 - DNA, 1003 bp, Heterodera glycines
  Promoter: Source sequence=SeqID_38; Location=17190..18192; Strand=-; Gene=SeqID_53330
ctaaatgccagcctttaatttgcttataaccttctaatttcgagaaataaaacctcggaataatttggaaactttagattatattgtctaaaatggatagaaaatccacagcctcgctccttatagagcaaaaattcaacaaaatagacaacgacggttctggacagttaacagccgttaaattgcagcgcgctctaacaaatgggacatcgcggccgtttaatctcgacacatgccgtcttttagtagtccaatttgacactttaagaaatggatatgtcggctatgaagattttaaggcgctttggaatgtaggaaatgatgaatttattgttgtttactgaatttacagcatgtaaacgattggaaatatgatttcgtcaaattgagcgagaaccttggctttttgtctatgcggcagcttcaaaatgcattagcccaatacggtattttttatttaaaaaaaattattgtacttttcaggcttcaattttactacgccattttttcaaattcttctgcgccgattcgatcggacgcgtaccggtagatttttcttgagtatttttgacttcgtcaccttttcatgttgtttattgtttgacgactttatgcatatgtgcattatgcttcagcggcttatgccttcatttcgtactgtcgatgtttgtgccacaggccgcattaatatccgtaaaattttatcagtaagtgcattttataatatagcttattttaagattttgaagattttctgctcatggttttagccgccgatatttaggtaatgaatttccgtaatgaaaattaataatttttaattaaggatatgaggcacttcaaactgttatatatatagcatttatttcaccgatatttcattttgatcagtataaaaaatattttaattagcatttttatttttatttgttaagctaatcaagctatatttaaatttatataaaatttttataactggttttagcacattacccataaaatg

SEQ ID NO: 110409 - DNA, 1003 bp, Heterodera glycines
  Promoter: Source sequence=SeqID_10630; Location=1029..2031; Strand=-; Gene=SeqID_73865
tttcatgctttattataaatatgtatttaaaaacttttttaatgtttgcacttctaataaagaaatattaattaaatttttttattatttagatataaaacaaccaaaaaattttaaaaattcatttcccatttttataacaacacaattttatgataataatattttaaaattaaatgtttccacttaaatcaaaattaattttattaattaaaataattttttaagtgatttactagttttgtttatttgtaataaaatatttaacatattaacttgtctatatttttttgctttttttattgctattttaattattattatttttgtaacaatttttgaaaagaattatttttttcttaatttttttaacttaaaccaaaaatagatttttgatttcttaataaataaatttgccaaatttgaaactgagaatttgtgggggaacccaaaaacattgccccgaaaagcggggcagaagagaagaaattggatatgcctaagctgatgactgactgacttactgaaaatgatggcccggcggttaatctcccgccccgagaaaggccaatgaatgcatttcataggccacaaattacacaatttggcctgccttatttgtccctagccttattggcatgacactgagaattttttgcaacaaaaatagaaattctgcaaaaaattgtattaaaaatggaaaattttttatatttttcatttgagaatttttttatatatgtttttttttgaaaattattccagtattaattcatttaaaaataattatttcattttaataataaacttgagatcttatattttatgaaaaattttctttattcaaattaaaataaatgctatttaaataaattataggtaattactttttatggccctgtctattaccatagaatgttttattattttaaaaactattttaggataaataatttatttcaactataaaatttcaacaatccattcggctaaacaaattatg

SEQ ID NO: 110410 - DNA, 229 bp, Heterodera glycines
  Promoter: Source sequence=SeqID_33339; Location=96..324; Strand=-; Gene=SeqID_63430
tttttcatctttacggtcgtaaagagcgaacagcaaagtgtcactctgaaatgactttggcattttattcgactaattaaatgatttctccccctcccccccccaatttgcctgaaggcgaagcatttgaacgctcagtcgccgatagcccgggaaatcctccgcccacaatctctgctgcacttcaattgctccatttgaatgttcattagcaaaaagtgtcaaaatg

SEQ ID NO: 110411 - DNA, 1003 bp, Heterodera glycines
  Promoter: Source sequence=SeqID_5127; Location=2752..3754; Strand=-; Gene=SeqID_57008
attctgaagggttctcggggggcgttaaccagggatctgacatccattatatccaattttgaatgtctaacctaaattcaagcaaaaaagcaaactccgaaaaacttagttttctatttcactcgagttcgggtaagagatttctcaacattggtgtaagattcgtgtttagctacccccgaaaacccataaaacaagttttcacgaataaaaaagggccctcaacctatggtttttcggagtgccccaacagcaaaaaatgcattaatttaaaaattacgcttaaacaaaaacagaattgaaaaactgtaaggaaactgcataggatataatgatcaatatcttttgttttttaaacaaaaaacttcacactccaaaactgacagggcagccaacttttgttacacattttcactacataataaaattctttcaatttttgcaaattcgggggtaacatataatacttattgttagtatatttggttcccccaaattctgaagggttctcgggggggggggggcgttaaccagggatctgacacccattatatccaattttgaatgtctaacctaaattcaagcaaaaaagcaaactccgaaaaacttactagtagtttttgatttttgttcgagtccgggtgagctttgtcaaaattggtgtaagattcgtgattagctacccccgaaaacccataaaataagttttcacgaaataaaaagggccctcaccctgtggtttttttcggagtgcccgaacagcaaaaataattcccagggaaagaacaaattgaaaaattttttttatttttaaattaaatttgtcacttatttattctggcataatgttataagttaaacaatttgaacaaaaaaatgactacctacttctattactgcttactagagcccggaattttgaattttgctctctacatttgtcactttttattactcattttccttttaaagaaaagcacagatccaattccgctgacaaatg

SEQ ID NO: 110412 - DNA, 204 bp, Heterodera glycines
  Promoter: Source sequence=SeqID_4684; Location=3752..3955; Strand=-; Gene=SeqID_55373
ggggcctagggtagggatttttaggggcctagggcggggatttttaggggaaaaccaattttggggcctagggaggggatttttaggggtgcaaaaaaaacaatttaggggcctaaaaatacttaaaaacctatgaattttcccacccccctagccattacggaggacgacaacggggccaagaaggtggagaaaagtggcatg

SEQ ID NO: 110413 - DNA, 65 bp, Heterodera glycines
  Promoter: Source sequence=SeqID_10201; Location=1033..1097; Strand=-; Gene=SeqID_73319
ggtttgaacaatattttcaatagaattttaaatattattttgttttgtttttaggtccttttatg

SEQ ID NO: 110414 - DNA, 68 bp, Heterodera glycines
  Promoter: Source sequence=SeqID_42764; Location=352..419; Strand=+; Gene=SeqID_70581
ttacccaagtgattcctattcaccacctacctgctgtcctgttgggctagcgttggcacaaccaaatg

SEQ ID NO: 110415 - DNA, 130 bp, Heterodera glycines
  Promoter: Source sequence=SeqID_1103; Location=2792..2921; Strand=+; Gene=SeqID_67840
agtaagtaagaggtctcatccttcaaatcagaacaaaaagggttttcttagaaaattgaatgtcggattcttttgtagccgtaagatttgctttctttctatttagcatttgcttcaatgtatccaaatg

SEQ ID NO: 110416 - DNA, 145 bp, Heterodera glycines
  Promoter: Source sequence=SeqID_26775; Location=1..145; Strand=+; Gene=SeqID_57535
tggttttttctaatcaattataatgtcatcatttaattgattttttagcattggcatgaataaaatcaaaaaatttatataatatatttatttttttgttttactaatatttttgttttcatatttgaagcatttgcaataaatg

SEQ ID NO: 110417 - DNA, 1003 bp, Heterodera glycines
  Promoter: Source sequence=SeqID_20019; Location=934..1936; Strand=-; Gene=SeqID_84794
tggttgctattgagcaaagttatgggtagtttttttgttggaaatttccatttgattgttttttataacgccctttttgatggcttttttataacgacatagcaccaaaatatttaccaaatatgtaaataaatttttaaaattgttattattttggataaaaaaaaatctttataaatggtgaatggatgaaaacaaattttaggggaaaaattttaaatgaaccaactcttaattgcaaattcatttcaaaattaaataaataaatgcttttgattttatcaaattacgcgaattcatttaatcatttttttatgctcataataaattagatttacatattaaattattttttttgatacaaaagaacaaaacttttcttttttataattttatttgcatttgtgaaggaaagaccaaataaaattattgttaattgacagtttggctttaaattgaattcatattcaaatttggtgcgcttctaatcaattttttaacggattcgagaaaaaatttcaaaaaatgttataaaattatcaaaaatcgaacaaatccaaaaacatatcccctctgggcatgcatgggccaagaaaattgagttcaagcaacaaatttaaaaaggtaatttatttaaaaatattttattttcctttttttagaattcgaaaaaattgttgaaaaatttcataaaatagaaaattttttaattcatttgggaaaaaatgttcaactaaagaatggcaatttaaaaagaaaagtaaaatgaaaatttggcaaaaatcaaaatttaaattttgtaaaaatataattatcattaataaattttaaattttatttagataaaatattaataataataataagcaaaaaaaaaatatgcataacatatttcatcaatatttaattaatatgagtaggaaaaatgaattttcataaaatcaatgagaataaaagcaattaataaaatgaatttctaatcatttttattttatgaaaaatg

SEQ ID NO: 110418 - DNA, 375 bp, Heterodera glycines
  Promoter: Source sequence=SeqID_8341; Location=1..375; Strand=+; Gene= SeqID_67739
ccattttagaccataaataaaaaattcgataatttatttttcgactttttgctcgaattcaggttcggggttcgacttaggtcataataaatgtcagattcggattctccgacccttaaaacccctaatatgatcttttcttgaagaaaaatttcaaaaattttgtttttcgaaaaaggggagggggggcaccatccgtactattaccgttaatacttaatattcatcattatgtgtataaaaatacaaaaaaaaaaattcgaccaaaaaaaagttgcaaacaaattttcaaaaagtaccttctttaaagtagctccaaaaaggggcgtatgctaccatctaaactattacccaagatatttttagcacgcaatg

SEQ ID NO: 110419 - DNA, 420 bp, Heterodera glycines
  Promoter: Source sequence=SeqID_23732; Location=1..420; Strand=+; Gene=SeqID_54425
caagggtaattacagtaatcgttgcatagttcgtcgagagttacggtcaagggtaattacagtaatcgttgcatagttcgtcgagagttacggtcaagggtaattacagtaatcattggcatcgaggagttatggcaatggaagcaataaaaaacatttgtatttgggtggacgttttttgacaggaaaaattgcgttcaactaatcctttgaatttggggatcattaggaaaactaaaataatttctctcaatttcagcattttcatcataatttagttaattattttgggaattttcacttagatttttcttcaacattttggaatttatgaaggtatttctaaattttcattttttttaattttaaaaatttatttttttttaaattaaaattcgttggattttctttcaggtgatg

SEQ ID NO: 110420 - DNA, 1003 bp, Heterodera glycines
  Promoter: Source sequence=SeqID_2488; Location=4346..5348; Strand=+; Gene=SeqID_80014
ttcagcttctttttatatattgcacatttgttgataagtaaatgtgtcgtaaacatgattgattattgtttttcttaattgccatctcaaagaaaaaattttcaaaatcgtaaagtaattaatgacgctcgtactcccgaccggcgaacaaatattttaatttcattgataatttatttgcaaaatgaaaaatttatttaaaaatttaaactgcgaggtcattcaatggttttgtgtgtaattttttgtgaattttgcatttatccgtactgatttgtgagtgagataaatcgcttttttggcgttttcccaatttctataaaaatgtaaattttggaactaccaattcagcgacttttctgttttgggatccggttttttattatcaaattgaaaattatttctttggttgttcgttaattatctgagaattctaaaatgtcctaaattacaaaaatgttccgaatattacaaaaattttctgctttttaaaaagccaaccagaaaaatgacaatttattttttcttcatcatcagggatgatatgtatagttatttcactatttttttcctgagctccctatagcctgaaacgcacgaaaaacatgtttttttcggctgttgttaagctactttttgagttattagaaactattttctagttttttatttttagcaactaaaaaactataaaaatgtgatgtcgaacgatcttttcaatttacaaatctattttaactgataatcgctcacgtctatctcccgaacaactcgacatgttacttatttgcaacgtgaatctcaataatgatttggattaatattgtttatttttgaataaaattttgttattttacacccctaaattcggaagtttttagcaactataaatatcatccctaatcatcatacattaatctatttttttaaattttccaatattaaataaattctgccaaattgtgcattttatttgaaaaattagtaatattttaaaagaatg

SEQ ID NO: 110421 - DNA, 143 bp, Heterodera glycines
  Promoter: Source sequence=SeqID_15810; Location=1733..1875; Strand=+; Gene=SeqID_80132
cgtgaatagtttagaatctgatactactccccttgcattctttgactcataaaagaacaatttccataaaagcacgattatctcatattttggccatacctgcatcataactaatcattatttctaggctaacaatcgaaatg

SEQ ID NO: 110422 - DNA, 390 bp, Heterodera glycines
  Promoter: Source sequence=SeqID_5631; Location=639..1028; Strand=+; Gene=SeqID_58710
attctacttaaaaataaattaatttcatttttttaaatattccattaattttaattgttttttttcggcactccgttggacggaggaaaaatgccgtgaaaatggcattgaatgttcagcagagaatcgccgtcaattgcttggcccggcactgttcaaaattcggctcccgcttttctcacatgtggaatttactgttcaaattggtaaaaagtggatttaatattaaaacaaagtaaataatgggatatcaattttaacataaattacctatattaactatacagaaaagcaattagaatatcgtttaaaatttatactttattagttagtaaaaatttataaaattagacatttttaagggttgcttaaaattaattgcttagaatg

SEQ ID NO: 110423 - DNA, 111 bp, Heterodera glycines
  Promoter: Source sequence=SeqID_31649; Location=140..250; Strand=+; Gene=SeqID_61965
tctgatcagtcttttcaaccgaatttgggagaacatgcacgtgatctggctttacaaccatcgaatttgggagaatcaacagctaatcaagcttttcaacaattgaatatg

SEQ ID NO: 110424 - DNA, 1003 bp, Heterodera glycines
  Promoter: Source sequence=SeqID_9791; Location=372..1374; Strand=+; Gene=SeqID_72690
ggacagtgagtgagccccttgcattgttcccccgttttttccccccccccccccccaatttcgccgccttcgcagcgaatcgatcattttgggcggtgattataaaaaaaataagacaaatacgatgataaatggtattgataataaaaaaataaataaacaattgaataacacaccaccacccccacctaatgagaaggtatttatcatttattcattcattcgttaattcactcgcttttatttaatcactgataattttcggatgattttattttgctcattgcaagcagcagaagagcagcagaagcatcaactgtgttgttgtacatatgtattacatttatttgcctcttcgttggacatttaaatgatttataattttaatttaaaaaataataagattttcaataagtttttgaatttgaataatccctccagaaataatttgccaattaccatttgatgtaatcctttttggtccagcattaatatttttgtaataccctgcaaaacattttcattccatacacatttttgtgtcaccaattcgtgctcacttttcagccatcaactgcaagttttaatactcttccaaaaacacatattatcggtcacgcctatttgagtcatatcgaatttcccaaaattttgcaaaatctcctcatttttaaaatttaatttctgtataagttaatttaatcttaaaatatgaactttaagatcttaaagactagaaatgaaaggaaaatgaattgaaatcatttaaaaaagatacatatgacaaagtgtgtagtaattgctcatctgccgagtgagctgctgttttggtttggagcgcaattatttatttattatttgacgaatgaattaattggctgcgcgaaaattgatcgattgacccggactttttctcaaaaacatcctttattattaatttaatttaaaaatatttattaggatttcttaaatattttttccgccagcagaggaaataaaaatg

SEQ ID NO: 110425 - DNA, 496 bp, Heterodera glycines
  Promoter: Source sequence=SeqID_2313; Location=1987..2482; Strand=+; Gene=SeqID_79055
ttggcaaattttcatgtgatttggcccagcagtatgcgcaattatgctctgacggaagcaaacgaaaatatttgggaagaaaccaaataaataaaaaatgtacagcgaaatagcagtaaaatgaggagggagatagagaggagaaagaaatagtgtgtgtgagagagaagcgagagacagcgagttaaaaagagagagagagtgagaaaaaaagagaaaaagagggtaagcataaaaatcattcataattgtttttttctataaaataaaagtgcaacaaaattaaaagtgcaaaaattggtcaacaacgaaaacccagcggaaatcggtggaaatttaataaattttgggagggaagttgcgaaaatgaaaatgttcacatgaattccccaagctcagctgatttttgctgagccaagacaatataaaaggaggaaattctgaaggaaaatcacttcaaaaattaatttactaaaacaaaataaaatcgaaaatg

SEQ ID NO: 110426 - DNA, 141 bp, Heterodera glycines
  Promoter: Source sequence=SeqID_17939; Location=1..141; Strand=+; Gene=SeqID_47488
ggtttattaaacttaagtttttaagaaaaatgaaggttttcggccttatggtattgtcgaaggattcatcgacggcgaaagttcgtttgttgaaaggggcttttgagttgaacagcttcagttttttcacaaggaaaaatg

SEQ ID NO: 110427 - DNA, 473 bp, Heterodera glycines
  Promoter: Source sequence=SeqID_4899; Location=3713..4185; Strand=-; Gene=SeqID_45929
aaaaaaaatccaggtccaggcaaaacaggaaaaaacctggattttcctggacaaaattttagaatttattatttcaagtgaccgatattttttcaagttttcaaaaaatgattaaatatatttaaaaacaaattattattgtaaattagatatttttagatgttcccaagcaattaattgaatttttcaaacatttttttgatttttaaaatgagtttaaaaaaatccaggtccaggcctggatccaggtctcgaggagcctggatttttcctggacctggattttcctggatttttgtccaggaaatccaggtccaacatggaatccaggtccaggtccaggcatttttcaaaatgtcgatctctatttttgagcaataaaatcaaaaatcagaccatccatttttgaattactcatttgtcagttacttaatattttggcttcaatttcactcatttccctcttcagtatg

SEQ ID NO: 110428 - DNA, 505 bp, Heterodera glycines
  Promoter: Source sequence=SeqID_21865; Location=597..1101; Strand=-; Gene=SeqID_52494
attttaattgatttataatgaaatatttttgcttcaataaaatgtatatttttgttggtcatttttaaataaaataattaggtaaattcatttattttctgacaagggtgttgtaatggctgatcgagaatagcctgtaggagctgaaagtgctgtaggagcaaaagcaacaggggccaaaatgaaggaaagtgtttcgatgaaaaatgcacgaaaatttcttttttagccccgaaattcttcgttttaatgttaatagacattaatttaaaaatttttgagtttttttaaactatttacgaaaaatttccaaactttatagtaatttttagatatttacagatttatccctttttaaaaacaagaaaaaatttttttactcattgcttatcggcatgatttggcgccggagccaaaaaagccgaaaatttacaatagcaaatcgactatgctctacacgataaaagtggttttaaagtgatttggacactaacagttcgatatg

SEQ ID NO: 110429 - DNA, 191 bp, Heterodera glycines
  Promoter: Source sequence=SeqID_29604; Location=711..901; Strand=-; Gene=SeqID_46174
aaaattcaacgccttttatatggctaaatttccaaaaagaaattcattcccaaaaaaagaatataaaagcaacaaatctcctccaatccctcactaatattcattttcgtcattctgccttttgctggccaacgacacacacacattttcctcaacgacgttcgaccgactacgacacgacgcgtacgatg

SEQ ID NO: 110430 - DNA, 364 bp, Heterodera glycines
  Promoter: Source sequence=SeqID_12555; Location=725..1088; Strand=+; Gene=SeqID_76208
tatttttaaatctgtgcagggattgaggaggagtgaacaaaatttcggtatttatatgcgcaaagcatggaaatagtgtgaagaataaaaggaggtgaaagacggaagatgaataaacatttaagcatgctcatataattttaataaaatttaattatacggttccctaaattcccaattaaataatacggtgcccataaagcgcagaaaaacagcaatgtgcaaaaaaaaagtgcaaaatttttaaaatgaatcgggaaaatgatcgggtatacgatgtgtgcactttggccacgcccacttgcgcaccaaatcattcccagcaagaaatcgaaatcattctttattcaaattctagaaaatg

SEQ ID NO: 110431 - DNA, 640 bp, Heterodera glycines
  misc_feature (10)..(10): n is a, c, g, or t
  Promoter: Source sequence=SeqID_29027; Location=1..640; Strand=+; Gene=SeqID_59597
tttatgggcncaatgaaaaacaaaaaacgggtgagtaaatcttgaaaatattgcaaatcaaaagccataaacccacctcgtactgcgatttgagataaatttctgttttttcacactatgagttggtttttttaccaatgattttaccccaaaaatccccccctccatccctgtgatttttttcgtaggggctcattaaactgtaaaagtgccgaaaaaaccaatcatttaaaaatcctcacattttttttcttaaacgtcggttcattttgcggcaattagcgcacaattattgtcgttatttgtgatcggtaggggtcaactgcgtctgagccaactgctttcgtaccggcaaaggttcacagttttcggaatatgaaacaaaagggtccataaaatacaaaaaaaggaatttaaattttttttaggcattaaatctttttttccgagaattaacgtttttctgctttttttttgtaaaatttgcggaattacttttacaaaaatgttaagaatcaaatttaaaagagtcaatacgatttatgagaaaatttatataaaaggcagagaaattgacagttaatttcatttttgcaattataacttacgacaaaattgtgcagctaattgccacaaaatg

SEQ ID NO: 110432 - DNA, 571 bp, Heterodera glycines
  Promoter: Source sequence=SeqID_30648; Location=963..1533; Strand=+; Gene=SeqID_61056
taatttcgtatgttttttccggaaaatcaattcgaaaatcaaaaaataaaatctgttttattgtatgtgtaaattgatggagaaaagaaaagtggaaaatttgaaaagccataattaaaggaaaatgaaatttttaataaaatttatttggcaaaataaatggcataatgttcgtaaattgttttgacacttaaaacatctaagagatgataaggactgccaaatatttgaacaatttcaaagttttgtccctattaaaggcaaagatacctaatttttaaataaagcaattttcaattccaaatctcataaatttgaaaaaaagacttggaagccctttgaatgttgggcggatttgatacagtacgcaatgtgtatggtaatgtacaatttaaaaaataacatttaataatcgagaaaagcaatgaataaaaaatgaaaaaatacccttatttgttaaggaaaaataacaatttttttggggggggagagattgaccaatcggtggaagggtgatcaatgacaataacactactgtctgatcacagaatgataggcatgaacggaaatg

SEQ ID NO: 110433 - DNA, 282 bp, Heterodera glycines
  Promoter: Source sequence=SeqID_5085; Location=1960..2241; Strand=+; Gene=SeqID_56847
ggtaagaaatgtcggaaaaaaatgaatagttgaaaaatctttggcactttaaggaatatgttcaccaattatccggttggccacccgaccgtggtgcagtttgacaaggacgtggaatggaggcgtccagaggacgttgttggcgacgacggcatccgccttgagggcatcatcaagtgcttcgtagtgccgccccgccactgccactacgatatcccggtccttccgtaccggctcaacaaccgcacgctgttttccctctgccggacgtgttccgaaatg

SEQ ID NO: 110434 - DNA, 1003 bp, Heterodera glycines
  Promoter: Source sequence=SeqID_8740; Location=749..1751; Strand=+; Gene=SeqID_69048
tccccctttttcccttttttattttgtcacttttcactctgcctcatgtttttgtaattggactttaacccccccccccccccccggggggcaagttgtccaaacatccccttttttaacactttttctctttgtctctccccgtccttctcctgcgttttttcgcctctctccttttattcaaatgtgccgtcgcctttctcagcttttttcctcccccttcttctttcttctttgtctccctttggccaatttttgttcacatctgcaaatcgttttttccattttcctatggtacttctgtcgcccgccccctctgtgtctgtttacttaagccttgggctccccccatacacacacacattatataatcactgctcctcttctccccaattttccatcttcaatgccgattgcattaaccccctcggcctttcttctcgtgtcaaataaattgttgttggtcgaagtgttggttggatcagggacggtagagacgggaggaacacacccccctctcgtcactcacaccgcgagaacggcactccgtctgccccccccccccctctcctctcgcctcgccactctctcgccttcagcgtcgccgcccagcgtggcgagtcttgtcgtcctcttcaattgacccaatccctcccccagtttgtcgcccctttctcgacaggttgcagcaaagttataaagagattaatttactaaatgaagaaatagcgttgataatcactacttattcagttccggttggaggtaatcgaatataaattttgttttaaaaatatttttaggtcaatttcaaccgttagatttctttcctccaaaagaaaatggacggcttttagtaaagaataaaacaaataaatattgtctattttatagtgtaatattgagccaattgtatcaattgattaatagtgacggatcggatagaattacatataaacaattcacattaatatatcaaaatgaaaaaagacaacaaaaaatg

SEQ ID NO: 110435 - DNA, 68 bp, Heterodera glycines
  Promoter: Source sequence=SeqID_13956; Location=1..68; Strand=+; Gene= SeqID_47173
taatcatttaactttaggctaatatattttaaatgggcctttgctcaacagactgtgccgacagaatg

SEQ ID NO: 110436 - DNA, 96 bp, Heterodera glycines
  Promoter: Source sequence=SeqID_19054; Location=945..1040; Strand=-; Gene=SeqID_83793
tattcaaggacatagaaactgtcaagaaaaatgtagactattttttattttaaagaaataatatttttttagaccaagggctatccgagcgcaatg

SEQ ID NO: 110437 - DNA, 1003 bp, Heterodera glycines
  Promoter: Source sequence=SeqID_11734; Location=2903..3905; Strand=-; Gene=SeqID_75218
gtgattgtttaaaataggtaaacaggttacaattttgatggtattttatgatttgcgaatttacggttttacttccgatttggtgctgttctataacgttatataaaagacacaaaaagggacttatacaaaaatcacctaattaatgtattatctcagtcggttagagcacggcacggattgctggggtcgtgggttagagtcccagctggcgagttattttttatgttcaacacggggctcctggggtttttttttctgagcggcacggtcccgttggtttgtcgaaaaaatggaacggtaaagcccgccgagcgcccgggcacgtcccgcctctaaataacagttttcggaaaaatttaaccatccaattttgatgctcacatattttggatttctttcatacatatttatgttatatttattttaattaatcagtagggatgctaattttatgtaacaaattttgcgaaatatgtaaataaaatatgtataaaaaatgctaaaatatgtatgaaatatgtacaaaaacccccaaatatgtactaaaatatgtaaataaaatttttttaatggttattttttggaaaaaattcttcgtaaaaagtgaaataggcacaaaatgccataaaaatgaccaaaataggcttagaatcacatttgaatattttacaaattaatttttgatatatcattttttgaaaaaatcgattttttagggatacattttcaaaaaaaattttttaaattttttacaaaaaattttataaattctcaaaaatcctcaaaatatgtaaaaaaatgaaaaatatgtacgaaaaattgcgaaatatgtacgaaaaagtccaaaatatgtataaaaatatgtacatatgtaatatgtagaaaaatcccaaaatatgtaaaaatatgtaaataaaagtcccaacttttgttcgcaaacacaaaaaagaaagtgtttttcctactaattaggctatggagaatctaggaaaaaaatatg

SEQ ID NO: 110438 - DNA, 72 bp, Heterodera glycines
  Promoter: Source sequence=SeqID_18730; Location=2296..2367; Strand=-; Gene=SeqID_83402
ccctgtgccgaattcctttgagcaaagtgtaaagaacctcccagaacgcaactaaatgtggcaaaaacaatg

SEQ ID NO: 110439 - DNA, 780 bp, Heterodera glycines
  Promoter: Source sequence=SeqID_6530; Location=1455..2234; Strand=+; Gene=SeqID_61909
aataatttttttccaatccctaagaattttctgaacggtctgtgcgaacacaagccatcccaggacttgtggaactacttcacactttcagccgttacataatcccatttgccaaatattaacctataataatataattaattgtttgttgttataatatgtgcaataatcttttatcattttttcattttgatctcgggcagcatacccaaaaaacttaaatatcaattagtctctttttcttaattatgttcatatatatatttgtatatttttaaatcaactattcaaatttcaacaaaaaatattattgttattattattggcaatttaagacaataaaacattgaacatatttatctatgccttaaattctaaaatttatgcatttgtttagctatttattataatttttaattattattaaattaaaatttcaactcttggtccataaatatttatttaaatgttaaaatagtcttccggattctttccgttagtctgtcgattctattgaattttactctgtttcactttatgcatattcaaaggaaaagcatagaagcagcagcaacagcagcaggcattcttttccaggctttgttccgctgcttctccctcgccccctccggcagttcgctgcctttggcccactctcctcgccccaggggccctatttgcgtgtgagaaaatataatggtgatggttctgttggttggtggttgtggataaaatttggcacgaaaagccgagcatcgaccaaagacaggggaaggcatg

SEQ ID NO: 110440 - DNA, 556 bp, Heterodera glycines
  Promoter: Source sequence=SeqID_16034; Location=1244..1799; Strand=-; Gene=SeqID_47335
ataaatgtgttctagaaattaattaaaataactattaaggggtattgggggtcgctgatcacgaatatagcacccatttttgccaattttgaacccctgatccgaactcggacaaaaataaaaattcgaaattgtatggatgatatcctcattggcatcttgccaatggggtattattggtacaggaaacctatcaattctttgtccctgtacagctcatgtagtgaatggtagcgctgatctgagcccggattcgtgatcagcgaccttgaaaaccccttaaaacttattttcactaatttctaaaacacatttatctgaaaatgtatgttaaaaatacccggtaaactagaaaagtaccagactttgattactttttgcttgtttcattagtttaaaccgtatttatatcaaaattgagagagactaaaaaataagtttcgactttttgttagaaattgggtccggggttcttgagtcgaaatgaatattagaatcggattttgaatggaatttttagatcttcttttttcctgttctaatccaccgaaaaatg

SEQ ID NO: 110441 - DNA, 916 bp, Heterodera glycines
  Promoter: Source sequence=SeqID_6610; Location=2220..3135; Strand=-; Gene=SeqID_62198
tcattaataattagggatgggatttttatgtgctaaaaatcctgaaatatgtaataaaatatgtgctaaaaaatgcttaaatatgtgctaaaaaccccaaaaatgccaaaatatgtgctaaaatatgtgttaaaaattggaaaaatcaagtgtctttttgcataaaaattcccaaaaatctcattctttatcatttttcgcccatacaacgcaaatcaaatacatttcaaagtgtttggggtaaaattgatctttttttgattaatcattttataaattgaaagttccagcagagaactgaaatccaatgacgaattaatgaattcgattttgttactttctacattcgaaaaaaaatttaaaaaatttgaaaattctataagaattgtgaaaaaagttgatttttagggttgtatttttcaattttcttgtatttttattgcaaatttttctcagaaatgccaaaatatgtgcaaaatatgtgccaaaaccccgaaatatgtgccatatgtttttatgtgccaaaatgtcaaaatatgtgtttttatgtttttataagtcgctctaaatcaaaaattgttcggagataatgctatttttgggcttctctcgccataactaagccgcaaaaaaaatatgtaaaaacataaaaatcccatccctattaagaatgcacagcttaaagaaaactttctaattaaacacagatttcgactgtgagtaccatttttgttgtttttggtaaactgtgcaaaagttagggagaaaacaaatttttttggtccgttaacggccgagccgctgtcgaattcgacatttaaacttttttgttgtttttataaattgttttcgttttcccaaacttaagagttcatattctttgctgaccaccgttaccgtctgatatttgaggatg

SEQ ID NO: 110442 - DNA, 348 bp, Heterodera glycines
  Promoter: Source sequence=SeqID_3553; Location=2588..2935; Strand=+; Gene=SeqID_50847
ttgggccacaattaacttctttaatgaacggattgagctaattaatgaatgagccataaaacaaagatttaaaaaacagttcaaaatacattggatatggagcagtagaacagtaaaaggctggctggttgacttaaaccgaagaacgaagccggattttttaaatattaaatttaaatggcataatgttttcatgccaatttgcgccatgccaagcgccaaacctaaaataagaaatcaaattttttttaacgctttaaggccacattcccaatccaattggctttctacagttttataagcttcatattttaattaattatatttaatttagcgtatttctaaatg

SEQ ID NO: 110443 - DNA, 216 bp, Heterodera glycines
  misc_feature (1)..(1): n is a, c, g, or t
  misc_feature (16)..(16): n is a, c, g, or t
  misc_feature (22)..(23): n is a, c, g, or t
  misc_feature (25)..(28): n is a, c, g, or t
  misc_feature (36)..(36): n is a, c, g, or t
  misc_feature (40)..(40): n is a, c, g, or t
  misc_feature (44)..(44): n is a, c, g, or t
  misc_feature (50)..(51): n is a, c, g, or t
  misc_feature (56)..(56): n is a, c, g, or t
  misc_feature (59)..(59): n is a, c, g, or t
  misc_feature (61)..(61): n is a, c, g, or t
  misc_feature (66)..(66): n is a, c, g, or t
  misc_feature (77)..(77): n is a, c, g, or t
  misc_feature (83)..(85): n is a, c, g, or t
  misc_feature (88)..(88): n is a, c, g, or t
  misc_feature (92)..(93): n is a, c, g, or t
  misc_feature (95)..(99): n is a, c, g, or t
  misc_feature (101)..(102): n is a, c, g, or t
  Promoter: Source sequence=SeqID_35760; Location=232..447; Strand=+; Gene=SeqID_65239
nttcaatccctttttntttttnncnnnnactaactnaccntccnatcatnnccatntantnatcantttctcatttncctttnnnctnatcnntnnnnntnncctcatcttcatttgtttttttgattcaattaactgtcaaaggatcgtcttcgcactgcccaattggactcccagcggaaggacgaacttgtggaggcgctgtacgaggagatg

SEQ ID NO: 110444 - DNA, 1003 bp, Heterodera glycines
  Promoter: Source sequence=SeqID_22027; Location=282..1284; Strand=+; Gene=SeqID_52660
atctccaaaattatttatttactttcttgacaagttgcaattgtatgggtgaaattgataaaaaaaatctcatttttggaatttttgtgcataaaaacagtggacccaaaatcataaaatattaattgtgcaaaaaacgaagccctaatgattaataagtagggatgtcaattttatgtaaatacattttttttttcctggcttctccatgctctaaatagtaggaaaaacactttcttttttatttttgcaaacaaaaatcgggacttttatttacatatttcggggttttatacatattttacatatttcgggattttatacatatttggtacatattttggactttttcttacatattttgattttttttacataatttgcgggttttttacggaaatttttggaaatcctcaaaaaaaaatccaaaattttggtaaattttttatttttttatacatattttgagaatttttgaaaatttttagaaatttctagtgaaaaaattaaaaaaaaactttttttaaatgtacccctccaaaaataatttcttaaatgttaaaaggtgattctaaacatatttaggtcatttttatgccattttacgcctatttaacactttacgaaggttttttctcaaaaaataaccatttaaaaaaattttatttacatattttcgtacatattttgggtttttatacatatttcttacatatttggggattttttttacatatttatgtacatattttgaccaatttttgtacatatttttgacatccctatcaataactaatttagaaaaatgaaataaaaattcttttacttcgcagcctacaatataaaagccattggaaataagttttcatgatttttgataacaaaattttttccaaaaaatgtgttcatcaaaataaacattaatttcataattaagattaattttttcggtagaatatggccatttttgtgacatacattcaccagttatactttcgcaatg

SEQ ID NO: 110445 - DNA, 159 bp, Heterodera glycines
  Promoter: Source sequence=SeqID_8422; Location=740..898; Strand=+; Gene=SeqID_46597
acaattctgtggcagattcggaaatagtacctccgattttcctgctgaagtaaagttggctagaatgagaccaataaatcgaaaattatgccaattatttttaggcggtataaataattatgaaacgcctaatattttcagacttcttccatcccaatg

SEQ ID NO: 110446 - DNA, 1003 bp, Heterodera glycines
  Promoter: Source sequence=SeqID_9863; Location=1406..2408; Strand=+; Gene=SeqID_72892
gaattgattaagcaaaatttattccgggaaaaagcctcaaacttgggtaattaaaccaaaattttgaaatggtgaacgaattatcacaaattgattacagaaatgccatcaccggggaattatcacaaatggaattgggcaccgggatgggacaggaaatggagggcactggggccacagaacaaaaatcaataaccggggggttaaagaatgatcacaattggggggccatcacagttaaaggcaaatggaggggcggggagagaaacggcaaaaattgccaaatgaaatttggttgtgaaattgggggcatttttggccgcttaaataacaataaaattagataaaaagtggcaaatgtgagcagaacaaaatgggccgaaaatttgggcacaaaatgaaaaacgggggacaaaaatgaacgaatgaacaaaatgggcggaaaacgggaaatttgggaggttcatcgttctttggagtcgattcgccaaattggggacgggggcagaaaagttgcggtttgacaaattggtcattaatttgtgcgcagggcgggggaggaacacacaaaaacaattgacaatttgaaggaaaagggggacagagggatgaaacggcgaaaacatgttgcgcggcgggcgggggattggtgaagggcctcctccctcttaattccgccgatcattgatcggcgataggaataaaaattccgacatccgcgatagttttctgggctttttattgacaataataactccaaataaattgtaattatagcattttatgactctttgtatgtataatgagagtaggaacattttattggtatgccttttttaatatccaaaaaagataaattctgcttttctgttaaacataccactaaaaattttggatatgtgtccaaacaatttaataaaaattcactaaattccgcgatagttttctgggctttttattgacaataataactccaaataaattgtaattatagcattttatg

SEQ ID NO: 110447 - DNA, 1003 bp, Heterodera glycines
  misc_feature (155)..(155): n is a, c, g, or t
  misc_feature (330)..(330): n is a, c, g, or t
  Promoter: Source sequence=SeqID_8268; Location=1501..2503; Strand=+; Gene=SeqID_67500
tgcgcttaatcttttgccattattttgtaccaaaaaaacagacagaacagaatttgtgcatattcacatacactgataatataatattataataacttttctcagtcttttgtaaatggctaataaattgaattgccaattgacacgacaattgngggaaaatgggcaaaagttttttgggaaggtatcactgatcagatttgggatcaaagttttacgaattataagggcaaagagcagatgtattggatacttttaccacgtgtaagaatgcacttttaattccgccattttcctctccaaaattcgtttttctccgattaattggcncaattaaattaattaatggggctgctctgttggtgtgaacattttgactacggtatgggagaggacacactttcattacgttgtttctctgttgaagtttattgccctgcctcgtgccaaatgccaactgttgcttctgtcccccccaccatttggccaattctccattattttggctaatttcccgattctttttccgtctccccgctttgataatgccaataaaacggaggcgctggcggaaatcggagaaaacaaaaattttcacaaatttcgcaccaaaataataataaacaaaaaaattaacctaataaaaatagattatctaaattctactaatttgctgtgttttttctcattttttttgcctaattttcaatttttttgtgcctaaatttgatgccgaaatttaaattatatgcaattttaaggaaagcactttcttatcatattgtaattatgctgctgcttctctccattttttcgcttcttcttccggtgtttttgactttttcccccttttcaaatgcttttcccgtcctttcggttcgctttaatttttatttttaaatcggtttaacaaaattattgctgttagcagaaaacaacagaaacagcaacaaattacaatgctaatgacccgtggcgatcattgccccccgagttggacatg

SEQ ID NO: 110448 - DNA, 457 bp, Heterodera glycines
  Promoter: Source sequence=SeqID_12677; Location=1065..1521; Strand=-; Gene=SeqID_76356
aagaagtgatcagtgtgaaaaataccataaccatctgtccgacggcatactgtacttactgcaatttcgaatcggaatcgatgttcaagtttgagacacttctttattattttggtttaccaatatatacctaattagggaatttaaaatgcaattaatctctacattttgttttacttctttacctgcagggctttttctcatctcctgccttgaataacacaaaaaaagatttccttttcatttcttttcacactttccactattaaggtggcgtagcgcagtgggtaaatgctttgctttagcttttgaacatatgagttctattcccattgactgctcttaatttggtctagaccgagcgcgccgcccaatttttaaaattttttttttgatccggaaacgggatttttccttttttttttacagttccctccaatgttttaacggcggaatg

SEQ ID NO: 110449 - DNA, 142 bp, Heterodera glycines
  Promoter: Source sequence=SeqID_11052; Location=156..297; Strand=+; Gene=SeqID_74388
agtgggcgggggagggggggggcaacaaatcgtaagaacaacaaaaaaattgcaacaacatccccctcccatgatttaggcattgccgcgccgtgttcgtgaggctgttgcacaagtgaatgcgcagcaattgcagcgaatg

SEQ ID NO: 110450 - DNA, 1003 bp, Heterodera glycines
  Promoter: Source sequence=SeqID_14909; Location=62..1064; Strand=+; Gene=SeqID_79069
cattttctcggtgcagatcttggaaaggtttaaaaataaaattggcaaatgagaatagcgaaaaaaaaataaaaaatatagtgtggcaagaaattttaaaataaacgtatatatttataaaaattaaattttggaacagaattacaataaaataattcagttaaggttaattaaattgtatggtaataaattagaatggaactttgattaaagctgaataagagatttagaaatgcataaatatttcattattatatgttttgttttggaaatttaatataaaaatattgtttttctttttttcattaataaagaaaaattatttgtttgctttttcaagaataattgaatgtataacataaaaataacacacatataagcaattttaacaaaaatatgaatgaaaattaaaacaaaaatatattaaaaacagacaaaatatatattggaaaaaattggagctaattaaggtaagttaatcgttgcattaacaaggggggtgcaacgtatgatagggcgggatataaatcatccctttaactatcatttaacccctgaaagctccaatgatacccgatgctttggtgcgttcacgccgcgggtatcgttagtaagccaaaaggccgaagccaaatccaaagcagaaaaccaaaaaattaaattaaagaaaagaaaaaaatatgacattctatggttttttaaattttagttttgaaaaatattaaaattaaaatatatataaatttaaaaaatagattgttttaagttattattatgatttttaaaaaggttttgtgaacagattattggccgataaataggttaagtggtttttgatcattaattgttagcatccagtgctttgttggccggtaaatgtgttgttagaaaagttgtcgcggtgttttcttcaaaagtaaataaaaacaacttttacattaatacatattatgttaaataaataaagttaattcattcttttctttaaaaaataattcaaatg

SEQ ID NO: 110451 - DNA, 121 bp, Heterodera glycines
  misc_feature (53)..(53): n is a, c, g, or t
  Promoter: Source sequence=SeqID_27194; Location=1..121; Strand=+; Gene=SeqID_57881
gacagatagatgatgattgcttaaagcatatgattatttaaaataaataatangataaaattaaaaaaagcatttttaaggtctctgatgtggatgattggaattcgttctgtacggcatg

SEQ ID NO: 110452 - DNA, 278 bp, Heterodera glycines
  Promoter: Source sequence=SeqID_13794; Location=1538..1815; Strand=-; Gene=SeqID_77723
aaattaaacaatttttaatatttaaaaatcagtgaattatcgatttgtaaattaatgccaataaattgagaaaaattgggcaatatttgatgaaatgaaattgcaatattaaagaatatttcaaacaaatatttccattatatgtaaaaataaatttgtggcatttattatttattatatttttctttatttttgtaattgaatccggcaaaatccgaccgaatttcgaagaaatatttggcaacggatggaacaaaaaagagagaaaagaaattatg

SEQ ID NO: 110453 - DNA, 86 bp, Heterodera glycines
  Promoter: Source sequence=SeqID_12998; Location=2155..2240; Strand=-; Gene=SeqID_76769
aaattcaaaacaaaaaattgttgtacactttgccaaatgccatgacaattgggccaaaaacgccatatttaaagagggaaaacatg

SEQ ID NO: 110454 - DNA, 322 bp, Heterodera glycines
  Promoter: Source sequence=SeqID_21871; Location=1213..1534; Strand=-; Gene=SeqID_52511
tttcttattaaattttttgacaaaaaatcgtgaatatacttttattcgccataattatgctgttaatacttaataaaaattaatgaaaataagctttaaggggtttttgaggtcgctgatcacgaatatagcacccatttttgccaatttcgaacccctgacccgaactcgaacaaaattaaattataaaatttatatggatgatatcctcatgggcatcttgccaatgagggtacccttggtacaggaagcatagaattcgaaatttgtatggatttattttcattaatttcaaaaacacatttataggcatttgaaaatg

SEQ ID NO: 110455 - DNA, 736 bp, Heterodera glycines
  Promoter: Source sequence=SeqID_39008; Location=1..736; Strand=+; Gene=SeqID_67675
ttttaaagcaaattgcctcggggatttgctaccctaaatatattaacactcccccttttttgcacgaaatttccgacaaaattaaattgcagcaaattttgcgcaagtgtcatagaaacgccgtgccaatttcggccaaaaataaattgcccgcccggtaagaagccccgttcccgtttagtgctgtctttcccgccaaaggttttttgtggcaaaagcttctctagggggtaaagagtggggaaagggatgaagcaattattaaaatgaaatgtgatcagaattggcaccaatttagagcttctggggccactgagtgagcttttcttttccgaaccttctcgaaagctcgcaaagggaaaatcttcaattaacacatttcattttaaaattattagtaataatttatgctgtttatatggcattgtttaatctcggagtttcggtatacgttagaaaatcattttaaaatatgtaaaatttttggaaagaaatttgaaactgagaattattaattccgtgtttaactttctattaatttttggctttggggcttcaattattgtgcccggcatcggaaacgattttttctaaaattttttggatcgcaactcttttttcatgttttaacttcgacataggcttaaacacaaggcaataccatgcctaattatcgataatttcgaaaattaaaatccgtaagttcgtttttgtattaagcacagattttattatg

SEQ ID NO: 110456 - DNA, 184 bp, Heterodera glycines
  Promoter: Source sequence=SeqID_9321; Location=1..184; Strand=+; Gene= SeqID_70990
tacatcttttcgttgctttttttctacccgaatttttctagttcggtttcaatgactataaaaataatacagaaaagaaaatgttgcttattgtttagagaaagacaattattattcagcatttttgtgacatcgatcagttgtaaaacggcaaattgttgtgctaattgaaccgcaaaaaatg

SEQ ID NO: 110457 - DNA, 605 bp, Heterodera glycines
  Promoter: Source sequence=SeqID_6905; Location=1401..2005; Strand=-; Gene=SeqID_63248
attaataaagacccaattttatttgcttttaattgcatgcatatgagaagcatagaaatagaatttcatcgacagtttttcaaattggagcgacattttgcaccaaaaaagacattttgtagttttggcaaacttttgctcggcgatttgtaaaaaaaaaattagaagcgaaggctttctaatgatgtcaaatttatgaaatgtgaccagcagagaaaaatgctttaaaattggctcagactaaaccgacccccaccccaattttccatgaaaactatttgtgatggacaaaaattctaattttcccccggcggcgcctttcggcaccgccagacccccaaactttttttaaactggctcaaaatcgccaaattcagttgggcgccctacttaccttagacgtttttcatggacaataataatatcaatattaagtgctttataaaactgacaaaactcttaatatagcagcattaaattttttaatttcatttttatttgattgaaattatttacgatgaacgacttgaaatttcgatttatggaaaaaaaatttaggtgacattaaagaagtgttgcgtatttcgcctattttaaaagagatg

SEQ ID NO: 110458 - DNA, 53 bp, Heterodera glycines
  Promoter: Source sequence=SeqID_32068; Location=701..753; Strand=-; Gene=SeqID_62381
tgtcatagaaaaatataaatagtttccaaaaaaattaaaaacaagaaaaaatg

SEQ ID NO: 110459 - DNA, 99 bp, Heterodera glycines
  Promoter: Source sequence=SeqID_6078; Location=2847..2945; Strand=-; Gene=SeqID_60235
tcggtcgaatcgtcttcctatacaataaataattcccgtcagtttttttttgtttcattttttaaaatgaaataaattttgtgcccttttttcaggatg

SEQ ID NO: 110460 - DNA, 681 bp, Heterodera glycines
  Promoter: Source sequence=SeqID_2861; Location=778..1458; Strand=+; Gene=SeqID_82021
aaagctggatcaaattcaaaataaaaatttcaatcagaaagtagaaaatttcatggaaaatttgagggttttatcacaaacaaaaacgtgtcgtgctacgtaattgaaagtaacataatagaacactacgtagtacatattatggttggtataaatcgatcatttcgttattaggttgccgctggaggggctagaatcgccgcgaacgtggacaacgttatcaaatttgcgacttgggacatgtttttcgaagcgcgtcgcattttgcaggctgacatggaagtgcgtcactttttctacaatcaaatccggcaaattgctcttcaaaacaacattaaccaatttccgatcgtctctacaaccgtggttacgttttggtcagatgactcgcagaaattgaagacgcagccgtgtcagttcttcgagttttaaaggatgatccattgttcattcagcattttttgttgcaaataaagacttattgcctttaaatcatttgagtaattagagtttaatcatgtacctaaatttttcaaatagggttggtctgctgggaccaaattgatgcttttggacccagtcaatacagaatcgtgtaaatatctttacccggacccgatttgtctaaccctatttccaggttccaaaaatatcgaagaattacttgtacactttattatg

SEQ ID NO: 110461 - DNA, 595 bp, Heterodera glycines
  Promoter: Source sequence=SeqID_8702; Location=1389..1983; Strand=+; Gene=SeqID_68895
gtcaattaaacgataatatcggtgcggaggcgggggaataaatgacatgacaaattatatgtgtgaatggtggacaaactttgtatattggcaactcatgcaaaatatttttttgcccgaggggccattcgaaaatttaattgcttttagtgtccgatggttgcctaataagcacctcgtttaatttgaaaatttaaatatattttgttttgaaacaaatattcaaaaaggctctattcagtttatgcgtccgatcaatgaccatcctcactttcttaggctataacatttttttttctttcttatttgggcaactaaatcatggactaataacaatagacaaaaatcttcatggctatactcggaaaaagctaaattcatatgttccatattttttaatttttctataataattattattatttcttgcatggacgcctaaactgaaattagtgccaaaaaagtacaatttttatttaaaataaatgttttcaatgcctaccaatgccatccataacatactcttgaaaatagaaaattcgatcatttccacccgtaggcttacccgcctggctattgtgtgccgccctcaatg

SEQ ID NO: 110462 - DNA, 205 bp, Heterodera glycines
  Promoter: Source sequence=SeqID_42282; Location=244..448; Strand=-; Gene=SeqID_70211
ttgggaaaatgtaaatgaaaaagtgccgctcaagaagacagtacctaagtaacggcagagcattttacaatttttgactagcggaaaccaaaatggactttactgaacttggcaaatgattaaattataggaattagtgtctcgactaattgcgactaataacttttaccataatgggaaaaggacggaaatcagtcgatcgatg

SEQ ID NO: 110463 - DNA, 419 bp, Heterodera glycines
  Promoter: Source sequence=SeqID_27337; Location=1..419; Strand=+; Gene=SeqID_58027
ctttcgcgtgagcattttcctttttatttcttattgcattttctccgctttcatcctctgttcgttgcttcaaaatgcaaaaaaaaacccctaaattttgggttgaaattgggagtggtcgtcctactgcttcgaaacgaaaatttttatgtttggtgcaatttttttaaacggactgctttttagagaattgcacctcccccccccccccccccacgacgccacagaattattaatacagttacaattacaattaattttgtttcaaaattaaaaaaaaaaatcttcaaattcccgccaccaaaatagaatttggggtctcaaaatgacaaaagatctgctgacgaactaatttatgtttaattttacactttattttgcctctttttgtcagtttccgtacgcatacccaccaaatg

SEQ ID NO: 110464 - DNA, 864 bp, Heterodera glycines
  Promoter: Source sequence=SeqID_13986; Location=1322..2185; Strand=+; Gene=SeqID_77948
atatgcagatgaataaataaatgtgcaaaataaaatattttaatcttttcaaataattgaaaagcggaacatttgaatgattaaattatataaaatatttttataaaaagataattaattatttaagattaaaaatttatttaaaacatcattttacttttaatttgataattaatattcataacgaaatcttagattttttcaataaaactttaaataatttgacaaattataatcccgacattttaaaaggaattttattttttttaataaataatattttttaaattaataaataaatccaacaaattatttttaagcgaaataattgaacttattttaattattttaaatatggttataaaaattgataacgtggaatatgaaaattttattttagaatttgagttttaccatttttaacttcaataaatttaaatcaaatttaaatattgaaatttatcaataaaactttaaaatatatgctcaacaaattataacccctatatttaaaaggatttaaattttttaaataaataaaatttttaattaaataaataattttaaaattataaaaacattaataaattaactgtttaatatgaaaactatcttaattttcattttcatttttctaaattaaagaaattttaatattttcaacaactgacaatgcgtcataaatttctcaaaaaaccttaaatagatgcacaacaaatttaatttatttgcaataaataaatgtttttttcattaaataataaatatttaaaaaaattttcatttattttaaataaataaattaaataataaataatttaaacattttttgccgattttcagcgtgtccgggacagtctcatg

SEQ ID NO: 110465 - DNA, 91 bp, Heterodera glycines
  Promoter: Source sequence=SeqID_41458; Location=417..507; Strand=+; Gene=SeqID_69571
ggtcagttggcacggcaaaccccgcgggtgtcaataatttaatcctcccccccccccccccaactctgtgcaggtctctctctgctcaatg

SEQ ID NO: 110466 - DNA, 56 bp, Heterodera glycines
  Promoter: Source sequence=SeqID_12313; Location=3793..3848; Strand=-; Gene=SeqID_75909
aatacctctcatcattgttgaattttgtgaattccattattcatttaacagagatg

SEQ ID NO: 110467 - DNA, 651 bp, Heterodera glycines
  Promoter: Source sequence=SeqID_8128; Location=1..651; Strand=+; Gene= SeqID_67064
attttctttttcttcccatttttccccaaatatttcttcaaatgttttttgttccaattttttcttttccgctacaatttcaattgagcaattaaaaaggcaattgcaaagattaatgggaataatttcattgttgacaatttttctttttcttaaaaattaaaaattaaaatttataatttattcgatatgaaattaaaataaaaaataataaaattcctcaataaattactaaattcgaataactgatttttgcgcaaaattttccttattcatctatttttctttctttttttctgcaaaattataaaaaagttctggaaaaaaatgagagtcagaatttatttttgggacaactgtcagtataagcctttgtacagattcaacattcacttcaatagggaactattggggaaattgcattcatatcaaggctgcacgcaattacggattacggattgcggattgcggattacggaaattacggggttttgggagttacggactacggattacgggttacggatttttgggatttttccgtaattttgatccgtaatttgacttttggattattttttcgagacgatttcttgtaagattatttttataaaaaacaaatttttctattttttatttaaagaaaatatg

SEQ ID NO: 110468 - DNA, 127 bp, Heterodera glycines
  Promoter: Source sequence=SeqID_30481; Location=1656..1782; Strand=-; Gene=SeqID_60884
tttagaaatagaaattcaaataaaaatagtaaattcttcgcatttttcaccaaaaatcttcggaaaaatgataaatttaatcgaaaatatcatcagtagtaaaaaatttttattagagcccaaaatg

SEQ ID NO: 110469 - DNA, 127 bp, Heterodera glycines
  Promoter: Source sequence=SeqID_313; Location=1225..1351; Strand=+; Gene=SeqID_81961
tatttttgatcagatttgatataattctttaccttaatccaattaattcactacactgccaatgatctgaccaatcgattaatggttgactgacgctaatttgatttgtttttcagcggccgatatg

SEQ ID NO: 110470 - DNA, 628 bp, Heterodera glycines
  Promoter: Source sequence=SeqID_23456; Location=118..745; Strand=+; Gene=SeqID_54161
tgatgtatgggccgcaaaagtcgggacaattttcagaaaactatagaattaccgttttcatatataaaaacaattgtctgagttgtcggctcaaagtgcacgaatttgttaaagatttaaccaagattaaaaaaagaccaaaaactaactattttgccacaaaattcataataactaaaatattgaacaaaaattattattaggctaatttaaatacaattttcattaaaacataatcaattaaaaattaattttacgaatcatttaaaaaatagatggaaaatttgtaggaataaaaatcatttaattatttttttttgagtaacgcccattttgatggtttttgagtaatgacccggcaccgttttgagcccctttcttcatagcatatgcacagaaaaaatatgttaatccataccaagggcgtagccagacccttggcttcgggggggggggggctgaagtcaaaaattcgatttttaagggtgtatttttcttttttcagccgatttttaggagtgcatttttgttttttggaaatccagaattagaggggatgtattttgcaaaatttttctccgtttttcgccaatttttgcttttttggcatcaatttttcaaaaatatg

SEQ ID NO: 110471 - DNA, 397 bp, Heterodera glycines
  Promoter: Source sequence=SeqID_21002; Location=1212..1608; Strand=-; Gene=SeqID_51578
atccctcgggggaaaatgagctcataaacaatggcagcgattatcgggagtagcaaaatgacaccaatttcatcaaattgttaaagccgggtagggaacaaaatttggagggggcaaaaaagagacaattagctgaagctgatcaatctcggcatgttccgaaagggatcgctaatccctatcactgaacaatctcgaaacaaaactaaccaatggtgcgaatctttctcaaaaaattctaaaagggatcattggccaggtcccgaatccaaaacttaccaaactccgatcatttccgatcagattcactttcgaaatttcaccaattcagaaggggtcatcgaaatgacttctgtcgagaccaattaacaccaattaacgcttttttctccccatg

SEQ ID NO: 110472 - DNA, 487 bp, Heterodera glycines
  Promoter: Source sequence=SeqID_4720; Location=4543..5029; Strand=+; Gene=SeqID_55504
agaacggacgaatcaaacggacgtgtcagacggacgaatcacggaagaaccgagggaaaagatttttttttaagggggaagatgttgggaccggtactctattgtccgcccatattattttcattcctttatttctctccccttattctctcctctatctctcttcccttctgtcccccataaataccctgcggtcctctgacctccccgtcattcatttgtcacccatttattttgcttatattgttcaatcaatattcgccctttgtcctccgtccctcttctcttcattatttatttgtgtcttcccaacttgaataaatcctttatttattcacttcgccggtttgggatttgacggcacaacaatgttgtattatatgttataagaattttaggcagacaatttatttatttttggtttaattataaattaatttaaaaaaataataattatttttaaagatatgctttgggattaaaaatg

SEQ ID NO: 110473 - DNA, 1003 bp, Heterodera glycines
  Promoter: Source sequence=SeqID_9396; Location=1947..2949; Strand=+; Gene=SeqID_71262
aaaattatccctaaatttaatatttttttcttaataaaaattttttggtttaaaaatttgttcatattcgaaaaaaaactttaaaacattaataatttcatttacaattgaaatatttaaagttttaacgtgttttgttacctaaaaagcgttaataaaaaattttatttgcctatttttgtgcctattcgggcttttttgtgcctatttaatgcctttttaggtgcatatttcgcgattttttgtgcctaaaaatcgcatccctataaatatcttatgaaatttttatttcgtgtcaaaaaacttttttttttaaaaagatttcgtgtcaataaaaaattcgaaatatttgtgacacacatacattgcaaaattaatatattagatagataactaaaaatttgtcttttggtgaaaataataaataatggcaaaattttcttatatattgaaatttttaaagcgaagaaattttttaaagctgaaaactttttcgtaattaaattaatatcttatttacacattcgaaagccacaaaataaagaaaaatcattaaaaataacatttttatggatacattttgaaaatttctattttagagcatttttttggcatttcataggggtgtatttttcgttttttagcattttatgattacttaactttgattaatgcaaaaaatatttaacaaaatcgtaaaaaagccgaaaaattatatatttttaaattttgaagtatattgatgttaatcgaagaattttcgctctaaaaggctgtatttcggcgtgcatataacaggcaggaagtatacatatttaaaaaatattaataagttcctccccaataatggtcattttatgtgtgtgaataggtgaatcatataaatgtcgtcactaaaacagaataaataaattataatgcaattgattttggttggcataattcccaaatcattcaattcattcaatattttcaaaagaaatttatatttcttaagaaaatg

SEQ ID NO: 110474 - DNA, 1003 bp, Heterodera glycines
  Promoter: Source sequence=SeqID_1273; Location=4876..5878; Strand=+; Gene=SeqID_71243
ccttctgctgctcctctttcttctgcttgttcttccaacttccaattgcgttccaaaatgtttttcgttcttccaattcacttttattttcgattctgtcctttttattggctttccaaaattgtcttaatttaaataatttattgctaattaaatttaactaattaaatatattaattatcatttttggtggcctgaattatttgtgcgctttttgaacgctttgccaaatctgtggcagcaaaagttgcgctgtctttccatggcattttaatgtttttcaactgattttgctcgacgactcccaaaaacggcgtaattatctttgaaaattttctttaattttttcccatcctatataataaagttgagtgtctgtatgtatgtacggatttttgaatttgtgtggcgttttgttattattttgcgttaaaaaatgatttgaaaatgaaaatgtttttgttttgttttgcgttaaaaaagcatttgaaaaatgaaaatgtttgttttttttttgcgttaaaaaatgatttgaaaaatggaaatgtttgattttgatttttcagtttgttttgcaaaaaacattcttagtcatttattcgcttttttgtgtatgttaaatataacgccaaaatcgtccacacctccattcatcattttaattttttgtttttgtctttcattgtttaatttaaaggtttaatattgcttatttttttaaattcaaagtctgtttgtcgtaaaattttatggttatgtattggttagaaaaagtatttatttttgttgtatacacattatttcatatattactttaatttttgttttattttagaattgttaaacaattagagaattgtttttctgccgatacggctcattttttctaccagttttgtcaaaaatctggtgactaaacaatttatcgttgtttttctgccgctacggctcattttttctaccggttcggttttttcaaatctggtgccagcctgttgccatg

SEQ ID NO: 110475 - DNA, 724 bp, Heterodera glycines
  Promoter: Source sequence=SeqID_13548; Location=2789..3512; Strand=-; Gene=SeqID_77446
tgataaatcccctcttcaatgctcaatttttttacttatatttaagcgttgcgacgaatattttaataatttttaatgaaaagaaacaaaaaattatattattattttttaaatgattcctactcacattttaaatatttattattcaaaattatatttatagattttggaattaaatttgatttgatttactttttttgttgccgtaaatttgcgtgggctttggttttcattttaatagcatcatagcatgtttttaatgtttaatttcttcaattaaaataattaaattttaaatttaacatttccggggtttaaaacgaggaagtgcgttaaaaaaagcatcagacaaaaatgcgaaagtagcttttatgaccgtttaactctctcattccttcccattttttccatttgttggataaatattaattattattttcaatttttgtttctttttttaaacaaaaatatgattttttattattatttccattaatttccgtctgattgaatttccctctccaatcggttcacttttttgtcgattgatcagagcaacaatttcatttgtttttaaatttaaagtgcaattgacggtgggggggataaatgaatctaagaatacttccttcctcctcttctctttttcataaataaaatttaattttcaaattttaatttactttttatttaatttttgttaaatttgttttcagcagaaatg

SEQ ID NO: 110476 - DNA, 65 bp, Heterodera glycines
  Promoter: Source sequence=SeqID_2901; Location=2010..2074; Strand=-; Gene=SeqID_82271
ggtgggcatcaaaagagttcaaaatttggcaaccattttcaggcaagcgcggtgagcctgggatg

SEQ ID NO: 110477 - DNA, 133 bp, Heterodera glycines
  Promoter: Source sequence=SeqID_26398; Location=2192..2324; Strand=-; Gene=SeqID_57130
ccccccccccccaattaaaaaattaattattctttgttcctaataaaaaaaaccaagtttatattaaataaccccattaaaaattttaaaaaaattaatctaaaggaaaaacaggcgctgattgccaaggatg

SEQ ID NO: 110478 - DNA, 143 bp, Heterodera glycines
  Promoter: Source sequence=SeqID_18087; Location=2042..2184; Strand=-; Gene=SeqID_82673
tccttactgattagcttttagcaatcagtagaagttagcgctgctgataatttgtctaggcgacatttattagctcatccacgcgcacccactcagtttgtatctaggcgctgcaaacataagagtggtgaacgacaaaaatg

SEQ ID NO: 110479 - DNA, 156 bp, Heterodera glycines
  Promoter: Source sequence=SeqID_25296; Location=449..604; Strand=-; Gene=SeqID_56047
attaattagttttaattaaaaattaaattaaaatttgccatatttttataaagtgttttaattacaaaatttgcatttaaattcaatgaaaatttagaaaagaaattgttcaacgaaagtgctggtcactttaattcgcaagtgatcctcaccatg

SEQ ID NO: 110480 - DNA, 613 bp, Heterodera glycines
  Promoter: Source sequence=SeqID_28476; Location=1..613; Strand=+; Gene=SeqID_59092
gttattgctctaataaatttttttttctctgcggcatacaaaatataataattgaattttattatcataaattcacatttgataattaaataactaaacgtagccaataatgataatacattacttttactaaatttaatatttttattcatagcaaattaaaaactctctctctctctctctctctccgtgctgaaaaccgacaaaacaacgtgaattgacgtgtgcagactcaagaacgacgaaacgacgaacaaattggtggcatttgcagtgttgctgacgaagtaaatttatttgaattttgcctataaaaaatatataaaaataaaataaataaaacaaaaaataaaaaatctcttgtgactcattgggtacggtaattacagtatacaataaaagttggtaaattgaatttgtgagggttaaattgacgaaaacggacaaaacctcaaagggcaagatcaggaagaatcagtctgaaactcctgattatttagcaaggagattcaaagataagaccgagagtggtcgagaaagggaaataagacatttaaaaaggaagagaagtacaagtgtcgagcaaaaaagtaaagagggtgtaaacgaaatg

SEQ ID NO: 110481 - DNA, 1003 bp, Heterodera glycines
  misc_feature (46)..(46): n is a, c, g, or t
  Promoter: Source sequence=SeqID_4398; Location=6010..7012; Strand=-; Gene=SeqID_54311
atgataccaacaatcttggatttggatgccaaagaaaaaagttatnagcgaaaaacataaaaatttttgaaaatctgcccacaaataacacacaagcaccaaaaaatttaacattttctttcgaataaggacaattttaaaccaaaattttttccaagaaatgatatattttagggaatccttttttgggatattttgtttttttttgtttttttgctatatattaggtaacaaaaatgccgaaataggtatttcaatcagacatcgcttgtccttaatttaaatacacttttgtctttttagcacttacgccgaggcgggaaaaatcacgaaaagcgctatttgtgccgattggtccccctcgggttggttaaagcattttattcctaacggaaagtgattcattttcaggtgaattgcttttttgtgctatcagccgttccaacccaatttgtttcaatgtacaaaatcacatttatagtatttgccaaattccgaatttcattgtttagttgcaaaattccgagcatttgcggctatcagacccaaaatactcaaacatttgcacaataaaatcgtgctcttttgctggcgatcagtatttggtcacaggaagtgacgattggaatatttacgtgtggaaagtgccgagcaattggggttagtggggcatttcgaataaaaattaggcattttctatatctttgcaatgcttttcagacgatttcgccaatggcactgtcaatgttcactccgttttggagggccatcgctctattgtgaaccatgtgaagtacggaccacgcagcaatttgcttttgtcttgcggtgtcgagaaaatcattaaagtgaaaatccaaaaaagaatttatttataatttttgctcattgtcagtgttggagtgggctgcctttgcgtgactcgtaccaaaatccgaaaaaacgcgagcgcatttcgacgattcttcccgactttctcggtgatcccgaccacgggtcgatg

SEQ ID NO: 110482 - DNA, 195 bp, Heterodera glycines
  Promoter: Source sequence=SeqID_33350; Location=606..800; Strand=-; Gene=SeqID_63439
cgcggggagaaaaaaacccttaaaaaaaggcttaagcatcgtgcaacagaaaagaaagaaatccctgcaaagcaaaagggttggcttttgctttccctcccctccccctcaactcattaattagcattaattagactcatttccgtgtttaaattttaagacggaggggtcgtattaccatcgaagtggacaatg

SEQ ID NO: 110483 - DNA, 621 bp, Heterodera glycines
  Promoter: Source sequence=SeqID_13292; Location=2263..2883; Strand=-; Gene=SeqID_77132
actgagtgatccatcgaattgatcaccaaacgacgaacccgaagaagaagcttttgaaggaaaagccaaacgaaaagccaatgtcatgcgatggttaattaattcttaatttgttgcttaatctaaaaaaagtttaaagtctcacaataaaaatcatttcatgtgttgagaaatgaaaacgaaaaaagctaaaaataaataactattttttaatagacgccctccgtttatttcaaagcagtccaacgttcgttttatttattttcaatggaatttaaaaagtgtcaaatttcttttccattttctctctttttatttatttattttttatttttggattgacggattttttattctttggtcaaaagacagaaaataaaagcccaacagtgaaattaacggaaaacccaaagggatggatcagtgtatcgaattcacttttccattgtttgatcgatgctataaaatggacgtgtaaatgcttaaaaattaaaattattttaagtaatatttattaaaaacatttattttatattaatataaattattattttatattataaattttttacatttaataatgcctttatctttcagattttttattcaatcaaaaaaatg

SEQ ID NO: 110484 - DNA, 110 bp, Heterodera glycines; identical to SEQ ID NO: 98226
  Promoter: Source sequence=SeqID_30516; Location=261..370; Strand=+; Gene=SeqID_60925

SEQ ID NO: 110485 - DNA, 191 bp, Heterodera glycines
  Promoter: Source sequence=SeqID_11265; Location=1063..1253; Strand=+; Gene=SeqID_74634
gtgattttttcaaagaatatttactggtatctctcaaaagaaaaattttccaattttgtttggataaaaattttgtgtactttcactaatgacagttttatttacttattttttcatccctttccctttcaatgcgcagcgtaaaacctgatcaaaaattggcacatttgttccccgacaatttcggcatg

SEQ ID NO: 110486 - DNA, 190 bp, Heterodera glycines
  Promoter: Source sequence=SeqID_11326; Location=1286..1475; Strand=-; Gene=SeqID_74710
atggcacacaatccaaaaaaggaagagagagagtgcccggaactgctccgaaaaattttttaactttagaaattttcaagaaaaaaataacggcctggatcgtccggaaatattcaaattgcccaattcatcgctttattcattcattcttcggtcttaattaagcttcgaagtggacggacaagcaatg

SEQ ID NO: 110487 - DNA, 406 bp, Heterodera glycines
  misc_feature (35)..(35): n is a, c, g, or t
  Promoter: Source sequence=SeqID_1712; Location=1300..1705; Strand=-; Gene=SeqID_75466
gattttctcatatttggttttataatttttagttnggaattataatacttatttataatcattgtaaaaattactttattgtttaattatttttatatttcatattttaattatttatattttccatttaattttatttaaaattacactatcactaaaattcatttttttattgtcttaggttctatccagtttgacagcacacaatttttaacttatttgccaaatttttttttaatattttgggggttttgtcaattttttgtaaattaacacttttgttgttagcattttgagaattgttttgtgattatatgaaatctttttattcagtctacaaaaatttttttttgtttattttaaaatttaccaaaaatttttgcttttagggattattgtgaagatg

SEQ ID NO: 110488 - DNA, 660 bp, Heterodera glycines
  Promoter: Source sequence=SeqID_24634; Location=425..1084; Strand=+; Gene=SeqID_55371
agtgtgcttatttctaagatttgtgcttatttcagcattacgtgcttattttgggatttgaaaataaaaaaaatgcaaattttaatgaatgttttgaattatcgtcttttattgaagcgaatatttgaattactaattcgattttgaaaaaattcaaatttatttcgttttattgagtgtaaaatacccaaaatttcagagaaaatctgtaaaaaacagtcaaaatttctatttttcctccggcggcgcttttcggctccgcgggtccccaaaacttatttgttttcttaaaaattggctcaaaatctcaaaaattggtcattttctggcggaactctgttaacaaattgggcgctacttaaaaagagtattcttttgaaaatttcacttttttttggtcaaaaattttttttgttagttttgatacagaatttgttttttttaacagatggaacgaatgacaaaaaaaaacaacaaaaaaagtgaaagattttgaatttatcaaaaaatcatagagacccttttgttttgcaaaattttgtgaaataaaaaattgtgaatatatttttattcgcaaaattatgctcaatgcttaaatgtgtgtaaaagtcaaaaattctctaaaaaaagatcatttatattatttttagaccaaaaatg

SEQ ID NO: 110489 - DNA, 106 bp, Heterodera glycines
  Promoter: Source sequence=SeqID_4417; Location=3076..3181; Strand=-; Gene=SeqID_45800
agtcgtggaccaaggtcttaaatttgcaataatccgtttcaaatgatatttattcttttatgcattttgtcttgcttatttagttggtttggaagaggcatcgatg

SEQ ID NO: 110490 - DNA, 799 bp, Heterodera glycines
  Promoter: Source sequence=SeqID_234; Location=1..799; Strand=+; Gene =SeqID_79025
cggctaaaaacgtcttttatgatttttagcgcatttttaggtatacatattgagacaattcgggcaggacaagaaaagaatgaagttgatttctcatgaaactcggaattggttatgtttagtcgaaaatatgcttacatgatactcataaaaaatacaaataattcaacccacctattctatgaccacattctgaaaaaaatcccagaaatacgaggaaagatatgcttggtcacaataaaataaaaaatggctagtgtgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaatttgcggtcacaaataaaataaaaattggctaatatgtaaaattggcgtccagaaagacaacgacttggcaaaacgcattgacgagaatctttacgtcgataatattctaatcgaaatg

SEQ ID NO: 110491 - DNA, 1003 bp, Heterodera glycines
  Promoter: Source sequence=SeqID_10254; Location=782..1784; Strand=+; Gene=SeqID_73409
aatttaaatttaagagcaatgaagttggatatcaaaagcctttaagaatttaaataaatttcttccacatttattaattttctaaatcttattcatgaaattaaaaattaattagtgctgttttgattgagaatatacaaatttttccaataaaaattattcatcaactattttattccttctaattgtttttcataatttgtaaatttacttaaattttgtcaaataaataatcctttctgaatttggccaatttcttttcatgatcatataaattaccatttttattcgagaacttaaatttaaatttgagaaaaacaaagatatatttttgttataatgaaactaaattaataattcgatttaaattagtcaatataatcgaaaaaaataaaaatttggcctacttcttctcgtgatacatttatttatcattttattctcgaatttttccggttcttaacaaatattgaactataatgaatcattattttattgctttcgttcccctttaattcttttcgtttttggtgatgatttattcaatcaatttttccaacttttctcgcgcaacgcacaaaaatttctccatgaaataattcgtcccgtaaatctccaatttattttagtgaaaatagttttcacgctgaatctgccaaaaatgactaatcattttcaatttttttgtaattttaatttttatgcatttaaaatgcattaattgttatttgttttcttttaaattgatgctctaaaaaataaaaaaactatttaaaatttaaaaaatttgattaaatgatatatttttgttaaaatattattttttataaattaatagcaagaaaatgtctaatttattcgtaaattttacataaaataatattttttttaaaacaacattaacacgattttaattagagtttcaaaaatttccgtttaatctatgtttgtttgtaaaactactttttttatattgggaatttgtaatttcagttaaataatg

SEQ ID NO: 110492 - DNA, 120 bp, Heterodera glycines
  Promoter: Source sequence=SeqID_19645; Location=1..120; Strand=+; Gene=SeqID_84383
aaaaaaataaaaaatatagtttggcaagaaattttaaaataaacgtatatatttataaaaattaaattttggaacagaattacaataaaataattcagttaaggttaattaaattgtatg

SEQ ID NO: 110493 - DNA, 73 bp, Heterodera glycines
  Promoter: Source sequence=SeqID_40153; Location=580..652; Strand=+; Gene=SeqID_68577
ttttgcaaaaaaaaaaatattattgtaatattttaattttgggaatttcacacttatttttgaggaacaaatg

SEQ ID NO: 110494 - DNA, 348 bp, Heterodera glycines
  Promoter: Source sequence=SeqID_12509; Location=738..1085; Strand=-; Gene=SeqID_76156
aacttggtcattttccctatcgaattttaaattgggtgattccgacaaacagaaagcttattttttattgattttaacggacaataatattaaattcggccgataatgattttttttcttgtcggaaccacaatttctggaatgcaatttttcggaaactaaaacttgtttttctgaatttgtatccgttattcattttattttaaatttaaatcattgtctattcaattttttaatcttttttttgtcaaattatattcaatatatatttatttcgtttgttttttataagacttataattaactgacaaaagcaggttaataaatttctaattcaaaaaaaaaatg

SEQ ID NO: 110495 - DNA, 153 bp, Heterodera glycines
  Promoter: Source sequence=SeqID_15328; Location=2031..2183; Strand=-; Gene=SeqID_79569
aattattttttgttttgtttatttgtttgcaaaatgtaaaaacctaaagaaaacataaacacttaataattttaattattcaacagatttttgtttcaataccttcaaaactttttgttttattttaaattaattttcaggtttattattatg

SEQ ID NO: 110496 - DNA, 141 bp, Heterodera glycines
  misc_feature (75)..(75): n is a, c, g, or t
  Promoter: Source sequence=SeqID_18520; Location=2249..2389; Strand=-; Gene=SeqID_83144
ttttcatcgcaggttcttccaccgtccgagtttcaattcgttgtccaccgctcatcaaacattcgcttgtcgccncacctgttgggcctccaaatttggcacttccacccacccgttgagatggcacaccaccaacaaatg

SEQ ID NO: 110497 - DNA, 401 bp, Heterodera glycines
  Promoter: Source sequence=SeqID_29615; Location=743..1143; Strand=-; Gene=SeqID_60086
ctcaatacttttttttttctcaaaaattcttaaaatccggaaaaagatcctttttggtgtaaatctataaagaaattgcattattattattatttttttgtaagtcctttgtctttgtgggtcctttgtccgtgggtcctttgtcactgcaccggtgagacagagtttgaagaaatgggacggacataccaataaattaaaattgctttgttcatttaatatgttaaatttttttgtttaatttggaaattgggagcatttttaatacatggcacggcctacgcacggaaattaattgggttatcctttaaaaaagattttattttatatttttcagttgctaaatccgtccggttttccgtgcgcgcgttataagcatcttcgccaaattgttgctgatg

SEQ ID NO: 110498 - DNA, 102 bp, Heterodera glycines
  Promoter: Source sequence=SeqID_9106; Location=1581..1682; Strand=-; Gene=SeqID_70266
tttatgatggtgttccgtgccatccttccgtttcaacaaagtctgctcatcgctgccgtgctcgcttcagtgatcctctgtcgctgctgcagtgccgaaatg

SEQ ID NO: 110499 - DNA, 204 bp, Heterodera glycines
  Promoter: Source sequence=SeqID_228; Location=942..1145; Strand=+; Gene=SeqID_78605
atttcttgaacaaataaaggattaaattttgctaaaagggttggaaatttccgccttgacggatggatcgagactcaaaagaaagggcttgagatccatggctgcgtttggcacgcatgttcaaaatgttatccggatgataacgaaattttgccatgcggtaaaagtgcaggacggattcgggagaggaacaaacaaaggatg

SEQ ID NO: 110500 - DNA, 141 bp, Heterodera glycines
  Promoter: Source sequence=SeqID_6684; Location=698..838; Strand=-; Gene=SeqID_62473
ttttctttgattaaaaaaaaatcctgaaattattttattatcaccgcgaaaacattgatcactggcgtcgaaaatttatgagtgaatttggcattgtttgaatttaaattggcattcttttatatacggcacatagaaatg

SEQ ID NO: 110501 - DNA, 181 bp, Heterodera glycines
  Promoter: Source sequence=SeqID_13973; Location=1386..1566; Strand=-; Gene=SeqID_77931
ctgtacgcgtccatttgctgctgttggtgtgctgtgctgagcatctgtgcgtacacatgctcgtaaatgtgctgttgcaattccaagtgtttgtggtacaatcgcagttcgctttcgtcgcaactgttcgcgtttgtccgtatgctttgctcctgttggtcttccgttcgctgctccaatg

SEQ ID NO: 110502 - DNA, 919 bp, Heterodera glycines
  Promoter: Source sequence=SeqID_2136; Location=671..1589; Strand=-; Gene=SeqID_78032
tccctgactggggccccgttggcactaccttgtgcaattttttgtggggttctccacatcagtgaataatattttgaaataaatttctgtggcataaagtattgtaagaaaaagaaattccataacaacattgctctgaattccgaaccccggacctgaatttgaataccaaaaatatacaatttataaaaggaacataaggttcaattcttcaaaagcattatttggatactataaaaaaatataagaaatttttttttgtacatttttatttattaaaaataaagttttttctttaaaaaattttgagctttttttacgtaggtttagaccccttttttcattttttttaaacctgggtttgaatccataaaataagagttttcaacaaaagccttataatttttttaaaagaggccgacatgtggaagaattgaacctgagaaagaagtaacagaatcaaaaagtcgggtccgggtaccgagtccgggtcttgaaaaagccgggtatccgggtctggacccggtcgggtatccggacccgtgtaaccttattttatgcgaatatttttcggtttacgttcattacactttgccaaactgttattaaaattcgaaataatcacaaattcaaaaatattggggggtcgttgtggtaccctagttcaaaaacgggaaccaaaatataaaaaatttatcttccaaaatttgacatatttgatagctgttttagatataatataatttaattatattaatatatgtaattgatgcatcatattatgatacaaatgactaaatgtggttaataattgatcgaataatctagccatatgaaaaaatgaataattacaaaattcatttataaaatattattgttataaatcttttcattttatttttacaaaaaaaaaataatg

SEQ ID NO: 110503 - DNA, 1003 bp, Heterodera glycines
  Promoter: Source sequence=SeqID_20494; Location=1577..2579; Strand=-; Gene=SeqID_51034
ttaaattaatggaaaattgaaacgatttttgtttccccccccccttccgtcatcctcctcttctcataatcatcatcattttcattttttattctcatctcccccagcccctcccaataagccaaatgcgaagggtaaatgcgatgatttggaattattacaataaatgctttagtgggtattggtctcacaattgctgacagatgacgggggaggggggaggggatggatttaagcgaaaaatgctaataaaagcaaaaacactggtgggggaacagcagcagtatttgtgaagagcacatttctttttattaggcaaattacgaaaaaattttatcaacaaaaattgtaggtgtttttcaaaaaaaaaatttccctgcgccgctaatcggcggcacctccgtccctcttctttgtaacctaattttttaaagcatatctcaaatttattaaacgttgatcataaattctagggtcaaaaaaggacgaaataatcaaatcttggtcattcaatcacgaaaacgaaagaattcgaagaaaaaaaataataaaaatcatatttacccaaaaatcccgaattatttagggagcctaaaacaaacaaaaaaatataaatttctcaagtgtaaaaactatacaaataccaaaaatggtaatttttattcaaaatttttgtgtttttcggcggaatgaattttttcaaaactttttgtttccgctgctcattttactcatttcacagcatttgtactttttttgcgtacctccgggaaaatttttttgaaaatttgagtgtaatttgttaatggattttgtccgaaattgatcaaattttaacacttttatgattgtttttggaatcaaaaacggattttgattaaatttcgaaaccaaagttttctgattcgattttgacttttggtatttgagcaatttttacaaatttattttgactaatattttttttattttcctttttttacagtcaatttccaataaaatg

SEQ ID NO: 110504 - DNA, 53 bp, Heterodera glycines
  Promoter: Source sequence=SeqID_10389; Location=1118..1170; Strand=+; Gene=SeqID_73577
ggttaatttaaaaaccttttacatacaaattctttaaattcagacgaaagatg

SEQ ID NO: 110505 - DNA, 373 bp, Heterodera glycines
  Promoter: Source sequence=SeqID_2791; Location=1..373; Strand=+; Gene= SeqID_81621
tgatactttttttctttttttcggcattttattttgacttttgaaaatattataaataaaattttttacttagggtggaacataattttgatacccaaattttttccaatttttaaaaatcataactccgttatttctgcgcctatttaaatgattctttttttattttgttcttcatggtttcctcttttatatcttactatcgtttcactttttatttgattgatagatttttctgccttttttcccgaccatgccaaaattgaaaattggcccactaatttttctcgaattttttatggtcaaaaaccaaagctgatataataaaatcttggtttttctatacaatttagaccagtagaatccgaatatg

SEQ ID NO: 110506 - DNA, 422 bp, Heterodera glycines
  Promoter: Source sequence=SeqID_35456; Location=1..422; Strand=+; Gene=SeqID_64999
aaaagaataattatttatctttgttgtcttataactttttaaaacaacagttaagcgatgatagtgaacataggaatcgatgtagaatatttttctctatcggtatgttaaatttggtgtggatttaacgtgcaggaaaaaagttaaacgtcacgaagtaaatgttgctctttacagcttttttttcttttttaccgtccatggtgcagggactttccccaatcaaagacgcttccaattaacgatcatcctcagtttaccataattttccatactaagtcgaacatacgttcttggcataaaccaaaagattaaagtttaggaaatttgtaaatacaaagaaatgagcaaacaatgatttaattaaaagtttaacaaataaatgatttttaacgtttttcaaacaagcaaattaaaaaatg

SEQ ID NO: 110507 - DNA, 1003 bp, Heterodera glycines
  Promoter: Source sequence=SeqID_5160; Location=574..1576; Strand=-; Gene=SeqID_57110
aaaaaatgcgtttttaaagcagaaaaaagtcgtcgcaaatgaggaaaatgatcagccgaaacaaaaaaaggttggaaaaatccattccgatgacaaatacaagccattaaataaatattaactatttttcattgtatataataaaaaattttaaatgtccttgggtttcatgaatttttcccattatgtccttgcaaatcggcaacccgtccttgaaaacggagcatggacgatggcagccctgggtaaatctttagtaaatgaagttaagataatgaaaaatgaatgagagtcgtggtggttggttgggttcgtctgtgaagatgagtgagtgaaagtgctgggggtgttcccattaaataatggactttgtactccttttttattgctgatcgagtgagaaaaaatttgagagaaaaatttaaatttccgctaaattttgcactaaaattaagtttgaaaaataattggcattattaatttgcatgaaaagagtcactctcccattcactctttttaaatcgcttgttgacaatttgcattcattcatatttctctaattttcgcataaaatggtccgtccaaattattgaatttttttttgatatctttttgatatatgttttattatgttttatatttcatagaagcatatgttattaaaaataaaattataaaaaattttgctaaaagaagaaaaaagaataataattttttttttgagaaaaattttccttcataatttttgtttaatatttgcttaatgggaaaaattttacttaaaatttcaattttctataaggctggacattttttctaaaaaatctgacctagatttcataatttgtttaagcatgtatgtcttggaccaaatccaagcattgctattttttccaattttttttttcaaattaatcactacttccattttttcttttaaaacttttgttcagcaatttgttaaacaactttttgagcaataatatcaaatcatatttgaatg

SEQ ID NO: 110508 - DNA, 577 bp, Heterodera glycines
  Promoter: Source sequence=SeqID_1461; Location=1..577; Strand=+; Gene= SeqID_73668
tgaaaagctcaggtcccggtcccggtcccggtagggcaaccgggaaccgggaaaaacaagcactggtaagaatgggggtctgagtgcaaaaattagtgagaaaattggagttaaaggaaaaaatttagaaataataattaaatatattcataaagtagcaagaccaaaaatttatgtgaaacttaaatctgaatttctaataatattcgatcacttagtccaaaaatgattaattgtttgaaagaaatgaagaaaatttgatttgaaaattttcattaatttattagctttaacttttgggttttattaaataaaaaactaaataaaaatttaattatttaatattttcacttgaaataaattaaaattggtaaaaacccaactcgttttttgccaactcgttttttacccaactcgtttttgacccaactcgtttttattaccccaactcgtttttattatcccaactcgtttttttgactggaaaatggaaaaaccaaagaaaacgtttaaatttttaaaaatttttagttctaaggtaatttttatttatttacagactaatttacataaaatg

SEQ ID NO: 110509 - DNA, 131 bp, Heterodera glycines
  Promoter: Source sequence=SeqID_10221; Location=2705..2835; Strand=-; Gene=SeqID_73363
tgaagtattggtcagctaaacaaaaaaaataacaaaataaaaaaggcatttgatgaccggctatgaaaacttcgaacaaaatttcgcctttcacttctgccatatcgccacagtacaaatagaaaagaatg

SEQ ID NO: 110510 - DNA, 305 bp, Heterodera glycines
  Promoter: Source sequence=SeqID_32246; Location=588..892; Strand=+; Gene=SeqID_62569
agaaagtgatcaaaagggaggagggaagtgagaatgatcagaccaaatgagaaagtgatcaaaagggaggaggagaaggcgtcagagcggacgtaacgcgtcgcgagaggggcaaaagtgcggcgggggaggacgcgcaaagagaggcggaagtgagaaaaacagtggttaccgagctggcggcgaagttcgccacgcaaggcgcatggcctgcgggaagaaagcgcgaattccctgccaaaattttccgacccacgccaattgtgccgacatcgaaataccgacacagtgtggcggacggaatg

SEQ ID NO: 110511 - DNA, 1003 bp, Heterodera glycines
  Promoter: Source sequence=SeqID_1148; Location=4040..5042; Strand=-; Gene=SeqID_68691
tcttctttgtctccctttggccaatttttgttcacatctgcaaatcgtttttttcccatttttctatggtacttctgtcgcccgccccctctgtgtctgtttacttaagcctggggctcccccccccccacatacacacactttatataatcactgctcctcttctccccaatttttccatcttcaatgccgattgcattaaccccctcggccctttcctctcgtgtcaaataaattgttgttggtcgatgtgttggtgggatcagggacggtagagacgggaggaacacacccccctctcgtcactcacaccgcgagaacggcattccgtctgcccccccccctctcctctcgcctcgccactctctcgccttcagcgtcgccgcccagtgtggcgagtcttgtcgtcctcttcaattgacccaatccctcccccagtttgtccccccttcctcgacaaactttttggtgccacgacccgggaccacgaacccttcgcccttcaattcactttcgaccatccatcactcttctctctgccgccagccgaccctttaggctcccggcaactcaacccttcgctgtccgccgaccatcttaggcctccggcactcatcactcaaatcaagtcgccagccgcccttttaggctcccgacaaaccctcaccgagtcgtcagccgcccatttcaggctttcgaccattcatcactcttctcccagccgccagccgccctttcaggctcccggctttcatcactcaactctttgccgccagcccccctttaggcttccgacaagccctcaattgagtcgtcagccgtcctcttaaaccgaccctttaggctcccggctttcaccactcaactcttatcgtcagccgtccctctcgggctctcggctaatctccactcaacccaccaaccgacagccgccttctctaggctctcgaccaaccaagcccgactcttgcgtccagccgccaatcctagactttcggaaatg

SEQ ID NO: 110512 - DNA, 301 bp, Heterodera glycines
  Promoter: Source sequence=SeqID_32484; Location=798..1098; Strand=-; Gene=SeqID_62790
ttggttatgaattaatcacttttaatatgtcattttcttgtaaattttgattaaaatttaaaatcttttcaaaatccaaaatagaattatataatttttttaaactttatttatttccccctttttcgtgtccgttgttctgcatctgttcgaactgagcctctcagcacttggcattctgcccgtttacattgaaaaaccattggcactggtcattgaaggcgcgccaatagactcgccagacgttcaatggcaatttgaattgttaacaaaaatattacgccaaatggatgccaaaatg

SEQ ID NO: 110513 - DNA, 53 bp, Heterodera glycines
  Promoter: Source sequence=SeqID_6809; Location=1352..1404; Strand=-; Gene=SeqID_62961
tgtaagttctggccattggcttctggtgtatttccgtccgttccctcaaaatg

SEQ ID NO: 110514 - DNA, 403 bp, Heterodera glycines
  Promoter: Source sequence=SeqID_38600; Location=1298..1700; Strand=-; Gene=SeqID_67368
agtaagacaaaaacatattatatttttttattaatatacataaattgaataattttttttgtcatctaataaagctaaattacggttgatcaatttttgcctagtgatcaatacataaaaaatgtgattaggcttttgggaacatttgaacaaagcttaattaggttaattacggtcggtctagtcaaagtgacaattcaaaggttaactgttttcgatatttttttttggtgatcaattgggtaatctatggattctgaaacaaaaactcaatgaaatttgatccttaattaatcaattaattaattacccaaaaagttaaggatcgatttctcgagttttagagacaaaaattaattgcagcaatttatagtccttatcgacgaggaaggcactggcgatg

SEQ ID NO: 110515 - DNA, 317 bp, Heterodera glycines
  Promoter: Source sequence=SeqID_8369; Location=3335..3651; Strand=-; Gene=SeqID_67825
aacgaagtgaaggggaacggatggacgaaggactcacaaacatttgactcaatttttgaccgttcaatgaatgatctgatctgccctctgttcaactgatcttttcttttgcctcccatttgtttgttccgttctctgttttttgctttgtgcgatcacttacccattttttgttcacttttctatttattaattgaaaaaggcacgagttttctcttccgtcgttttgaccttatgactttccaaatgtttggtctgtcatcaaatggctcattttcatttttcccaccccattacttttcccaattaaaaacatg

SEQ ID NO: 110516 - DNA, 258 bp, Heterodera glycines
  Promoter: Source sequence=SeqID_3802; Location=1812..2069; Strand=+; Gene=SeqID_51932
tcctgaacacattgacaacaagaattgattgaaaaaaagaaaagcgcaaaacaaaaagcaaaatcaaaaactcactattcccgcgctaacgccctttttcggatgcggaaggcccaccggcgtggtcttaaagtgggggcaaataaataaatgcaaattatggaaaagcgctgtgctcactgcggttgatttgagtggtttggtcgggcccggaggacgcgaaggacggacgacagccttaaaaacagaaaaaagatg

SEQ ID NO: 110517 - DNA, 1003 bp, Heterodera glycines
  Promoter: Source sequence=SeqID_2617; Location=2858..3860; Strand=-; Gene=SeqID_80739
tacaacagtgatcagaagaggtacaactgtgattaaaagaggtacaaatttgatgaagaggtacaaaagtgattaaaaagctacaacggtgattaaaagaggtacaaatttgatgaagaggtacaaaagtgattaaaaaaggtacaacggtgattaaaagaggtacaacagtgattaaaagaggtacaaaagtctaactttttatgagatgtacaaaaataatttcaaaattttaaatataattttatagaattaggtttatttaaaaatttaaaaaaaactaaataataaaaaatgtaaaagtttattttttaattaataaacggaataatttattttactttattttgaaaggaattattatgcatccaaatttttaaatctaattttgcttaaaaataaatctattcatcaaaagaaaaattaaatttaattaaaattattttgttattaataaaaacaaaaaataatttttttaatttaaaaaaaaataaatttaaataaattaaaacgaatcttcaaattaattaaaaacagtgaaaataacccaaaaatgcatagaaaaataatgtacaccgtccgggtccgaacctcatcaaaaaaaaaataatttaaatataattttttatttattaactcaacaaaatattttaaattaattaaaaaacaaaaataaaattaaattaattaataacatcgaaaaaactaaaaaataaatcaaaaaataataaacacggcccggatccgaacctgccgccccacccctcagaatccccaatctttttgacttattagaagaggtacaacagtgattagtaaattcattaaataaaaatgaaaaattttttaacaaatttaatttaaaaaaaaattaatttaaacttataaaatttattcatcaaaaaaaaattaatttaaatttaattttttatttattaacttaacaaaatattttaaattaattaaaatcattaataaaacaatattaaatacccaaaaaatg

SEQ ID NO: 110518 - DNA, 703 bp, Heterodera glycines
  Promoter: Source sequence=SeqID_25060; Location=1201..1903; Strand=-; Gene=SeqID_55791
ttagaacctatttttaggacgacggttcaaaactcgaaaaattgagagatttggcactctaacctttttttaaacgatcgaatcatgaaaaatttggtatcatccaaaagctcttcttgacgtgctaggtctaaaaagcagtgaataaattttcctgtatgttttaaacatactgtttattaatattcatactttggtatggaaatggcccaaatgccttagtagggaatttggcgatagggaatcggccggtaggaattggctggtagggaattggcggtagggaactggctcgatcccaaatcaaagtgccgaagccgacaacttacaattgtttattgaccaacatttccttaagcacaagctttcgcgtataaacggaaatgcaattttcagctttaaaattttatggaatttgaatttaatttgtcaaacaaactacttggcttagaatttcttgtaaatagtatcctagtttctaattgcagtccaaaaacatattcacagaattctgtagaatcagaattaaacattcctattttggtctttttgccaacttattttccaccacaagcgcatcttgcacatccgagtgattaattcgttgttactaaatggagagtgaagatattttttattatgcaaaagtcattattatcttactgactgctttgtgattaaagatttgaaaattttgaaaatg

SEQ ID NO: 110519 - DNA, 323 bp, Heterodera glycines
  Promoter: Source sequence=SeqID_5016; Location=615..937; Strand=-; Gene=SeqID_56578
tttaaccctctaattcggcactttttcagatttggcaagatcattggtcccacgagacgctttcccaaattgccgctctctctctacaacaaaatggtgctgctgatcggtccgatcagtcgtcctcgtggcttttgtccgcctttgtccaactttttcacttggcaccagcggagagtcaatgcccagccaaatttgctcattttgtcgacactttccacgctttgatcagttccaaacggacggccgtggagggtcggctggcgcggctaagggcgggcgtcgaccgattgacggagacgcgaaatgcggtggcaaaaatg

SEQ ID NO: 110520 - DNA, 306 bp, Heterodera glycines
  Promoter: Source sequence=SeqID_15725; Location=3237..3542; Strand=-; Gene=SeqID_80048
tttggaacaaatacctatatattttatctcttcattttttaaatatttttcgtcttatatatatattttttgttactgatcaatgcctacctacatacattcttggaatcaaacgaaagttgaattatcacgtttatcgaatatccggggcctatttcaattcccgtcgtatctccgatatgatgtcatatctccgatacgacatcgcatcgtgtaattctgtttcaataaaaaacatgcgatgtcgtatatttctgtttcaattcatcgtcccgatgtcgtatatacgatcatcgtaacatcatg

SEQ ID NO: 110521 - DNA, 71 bp, Heterodera glycines
  misc_feature (8)..(8): n is a, c, g, or t
  Promoter: Source sequence=SeqID_43742; Location=1432..1502; Strand=-; Gene=SeqID_71348
tgccttgntcatttattatttttattttcatttgttttttccgtgtttttcctttttggtttttctaaatg

SEQ ID NO: 110522 - DNA, 65 bp, Heterodera glycines
  Promoter: Source sequence=SeqID_31841; Location=1142..1206; Strand=+; Gene=SeqID_62148
tctcaaaaaattgtttaaaaaattctgtgtcattctctccatcaagtgcgacccaccttcaaatg

SEQ ID NO: 110523 - DNA, 144 bp, Heterodera glycines
  Promoter: Source sequence=SeqID_29038; Location=647..790; Strand=-; Gene=SeqID_59606
tattggacataaatacagaaacagaaaaacaaaaagaaaaaagtgcggaaatttcaaaagatacagaattaaataaaaatgccgaaaaatcgaaaaaaatgatccaaattttgctgaaccaaaatcatatcaaatttagtcatg

SEQ ID NO: 110524 - DNA, 566 bp, Heterodera glycines
  Promoter: Source sequence=SeqID_39567; Location=1..566; Strand=+; Gene=SeqID_68109
aaatcagaaccattacacaattaaaactgttcaaaaatgttaaggcaacgtcaaactcataaattcgaacaaatgcgtaaataccgataatttgtttgccgagaaaaggaaccccggcaccggcggtttgaaatgttatgacgagatcaagcaccaatcttatgactgctcctgtcacggtgataagaaatgccttgctgaagaaaaatgggcgcacgacgcctttctttgtccaataataaaggtaattaattaatttattattaattaatgccaaaagacaccgccacagacaaattcatataatataggaaatttaatttttaagtagagtgaagcgggaccgggacctggtagcggacaactgagtaccaaggtttcggttttgacatggacctggactagtcccggttttcccagccaaaaattaacggtttttcaactcgaaaaggtcccggtccggttttacccaaattcccggttccgcttaactctattttttttgtatcaaaaaaccggaaataataaaaaaatagggacgataaactggaataaggataaatatg

SEQ ID NO: 110525 - DNA, 140 bp, Heterodera glycines
  Promoter: Source sequence=SeqID_10510; Location=666..805; Strand=-; Gene=SeqID_73737
acaaataattgtattattatttttaattataacaacataaaattgaaaaaaataattgaattaaaaatcgaaaaaaataattttaaagaataatgaacatctatcaaatttctttcaggtggatcgcaaataagtttatg

SEQ ID NO: 110526 - DNA, 94 bp, Heterodera glycines
  Promoter: Source sequence=SeqID_8525; Location=2506..2599; Strand=-; Gene=SeqID_68395
cattgctgagcggacaaacttgggctttgtcaaacgacaagtgaccgctgcagtacagaagcggaagggaaacgtcagcgagcggaacgcaatg

SEQ ID NO: 110527 - DNA, 519 bp, Heterodera glycines
  misc_feature (29)..(29): n is a, c, g, or t
  Promoter: Source sequence=SeqID_45265; Location=1..519; Strand=+; Gene=SeqID_72595
atctttttttgtcatttttcattattttnagaacatttttgggaaaaggagtgactatttacacgttttttacagcgcgattttttcaaaaactttttgggaacttggaggagggtacagcggtgccgataggcgccgccgggaaaatttcacaaattttgaatgaaatttgcgatgaaaaatgagttaactttaattaaatttattattaaatttatttaaaaatatttggcattctgtcttagaaaaatcttcaaaaaatcaataaaatcccgcataatcccgcacaaaaaatcaaatttgcggatcccgctgcgggattggaactcaaaattctttgcgggacgggatcccgcgggattaatcccgcaaatcccgcatttcccaaaaaatacgggattgcggactgggatcccgcaaaatcccgcgcgggatcccgtcccgcgccggtctctagaagagacaaagccacaaaaaaagtcacaaaatgccaaaagtttaaaaagttcgagtgccatg

SEQ ID NO: 110528 - DNA, 1003 bp, Heterodera glycines
  Promoter: Source sequence=SeqID_11752; Location=47..1049; Strand=+; Gene=SeqID_75246
tcagcatctatatacctattgaatataacattctaatcataacaaattttaattacttaacctaatactctattagaataactaggtgtgtaaaaaaaccgcaaaaaaaaatatatttatatattctatttgtttttattgtgatgcttttcaacaaaggaaaaaaaagataaagcagaataataatacaatttttaaagttatttttaatatttaaacaaagaattaaggtttaaatcctttttaattttagccatcccagaattgatcaaaaatatggagtatagcattcaatagtcacgctttacgcacctgaggcagaggcaactgctcaaaatttgaatatataaatcttaataagaattatattttatattaaaagatagattgttgtagatattgttatttaaatatattttatataaattatagttaaatagcaagagaaaataaaaaacttttctgttggtttatttaaaataaaaattcatataaaattaaaaatataaaatttcaatcaattatatttgcaattctcctttaaagaaattaaataaaataaattaaaaatttgttcattataaatagggctcacatttataggcactaaaaaccgccaaaataggtaggctttaggctataaaaaaacccccaaaataggcactaaaaaatggaaaataggcactaaaaaaactcatttttaggtgtgtgaaatgacaaaaaattattcaaaaaagtaaaaaaattaggccaagacagtattgagattaatagttttttaaagcataaattcttgtcaagaaaataaataaatacattttggagatgaatttttggaaaatttttcatttcttagggagtttattttttaaatgattataaaacaaaatagtattaagaaaatcttttcttttttgagtaagaaaaagtaaaatatataaacccggaaataaatttttaaataaactcatatagtaaataaattcagcagattataaccatg

SEQ ID NO: 110529 - DNA, 278 bp, Heterodera glycines
  misc_feature (21)..(21): n is a, c, g, or t
  Promoter: Source sequence=SeqID_42293; Location=1..278; Strand=+; Gene=SeqID_70218
aattcatttattataaatttntggaaaaacattaatttatctatatataagaaataaataaaaactaaaaagcattaaaaaagcttttaataaaggcacgtttcttactaagttagaatttagaaaaaaatatattaaaaacaaaatttcatcaatatcgtaatactttttggttaatatataataattattatcaaataaataaaatatttctaagtttcttaattttagcttttccaaaatttcgacacacaaagaagcaaattttgttaaaaatg

SEQ ID NO: 110530 - DNA, 683 bp, Heterodera glycines
  Promoter: Source sequence=SeqID_6644; Location=927..1609; Strand=-; Gene=SeqID_62312
ttgcgccacggagtcggcagatgaatggccagagaaaagatagacaaagagatttttaagggaacggaaggaaaagaaatggaaaaagagagtaacgaaattggaaaatatatggccaatgtgtaaaaatgatgagaaatttatagtttttttgaatgcagcttttttatacaaatttaatgagccattttggaagcgcttttaaaagaaaaagaaaaaaaaattaattttattggtgaccaacaggcgccgccggagaaatttgaggatttttgccaaatttgctaacagattttgagctaaataggccaattttgtgggttttttggttctagtcggttttatgcgtcccatgaatgatcatgccagtttcttaggccataacttttttcttacttggtcaatacctatattcttgatattgaacaaaagcttaaggtctatagaagcttttgtataactttatttttagctaaaggcaatagacaaaaaattatactcggaaaagttgaatttcgtattttttcattgtaatttcttttttaatgccagcatttgcttttttcttgcatttataaaatctcgagacttttgtctttcgcttggtaccaagaatatgggtattgaccagagtaagaaaaaagtggtactaatggcttacctgttccacatttgcctcaatg

SEQ ID NO: 110531 - DNA, 100 bp, Heterodera glycines
  Promoter: Source sequence=SeqID_14684; Location=1..100; Strand=+; Gene=SeqID_78795
cttccgagggtttaacccaggtattgcattttttttctctattgaatttttcattaagacatacaacaacaatgccgtgtttgctgaaaagagcaaaatg

SEQ ID NO: 110532 - DNA, 598 bp, Heterodera glycines
  misc_feature (104)..(104): n is a, c, g, or t
  Promoter: Source sequence=SeqID_35771; Location=428..1025; Strand=-; Gene=SeqID_65247
cgtgaattttgatttgactaaaatataaaattaaaaaaagaaaaactgcacaaaaaaaagaaaaagaaattaataaactcaattatctatcactttcaatattngaaggacaatcaattgaattattaattttggatttattgtcactttttcccctaagggcaaaaatatacaaaaaaataatgatgggaatgacatgagaatgaatgtgcagaagcagtgtaatgggtgagaatttattcattaaatatgtagcatttgttgacaataaaaaaaatatgagatagtcaaattgaaacataaataattatgtaattaaattaattttcattggccccacggggcgccatttggacaaaaagaaaagggaaaaaaggggggaaataatggaaacaaaaattaaacacgcgttattttttatcaatggtggaaaaaagttgttttattccaaaatgattaaatgatttttcgataggaaaaagcacttaaaaatttcaaaacaacttacccttttcaatatctcaaattttttctcgataaattttactaaattttgcatgacacatcggtttactttcagttgggcctaatgaaaatg

SEQ ID NO: 110533 - DNA, 558 bp, Heterodera glycines
  Promoter: Source sequence=SeqID_17022; Location=545..1102; Strand=+; Gene=SeqID_81442
taacggtgactttaaaataagagaagaggtggttaataaattacaaattaaatatgaattaattgacagaggaggaaggctctttttaatttcacaaaagcatcggacagattttctcttttaagctttagtcttataaggcgtcccataaaacgcccttagcaaccaattagttgtgattattgtctgttaaagaaggtcaccgatcaatggcaccaaaagaaattattactggaaaagagtattctcataaccaatggataggatcaatagattatgaagtataattaaactcaacagacaataattggcttttgttctttgatttgcacaacagtcataatttatcaaaatataaaaaatccttctcacaatcagacacaaagcaatcgatggattaggtgaaaagttcgtagtctcttctgataagaaattctcctcttaaagaaatggctgctgaactgattgtctgtcatctcaaaatcacgcgatcactttgacgatgtaaaacgcattattgccctgcctttttatcgagtattcctatgacggaaaatg

SEQ ID NO: 110534 - DNA, 1003 bp, Heterodera glycines
  Promoter: Source sequence=SeqID_1386; Location=127..1129; Strand=+; Gene=SeqID_46838
gttacttgatgaatatcttagacaaaatgaaggttcttgaaaaatcagagctcatatttggcattttatttttcgaattcgctacaaaaaaaataaataaatgtaagtacacgcgattcaaattggcagttggcactattggttggtccattactcatgggtcaagcccagtgttagacaaaactcatttcgccaaaattataaatggcgtaattttttgcgagctaattcaaaattcacacgggtaaataaataccttttttcttttttaatgaaaatgcctaggcttgagtcccattagttcatgccattgtttgctgcatatacctttcagtgcatcaatgtttttcatgataatttctatggagttctttcgcaaaacaatgacacttttggaatataaaaaatagtgacaaatgactcctggtaacagtaacggcttttctgtgcgcagctccgtatcattaatcttaccctttggcaaaaattatgaaacgattatttcaaaatgccactcacaatgtttcggctgacggcatataaataaaatatttaaaagagcaacacgaaaacttgccgtgacactgcaattaatttttttgatttttcatttgatcatatgaaaataagtactatttactgtcataacttatgttaaatttgataaattagtttgaacttttgcaagctaatagagaaaaattctggctattttatgctactaagaatgcaaaatatgattgcctttaagcaaagttatgccatatgctttgtcgaaaaaattgccaggttttgcgcaccttatgaaagaatataaaagtagtttctttctccttattttctcataatcataatgtcctcaattattaatttcataagaagtttttttggcgtttttttgggccggcgcgccccccgccccgtcaattgggagcggcatcggcccttgtgcaaggagacggctgtcaagcggcttcctggttccaactgattttcaggcatg

SEQ ID NO: 110535 - DNA, 1003 bp, Heterodera glycines
  Promoter: Source sequence=SeqID_15550; Location=713..1715; Strand=+; Gene=SeqID_79833
gagccaattctctgctaataactttatttttacatttttttgattcatttaaaattaaaatttttgaaaattttctttatttttaagcacatcagaacttttcccctcccaatctttgctttttctcttccgttagcatcgtaaaccattcccattttccgcttaatacccttacccaagtcaataatttcaattgaaaaaagtaagtacaccaaccgccagcggcgccttttgcctcgggccaaatgattggggggaattagcggtgcaaaggccccgaggggtaattttgatgatgccaaaggacaacacccaccggaaaaggaaaagccaaaagccatttttggcatcttagaggcaagcaaagccactgggaaagctcattcgcgtcagcagttgtttttggcaaatttaattgccgggacaaaaaaataaacaaagcttcttcggggcacagtttttgctttgatcagtccgtcgccggaggcacaaaaagcggtggcggatgggcgatgctttttatgtgctaatcggcagcggaatgtgtggtgttcttctcacccattgtcagcaacgacattcgccgcccgcccatccgccgccaccgccgaatcatcggccgtcaaaccgtccgtccgccgtccgtcactttcaaacgccacgtttcgctatttattataaaaatcgatcaatcatcggcccatttgtcctcatttttcacccgttggccaaatgttttttttgtacaaaagtaaaagcgttttttttttgaaaatgtttccgaaggccaaacaattttgaagcgtcgcgcagtcctcaaattaaattttgataaaaaatttttttttaaattaattatttttatttaaatcattaaaaatggaattcttttcgttgagattgtgccaacggtgtctattgtttgtctctttgcattaattattgttttgttgccctccatttgcttgctaattgcctctcctccatccttcacttgcaaatg

SEQ ID NO: 110536 - DNA, 426 bp, Heterodera glycines
  Promoter: Source sequence=SeqID_17495; Location=2033..2458; Strand=-; Gene=SeqID_82000
agcaaagaatttgtgacccaagattaccatcgacaactgctcaatggctggcaagatgctgaagtcttacaaactttgaattctatttttatttttatgaaatttaaattaaaaatgtgtcagagtgtcctcaacgcatccttttggccatttagccacaaaaaatgggcctgccaattcaaatccgtccattccatttttgccggcttagcaatgaaactgtttgcgaggccacaaagtgcaaattatagaataattaaattaaatttaaatctaattttattcaaatgtaagaaaaaacattttttttgattgatgagacgaaaaaattattaaataatttaaatttaatagttttaaatgttttaaaaaaattttgaaatttccccagaaattttgccaattttacactgactctgttcaatg

SEQ ID NO: 110537 - DNA, 165 bp, Heterodera glycines
  Promoter: Source sequence=SeqID_36738; Location=856..1020; Strand=-; Gene=SeqID_65986
tttctgtttgtgtacaccgcattttctggccagaatttcattgcgaatcatttagcagcaaaaattttattcattcctgtgattggacttggtatttgcatgtagaaaattattaaataaatattttaaatacatttaaattcaggggcaatttttccggcaatg

SEQ ID NO: 110538 - DNA, 234 bp, Heterodera glycines
  Promoter: Source sequence=SeqID_183; Location=721..954; Strand=-; Gene=SeqID_76518
aattttaagttaaaaattatttatacacaaataaataaaaataattctctcccgttttcttccaattgtctttgagtttcaaaccaattctacatcttttatgatttttttaaagttaattttaaatgaatgtgaaggaattttgtacttattaaaataatttttttagtcaccataattaataatcttcacttcgttctttttacttaaaaaaatatttctcagcataaaatg

SEQ ID NO: 110539 - DNA, 472 bp, Heterodera glycines
  Promoter: Source sequence=SeqID_11070; Location=605..1076; Strand=+; Gene=SeqID_74407
ggtaaatccaaaaaataaaataaaattattattattaatttaatttatgtgataagccggcgaattaaaatattcatctgtataagattttttttttttgaatttttagcatagtcctaccaattttggcgtttttcatcctattttgccatttttctcaagattttggttccttattttggcatttttctcaagattttggttccttattttggcatttttctcaagattttggttccctattttggcattttttgcccctataacctgatccttagtaatatttatttaaaaaaatgtatgccatatagacgagcaagtccaaaaataaaatttcaaatgaaattcagaaaattgtgagactacagcgggcgatggtgacagtccccgcctctcactgtcaattgatcagctgtcagcacgttcccgatccggcagccaagcgtcgggaagccaatcgcctaacaaaatg

SEQ ID NO: 110540 - DNA, 79 bp, Heterodera glycines
  Promoter: Source sequence=SeqID_14923; Location=259..337; Strand=+; Gene=SeqID_79087
ggtagggcaaacatttcgagtttaataatcaaatagctgctatttagggtacaagggcgacattggccgagtctacatg

SEQ ID NO: 110541 - DNA, 330 bp, Heterodera glycines
  Promoter: Source sequence=SeqID_23116; Location=713..1042; Strand=-; Gene=SeqID_53822
tttctgcgtccatcatttgatggccatcactcggaggagcgccctctaatcaaaagggaaagtggcaaactcacgacaaataactgtaataataataccaattactgtaatgaaggcaccgcgataaagtaggaacaaaatgccaacaggtgccaatttaaaatccattgcattcggcctggggactaaggtggagcagccggtcatttacatcagtttcctgggattcaaaaccagaaaacagttattcattacgccagaaaaagcaaaaatttaaatttttatagtaaaattaatttttgaaaagcacttttttaacaaactaacatg

SEQ ID NO: 110542 - DNA, 1003 bp, Heterodera glycines
  Promoter: Source sequence=SeqID_6267; Location=1058..2060; Strand=-; Gene=SeqID_60956
gatttaggaatggagtttaaaacccatgtttaagggtcagggaccaaaaaaatatataatttgtatttttctcgaaaacggacattgggacggtaaatttcttcaatataatttcagttccaaaaattttttaggtttaaaaagtgttaaacagttttttgatataaaacattattactgcgtttattgtgaacaaacatttcgtgaaaaaataaaacattctgttaactgcataataaaatgtcaacggtgcggcggatggggtaaagcaagtacagaaataaaaaaaaatataaaatgtttagggttaaattttccatgtaaaaatgaggaaaacgtactaaaagaatgcctaaaatgcaatagatttttctttaatgttttttgttatcagaaccattttaaattggcttgcaaactttataaacgctgcatacagtgtgatagcgaatataatacacgggaaaaacatatttgtggtaaaaaataaattaccaatagaaattttttcgataatttaggctcaaaattttgtaatgtgtgtaaaatcaagcactcaaaatcgaaaggttgctacataaagaaaatcatcattccgaaaaatctgccgcgttatcgtatcataagctacgacattgagtgttcagtatgtaaaataataaacaaaaaatattagcaattttagacggataatttaatagaaaatggaaaaaatgaggggatttttgaacataaagtagttttttatatttgcgggccaaaggggattaagcaccacacatggtgtacggttgacaactttgaccccgtcttcgagtttttaacatgggtgctatcgtttaaacatttcgaaaccatttgctatgctcatttcgccggtaaaatcaaaaaattaaattttttataataaacatttttagggcgttacgatgcgcactttattttgcgcgcattaacagaattgggatatatacctgaaataattatttcagatttaaaaatg

SEQ ID NO: 110543 - DNA, 559 bp, Heterodera glycines
  Promoter: Source sequence=SeqID_39019; Location=1..559; Strand=+; Gene=SeqID_67685
tgttcaaaaatcatttgttaaaaccaattttatcatgtagagcatactcgattgtatttttttatactttaatttttttaaatttcaaaaaaaaattacaatttttttagctatttttcaaatttatggttgattttttatattaactcttttcttacttttattactggttttttatttacaaatgcaaaacaaatgaaaaatttgatggaattacgaccaattttcaagatttactaacaatacgttttttttaattttcaacaaatcgctgaaaaaacttttttattttttttcgtgtggaatcctcccccccccaaaaaaaattatttttttctcgaaaaattgtacatccagcagagaaagatgaaaattaatgtttttttatttttaggcaattttaaatttccgccagaattattgggatgccaatgcttgtcatgagaaactcgaaatcattggcgacaaaagtctcattgtccattataagagaaatgagaatggtattttatcataatttacttagttatattatatattctccttaaaagatggtatg

SEQ ID NO: 110544 - DNA, 1003 bp, Heterodera glycines
  Promoter: Source sequence=SeqID_9344; Location=335..1337; Strand=-; Gene=SeqID_71065
caaacctattgcgcgactttttcttgcaaacccaaacctattgcagggggggtgcgcgacttttttgactgcgcgactttatgcaaattattttaattaaatttatttaattttaaattattttaaacgtcttaaaggtcaaagacgttgaatttaaattcatttaaaattgtccaaaaattccccgcaccaagcggatccgaaccccaggggggcggccagactgacgcactaaccactcggccacattggcaattgatgataaacattaatttgctctcataaagggaaaaattgacgtcaccagcggcggaaggggggcaagagcaggcggcgagaatgggggagggggtcaaataaacaaatcaattattgaattcacaattttctcttttaaaagcaaaaagaaatgggggcccgtataataaaatataatttagaaattaaaataattaaaaggttaattaattaattattttccaaataaattttttattacttctaaaataatataaatattttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtgtaatttgacaccgtttcttttatcttttcgttaaaaattaaaaagattgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaaaattttttttattgtcccaatttttaccattttgtgttttttcaacaaaataaatatttgttcaaatttaaagaattaatttttaaaattttagacacaaaaacaaatcatg

SEQ ID NO: 110545 - DNA, 548 bp, Heterodera glycines
  Promoter: Source sequence=SeqID_22762; Location=749..1296; Strand=-; Gene=SeqID_53462
ttttctctctctctctcactccttctcactctcactatctctcgctcgcaatatgtaaagcaattaaataatttctacttagcatggagaaaacagtgaagtcaacaatggtattggccttacgcaataattttaagatcaattttgcatgtaaaaatgaagtagaatctgtgccaataaaagagtactgcttggccagtgtaacagcacaaattcaggcaggcaaccatacatattttctgctttaataattttattactagggattggtttttaggctaaaaggctctaaaaacaggcagaatttttaaaatttagtttgtaaaattttttagttctaaattaaaagaagcttaaagaattaccgttttttgccaataatctaggcaaaatcataggcggcaaattttttcagtaaattatatatattatatataattaatatatatatatatatatatatatatataattaatatatatatatattgttttaagcaattttccaaaccctaaccacacactatcatcatcattaccgctaaaatg

SEQ ID NO: 110546 - DNA, 76 bp, Heterodera glycines
  Promoter: Source sequence=SeqID_32079; Location=682..757; Strand=+; Gene=SeqID_62391
tctgatcaaaattggatgaaatcgcatcgtaccattcattttattatgtcatttgacagaccaaccgaaaaacatg

SEQ ID NO: 110547 - DNA, 77 bp, Heterodera glycines
  Promoter: Source sequence=SeqID_14390; Location=75..151; Strand=+; Gene=SeqID_78427
ggtccaccgactgactgttcctctgatcagtgatcactgatcaaccttccccgctaaactctctcggtttcagcatg

SEQ ID NO: 110548 - DNA, 213 bp, Heterodera glycines
  Promoter: Source sequence=SeqID_3168; Location=953..1165; Strand=-; Gene=SeqID_83503
ggtgagagaaaggggagaaagcgagccgaggggggggatttaaaatattccggattttattttaaaaggattaattgaatttaaaatatatccctgggctgcttatatgcgatcaaagtggggaggggagccatggggagggaggtggggaagacgttcggtaatgataaaacggtggtcatgatcagtgatgggagggaggccataggcatg

SEQ ID NO: 110549 - DNA, 215 bp, Heterodera glycines
  Promoter: Source sequence=SeqID_26053; Location=1..215; Strand=+; Gene=SeqID_56800
ccagcacctcttggaacttcccgggaaaaattcgggttggaggcatcggagtcggggataagccacaaaaaatggccaaaaatgtcggggacgaagtccctttccaagcttgaacatgtctcatattctccgcccacatatataaaaccgaaatttgtttgtccgaccatttaagccgctggcgctgctgctcctccccccaatgtgtctcaatg

SEQ ID NO: 110550 - DNA, 471 bp, Heterodera glycines
  Promoter: Source sequence=SeqID_34733; Location=1..471; Strand=+; Gene=SeqID_64457
ccccccctgggaccgtccctggaggggggggggggaggcaaaaacaacagtcatacaaaaacaaactaataaatggaaagtgacgtgaagagaaatattttccttggtaaggactgctggggaagagattacacaatcatttgggacaatctttcaaaaggaggcgaacaccatcaaaatgaatgtgacagtgagcattattcttccctttgaattaaggcgactacgccgttcagcctcacacggacccgctgagactggcgaacccccacgcctaaggaagggagcgaagaaggaattcgatttaattaggtcgcttgtaaatgtcttatttaaattcgttttgattctgttttccatgcgaatcaaaagttgtaaattgaaaataattctctattcgtgtcaaaatgacaataaatatttgttgtgcttatttaccgacgtcacacaaattcactgtcaggaaaaatg

SEQ ID NO: 110551 - DNA, 1003 bp, Heterodera glycines
  Promoter: Source sequence=SeqID_2496; Location=77..1079; Strand=+; Gene=SeqID_80074
ttttaacttgtttggagcttatatacccacctttataattagggctgggatttttatgtgctaaaaatcctgaaatatgtaataaaatatgtgctaaaaaacccaaaatatgtgctaaaaaccaaaaaaaggcctaaatatgtgttaaaaaatgcaaaaatatgtgctaaaaattggaaaaaccaatggtatttttgcataaaaattccaaaaaactcattctttatcatttttgcccgcacaattgcaaataaaaaacatttggaggtgtttgggggtaaaattagtccttttttgataaattttttttaaagataatttttccatcagttgagtaagtccagcaagaaacttcgatatccagttgtcgccaaaagaaagcgacaaaaatcgatccgaagatcaattttgtgatgactaagccccgccccctctggtcgatataaaaggggctcatttttcccattcgttagcattctattaattttctctgtattaaatttagtttgttcactctcttcccttttttaataaagtctctttgaaagagctttgtgcaattaaaaaggtattttttaaggagaagaattctccgtaaaatcaaaaggtttatttgtgaagagaagaaattcttctctgtcacaaatagaagcaaaaccaggactcatcctttctaagggtgagccaaggaaaggagaagaagcatctcctcttacctttccatttgctaaaagactccccccttttgccgggtgagtcagcttccccttctgccgggaagtacagattttttgcggcctttcgccgacaaaaattggagccccgtaggggtcggcttccagtcgtaagcctaccctccaaccatcgccaatccaaagcgcagccgtagcgcttggatcaaacgcacaacccaaaggggtttattgcgttttcatcaagcgtaagagcaatgagtgagctcttgcgcatttccattgcaccaatggtggtgcgtctcaagatg

SEQ ID NO: 110552 - DNA, 300 bp, Heterodera glycines
  Promoter: Source sequence=SeqID_15403; Location=1..300; Strand=+; Gene=SeqID_79665
tggcgacgcccgtgcagacttttgactgtgggcttattgatctgattgtggaggaagaggtttgacagcaaccgagttttgctgtgtcatcgctgaagactgcctgcatttgctattatctaggcgataataacaactttttgttggacctgctaacagtttaacactgttagtagtgagaaattttgcgccgctgatattgtgttttggcaacataatttcagttcgtccacgcgcacccactctgataatatcttggcgctattatcaatagagtggtgaacgacaaaaataaaaatg

SEQ ID NO: 110553 - DNA, 206 bp, Heterodera glycines
  Promoter: Source sequence=SeqID_11347; Location=512..717; Strand=+; Gene=SeqID_74731
atgaccaattttgacaagcattgggcatttctatcgtagcaaatcttgggaaaaaatgaaattcaagaccaattgaacccaaaaatttaaaaatttcggggatagggttggaaatcctttaaatctggtcttataacgagttgacgttcattaacaggaaacttgccgaagaacaaaacagtgtgtcgccagtgcgtccgaacatg

SEQ ID NO: 110554 - DNA, 511 bp, Heterodera glycines
  Promoter: Source sequence=SeqID_20798; Location=598..1108; Strand=+; Gene=SeqID_51376
tattttatggtatttatgttttcataatttttaattttgtatatttactagcatttaaaaattaatgtgaaatttgtccggtaaattgcaaaagtacatcaacccaatttttgatgttttccggatggaaagatatcgatttgggtgaaaaaatactaaaaacaatgagaatggcggacggttatcgatttctgagtctaaatgcttacagtgtatgtaataattgtgcgaataatcgaacaatctacctaatccttcacacattctctgcgataaaaccaaatatttcattggcatatccaaattttggtgcatattttatgaaagtggtcctaccatcggcaattaccatttctttttttttcgcagaaaccaaaacactgcactattgctaaaataaatcccaaataggtgcctaattgtaattgtgtctcatttctttcctcttgaatttgtgtaaattggaatttgttttgaaatgattgacgaggaaaagccattttagaaaatg

SEQ ID NO: 110555 - DNA, 463 bp, Heterodera glycines
  Promoter: Source sequence=SeqID_27348; Location=1379..1841; Strand=-; Gene=SeqID_58041
tagctttttttggaattttcttataactgaattttcttttttttttccttgagaaatttctatgtttgaattttttttttttgagatttctgcggcgagatttcggccggcgagatttcagccggcgagattttggcggcgagattttgtctcggcgagattccggcggcgagatttcggcggcgagattttgtctcggcgagattccggcggcgagatttcgtcccgtccccttctgtgatagttagagggacaatagggtcccgccctatcacacaccacacccccctcattaatgtggcgattaacttaccttaaaagctccttttcaatttcaattttccaaatattttattattagttgtttttcgtattttcatgtttaataaaattataaaatttccttccatacaatgttatcaatagggagtccaaaaatatggatataaaatcgcgaaatatg

SEQ ID NO: 110556 - DNA, 235 bp, Heterodera glycines
  Promoter: Source sequence=SeqID_17546; Location=325..559; Strand=+; Gene=SeqID_82053
agaaattttctatgcaaaaacgctctcgaacatgaaacgaagtgcggtgcgccatggccattttatttttcaaataatttttatatttaatagatattccagaaaaatggctatctctttttttgagaaattttctatgcaacaaacgctctcgaacatgaaacgaagtgcggtgcgccatggccattttattttttaaataatttttatatttaatagatattccagaaaaatg

SEQ ID NO: 110557 - DNA, 546 bp, Heterodera glycines
  Promoter: Source sequence=SeqID_17022; Location=543..1088; Strand=-; Gene=SeqID_81443
ggaatactcgataaaaaggcagggcaataatgcgttttacatcgtcaaagtgatcgcgtgattttgagatgacagacaatcagttcagcagccatttctttaagaggagaatttcttatcagaagagactacgaacttttcacctaatccatcgattgctttgtgtctgattgtgagaaggattttttatattttgataaattatgactgttgtgcaaatcaaagaacaaaagccaattattgtctgttgagtttaattatacttcataatctattgatcctatccattggttatgagaatactcttttccagtaataatttcttttggtgccattgatcggtgaccttctttaacagacaataatcacaactaattggttgctaagggcgttttatgggacgccttataagactaaagcttaaaagagaaaatctgtccgatgcttttgtgaaattaaaaagagccttcctcctctgtcaattaattcatatttaatttgtaatttattaaccacctcttctcttattttaaagtcaccgttatg

SEQ ID NO: 110558 - DNA, 181 bp, Heterodera glycines
  Promoter: Source sequence=SeqID_43575; Location=314..494; Strand=-; Gene=SeqID_71216
tgtaaaaataaaattttaattaaccttcatcctcccattctcacccaaaaaggtcatggaaaatcggctaaagaagcaaacaacgggcgttatcaatcagttgaacaggtgggtagtgctttttccatgtttttataaaaaaatttttgcgttttacagggccaaaattcggactgtcatg

SEQ ID NO: 110559 - DNA, 180 bp, Heterodera glycines
  misc_feature (99)..(99): n is a, c, g, or t
  Promoter: Source sequence=SeqID_30212; Location=1887..2066; Strand=-; Gene=SeqID_46196
tgcatattttcactttttatgtgcatattttgccatttttggtgcatattttatgcgcatattttgcgattttatgtgcatatttttggatgccctacncatcaccatctaactcattcatttattttatttacaatcttataattttatttttgttccttagtttcttttgctcaaatg

SEQ ID NO: 110560 - DNA, 1003 bp, Heterodera glycines
  Promoter: Source sequence=SeqID_572; Location=398..1400; Strand=-; Gene=SeqID_56551
acatttcttgtgaattatttctcttttcaaatcccttggcgttttcccgcttttttattttatttaatcatgtgttcattgttctaattttttacaattttatgctttgataaataaatattctaataattttccctttttaaaaatgtcattcgtattttttcgattttaccttttttatttcctttttcttttcttgtcctttttgttttttgatgatgcaacgcgttacttttggccattgtcagcggcgtttggctttgccctgttgccctttcgttggtccgccgtttatttcgtgccatttttgttctgacgacgcgtcggccaattcgtccggcgaagacaccaacaaaaaaccgtaaatattaattcatttatcacaatttataaacatttgcttccactccctcccattttaaaggcaccaagcggcccggagaatagcggaaaaggcggcggttgcggcacggaatgagcaattctatcgctacgttcaggtgatttttctggcaaaataattggaatcactgacaattaatcacaacaaatagacttttgccgttccgccattttccaatttttcccctctcttttcagcagggaattggcgcgcttcaggcgcaccaacgggcggagagtgacttcaaagggctgttggaccaattcacgcggatggcctccgatcagaccgcgcccaacacggacgggggacgttcgctgaaaacgccgccgccttttgcggccggcgaaaaatgggaacgattggaggagctggcggagcagtgcaaaatgtccatttcgatggctataaagtcggtcaattgccatttggggacatttatatgccatttaataaagtaggaaagatttcgtggattcttattccgccgaggctgaacaatttcaacggcacttcgtcgagcggaggacgcggcaacagcagacggatgctgaaaacaaaacgaagacgggcgggcgcagcgcgccgtaccgcgcgatg

SEQ ID NO: 110561 - DNA, 732 bp, Heterodera glycines
  Promoter: Source sequence=SeqID_8150; Location=533..1264; Strand=+; Gene=SeqID_67141
tttgaagagaatcgaacaaaattacaaaattagggtcattaaattagccttttccatgcattgtttgctttttgtttatgtttacatttctcttccgttcttctgtttcccaatgctttcgctttcttttggaaatgcatcacaaaataatcggatgaatttgatggggggggggcggagagaggaagtgatggaatgggagaaatgcaagagtttatcagagaagcggcggcggaggccgtcccctcccctttttctccccccccccctccccctcccttctcatgatttgcctgatgatgacaaatggaaggttttgcaaaaatgacccccgtatattttatagattatttttattctatggacgaaacattattggaacattcaacagaaaaatggcaaaaaattccaaaaacaaaaattgaaaaaagaaattacgaaaaattaattttgttaagagaaaaaatgctcgatattttaaatgaaattttaacactttgcgaattgagagaaaaaaatggacaaaaaagtgaagcaaacgcagagaaaaatgaaaaagaatatttattgggcaaaatccatcgaaaaaatttaacaaatgccatcaaaatgggcgaatttgaagaaaaatggaacggcacggcaaaggacgaaaaattaatgaatttattcaaaaataattatttaattacctcaaaattaggcaaatttagaagcgatgcgcaaaaaatg

SEQ ID NO: 110562 - DNA, 1003 bp, Heterodera glycines
  Promoter: Source sequence=SeqID_14975; Location=2519..3521; Strand=-; Gene=SeqID_79132
ccggttacggtagcggcaccggtggcgcgttttccctccagcgccgcccgctggtgcctgcgctcccccccggcaccagcggactgatcaccaccaaccagatgggccaaccttattgcatggacggccaaatgccgggtcacacaattaatcaatggccttttttgggttgtagtgccagggccagaacagtacaaatgccaatggtggaggatgttcgaaagagccccccatccctaaatcgaaaaataaaaaaattgaaattttaaaaagaaataaattaaaaatttttttcatttttttggttttttatttcgtgaattaaacaaaaattcattttatttatttaagaaaactgacttaatccaattcttatacaaaagaaaaatattttttaagtttttgtgttactttgccacaaaaaaatgaaagagtaaaatcttaaagtaaatgtcggaagctaaaattggagagcgattaaattgcaatttatatacatatccttatgccccgccccaactaaccataatctggattaaaatttaaattcgcttttttgcagcctatttaggccaactggtacggtattgtgttatgcttgggcaagcctgtgagtttttgtttttttttcaaaaaaattttcatcgatttgctctccaatttagcggaatgccctccctcttacacgtgtgccatgtccaatcggcccggcttgtacgtgtgctgtcacccgttcccaatgaacaggtagagaagcacatgcttaatctcgtaaatctgttgcacttaatacactcatttcaaaaaataaataaaaacacgaaatttttccgaaaattcatgaaaattaatttgtaagaattttcgtgctaaatgaaaaataatgagagaaaaacagaaaattttattatctcccgaataattaaaatattaaacacgattattgggtacggtaaaaattttgttactgtatttaaggcgagcatccaaggcacagcaaatg

SEQ ID NO: 110563 - DNA, 149 bp, Heterodera glycines
  misc_feature (38)..(38): n is a, c, g, or t
  misc_feature (52)..(52): n is a, c, g, or t
  misc_feature (60)..(60): n is a, c, g, or t
  Promoter: Source sequence=SeqID_21016; Location=1..149; Strand=+; Gene=SeqID_51594
aaaaagcagctgaaagcaaaatcacattatttttgctngtcagaattcaaanagaattcncagtctataaatgttaccaaaaaattacaaaaatatgcaccggcagttttcttttcttttttaaagatgtgaaaagtgacgaaacaatg

SEQ ID NO: 110564 - DNA, 797 bp, Heterodera glycines
  Promoter: Source sequence=SeqID_11680; Location=1..797; Strand=+; Gene=SeqID_75150
cggttttgttcgccactttcggcacgttttgctgaccctgagattctcgctccgatttcgaaaaataattttttttcttggctctcgaatctcgacgcatttctgccgatatttgcttaatttaatggcactttcatttgacgattctctgccgaacattggcatttgtaaaaagtactcccatttggttttctttatttgatggcgatttattgataaaataaattgggatatataaatttttaacattttgatggacatttacttactgaatgcattttatgatgcaatttctcaacattggtcccaattaccgagttcaaaacacacttttcttttctttctttccctcccatttaattgccttttgcccccccccccgggcgttttttccccccaaagaatgcccaaatttgttgccatatgatgggctgtgtgtccttggtccgttctgctgatgtcccctccccccttctcatatgaccctctccctccctcactttttgtccattttcgccgcgggggttgaagttttcgtagaaattgaaaaattacatttaaaaaatattatttcatttatttattattttattttaaataaaaaactatgtttattttattcttaaaaataatatgtttttctgctgattcgttctcattttccaattgaaacgtttcgttaaaaaaggcggaagttttttgcctttcgcccccaaaaaattgtcagtttttgcgtcaaattttttaaattgtaaaccattaaattttagcaaatttcgcatttcattcccccaatg

SEQ ID NO: 110565 - DNA, 238 bp, Heterodera glycines
  Promoter: Source sequence=SeqID_14351; Location=458..695; Strand=-; Gene=SeqID_78381
aaatttcataatctcaatttaggaaaatttatagcaacggaaaaagacaaaaaaattttgctgatgatttaattaaaaacgccaaaatagatccaaccaaaaagaattatggaattgacgacattaaccaaatccgaaaatatttcgacagagaatttccggggaaattcttaccagccgctttttcaaaggttgaaatgaaaagtgatttttacaaaaaaattaaaattcaggaatg

SEQ ID NO: 110566 - DNA, 395 bp, Heterodera glycines
  Promoter: Source sequence=SeqID_18103; Location=603..997; Strand=-; Gene=SeqID_82686
aaaaagttttttgcagagcgctttatccaaaaaaatctttttgaaacagggggcgtggttccagcggtgccgataggcaccacccgggggaaaaattggtggaaatgttgaccattttttaacagattttcactgaaaattgtgaatttattagtcaaattttgaaaatttcagggcgaattttaggggccggtggaccgattgcctaaaaatagccattttgagcttttcttccaacaaatcaacatatcaccctaaatttgaaaatttggtactttttgttttataaaagttatgttgcacattttattttttatcactatgttatttttattgtacaattttgtagtgaaattttttgagtttatttaaatatttttgtagaatgaatgatg

SEQ ID NO: 110567 - DNA, 289 bp, Heterodera glycines
  Promoter: Source sequence=SeqID_10580; Location=1931..2219; Strand=+; Gene=SeqID_73817
ttttttaatttccgtttttaattacgcatttatttattaaaaaatatgatttaaaaataaaattgagttacctaatttagataattttattgggaattataacaaattaaattcactttttgttagcacatacattacttttccaaaatgcttatctttaaattccattttttagaaggaatttcgcgttgggactgctaatctttagtctcaccatttttttttcttcctccaatcattaataattcaaacaactgatcagttcctgatcaatcattgcttcaaaatg

SEQ ID NO: 110568 - DNA, 146 bp, Heterodera glycines
  Promoter: Source sequence=SeqID_13429; Location=1691..1836; Strand=-; Gene=SeqID_77320
tggcactcttttgatcgttctgtttttcattttcgaggtgtccctcccccttctgatttttccctttctccccctcccttcagttgttgtacgtcccctgcatggtgtccatttatcacaatttgtccaatccatgctacaaaatg

SEQ ID NO: 110569 - DNA, 300 bp, Heterodera glycines
  Promoter: Source sequence=SeqID_3560; Location=1127..1426; Strand=+; Gene=SeqID_50865
gctaaaaggaaagaaaaaagagtaagcgaaagaaaacaatcgaattatccagcattgaaagaataaattttgatagaatggtaaaacatccaaagaaacatagtgttgatgatagataaaatggtcagactaactccttcgggtgaacggaacccaaaaatgcactgaaaacgggagtatttggttttctcccatcgccccaccccccttagaaacttttgaaaaacaaatttcttaatttaattttctaacttcctttccaataaaattaattttagatttttaatagaaaaaaatatg

SEQ ID NO: 110570 - DNA, 258 bp, Heterodera glycines
  Promoter: Source sequence=SeqID_7317; Location=1..258; Strand=+; Gene= SeqID_64453
tcaaaattgggtaacatttttggtgattaaatgagtgtaaatatctttgacatggaaattatgagggcattctgtgcattggttgatgctcaaatagttcttctcgtgtcattttcaataagaaaatttgttttgtttggccaaatttggtggtcgccagtcagattacatttaaaaacaatttggggtcacattggttaatatttgttgccttaaaagtgtccaacattatttactcattgtcagatcaaagacatg

SEQ ID NO: 110571 - DNA, 52 bp, Heterodera glycines
  Promoter: Source sequence=SeqID_11944; Location=279..330; Strand=-; Gene=SeqID_75464
tcattaacagcagaaaaactgtgaaaacagaaaaaccgatgctaacaaaatg

SEQ ID NO: 110572 - DNA, 307 bp, Heterodera glycines
  Promoter: Source sequence=SeqID_7375; Location=816..1122; Strand=+; Gene=SeqID_64644
ttttgaagctgaactggtttaagtgttctaaattagtaaactcatttttttggcaaaaattgattaaattatttcaaagtacaacagaaatgaaagtcgattttgaaggcttttttggtgaattaattttatttttaatgcttttttaaatgaaaaagtagaaaattctgaaaatattggattattttataataaataaaatattgaaaattttgattaatttattgttaatcatatcttttcaactgatttatttcagtcattcataaattaatgccttcttttaaattttttagaaaataaaatg

SEQ ID NO: 110573 - DNA, 60 bp, Heterodera glycines
  Promoter: Source sequence=SeqID_1753; Location=1..60; Strand=+; Gene =SeqID_75720
caatcatataataagcggagcagaacgacgtcaaatggtacggatttacaaatacaaatg

SEQ ID NO: 110574 - DNA, 173 bp, Heterodera glycines
  Promoter: Source sequence=SeqID_17546; Location=2027..2199; Strand=+; Gene=SeqID_82054
tggcaggagaatgaaattggaatgaggttgaaaaattttacttttatatgcgcaaaagtgtggccacgcctacaccatttgaaaagagtcacggttttagacacgcccactaaaagccaaaacattttgcctgccaaaaacccagaatcattttaccaatttttgtcaaaatg

SEQ ID NO: 110575 - DNA, 180 bp, Heterodera glycines
  Promoter: Source sequence=SeqID_6833; Location=1..180; Strand=+; Gene= SeqID_63036
tcgtgttttttttaattttagggtcaatattttataaattagaggtttttataataataaatataattcccagccctattatgtaattattttcatcgctttttatgccaaataaacacaaataaatctaataagtatttaaaaaagattattaatagtaatgctcttttaaaggaaatg

SEQ ID NO: 110576 - DNA, 915 bp, Heterodera glycines
  Promoter: Source sequence=SeqID_3331; Location=1947..2861; Strand=-; Gene=SeqID_84243
agtgcgcggaagtgaattaattatatttgagaaatggtcgacgatctcacaaattacaaatggatttgatgcttattttctctcaaaaatgcttttgttgcttcttcaacatttgcttgttttattagaatttttgttcaatatacttgagaaatggtcgatcatttttgagttggtcaattggaatttggataaatttttatcggaggccccaaaactcaaaattgctcaaaaccattttattggttttcttagtcggtgatttgataattggccggaatagagatgccagccagattcatgatcagaatggttacgcgttgtaagcattaaaatggtcaaaagatgccctaataactcgagaaatttaaaatatgcactaaaattagcattgcaaaacaaatctcatttcttgctcagattcgtaatccgtacacttttttacataccacaggaaaaatcaaaacaaaattttaaatttattttccgtagggaacacaattctgtggtattaacttacaaattagtgcctatttcgcgattttttatgcctaaaaaacgaacataatttgtatacaagtgtttattttttgaattggtgccaaaaatccaaagatttgtgttagtgtttttttgcaaatttaaaattgagacattttgccccaaattccttccatttccccttcatcaatttacaatccctttaacttacagaattgatttttttttgttttcatcgaattttaatgtttttccccagacttccaccaaattctattgtaaatcaacaaacaaaaaagaaattgtttattaaatagcatagaaacaatgttagagttcggcattttgtggaaaaaaaactggtcatgaacctgggttttgtggacaaattttagaaaaatccatggccccatg

SEQ ID NO: 110577 - DNA, 297 bp, Heterodera glycines
  Promoter: Source sequence=SeqID_4298; Location=1..297; Strand=+; Gene= SeqID_45770
tagtgatttttaactattttagtgacgaagtcgccaaaatagtgatttctagtgaccgataatgacatcagaatcgaaaatttttaatgcagaaatgcgttttttgagctcctttcttcaaaacaattgagcaaaaaaaaaagttttttcactaaaagttgcgtccctagtgatcagcatatttgtttaccccaaattcattgaaaagaaaatttttacagaagattaaaaatttttgaaaaaagttaataagctaataagggcactaaagaatacaccaaactacacaacaaaatg

SEQ ID NO: 110578 - DNA, 55 bp, Heterodera glycines
  Promoter: Source sequence=SeqID_13686; Location=1..55; Strand=+; Gene= SeqID_77599
tcagaggaacggaaatgcgcagaacgacgaccagctggatagaggtggactgatg

SEQ ID NO: 110579 - DNA, 285 bp, Heterodera glycines
  Promoter: Source sequence=SeqID_3837; Location=2762..3046; Strand=-; Gene=SeqID_52070
tttttgccggtgattgtcctgtcgcttaatgcggtgtgatccgatatttcagcagaaattggtttttcgcgagttcgttttcccaatttttctccttcttgttgagaagcattcctttcttgaaggtttggacgaatcgctccgcttctccattgctttgcggatggtatggcgctgtgagcgtgtgcgtaatgccacgttcttcacagaacttcgcaaattcctttgaagtgaattgcgggccgttatcactcatataacttcgaattgtatcgcaaagacatg

SEQ ID NO: 110580 - DNA, 318 bp, Heterodera glycines
  Promoter: Source sequence=SeqID_1519; Location=5821..6138; Strand=-; Gene=SeqID_74176
atggttttggacagaaaattttaatttcaaaaaatgttcgactttttttcttaattggattttaaaaatatttttgtcaaaattaaattgattattttttaattgaatcccttaaactaattttgcattttctcacaatatcccctctcttttctgctcccattgtccattttactaaacattatttctcccataagtgccacttttaattttggggtttgcccctgcggcggtgccacttcaatcaacaagttttacacttttgccgacgcagccagaaattgccattttcaaatttgattttcgatttgcaaaatg

SEQ ID NO: 110581 - DNA, 82 bp, Heterodera glycines
  Promoter: Source sequence=SeqID_34328; Location=1..82; Strand=+; Gene= SeqID_64160
ccatttatagaaaaacacattaaaaataaattaattttataaaaaaataaaaattaattaattaaaaagtcgtcatgacatg

SEQ ID NO: 110582 - DNA, 1003 bp, Heterodera glycines
  Promoter: Source sequence=SeqID_39; Location=10503..11505; Strand=-; Gene=SeqID_54450
gccttaaaatcaagtaaatattattaaaaataaaattcagaataagtggtctcaaatttcaggaccatctttaatcatttaaaatttggcgaattattacaaaaatattatataattaaagttaattgttaagtgtgtgttttttaatttgtaggcatttatcgccaaaaaaataccgaatatatttttaaaacgtaaatattgcaaattataagcatttatatgcactaaaaaaatacacaaaccttataacctaataatgcattaaatttaaatagtttatatatgaataaattaaaaaattggagggaaaaggtgaaaaaaagttggaaaataatagcaaaacatttggtcataagtttgaaaagcattcaaagatggaagaaacaattaaaaagtgagaaaattcagtatacattcaaaaaatttatgataaataaaagaaaaattgttgaaaaatattttaaaataaaaaatgcatttatgcaaaatggaaaacattccgcgaagggatggaaagaatttaaagcaaaaattcaaatatttgccgtatgttatttgtaatttgaagaaccaaaaaagctggaaaaaattttgtttaataatggtaacgcaaaatttaattatttttaataaatcgtttttgacaaaaaaaattagatattataatcatatttattattaagaaaatttactcattttactgtcactttcatcaaaacattattattatttaatatgcgaaatttttttattggtattaatcaaattaataaaaataattaaaaaacaaaaatattcacatgaaattgtattcccggacatcctttgcaatgtcatcatcataacattgttcaaatgatagaagccggaaattatggcaaacattaagcctaccatttggcatataaaaaatgccaaaaaatcatggaaaaaacacaaattattatttaattatttattaaatattcatattttaaatttttaacaaattaaaaaaatg

SEQ ID NO: 110583 - DNA, 87 bp, Heterodera glycines
  Promoter: Source sequence=SeqID_5408; Location=5153..5239; Strand=-; Gene=SeqID_57924
acataatttcagttcgtccacgcgcacccactctgctattatcgttggcgctattatcaatagagtggtgaacgacacttaaaaatg

SEQ ID NO: 110584 - DNA, 78 bp, Heterodera glycines
  misc_feature (74)..(75): n is a, c, g, or t
  Promoter: Source sequence=SeqID_27520; Location=1..78; Strand=+; Gene= SeqID_58212
cgcatcgttcggggggactgccccgaaaacaaaaaatcgatttttcaagtgtccgttgggggtactcaacattnnatg

SEQ ID NO: 110585 - DNA, 449 bp, Heterodera glycines
  Promoter: Source sequence=SeqID_20304; Location=818..1266; Strand=-; Gene=SeqID_50814
ttaaatttaaaaagaaacttaattttttgatagttttataataactaacgacttcgccgcggaaaattaaaaaagaaaagaatataaaaagttattcagtggcaaagtgataaaataaaagaaaaaacaaagaaacgatgaaataacattgggcgagaaaaatgggggaaaaagtacaaaaacggtagttcatagctctgctgatggtaactcatatgatctgtaagatataatttacctgttcttatctttgtcggttgattagcaagtttttcacaaattgaccggtaacgggagaagtaattaacgcggttacaggttttattcactgaaatatacagaaaatcaaaccagtaatgagcttcaaactgatttgaaaattataatttgaatttttttggcgatttgtaatgaaaatatatttaaaaaagactataattttcagaatg

SEQ ID NO: 110586 - DNA, 586 bp, Heterodera glycines
  Promoter: Source sequence=SeqID_4815; Location=2055..2640; Strand=+; Gene=SeqID_55819
cctgcagagtgcggtgtgcaaattcggtcgaatggtcagcaaaatctttgttgtgagtgctttctaagtgtgtgcaaagcgatgaaaatgtcagcagaggacaaagacaaaaaaaattgctatttgattgtgctgcggttaattagcggttaattaagcattgtggggttgacgacttagagatttttgtgggaaaagaaaaatggatggactaaaaaattcttagttttttccgatttttctgtacctaaaaaccgctaatagaattgttatggtaaaagcgaaataggacaaaagctaagcaacgatcaaaagacgaacgaacaccaacaccataacaacaacacatgacattctctcactcactcactttgccggtgctgctggtgatccttaaaatgttttaatcggataaattatttgtatcttttataaaatgcctaatcatttgaattccccacccttcctatttacaattgttgttgatgtcgttgctgcaattgttgtccgtctcgccgacgttggcaccgtaccaacggcgggcgcctgttgctgcttttgctgctgttggctcattgcactgatg

SEQ ID NO: 110587 - DNA, 535 bp, Heterodera glycines
  Promoter: Source sequence=SeqID_9132; Location=442..976; Strand=+; Gene=SeqID_70349
ttctccggccgggaattttcgtagcgaattttaatatcacctgatcacccattgacaattcaaataatataaattaaaaatcgaacgatttgtggtgatcagtgatcgaaagccgacaaaaaattatgaaaaatttaaattatccatcttatctttcgcatattaacattaagctccaaccataattctttttatcaatgtttggattaaaagcattccctctcccattttttaggtcatcgttttgctcaacagcccaagcaaaaaaaaaaaaattacttttacatattaaaaaaaagaatatttttaatgatgggtcatcattttgccgtaattactttttgccgcccaatgtcagcccataaatagacgggagatttagcgcaaacagaaaatgttcattcattcatttatatgagctgatgaattttattttccaatttgtatattttctaattattaaatgaaattttaaaataataaatccaacaatttttaaattttagtccaatcaatagcttaaaacgaaaaaatg

SEQ ID NO: 110588 - DNA, 69 bp, Heterodera glycines
  Promoter: Source sequence=SeqID_3714; Location=1..69; Strand=+; Gene =SeqID_51586
ataagaaacgaatggggagggagcaaatgggaaagaattcgtgccacaacggacgacggacacaaaatg

SEQ ID NO: 110589 - DNA, 183 bp, Heterodera glycines
  misc_feature (58)..(58): n is a, c, g, or t
  Promoter: Source sequence=SeqID_2154; Location=2952..3134; Strand=-; Gene=SeqID_78138
gaaaatcttaagaataaagaacacttatggacagtgggattaagcaagccaaaattgnatcgcaatatttctttctcgtagagaatcaaattaatcgcaaatttttcaaccttttattcctaattaaaattttatatttaaatgtaaaattgtaaataaatcaattggccacctctgctgatg

SEQ ID NO: 110590 - DNA, 306 bp, Heterodera glycines
  Promoter: Source sequence=SeqID_43170; Location=1..306; Strand=+; Gene=SeqID_70905
ccataccacttgcataaatttactgtcattttatgacagccaaaaataattctattgtgcatttgctgctaattatttcatgcaaagagcgataaaatattttcaagaatcttttgcattcgacaccgttgaacagttgtatgcgcattttaaagaagagattttgagctcccccggtgaatattacccaaaccctctttgtgtgcttgattgtgtacacattgtcaacgacgaacacgctgatttgccggtgttcattgaaggaacgcttgatttgatcgcaggactagtactgtattccacatg

SEQ ID NO: 110591 - DNA, 193 bp, Heterodera glycines
  Promoter: Source sequence=SeqID_4489; Location=1..193; Strand=+; Gene= SeqID_54639
ttcacattcgggtccgggttttggaattggtcgaaacatgtcaaatccatgaccagcgagctagaaaagctctataatcatgcttttacaactttttaatttccaaaaattttcatataagggaaactgaccacaacaagcttaaatgtgaaatcagcataataccgtatcattttaattcagtcttttgatg

SEQ ID NO: 110592 - DNA, 302 bp, Heterodera glycines
  Promoter: Source sequence=SeqID_20097; Location=1..302; Strand=+; Gene=SeqID_84881
agattttgcaaaatcactgattttatctttgatttttcatcaagtacttgattttttgggaaaactttatgaaaattaatctggcataaaaaacttatatacagaatttgtagagctcaaaaagagctttcgaatgagctattgaatgtttggagaagttatgtttttcgttttttacgattttttgaaatttaattactggcctttacgggtcatgtgagacgggcgaggtcttgggttcgagcctgcttggcagcagtttattcttttatgaaaattgatgaaaaatcatagacaaaatg

SEQ ID NO: 110593 - DNA, 125 bp, Heterodera glycines
  Promoter: Source sequence=SeqID_20509; Location=1512..1636; Strand=-; Gene=SeqID_51044
agaagaggtacaaatttgataaaagaggtataaaagtgattagaagaggtacaactgtgattagaagaggtacaaaagtgattagaagaggtacaacagagattagaagaggtacaaatttgatg

SEQ ID NO: 110594 - DNA, 260 bp, Heterodera glycines
  Promoter: Source sequence=SeqID_4642; Location=1737..1996; Strand=-; Gene=SeqID_55206
aggctaaggccattgagcgcccgtcccattccaacgttttggcagtcaatcgaaaaccatttcagaagagggaacaaaacaaaagcccaactcagcctaattgttggcgttgtggcagtggacataaaacgcaaagttgtccccattcaaaggcaacttgtagaaaatgttccaaagttggacatttacagaatatgtgtgcgcgtcatcacgaatggcttttaaagcattcgagaaaacagacgcaacgaaagcaaatg

SEQ ID NO: 110595 - DNA, 209 bp, Heterodera glycines
  Promoter: Source sequence=SeqID_29769; Location=1..209; Strand=+; Gene=SeqID_60233
ggttcgttcaggtaactcagtacgggttccaaacgcatcgcccacgccctccgctcaaccgcgccatcccgccaattcccgagtcgcgcagcaacgagtcgattcagtcgggactggtggcacgccaccaaagtgtcggaagcgttgtgggaattcagcaacagacggcacagatcattgacgagaacaacccaattgatgtagaaatg

SEQ ID NO: 110596 - DNA, 187 bp, Heterodera glycines
  misc_feature (22)..(22): n is a, c, g, or t
  Promoter: Source sequence=SeqID_28906; Location=1969..2155; Strand=-; Gene=SeqID_59473
aatgtactcgacgaagcgttgnccgacaaattgggcgtgcagagccgatttttcttggctttggccatttttggatggcttccaatatcaaagtaagttgaaagagtttgaactgcttgacaaaacccaaaaatggaattcaacgacaggaaatgattttagacaagcgacaaatgacgtggagatg

SEQ ID NO: 110597 - DNA, 217 bp, Heterodera glycines
  Promoter: Source sequence=SeqID_3275; Location=1548..1764; Strand=-; Gene=SeqID_84021
gtcctgggaatggagagcgaggcgagactttgtgtatatgtaaattttcccttgtacattaacttttcccaaatacccacataatccgcacatttctgatcaccaatgatcaaaaggtggagccaaacggcgccataaaagcaaggcttttccacccacatttcatttccaaccagttctccctttcattactcaattctaacctctccaaagcatg

SEQ ID NO: 110598 - DNA, 897 bp, Heterodera glycines
  Promoter: Source sequence=SeqID_16542; Location=660..1556; Strand=-; Gene=SeqID_80947
ccccctttatgtatgttaataatactacaaattacccctcctggagattaaatcgaaatatgggtagcctttatataactatagaaaaaaaaattcattttataaaaaataatcttgcaagaaatcgtctcgaaaaataatctaaaaagccagttacggatcaaaatacggaaaaatcccaaaaatccgtaacccgtaatccgtaatccgtaactccaaaaaggccgtaaaaagttaagcctaaattttttggcatatttaaaaagcaattaaaaattttttaaattttattcacctcccttgttgatagaaaaagcatcagagtgccttatttaaaaggtaaataaaatttgatgcgtttcagagccctttctgaaaaaatatttatgaattaattttgcaaaaaaataaataaaaacgaaagactcagattttcgaaaaaaattttaaagccagctaactcggcgctcatttcagtgtaagttagtcctttaccggggagtatccctgcaaagtttggtacgcttctgctcaattagcaaaaaatatgagtgatcgaattttcactaaaaaagttaagcctaaattttttgccatatttaaaaagcaattaaaacattttgaaaattttattcacctcccttattgatagaaaaagcatcagagtgccttatttaaaaggtaaataaaatttggtgcgtttcagagccctttctgaaaaaatatttatgaatctgaacgacggtgagccaaaaacagctaccaccaaaaaattttgcaccgaattttggaatggtgccaaaaaatcgatgccaaattctgcacttcgcttattttctttttaatttgactgaaatttcaaaaaaaaaatttcagtgcctcttcttttttttgatg

SEQ ID NO: 110599 - DNA, 207 bp, Heterodera glycines
  Promoter: Source sequence=SeqID_10241; Location=1..207; Strand=+; Gene=SeqID_73388
tcatttaatgctgtttaggcggtcaaggattgaaaaaatgtaagtctgaacctaattttggacataggcgcaaatgtccaaggcgcaaatgtgaggttaccctacagagcaacccttcttctctagcacatcgcgttatttttgccactcagaaacaattccgttcttttataggtggtacattctctatatattgtatttgcaatg

SEQ ID NO: 110600 - DNA, 630 bp, Heterodera glycines
  misc_feature (78)..(79): n is a, c, g, or t
  Promoter: Source sequence=SeqID_18078; Location=1028..1657; Strand=-; Gene=SeqID_82665
attattaggatttctttttttagacaaatgcctaaaatttgcgcattgtaaagcaaagataagcacgaaaaacgcgtnnttccgcttggtttggggtgtctacgatgacttttataatgcctatttttgcctatttcggggtttttgtgcctaatgtgccaatttgcaggattctcgaaaatccttaacaaaaatacaataaaaacgaaaaacacacccctaagaaatgacccaaaaaaatttcagaaaatacgttccaaagaattgaaataattttcaaaaaaataattccaaaatttgtttattttttctcaataaaaatttttgttttaaaaatttgtccgtatttagaaaaaactttaaattatttaataatttcatttacaattgaaatatttaaatttttacgtgttttatacctaaattttttttgcctatttgatgcctatttcgctattttttgtgcctaaaaaaaatccctaattatttttatatatatatatataatatatatataataaacttaaaaataatttttcaaaattaagtggcaaaaaaatttcgtcccttaaatattttttgctgctttttctgatacttttgttcccgtttgcatattgcgttaatatg

SEQ ID NO: 110601 - DNA, 80 bp, Heterodera glycines
  Promoter: Source sequence=SeqID_5030; Location=1761..1840; Strand=+; Gene=SeqID_45960
agcttttaaaaaaaaggattgagcatgttctttacttttttttaaaaatccattaaaaatgcattttattgttgaagatg

SEQ ID NO: 110602 - DNA, 590 bp, Heterodera glycines
  Promoter: Source sequence=SeqID_8391; Location=642..1231; Strand=-; Gene=SeqID_67904
ttcttgacctgttccattaataatttttacccatttttttttacaaaattttattgccataaaaactttttattgtcaaatcttaaaaggagaaattcaaaatattacgtttaaaaatattagcaaatacatttttaaaattattcaaatttataatttacaaacatcactctactggtgtcattattgtatatacaaaattagaaaattttaatatcattacgaatatcattctactggtgtcattattatatatacaatactgcataatttggatattatataatcatataaattcacaaatatttagaatttatttatttttagccaaaagtgatttaattaaagattagttttcgctttgtccgatattttaggaaatttttttttatttggctgcatagcataaggcataaaaaaaattttaaaaagggacacaaacatacctttttataaatcaattttttgaaaataatttgctttaaagccaagggaatttggtgggcgtggagccgcaaggcaacatttgaaaatttaagcaccattaaattgtcttcaaatctcgactgtacgaagtttttcaaatcatg

SEQ ID NO: 110603 - DNA, 603 bp, Heterodera glycines
  Promoter: Source sequence=SeqID_26978; Location=992..1594; Strand=-; Gene=SeqID_57715
ttatgaaattcagctaatattttggcattggcatctatttctgcactgtatccgccggaataatatttgtttctagccaaatattttgtttcagtaaaattcattgattatcttttatttattattaattttttgtgttattttcatgtgaaaaggcaaaattttttttctataatttgataaaatttttgcctttgcttgtttcaattcaattggcaattggatcaccaaatcaaaatagaggtattaagaattaatttaaatttttctaattttaatttatctttgctttatggacttatgctaaaaaccagttattcttcttaaaaagacgttatttcatttggatcgtaacaaaaaaaatttcagaataaaaaattctcaaaattaattcaattaaattcttttaaataaatatcaattatttttattaaccacaatttgtgccatttgagatgaaaaggatggcattgaacaaccgcaacaatattgtgtgtcaaacattgagaatgatctgcaaattttgttggaacaaagtttggatgccaaagattgggcattgtccaacggacttgtcaaactgacaaattcttgcaacgaatg

SEQ ID NO: 110604 - DNA, 117 bp, Heterodera glycines
  Promoter: Source sequence=SeqID_31671; Location=1524..1640; Strand=+; Gene=SeqID_61983
tggcctttttgatgagtttgttctttttgggtgccaaaacggaggaatttctgcaaatggcatctccgacccctccttcatagtcttcttctcattctttgtgagcagcagcagatg

SEQ ID NO: 110605 - DNA, 663 bp, Heterodera glycines
  misc_feature (5)..(5): n is a, c, g, or t
  Promoter: Source sequence=SeqID_25071; Location=726..1388; Strand=-; Gene=SeqID_55800
ttaancagggctgtcaaaaatatgcacaaaaataggccaatatatagcgcgtaaatatgcaaataaagtcgtgaaatatgcaccaaatatgcacaaaaatcgcaaaatatgcaccaaatatgcacaaaaaagtcgaaaattaggggtgcaaattaattaaaaaattttattcatcataaattttatcggttgtttttgcaatttcaaatcaaaaatttctcaagcttttcggcagtgaagctcactgttgacccactcgcgcatccattaatatttggatttaattttaggcataatcaaaattttttccctaatttgtaagggatattcaaatcggaaatatttgacgaaaaatggcaaaataggcaaaaaaaaagctgaaaatatgtacaaaaaatggttaaatatgcatgaaatatgcagaaaaaacccaaaatatgcaaaaatatgcaaataaaagtcccgactttcatacgcaaataccatcctactaattagactacgtataatccaggaaaaaatatgcatttgcatatttttgacagccctgattattaatttaaaaagaaaaaagaaattttaattaaacttaagtataataaaaacacaattctattatgttttaacattatcttaaaatatattcagtgatttgaggaaatg

SEQ ID NO: 110606 - DNA, 460 bp, Heterodera glycines
  Promoter: Source sequence=SeqID_29873; Location=344..803; Strand=+; Gene=SeqID_60337
aatttggagtcagccaaatttacaaaagaaatttttaaaagaattttattgaaatatttttttattattcgtcctgataaaaaacggaataaaaaatgttttttgaatgttggcgcttaaatttattaatcaaacaaaaataaattcacacaaataaaaaatgtaattcatgtttttttcatatgtttacatatgtaaatgtaattttataattatcggaaataaaaatcaatccatttaattcaaataaatgacttaaaaattgctgctttcttagaatataaatctgaattaaatcgtcaatttattatttattttgacaaaataattgtaattattaattatataaaaagtttaatgcatcgcaattttgtgtttcttttgctgtcattttgcgtaaaaacagccaaatttgactcaataaaaggcgcaaattgtgataaccaacaacaacagaatg

SEQ ID NO: 110607 - DNA, 192 bp, Heterodera glycines
  Promoter: Source sequence=SeqID_6369; Location=1956..2147; Strand=-; Gene=SeqID_61283
ataaaaaaaaattttataattaaattatccttcaaaaatatattttttaaatttttattaatcaagtaatattcaaaaatatttttaacaattttattaattaaatttttcattaattaaattaatctcaaaacattttttaataattttattaactaatatcttgaaaatatttttttattataatttatg

SEQ ID NO: 110608 - DNA, 276 bp, Heterodera glycines
  Promoter: Source sequence=SeqID_21629; Location=1895..2170; Strand=-; Gene=SeqID_45667
tagtgtcgaaattactcagtgtccaactcagtgtcgaaaatgaagtaaaacagtgaaagttttgaaaatagttcagtgtcgaaattactcagtgtcgaaattacccagtgtcgggattaccggacacgagggaattgaccccaacccctgataaagaattttttttattgatttctctgttttcttttgaaagttttaatttaattttaaggaacaagtatttctgttaaaacctcacaaatttgatattagttcttccaactttttatttgaatg

SEQ ID NO: 110609 - DNA, 195 bp, Heterodera glycines
  misc_feature (44)..(44): n is a, c, g, or t
  Promoter: Source sequence=SeqID_40402; Location=1..195; Strand=+; Gene=SeqID_68749
tgttgacgaattgagcgaaaaagagcccgaaaagctcgcagaanattttggaggcaaaattggacaaagaggtggtcgtcaaagtgcaaatcaaggtcggttgagtgtgtgccgctaaatttgtttttaaactttgtgtttaatcaggagtccaaaggccatttcgaaggccaggatttcgattggataatcatg

SEQ ID NO: 110610 - DNA, 898 bp, Heterodera glycines
  misc_feature (48)..(48): n is a, c, g, or t
  misc_feature (164)..(164): n is a, c, g, or t
  Promoter: Source sequence=SeqID_12128; Location=1..898; Strand=+; Gene=SeqID_75701
tttttcattagcctttttaatttcatacttatttggaaaataaaaagngacacattgaagatgtttaaaataattatttatattattgtacactgacaatggtaacaaattaggtcaaatgttaggcttggattttacaaaaatttgaattcgtcatgaatatntaattaagaggaatattggattatataaattaggccagatgttaggatttggtgtaccaaaatttaaattcattgtccaaccgattggtacatatttaattaggaggaatatttgatcatactaattagatcaaattcgcagcttgggttaaccaaaatttaaattcagcgtccgatttgtgcatatttaattatcaaatgcgcggcttgggttgatctaaatttgaattcgtcgtccgatcggtgcatagataattagggaatttttaattttgcagatacatcaaaattttgtcggtattaattaaagcaaaaatttcaaatttaccgacaacacaaaacaatgaaattgggtcaagaattgtgattaatttgattttttggatataaaaggcagtacgaaggtttaccgttcataaaccaaattcataattccctccaaatattgtttttatgcaaaaataaaatatattttaaatagattcattcgcctcccaccctgctcttttcgtttcttaaaatttttcacatttactgtttgcattttctatattgcattattccaaaaaatttaaaaataaaatttgtttagcatttaccataaactaaatttatttattccaaattttaaaaatgtctacatcggaatcaaaaaatggtaaaaaatatacaagtcctcccttaacattaacaatctttcacctacagtaccggacgacgtcgactgcgaaatg

SEQ ID NO: 110611 - DNA, 221 bp, Heterodera glycines
  Promoter: Source sequence=SeqID_22775; Location=1..221; Strand=+; Gene=SeqID_53471
tgcgccaacacatcaccgcaaaatatcccaatggcctcatagacgacaactattcctgcccccacttcaaccccaacgaccgcgccttcgtgtcaacctgtacccatcttgaattaaacgcagcattggaggccggctacacagtccgcaaagtcttccacgtcctgcaatacgaccaatggagcgacaatgtcttcaagtcttacgtgagtgaaatgatg

SEQ ID NO: 110612 - DNA, 621 bp, Heterodera glycines
  Promoter: Source sequence=SeqID_786; Location=550..1170; Strand=-; Gene=SeqID_61217
actaattattgattgattgcatttgattcgtgaccggaaaatcggtcagtggaaaatgcgtcagtgatacaaatattttaaaataaatttctatggcattagtattgtaatataggactaaacttctataagaaaatcgttctcaatttccaaccccggacccgaactcgaacaaaaaatcgaaaagtcaaaatttcgaaattagattttttcttaaaaatcggtttaatacacggaaacaaactataagccatcaatactgcataagagatcatttatgctgtttttgaaccaaaaatgctaaattagaaaatttgggcgctacttgcaaagagcactattttgaaaattttttcacttttttttggaaaaatttttttttgtttttttgacacataatgatgaataacatttttggtcaaattttttcaaaatttttttttaataagcacgtaaaaaaatgtgatgaatttatgtctgtttcaaaattgtttttgtgttctttttgctctctcatttttcccaactctctctttttaagttacataacaacagagttttgccttgccttttttgacacaccaatcaattggaaaaacggcaaattgagccacaaaaatg

SEQ ID NO: 110613 - DNA, 644 bp, Heterodera glycines
  Promoter: Source sequence=SeqID_16772; Location=764..1407; Strand=-; Gene=SeqID_81179
ttttctcggccgagaaaaagcattttgttggacggacggacggagatggactaaatctccaacaaacaatcgtcgtcacacaaaatcacaaaacagctttcacacaaattcatatccaattcatcgatttgtgtgctgctgcatgcttatcctccgccaattagcctcccaaattttaggatgaaattaagagcaataaattttcagtgccaaaatgatcggggagagtgattttttggatttttggtgaaaataaaaaatcaactgtctaatcacttacaattagtatgaattatattggcctactcaaaactagggttgtatatgtttgagagatgccgaaattttcccgaaactcgagagtttaattcgaaattgaaaatttatacatcatttcaatacaaattctaagctaaattatagcattgttcgtagtttgatcagtatcagttgcgattgaataatttatgatgatcagaaaatgataattgatgatcaaataccaaaaattatcctttattaagagttaaattttataaaattgatttaactaaaattaaattttagaaattttctgcaaataaaaacaaattcacaaaaaagaaaataatatttttttttgtaaataaattagcctaaaaatg

SEQ ID NO: 110614 - DNA, 553 bp, Heterodera glycines
  misc_feature (37)..(37): n is a, c, g, or t
  Promoter: Source sequence=SeqID_32638; Location=1272..1824; Strand=-; Gene=SeqID_62932
tttaatattaattagataataaaaaattcatatattntcgaattcaattaatttatcggatatcataaaagaaaatttggccaaaatttgtttaaatttttttgtgaataattttcttggccattgagtatctcttttttggttagaaaatctaaattttaatttaattctttcgggtgtatggcatttttttaaattggtgctggaaagtgaactattcgttagtgtatatgatggatttaagcgggcttttaggcatttcttcgacagtgaaaaatgccaattttcaaacgctgtcggaaaacaaaacaaaaaatccctaacttttctttatctcctccccaattttcatacaacaaaattttaggaggagaaagggagcggaagattgttgtacaaatgtgccgttgtcgtcgtctcccgcagtgagcggagtgaaaaaaggcaccggaaaaattaggggggagaggcgaaaaatgagaagaacagcgaaaaggggggggggagagacgggacgggggaacacaacactttttgacgccctttcaaaatg

SEQ ID NO: 110615 - DNA, 90 bp, Heterodera glycines
  Promoter: Source sequence=SeqID_21083; Location=1..90; Strand=+; Gene= SeqID_51672
agaaacaaaagatggaggaggaagagcgaaagatgagggaggaggaagagcggaagaagtgggaggaggaagagcggaagaagagggatg

SEQ ID NO: 110616 - DNA, 91 bp, Heterodera glycines; identical to SEQ ID NO: 100405
  Promoter: Source sequence=SeqID_39263; Location=998..1088; Strand=-; Gene=SeqID_67870

SEQ ID NO: 110617 - DNA, 155 bp, Heterodera glycines
  Promoter: Source sequence=SeqID_4249; Location=914..1068; Strand=+; Gene=SeqID_45756
acttttcattctttattttattttagattgttttaaaaaattatttatttattggttttatcagtttccgactcattgtcagctgaactttttcttttttaagtgtgtttttgtaaattgtcagtggtatttcgtaaattgccgttataaaaatg

SEQ ID NO: 110618 - DNA, 442 bp, Heterodera glycines
  Promoter: Source sequence=SeqID_19843; Location=1735..2176; Strand=-; Gene=SeqID_84598
aattagccgacacaatgggaaagtgaagacattgggggtcaattaaaagttaatttgagtctaattagtcttggatatatttttgttagcattcgttcgtgtctaaataatctcaaaatgtttaaaaaaattttgcttacattggttgagctaacaaataaggaaagtatgaaaatacatttttgacttggtttgaagcttctatacccaagtttttcatgcataatttgccatttggtgttatttttatgcgtaattttgcataattaaatgaaatattcacccatcggtccgtccaattccttaatttgcgtaatttgccattcaaaatgcttttgattcgattggttaatcttttatcattttcgatttggcaaatgctttttattacctcaagagtcccgaacattacaaccaatgcaattggaaatacaacccaatg

SEQ ID NO: 110619 - DNA, 924 bp, Heterodera glycines
  Promoter: Source sequence=SeqID_3871; Location=1047..1970; Strand=-; Gene=SeqID_52234
ttttgagcccaacaaattatgcacatatgtaatgaagttggcaaaatatcaaattgaaaaggcaaataaataaataaaatagagcccccggggctctaatcgaataaatacggtatattgtgatggacttaattggacagccttaaaaatcctcaaaaaaataatcctcattcggcagagataaataaaccctcatcagatggatatatgtaaatttgtattcggactccccccccccgttggatacagcatctgctataattgacataatttgattaaaaaatcattaattgtaagaagaaaaggtggaatttaaagaattaaagaatttaattaattaattatcataattagggtaaatttaaaaaacttaaaatttaattaatctaactatactaaatcgatggttttttgaatagagattatttatgacacgaaaacttgcaaaaaaaagaaaataaaaaatggcaagaagaaatttttaaaatttagaataacaaatactaatgtttataaaattgtttacaatttgtgtttttgctttttccttaaattttttttttaaatactttaaacaattaattactttataatatgctttagagagaatgagagagaagaagagaggagagagagaagggtagtgcttagagaggtttggtgaaaggatgacatagagacaaaagaaagagacaggactttcaatttgtaccaagaatgtaagttttgtccaagtaagaaaaaagttattatggcctatgaaattgagggtggtctctgattggacacgcaaactgcagtagagccccccatatcctgatgggtagtacaattttccaaaaaaaaatttttttttttatgcatttaaaatttggatttgacacagtttgatttctgtaacctttttttttgctgtgaatgatg

SEQ ID NO: 110620 - DNA, 788 bp, Heterodera glycines
  Promoter: Source sequence=SeqID_44137; Location=1..788; Strand=+; Gene=SeqID_71669
tgtatttttggcgccctcttccccttcttcatcatcactcccccgcttaacggatacgaaccgaagcacagatttgtccctcaaagttcctcccattcatttttattacttggcccaatcaatcacaaacaaactttcagttaccatttttggccgaatttgttaattgttgtacatatttacataaactttctcccaaagaatatgttctttgtagtgttttgtctttgttttttctgcaattgctattcctctttttttacataaaaccgattaattaattattttgctccgtcagatgaatttcatcgcccttttatcaaaaccctgctttcgctttcatacgtttccttcttgcagtaaaaggtcggtttgcttccgatttgtcctcacatattttattttcaggttctcctacacactttcagtttttcattcattgccaagccgtttttctcgacttcgattgtttaggggcgaatcccataaaaattatgcaactgcagaaaacaaaagaccttcgagacatttaaaagatctcactctgcgagagcttcgcgaaattgcgacccttgcatacccacacagaaaacgcattttaggtatggtaacggaaaagaaagtggagatggggagaggagaccaatgaaacattgagaaataatctcgaatgtttcacccacattttttcatgcatctttgctcttctcactttagcgggcctttgctgtctttgtgtcagttcggtgattttcctctcagtccctcgaattctcggcaaactcatg

SEQ ID NO: 110621 - DNA, 1003 bp, Heterodera glycines
  Promoter: Source sequence=SeqID_10891; Location=186..1188; Strand=+; Gene=SeqID_74173
tgaaattttttattttcgattttttgttcgaatttcggctccgagttccgaattggtcgaaatggatgcctggttcgtgagcagcgaccctgaaaaccattggaagcatgttttcatgacttttgaaaacaaaaaaattttcttcaaaaaaggggggcaaccaaccatcggcagtattaccttcgcgaaaaatacgtttttttttttgttttacaaaatttttaaatttgggtgtttttcttttttttattatagcttggcgccaaaacgtcggcgccaaaacgatacggacccgtctggtgtctcgtattctcgtgttttggcacgatacatttcagcacaagaatattatgatttaacggaaggatggaaggacacaaaaaataaaattgaagaagtataaatgtaaaaattttacaaaaaaataattaatatttatgattttagagaaaaattgaaaaattcatatatatttacgaaagcaaaagcttattgaagtgctggatattgatggattaagaaatcatttcacaaatttattgaaggaatatgtaaaacgtgtgtttatagcaacaaatacattgaacacataatttttataatatttattttattatttctttttttttgctaaaaaaattgcgaaatattagaaatttaaaataaataaatattattaatacgtcttaaaattttaagaaaatttttgcttttttttgcgacaatgaaattaatgtatttggtaattgccatttatgttttaatccaatttgtttcattccatgtgaaaaaattatcggcgcaaaataatgtataattttatttaatattttaaaatatttaaatagaaaaaattaaaaaatggaaaaatattcaataaatataaatgatttaggaggcttccattttgtattcacaattttgtgaaaatttggacaacgcgtacagatacagaaacacaaaagattggcaaaaatatgaaaggattgagcatcaaaaaatg

SEQ ID NO: 110622 - DNA, 835 bp, Heterodera glycines
  Promoter: Source sequence=SeqID_8666; Location=1282..2116; Strand=-; Gene=SeqID_68807
ggtcaccccttttggggctgttgtactggcgaggggggcggaagttttaccaccccactcattcaataatggtctattcgttcatagaaagggcagaaaatgtacataaatgaaagtgaaaatgttttatggcgtggaaaatttgttgtgggattttctcccaaaaaattatttaattcctagcaaaaacattgacttaattaatttcgagaaattcccgaccttttggggttttggtctcgattaccgggcccttctcgatttctgttttcagaccggaaaatttctcgggtttttaagaggctctcaatttcgactcatgggtattaggaaattaattcctggtcacggattcgaactcaatgctcgactcgattctcgaaattttacttcctagtcatttccttactaaaaaactttctcttgattttttaaatttcaatcctctcgttttccattctctgatcattccattaataataataattattattattttaaaattacttttttaaaattaattttcgcgacgctttaaaattttttcctaatgaattttttaaaacatttccatcctcattagacaaaaatttatgacaaatttgttcattattccccaaaattcattccgttttgtgtaatcgatcggtacattcatcgcgccaaaaaaatatttattcatttttaggacgcaataaaataaaataaattatttcaccgtcaaataattcatcttaactctgtcttcttcttttgcttcgacaataaaaaaaacaacaacacaacgccaacaaaggttctctcaaatttttttttgtcgtccaccgaacaaatg

SEQ ID NO: 110623 - DNA, 1003 bp, Heterodera glycines
  Promoter: Source sequence=SeqID_15567; Location=1572..2574; Strand=-; Gene=SeqID_79850
atcgtctcctctgtcgccggttgaggcgaaagttaaattttaaaatatttgcacaaatctcaaccaatccgagaatttgttctacggatgcgcctttcagcaaatcgtttttccttttatccgattttgttgaggctaattttttgaagaaatcagaatttgcgcgaatgtatggacggactgaactcgtacattttgcgaaccaaaaaaatttcccttccttaaatagtttttaagcgcacttgtttcgttcattacgcttattctacaggtaaatatacctcacggctctccccagggaatattttgcttgtcaaccgctcattttccggagcatttgggtgcatgtttataaccaagtaactgaacggttgactagtcgcttcattgtacgcctccataaagtaattgagtcgttttgggaaaagttgtgacccaaccgttctgacctggagttgaccagacgggttccttgtcagcaccaaataatggctgttagctcgcgctgttctaatgttacgcccgtataggctttgggtgacaaaaataacgctgacattccagttatgtgaaccacgtgtgaacagtagatccagaaaatcgctcccacattcaacattaaatcatcaagcacgaggagcagtggtttcggctggctctggatcaacgcttgatccggcaaaccgttgtgcgtctcaattccccgcttcatcagatcaagaaccgactcattcatctctgaatagcaatacagaatttttgcaggcggcgggtctattagttccttgtaatttctcaacaatttcatcaaccattgcgttttgccactaccagtggcccccgacaaaattagagtgaatggtgcaataaacatttttatgcatatgttaatgcaacttcctgtttatttatatagagatgttgcacacatttgacccattttatccctccccgatttaatcatataattttctttttttttagcacggaaaaataatcaatg

SEQ ID NO: 110624 - DNA, 290 bp, Heterodera glycines
  Promoter: Source sequence=SeqID_18661; Location=2339..2628; Strand=-; Gene=SeqID_83327
cggcgccgccgataggcgccgtcgggagaaaaattgagaattcctaacgaattttgctaaaaaaatagccaaaattttcagaaatttccctcttttccccttcggggctccctcctcccctcacaaacgacctccccaccccttacgacgcacgtggggggggggggggggggagggtgcgccggcgcactccttgatcatgtatggacccaacagatttggtaattaaaatatttaacggatttaaattgtcattccattcgttttgctttatttagccgactttaatg

SEQ ID NO: 110625 - DNA, 792 bp, Heterodera glycines
  Promoter: Source sequence=SeqID_13521; Location=1..792; Strand=+; Gene=SeqID_77421
aattttgaaaatgcccgtgcgctctgggaaaaattatataaggagaaggatttaaaatttcgaaaaagaaaaaatttaaaatcggtgatatcgtcgtataccaagggaaaagggaaaatctcaaaggggtacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacaccagggcaggagaacactacgtcaaaattcacagttcgactccccgagactttggaattgggcacaaattggtcagtagctcagctctctcatcaattatttacccctactcattcaccgcactcggtataaacggtcaagagtttattaaagtatgggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatg

SEQ ID NO: 110626 - DNA, 110 bp, Heterodera glycines; identical to SEQ ID NO: 98226
  Promoter: Source sequence=SeqID_5871; Location=192..301; Strand=-; Gene=SeqID_59501

SEQ ID NO: 110627 - DNA, 173 bp, Heterodera glycines
  Promoter: Source sequence=SeqID_19532; Location=1275..1447; Strand=-; Gene=SeqID_84264
tagttcttatgtttttgttttcatttaattaagagtaagcattctacagtaaactattatatcataattatatacttacagtacatttacggtggtacccttgtaatttacacaaactgaatagattgatttgaatatagtttttgctttattaaataaaagtagcaacaatg

SEQ ID NO: 110628 - DNA, 282 bp, Heterodera glycines
  Promoter: Source sequence=SeqID_38858; Location=647..928; Strand=-; Gene=SeqID_67571
tttccttgattttcctgtttttgatcgtggcaaaaacccaaattttttatatctaaaattgattaaaatataaaggaattatttgacagggttttttaaaaataattcacaaattaaaaaatattttaaaaataaaagaaaaattgcttatggaaatgttttggcattttttattcatcttctcgacttttttcttcacgaatattgcaatggcacctcgcccattcccttctttgccagctgtccgaattgtaagcgctaccattgccgatttgcaaaatg

SEQ ID NO: 110629 - DNA, 445 bp, Heterodera glycines
  Promoter: Source sequence=SeqID_20047; Location=1..445; Strand=+; Gene=SeqID_84821
ttcaaatttcaaaaatttctaaaatcggaaatttctgtgaaattttttgggggggggggtggaaatttagaaaatatgaatgaatttaatacctcttcagctttagaaaaaattttttcagttttttgcctttcgtaattatcgaaatttacaattccctcctgcgtttaaaaatctcagaaataaaatttttcaaaatttctaactgttcttcattcctctaaaatttttgagctttctttttttcccataattttcggaatttctaatccccccctggaatttaatttttctccaccctttctaaattttttcggaaatttcagtttttcactacctctctttgtcccctcttcaggatgcccattttcccgtccttttgctccgcctttgcaccctccggcgtcgttttgtttcctccgccgcagcgacggatgacaaaatg

SEQ ID NO: 110630 - DNA, 106 bp, Heterodera glycines
  Promoter: Source sequence=SeqID_16220; Location=1396..1501; Strand=-; Gene=SeqID_80592
cccgcaatggggaagagatttcagagaatttgtttcatgattaaagtcaagtgatagaccagatttggttgtcagagtttttaatttaaaagttaaagctattatg

SEQ ID NO: 110631 - DNA, 1003 bp, Heterodera glycines
  misc_feature (693)..(693): n is a, c, g, or t
  Promoter: Source sequence=SeqID_698; Location=2427..3429; Strand=+; Gene=SeqID_59218
atgaatgccaaacgtcagtgggagtgtttgtcatgcccaattgaccaacaggtgatggagcattacagaatgacctcacaataaataattatgctaatttgttcagttccaaatcagtgatttggtccacggctccatcgatattttccacccaattaatttgatcatcgacacgccggaattccaacgtcttagacgcgtcacacagcttggtgggttagcacgcgtttttttccaatttcgcttatagactttaacttttgctcaaaatatgcttttgtgataaggtgtttccaatttggtctatccatcgggcgaccacagccgtttttcgcattctttggggtaagtttaaatggctcacattttaccttttcaattgcaagtttgcttttagcaataagatgacaaatattttattgggatgaacgattaacaaaatgaaatagaaatcgctattttttgaattaaaaaagtcgacaacagaaacaatttgaatcaaatgagctaattgttgagagactcttttggaatggtgcacttaacggcctttttcttccaccaaatcttttgtccgttctctttttcttcattttccattctctttcttacatctttccttccctctccttcattcagtgtctatcatctcgctcgtcttatggttgcgcatctttccggcattcaaccggncccttggcattacgccgaatgatcaactttgtgtttccattgccgctctcatccacgaccttggtggctacggatacacacgttcttcccccccccccccaccacaaattttttagactgttaaaaaaccgcctaaacttggcgtttgccttttcatttttccattttaagtttgccactttttaggccatgggcccttctctcatatgtttgagtcgaagttcctccgggaaatgggcgtcaaagattttgaggtgtcgtcaaatatgaaaagggaaatgaaaaatggataatttagcatgaggaaatg

SEQ ID NO: 110632 - DNA, 158 bp, Heterodera glycines
  Promoter: Source sequence=SeqID_35886; Location=1184..1341; Strand=-; Gene=SeqID_65341
tcacaaattattcaacaatttatcttaagaattttggcacaacttatcaaaataatgtcaaataaatgatttattgcgatatttgcggttgagatttaatagccaaaaaacaaaaattttctctaatcgaaaccgaggctcacgggtctcacgtcatg

SEQ ID NO: 110633 - DNA, 320 bp, Heterodera glycines
  Promoter: Source sequence=SeqID_10780; Location=771..1090; Strand=+; Gene=SeqID_74035
agaaacgagtgcattttaacagccgactcttcgcccacccatcaacagagcgtctccaccgctggtccacttttgcccagcatttccttccaaaccggcgaagaaacactttcagtgccctcgcagtctgctgtgctcacaccgggtccggcctttcattttggaattgaatttttaaatgacgcggactaattttggacccaaattctccccccccccaatgaatgccattgctcaacccttaggcacttcaattaacggacaatgtatttgcgcatgtgcgcaacccacaagaacggcaagtgttttggccagccatg

SEQ ID NO: 110634 - DNA, 803 bp, Heterodera glycines
  Promoter: Source sequence=SeqID_10602; Location=1325..2127; Strand=-; Gene=SeqID_73835
ttattttctccgcttaataagaaaagcggtgctacttaacaaatgatcattttgaatgttttttaaaaccaaatgggactactctcttggtttacaaatttcttctgataattagggattcgatttatagttgctaaaaagcgccaaaataaacccccaaaatagttgctaaaaatggggaaatagttgctaaaacctttcaaatttagcgtgtaaaatgacaaaatttattcaaaaaagctacagaattatggcaaattaatattgagatacctaaataatttttaaaattaaaaattcttgtcaagaaagtaaataaataaattttggagatgaatttttgaaaaaaatttcatttctaaggggtatatttttgaaaaatttcgggtcgattcttaggggtgtatttttgaaaattctcaaaaagttgatctttaggggtgtatgaaaatctgttaaaaaattgcactcaaatttttaaattcccggcggcgcctattggcaccgcctgaccgaagcgggtcactccgtcccgccaactccgtcccaggccaactccgtcccgagccaactccgtcccgagccaactccgtcccgccaactccgtcccaatacaaaaagggtcaactctgtcccaagcaaaaattcaagaatttttaaaaaataaatttgggtatgaacaattcataagtcttgatttcaatgaccgatttagtttttgatttatgcaagttcctaatttgtgaaagaaaaacttttaaacaatgacaacttttattttacatatttttagcgtaaaaatg

SEQ ID NO: 110635 - DNA, 174 bp, Heterodera glycines
  Promoter: Source sequence=SeqID_8914; Location=977..1150; Strand=+; Gene=SeqID_69626
tttgggacggactaagcgaagggacaaaaaacggacgaaagcgacgcaatttttggaccgatttcgcctcgagggaagcgacgaatgttccccaaaggcatttaataattaaatatttttgacctgaatgataaaaatttaaaaaacgaaaatttgtcaatgaaataaaaaatg

SEQ ID NO: 110636 - DNA, 861 bp, Heterodera glycines
  Promoter: Source sequence=SeqID_8350; Location=1411..2271; Strand=+; Gene=SeqID_67768
ttcttaagggtgtaaatattttcgtctttttcgtccaattttgctctgacgaaaacgaaacacgaaacgaaaaaaaaaattttgaaaaccgaaaacgaaacgaaaaaactttggtagacgaaaacgaaacacgaaaacgaaactcaaaaagtgccgaaaatgtaggacgaaacgaaaacgaaacgaaatttcgtccatccctgcccctgatggtgaatgaatgaatggacatttggaaatatggacgattaatacatgcatttatgccagaaagttgacatactctattaataaagactaatgagtattgaaatgatgtgcggcaaggcataaaattttttgcaaatacactacaacaaataaaacaaaaaaacaacctctcccctatgaataagcacacctcgccaaaaattttttccaatgcaaaagaaaattattttcctttttttggtggaaaaatcatttataaattttccctttttgtttgcaataattaatgcttgtgttccagtgggccaacttcttgttaacttttgctctaacctttttggtacggttctcttaaacggaggcattatttcttcaacattttcttactcataatttttcattttcaaaaatttttccgtcagagtataattgttttgagttttatttacaattttcaataattttaccagtaaaatataattatcgtattgtttcgggattgaagataaatataaattattaatttgtcttttagctggtgggcttaacagatattttcccactaaacctttaaaaaaggttattaatgacaaatttccggacaaaataaaagatttaaaacgtagaaagctgcaattgtataggaaaatg

SEQ ID NO: 110637 - DNA, 388 bp, Heterodera glycines
  Promoter: Source sequence=SeqID_6295; Location=469..856; Strand=+; Gene=SeqID_61059
tgccttcaaattgctcatctgtgaagccgaaagtatcataagcctttcttctctgagggttcgacaaaatctgcttatgcaagatgtgaagcgtatttgcactaattgtaagacaaacacaaactttataagcttgattgacatccataaaccgctgattggactcgggattcttgtttttgtctggatgccttttaacatttttaaattaaatttttaaaattttttaatttattaccattgcaaggctaatttcttataagcatctttaatgtctttttgactggctgtccgacgaattcccaaagtattgtacggattgagctcataagcaattatattgacgagaagcagtagaaaaacgaagaaaatttttgagtttgagatg

SEQ ID NO: 110638 - DNA, 68 bp, Heterodera glycines
  Promoter: Source sequence=SeqID_39825; Location=1273..1340; Strand=-; Gene=SeqID_68310
acctggctctttacgaaacggatgttgcacaacgcatcagtgacaatctttatgtggacaacatcatg

SEQ ID NO: 110639 - DNA, 97 bp, Heterodera glycines
  Promoter: Source sequence=SeqID_23809; Location=1754..1850; Strand=-; Gene=SeqID_54512
ttaaaatttgcatcaaatcattgcttctaattttaatttaaatacataaaaatttatttttatttatcttaatttagctaatttttttttacaaatg

SEQ ID NO: 110640 - DNA, 778 bp, Heterodera glycines
  misc_feature (17)..(17): n is a, c, g, or t
  misc_feature (23)..(23): n is a, c, g, or t
  Promoter: Source sequence=SeqID_9372; Location=1..778; Strand=+; Gene= SeqID_71141
tgtcatcattcatcacncctccnccttatgcttcatccctcattgtatatcgcacatctgctttgacttttgctttatcccgccgaacttgcccattcggctttatttcccttcagtggggcttcaagtttatttgcttcttggcggccaattctgtcattttattaatgccattatttttattggccagtaatagccatttacggccgtccatcacttttactatatgttctaaaaaaaagccgagagtcgagaatgtattttccaaattcaggattcaagggcataggaactgcttttaatccataaactttccctaatttttttttatcacactcgtccaaatcccgagaataatcaaaaaaaaatgcccaaatacttttactaattatcgtaattagggttgaggaactgaaaactccatggttttgcaagtaaatttaatattttcttttgtggaagtcccaaattcagagtccctatccaaccgtattcctaatttatcttacggtggctaagtattgatcaattctgagcactacaataagccaagagtctcgatcatgataagaaattgcccactaactgttacatatattttccgctaatcactccaaaaatgggtcgtcgttcgttggaacaccaaaaaaattatcaccacccctcctcaaccagcacatccaccccatttgctgctgctcccccctcccatccgtccctccaatgttcctccaccaactaccacatgttggcaccggcccaaggcgggcgcaaaatg

SEQ ID NO: 110641 - DNA, 632 bp, Heterodera glycines
  Promoter: Source sequence=SeqID_6958; Location=1936..2567; Strand=-; Gene=SeqID_63399
ttttagtaaactttcctttttcaatgccacgaatcggacccaccagggaaaattcgtggttagacttagttttatcagcgaatgatcaaattgtaaagcaatgtactattgaaggtggtgttttttcctctgatcatttagcgcaatttttcacattgactattccaaaaacactacaaaaaacaaaattcttttacactcgacggttttttccgtcgaatgtgtctctttttaatattatggtttcttctagaattagcgctttatctaatgagcattttactataaacgaaaaatacagtgcctttaataatacactgctagaaaccttaaacgagtgtattccaatgaaaaggattaccaaaaaagatatgacccctaaatatccagcatttaattgcatccatcaaagagaaagccagactgtatagacaatgtaaaactgatccatcaaaaaaacactatatgatagcattagtttgcacataaaaatacaaacaaataaatttcattctcaaattgaaaaaaggctatttcaaagggaaaaaattcgatttttaaatacatacaaaaatacgatgttaatccctttgaaataccaaatttagtttttgaaaacaaatgctatcatg

SEQ ID NO: 110642 - DNA, 1003 bp, Heterodera glycines
  Promoter: Source sequence=SeqID_17663; Location=275..1277; Strand=+; Gene=SeqID_82194
ttaaaatgccaattttaaatgttttatttttggaaaatgaaaatattttcactttattgtttcaaaaatattttcactttattgtttcatattcttctttttttctccatcaaaattgggtccgtttttcagaattccggaccaaagagtctgctactaaaattggttggtatgaatttttcaaacatgatttattttggcattaattttttaactactctacctacaatttttttagttttcagcagccattttaattttttggctcttaaagtcgctaaagaacaaaacccgaataaaaaattaaattccaataatttttaattcgattttataagcattgcaaaaataattagattttaagaaatttaattatacactttttttttcttttaaatttattaatgacatttcattgaaaagatgtgatgatgaagctaatattaaaaaatggaaatcgattcctgggcttggctcataagaaaggtgctccttcttcgcttggctattaggttaatgatagcctccggcgtcggctgggagcaattaaagccaaatataaaggcccgttttgtgtttcccatatcatttcgccttttctgtcacgcgatttcctgtgaaaattcttaaataaaagaaagacataaacaaaatgccgaaaatggactaaaattttacaattttattattttaaatgtctatttaaagcacctcaaatttttaaaaatatttgaccaatatttttttgtttaattgttccttttatcacattataattaattaatttaaatcaattatccgttaattaaaatcctttttttatttgtcttaaaacgatttgcttggatactttctgaattttcttacagaattaagttaaacctgttaaaaaacttaacttacttttacatttaaatttgattaattcttgaaaatttaaatatttttattttattttattttaaaattttatttaaaatgtcccattgggtttggcacaatg

SEQ ID NO: 110643 - DNA, 291 bp, Heterodera glycines
  misc_feature (262)..(262): n is a, c, g, or t
  Promoter: Source sequence=SeqID_6757; Location=928..1218; Strand=+; Gene=SeqID_62769
taggggcttcatcaaaaatgaacacatcagtatttcgaatttcaattgcttcattagaaccattttcaattgatgaataagaattgctatttaaatctaatggtaatttaaaacggttatgcacagttcgtccatttttaatagtgttgctgcaattccactaaaagccatgttcgtaacttttttaccaaaaccacgggctaagtgaaataaagcaatttgaacaaaagattttcccgtcccacctggtccatcaatgtanaaacaatttcctttatttttttcaggatg

SEQ ID NO: 110644 - DNA, 285 bp, Heterodera glycines
  Promoter: Source sequence=SeqID_32090; Location=1..285; Strand=+; Gene=SeqID_62402
aggatcttttttaaagaattagattcatactctactgatcatcaaaattgtaatgaaagtagggaataaaaaaataaatattttatgatcagtaggaataaaatgtttatttaatcgtagaatactttagtttttatttcattataatctttttaaaattaatttattgtatattctatttacttatgtatgtatttgccatgaataatattctgtcatataaaaaaaattcatttttaatgttttaaattaatttgtttttaggaatatttcatctttgaaatg

SEQ ID NO: 110645 - DNA, 240 bp, Heterodera glycines
  Promoter: Source sequence=SeqID_1840; Location=665..904; Strand=-; Gene=SeqID_76283
ttttgccattggtccgttaacagcggtccactaatggcggtccgctaacatacatagaatacgcatactccattggcacagacagcacagtttttttatgcaaatggaaataaccgaaaaaatgaaaaaaccaattaaaaatcaaattggaaaatgaggaaacaaacagttggctaaatgaatgacaataatgtcatgagtagggagtgtaattatatggatataaaatcgcgaaatatg

SEQ ID NO: 110646 - DNA, 593 bp, Heterodera glycines
  Promoter: Source sequence=SeqID_10530; Location=593..1185; Strand=-; Gene=SeqID_73759
aaacccggcactgtctgccggtcggccattcagtgttttttgaaactgttctgcatgcaactaaatctacctgtcggtcaactgtcgtccattcagcttgctgtgactgagtttatgttatgtcaggttgccgggattagtttgtttggaattaggattttgctttctcatgcctaattatatatgcaaaactttagaacgtaaaacaccgaatgaaaaagacaaatgtttgttggactgactttccgcatgttgtatcgttgttgtaattttgagacctttattcttttaagaaatgaagtcactgactcacgaccttcatcagtgcttcaattcccttcaatgttttattacagtctaattgaattttcagatattaaaaagtaatcttaatgcatgttttgttgttcattcaaaaattgaattttcatcattgtttttgtttgtatttgcttcatttatgctttttcgttttttttaattttttagcagaactatttgtattttttaaatatttattctgcaactgccggtcggctatttattttttcgcatttctgctgacacaactgccggtaggcttatctcaaatg

SEQ ID NO: 110647 - DNA, 366 bp, Heterodera glycines
  Promoter: Source sequence=SeqID_14408; Location=2140..2505; Strand=-; Gene=SeqID_78446
ataatgctaatgctaaacgattgtgatggccaaaaaacggttggctcggactttgcgaccgattgccccccgcccccccccccccccccgtgagagcatcggttggcttttaatcgacagatgaaccccagcgcagcttcattaatattcagcagtgccacccccgtcgttttctgatcattcaatttgctttttctttctttcgtctctcttctgtccaacattcgccctcccccctcattttaaccaatttttacctattcattttttctctggtcttatcaactaatctatttgtgaattttaatttatcttttaaaagattgattttgtcaattttttttaaaaaacaacaataacaacatg

SEQ ID NO: 110648 - DNA, 382 bp, Heterodera glycines
  Promoter: Source sequence=SeqID_15052; Location=1129..1510; Strand=-; Gene=SeqID_47263
ttatcaacaactacagcagacaaattggctcactttattttgtgaaaatattcacaattaattgtctttatcctttaaataattttgagattttaacaaaattattttcgctgattttatttggtttaagtttcacatttttgactgttaagcgactttggagcacgtgggaacaatttgcaaaaataaattcccatcaaacataattaattctaactggttttttctttttgaatttatattttattttttgtttttacattttcatccttgttaatgacttgtttaataatatttttattttttcctccctttttccgttcttttattttgtgacaaatttttgtccattccttttgcattattttagctataaaatatg

SEQ ID NO: 110649 - DNA, 866 bp, Heterodera glycines
  Promoter: Source sequence=SeqID_26064; Location=1..866; Strand=+; Gene=SeqID_56810
atgcaaataattttgcttgtgctgtccgcatttattctttttcactcggtcggcgcaaaagaattgccatcggcgctgattcagttgccttcccgcggtccttcttcattgaaaatgcgagaagcgccgatgaatcagatctttctgcacggcttcggcggagatgtgcaccagggatgggccaaattgaaaaataaaaagcgaaatgcgaaaagcgaaatttgcgaaactgaaaaatgcgaaatgaaaaaaaaagcgaaatgcgaaaagccaaaaaatgcgaaatgaaaaaaaagcgaaatgcgaaaagccaaaatatgcgaaaatgcgaaaagcgaaatgcgaaaagcgaaattttttctacaaatttttaatagttaaaatcataaagcaaaaatcattttttaaaattttattccaaatttaaaaatcaataaaacgctttattgaggcgcgctttttccaaaaaaactttttgggaagagggggcaggcggcgccgggaaaatttttgaaaatttgattaaaatttgttgacagattttcaccaaaaaatcatcaaattttgtgatttttgtatcatttttctaatgagaaataagagttttggcgcgccgctgagaacagtttttcagcaaattaccaaatttcgcgattttgggccattttctaagaaaaataggagttttgggggcgcggcggtgccgataggcgccgccggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatg

SEQ ID NO: 110650 - DNA, 313 bp, Heterodera glycines
  Promoter: Source sequence=SeqID_15417; Location=588..900; Strand=+; Gene=SeqID_79685
agtgggcggttcccattttttggggtccccgaccacgaatctttcaattattttgaccaattccgatttcctaatctaaatttgaacaaaaaatagtaattcgaaaaattcagaatttaaatttatttgagttcaggttattgattagaaattagtcaaaatacatatcagattcgcgatcagcgacttctaaaaccccggatcacttttcatatagcgccaaaaacagcgaatgtctgaacaatcttttggggcatgcccggcttaaaaagagaattccgtctaaaaagtctcaaattactttcagttaatg

SEQ ID NO: 110651 - DNA, 905 bp, Heterodera glycines
  Promoter: Source sequence=SeqID_11662; Location=1151..2055; Strand=-; Gene=SeqID_75124
tctctctaaaattgaattcaaattaaatttaaataaaggacagataattcgctcatctttcctagcatgtcgattgtgaatggcaaaagtggttccaacaaaaaaactagtgtatcaatttgagtttttggaccaatcaaattttcattttcgaataaccttacattttttatcatttcaaaaagaaatatatatataaatattgcgttaattcaaaagtactgatcactgcctttttgtgttgttatgagcttttcaattatgtatcactttctaaactcaagagctttacgtttgctaaaaaatcctaattaaatgtgaaatgaatgtggtgtgttcaacgagtaaaagtggtcaaaattttgcaattttttgcgctttatttatttttattagtattactgtaaatttcgattaccgtcccctccccgcgccggcatttccatggcaacctttcctttttgggttctttatgtttttgggtcacacaccaaaattttaaaaaacaacaaaaatgacagaattctcacaaatcctattctcaagctgatccatttgacgagaatttagcaaccatgaccggaaaatgcgtcagtgatacaaatattttaaaataaagttctgcagtattaaatattattgtaggtactgtataaagggaaaattctataagaacatcgttctgaagtccgaaaaggaacttgttttttgacatttaaattttcactggcattttacgggagccttattgttaggaacaattattgtatttatgcacccaaacaatactgtacgcgactgtgaatttgcgcatttttaaattttagtttttgacatgtgaccccaaaacaggaaagtaccttttttgaatccaaagattcttcccccccccccacccgaaaatg

SEQ ID NO: 110652 - DNA, 1003 bp, Heterodera glycines
  Promoter: Source sequence=SeqID_14716; Location=2247..3249; Strand=+; Gene=SeqID_78845
aaaattctcattaaaaaaaaaagaaatgttcgcaaaaaaatgacgaaaatatttattgaaaatgcaaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgtagaaatgctatttttaagcccctttcttcatagcatatgcgcagaaaaaatatgttaatccatataatttacaaccctattaattagctttaacttttgggttttataaaataaaaataaaataaaataataattttatattattttcactttaaaaaaattaaaatttgaatttttaaaaaattttaaaaatttttttgaatttttaaatttcccggttggtcccggttcccggtcccgaagaaaaatcgaggtcctggtcccggcttctcaggcccggcaagtcccggtcccggttttgcccaaaattcccggtcccgtggcactctatttaagaggcttaacaaaataaaataaaaaacataggtggaagatattcgaagctgcgggcttgtcatagccaaaaatgcaacaattttatatcattccaaggagtattctctccgttccggaatattttttaatctgaatgattaaatcgcaaaattgccgattttctctatttttggagcattaaaacaataaaattgaaaaaattaaatatgcaattaatctatttttaaaagatttaattgctttttcggcttttagagataaattgagcgcttacagttgggaatgttaagtttagccttggaggccgacaaaaatattttaattaaaatttttacgcacttgcagaaccgcatg

SEQ ID NO: 110653 - DNA, 258 bp, Heterodera glycines
  Promoter: Source sequence=SeqID_8617; Location=1..258; Strand=+; Gene= SeqID_68692
ttcaggaaaaccaggtataggaaagccaatttgcaaaaaaaaatggcctggacctggatccagtaaaaatctatgataaggcactgaacgtgaatgtgtgtggtatttaggggaacacgaaaaatcaaattagataactaattgaaggaccaagaattttttatccatttcgaccccgcaccctgcacaaaaaaatagaaattgtaatcgaacccgctgaaaacaaattttgccaaaaactcacatcctcttacaatg

SEQ ID NO: 110654 - DNA, 430 bp, Heterodera glycines
  Promoter: Source sequence=SeqID_20814; Location=1196..1625; Strand=-; Gene=SeqID_51394
ttgttgttgtcgtttgctcacaatgatcagaattttttgcattttcgccgtcattgttgttcagaaatctgtgtttacaacatttatgaagaatttcaattttttcgacccattttgcttagaataatctattctgatatttttatatatgtataatataaaatatacatacaaatacttttgacgcagcgggattttgacgggcagcggcttccttcattgacaaaaaaatatatttggcattatggtttttttcgcgttagtttgaatagaacattaaaagttggcagcgccaaactgaccaccgacccaaagaaactggcgcgagcgctcgtctaagacacgaagcggtcaaaatagaaatttctctgttctccaaatttttaaatgttttgtgacatttgcaaaaaacaaaaccactggactcatg

SEQ ID NO: 110655 - DNA, 255 bp, Heterodera glycines
  Promoter: Source sequence=SeqID_24088; Location=1281..1535; Strand=-; Gene=SeqID_54783
atcgaataaatccccacttttcatggcaacttttttgttggttgaccaatttttgttaatttggtatcataaatgcttttaatgtttatatttgtataaggtcaataactaagaaatgtgataatgttatccggtattcaaatatggggagactcagccggctgaatttggaattaatttgtgccattgctccctcacagtgctgccgctccctctgcccgccttcgtccccctcaccttcagtgcgtctccatg

SEQ ID NO: 110656 - DNA, 57 bp, Heterodera glycines
  Promoter: Source sequence=SeqID_22051; Location=1533..1589; Strand=-; Gene=SeqID_52685
atttaattaaatatacaaaattattttttaatcaaaaagactgaccttccaccgatg

SEQ ID NO: 110657 - DNA, 190 bp, Heterodera glycines
  Promoter: Source sequence=SeqID_15127; Location=790..979; Strand=-; Gene=SeqID_79309
gactcggatatttttgtaggtggtggagatttctcacatgacaaatcgttttcaaaagtttgaggggctgttggtataaacgatgacgatttttcttgtgggaaatcttcatcaggcggttcgatttttaaaataaaaaaaatttagttttcaagtttctgtcggaattaatgttcgggattcaaaaatg

SEQ ID NO: 110658 - DNA, 209 bp, Heterodera glycines
  Promoter: Source sequence=SeqID_36201; Location=1..209; Strand=+; Gene=SeqID_65580
ctatttctgagcattttttaaatcgaccgcgaaagttttgttgtccaccaacatttttggttttaggaaccgatttgtcggtcttttttttcatttctaatttccgtcacaatttgtatataggagtgcattttttgttgtttttgggccattttgtaaaaaaaaaaaaaaaaaaattgtatcccaattttcaggagaatgtccgaatg

SEQ ID NO: 110659 - DNA, 67 bp, Heterodera glycines
  Promoter: Source sequence=SeqID_17510; Location=2549..2615; Strand=-; Gene=SeqID_82015
ttgtatccaggcaggcatcagcgttaacgatggccttggaagaagagccactggatgcgtctgtatg

SEQ ID NO: 110660 - DNA, 492 bp, Heterodera glycines
  Promoter: Source sequence=SeqID_41899; Location=1..492; Strand=+; Gene=SeqID_69933
atatatatatatatatatatatatatatatatatatatatatatatatatatatatatatattgtacattttttctgaaattagccttttattttttctttatattcaaaatttctttactcttttctaatacaattttttatacattaatgcactttctttgtgtttgtaagtaagtaaaaatatttgtcggaaataaacaattttgtcaaaacacaaaatgtggcaaattacggaaatttttttgttgttacgaaataaaacaaaagttttccatcagttcaaaatttcaaatttttttaaaaattagacttatttatctgatttttgaatttcaataaaacattaagattaaaaaatgtattatttcagccaattaacaaaagaaacagtcatttaaaatgaaaacaatgactaatattgtaaaacattataagaaattgaaaccaaaatatttttaatgaaaaacaaaatgccggaatatgctaaatg

SEQ ID NO: 110661 - DNA, 307 bp, Heterodera glycines
  Promoter: Source sequence=SeqID_698; Location=1..307; Strand=+; Gene =SeqID_59219
tttgctgacgctgcgagtccttttgaccaacgccaaaattattcattttctgaaacaaaacaaaaaaagacatattaaatgtaaatgtcggataaatagaaaaactgacaaaacaatttgtttttcttttccattaaaaaaaaaaataaattttatgtgttgaaaataaaattcaatgcataaaaatttagtgccattattttttcgctaaaaaataaaactgtaataaaaaaaattttccccctttttagttaatttggtaaaataaacatcttattaatatatttgttttgtataaaacattatg

SEQ ID NO: 110662 - DNA, 166 bp, Heterodera glycines
  Promoter: Source sequence=SeqID_2879; Location=1891..2056; Strand=+; Gene=SeqID_82115
tttttgtcagaaattgaattcaattggagcaatgatttgatgagtagtgaatttgaatggtggtaagagattgaaatgactttgcttggtgtcggccagcaagtgctgcagtggtggtcaggcacagaaaaatgagtgggaaatcaataaacgacctttggtgatg

SEQ ID NO: 110663 - DNA, 231 bp, Heterodera glycines
  misc_feature (10)..(10): n is a, c, g, or t
  Promoter: Source sequence=SeqID_40717; Location=1..231; Strand=+; Gene=SeqID_46633
cgagaagaanaccttttttcacagagcaaaacagtccaatgtattgccaagcttgatgcagatttatttaatcagccgctttatctcgtcaatttctgtgagttggatattgaaattttgccaaatagcagtaattttctgataatagtgggtaacgcagcagcagcggctacgcgctaccattttgaaattgtcggattgaaaatgtatgttaagaaagtgtcattaatg

SEQ ID NO: 110664 - DNA, 717 bp, Heterodera glycines
  Promoter: Source sequence=SeqID_11580; Location=3603..4319; Strand=-; Gene=SeqID_75022
tcatcgcaaatttcattcaaatttgtgaaattttcccggcggcgcctatcggcaccgccggataggcttttacttaataatcctgtagaaattgagtcaaaaactgcgtcatttggtcaattttagacaaaatctgttaacaaatcgcattaaatttcataaaatttctcgcagatgtcgataggcaccaggtatggcacgaaaagacttccgatttccgacatttttggggtcggaattccgacttccgaaatttttgatgaaaagtcggaaatttttttaatttttttttttcaaaaaactagtaagttttgcacaatttctgttaataaattgaactgaaatttttaaaaatttcccggcggcgcctatcggcaccgctgtaccctcctctaagttcctaaaaagtttttgaaaaaatagcgctgtaaaaaacgtgtaaatagtcactcctttttcccaaaaatgttctaaaataataaaaatgacaaaaaaagattttgataaaataattgaataattttttcaagcgaatatactaaaaacatttgtgaaataccttttacttggttaagaattaaaaaatttagcctattaaaatatttagaaatttttttattatattgtatattttttgaaaaatttccgatttccgacgtttttggggtcggaaatccgatttccgacacttccgaaaatttttggagcctcggaatg

SEQ ID NO: 110665 - DNA, 1003 bp, Heterodera glycines
  Promoter: Source sequence=SeqID_6913; Location=890..1892; Strand=+; Gene=SeqID_63282
gaagtgcttcagccacaagtatgtgccatggatatgatgaataggcagaagaaggtccatttttgaagtcaaatcaaaaaaaaattgaatgagctataataaaaatgtaaataaattattataaagtatataagtaaatgaaaagcactttaaattgtaaatgcattaaattttgtaggatcacacgcagattttgagaattgagaaaaaaagatatttaaattcaaaatctccaaatattacagttatcattttttaatgtaaatgagtatcgttttgcgttacacttgtttttattaccaaataaaattttggaattaaaaatatatattttttaatttataaaggtctaaaaatttatgttgttattcctggatgatcctaagaattttaatttatattctacattccttaaatataaaatttcggtatttaaatcgttttattcaaaatttttggtgtagcaaaaattatttttatgcaaaatgttgatcatattttcgcaataattaagctttaaaactttaaactacattttgacaaatattaacatctttttaattttacatccgcattaatatttattataattattcaatgttttccaattttttacattctcttgcctttaaagtttctatctatagttttactttcatttcctatttttcacattatttactttaaggatttttagtgatcactggagttgtttatcttttgaatttgttattttttctgtgaactttttcttgatacgttagacaatttattagattttgagtatttccagataaaaacatctcctctttatttttttcatataaaaaagtaaacattttgtatatttactgtatctttctgaagaaatattttcttatatttatgtctttgaaataaaatcataattttaaaaatttgtttgttttattaataaatattattttttaatttatctattttatgattaattgctcattattttcatttaagaaaaattatg

SEQ ID NO: 110666 - DNA, 135 bp, Heterodera glycines
  Promoter: Source sequence=SeqID_18119; Location=873..1007; Strand=+; Gene=SeqID_82699
ggtgaaaaatgtttgacaaaattctaaaaattttatttaaattccaatttttccgcagggaatggacaaattggcgaatgtcaaagaaattcaggtcctaattacgtaattaaatcacaatttttaggggtcatg

SEQ ID NO: 110667 - DNA, 171 bp, Heterodera glycines
  Promoter: Source sequence=SeqID_43729; Location=961..1131; Strand=-; Gene=SeqID_71335
agtttcgatttgggccagaccaattaataggtcagaccaattgaaagatttattatgggataaataactatgtcaattttaaatttaaatttgtgtgtttggtagggagggcacctttttgaaaagttcggcttgtacagtgccacttcgacactccgccgttgggccatg

SEQ ID NO: 110668 - DNA, 388 bp, Heterodera glycines
  Promoter: Source sequence=SeqID_6295; Location=467..854; Strand=-; Gene=SeqID_61060
tctcaaactcaaaaattttcttcgtttttctactgcttctcgtcaatataattgcttatgagctcaatccgtacaatactttgggaattcgtcggacagccagtcaaaaagacattaaagatgcttataagaaattagccttgcaatggtaataaattaaaaaattttaaaaatttaatttaaaaatgttaaaaggcatccagacaaaaacaagaatcccgagtccaatcagcggtttatggatgtcaatcaagcttataaagtttgtgtttgtcttacaattagtgcaaatacgcttcacatcttgcataagcagattttgtcgaaccctcagagaagaaaggcttatgatactttcggcttcacagatgagcaatttgaaggcatg

SEQ ID NO: 110669 - DNA, 789 bp, Heterodera glycines
  Promoter: Source sequence=SeqID_4744; Location=4210..4998; Strand=-; Gene=SeqID_55589
attttttgaaaatgtcgtctaattgcgtggaaatgaatgaattaattaaatttgagaaatgatcgatctcacggattgaaatttgatttgattctctcatttattctctcagaaatgcttttgttgattttctttcattcgaataaaacacacatttgatattaattgaacagcttaagcctaagcattttttttaaatttgcatgtcaaaaatgccaattgagccatttaagaaaaaatttagttggtcattgaacggcgggggggaaacggcgggggggaaacgattcgggggggaaacgatgcgggggggaaacggcgggggggaaacgaggtgccctcgcagaattccgggaccgaggaaaaataaataaaaaatttttttttcttgtcttttcttttgtctatgactttttcatcaaatatttggtttctcaaaatttattaatgaattttgggtaaataaaagtgctctgatcacggatttgagttctatgtgtcttgcaaaatcaagaaaacttcaaggaaaatggggcaaattttctgaaaaattagaacattttcttaccatacatcattaaaattttacaaaaattttttccttttctgaaaatgtgaccccaaattggcaaaaatttgtgactttttgacgaaaattatgctacaactcggggcgctacgctaaaaatttttagtataaaaatgtgtttttttctcctcctccgcatcattccattctctcattaggtattcttcctgtatttcccggtcatttttttgctgcaaatg

SEQ ID NO: 110670 - DNA, 1003 bp, Heterodera glycines
  Promoter: Source sequence=SeqID_22165; Location=818..1820; Strand=+; Gene=SeqID_52824
tagtgaaaaaactttttttttgctcaattgttttgaagaaaggagctcaaaaaacgtatttctgcgttgcgttaaaattttttcatttggacgtcacttttcgtcactagaaatcactattttggcgttttgtcactattttttcactatttcgacattttttggaaatttgaataaatttaaatttcttattcaaaataagcaaaaaaagcgtaaattttttttgggcagatatttagctaataatgacttaatttttgctttatcttgttttttttcttctaaaatgctttttaacaccatatttagacatttttgaaagttttattttaatttaacgaatttgaagaaattttgagaaagtttttttttcatatttttgcacttttatgtccatatttcgcgattttttgtccatatttatggccatatttcatgattttatatccatataattacgaaccttattgattacatttaaacaaataaagtcaaaccttttttaaagaaaatttaggttacttactagcatttacaaattctttttcaaaagaaaattctttaattaaattgcgaaatagatatttgtaatgaatgaaataattcattaattgtccgatcactttcatttttcaccattcattctttgtttgcattacttaaccacataatatgagtagtggagtcgcttaatgatgaatgattatgatgagatggccaaacaaataatttgtataaattttcggctagaatcaattacaatacaaaacaaacaaaaattgcccaaaaatggaaaattgtcgattttatttgtgcgcgaaaattgctttgtggacaaaaagcgcgcgacaggaaaatccgacaaaaaaaaattatttatttgtccattaccgcaattatcagcagacagcaaagcactatataaattggtgaatgtgcggtaaaattaatcaaaaaataaattcaattaattaattaactaattaattttgtctcgaaaatg

SEQ ID NO: 110671 - DNA, 477 bp, Heterodera glycines
  Promoter: Source sequence=SeqID_1175; Location=1..477; Strand=+; Gene= SeqID_69395
tttggtttgggctattgtaggttatcaaatttagaaagttttcaggaaagaaatcatagaaaaaatttttctaagaaaatttcaaaaaaaaaccttgaaaaatttttcagcgatatttttggaaaatttgaaaaaaaatggtaattcatccataaattttgaaaaaaaagtataaatatttttcaaataattttctttttgaagtttataaaatattttttaaacaatttttttttcttgaaatttcctttaaaaaaaaattttctacgatttttttcctgaaaaatttctgtttgaaaattttttcaattattttcgttgcgggggaacaatacgggggactctgtttataaaacagcaaactggtgggattttacagccaatcttacgatataaattagtggtcacaaatcccgaccaattcctttcaatcggcatcatttagccattcatttttaaaggaagtgtcaccgtatg

SEQ ID NO: 110672 - DNA, 380 bp, Heterodera glycines
  misc_feature (11)..(11): n is a, c, g, or t
  Promoter: Source sequence=SeqID_28498; Location=1..380; Strand=+; Gene=SeqID_59109
aatagataaanttcgaaaaaaattattaagaaaattcaaggaaatgtaaaaaagtcgtttttttatttttctggaaattcagaaaattagtttttatacgagacggcgacgttttaggggtgtacccggtctgtggatggtattctgagttattttctgaaacccgaccccaaaaaagttataaatcgaaaatttctgaaaaattccgaattttatcaaaaatttcggaaattggaattcagtgccatccctggtgtggccataattcgacaaatgattgatttttgttttccaatcaaattgtttagcattttcttcgtgccaatgccatttcttccgtcagttacgaaattcatttttctgttcgtgcgccgtcaatg

SEQ ID NO: 110673 - DNA, 365 bp, Heterodera glycines
  misc_feature (20)..(20): n is a, c, g, or t
  Promoter: Source sequence=SeqID_34196; Location=494..858; Strand=-; Gene=SeqID_64047
gggtataattgtatgtattnggatgtttgtcggaggttataattgtattgtattggatgtttgtccgcgttataattgtattattgtattgctcatctcgtattattgctctgaataaatgctaaataccaaaattgggagatcagaattgcaagcggctgattgcatttaaaattatgggtgttgcgagcttaaaaattcattttttcaacaaagtgtaaatgtttcaactctttttgtcgcctccggcaatttctcaatttaattgcaacatagaaattcaaaaaaataaacattacgttgtctgtgggtcctttgtctagatattttgaatgggacaaactgattgtctccgcgtggccatg

SEQ ID NO: 110674 - DNA, 119 bp, Heterodera glycines
  Promoter: Source sequence=SeqID_14129; Location=2093..2211; Strand=-; Gene=SeqID_78126
tcgtcggattcgccgtcaaaaatcagacatcgctcggacggaacaattcaaaaccgcaccggtacttacgcattcgataggaatcggcactttttgggtggacaaaataaacaaaaatg

SEQ ID NO: 110675 - DNA, 1003 bp, Heterodera glycines
  misc_feature (744)..(744): n is a, c, g, or t
  Promoter: Source sequence=SeqID_4672; Location=2355..3357; Strand=-; Gene=SeqID_45876
ttaaagaagccctcttttgaattttatcaaaaacaaaaggggggacccttttgttttgcaaaatttttttgtgataaaacatgaaaatttgatatccggggttttagaggtcgctgatcacgaatctgacacctattcgaggttatggaccccaagaacaccagtgaataattttcatgactatatattaaaaaattttgcaaaccaaaagggtcccccctttttgtttttactttttgataaaatcaagagtactctttgcaagtagcgccgagcttattcacgtttgaatgcaataattattaacataaaccttcgagctttcggcgtttgaaaactcctttggggagcactccacggtacaaaaggtaatgtgccattgcgaggtaacacatgcgcgaaagaaaacggagttggccttcattggagagataatccttcgtaaatgtcgcctcccaagattttgtggacaagtgacgaatgctctctaccttctaaatgattaaatgtacagtcaaaattatctattaaatttaaatgagaacaacttcgggaaataatggaggcattgacgttgtgcaattatttatcaaacaattaacaaatttcgtgctaaaagttttaaaacaagtataggtatgtaaagcaagcaaagcataaatgagctgtgtacatcttttgggccttataaaatatataccgtatttctccaattagaagacccgagttttctatgtttcaacncctcacatttacaaatttgcaatttttggtaaatatgtattcgcgctttttcaaaaaactgatcaaaaaaatgccggttgcccttcttaaatatataaatgaaaactcactacacgcactcatttctatcagaaacaattttttgttcaaatttagtgtataaaagggaaggagttttttcaatgcgctcacttacaacatcgcctctcttcattcaacagcagcgccaacttaccccacagagcgacagcgacacatg

SEQ ID NO: 110676 - DNA, 67 bp, Heterodera glycines
  Promoter: Source sequence=SeqID_5228; Location=800..866; Strand=+; Gene=SeqID_57338
ttttattttttttaatggaattttctttttatttatagttttacattttaatagatttaaaaaaatg

SEQ ID NO: 110677 - DNA, 1003 bp, Heterodera glycines
  Promoter: Source sequence=SeqID_1787; Location=58..1060; Strand=+; Gene=SeqID_75973
cactatttcttcctttcgttttgagaatttttgactttctaccaaatgttcgaatttgattccgggactcttaattgatcgagatggaggtcggattcacaaccagcgccctaaaccctggaaacattttttatacgagtttaaaaccatttttttttgtggcgtaccaactgcactactgtagtaccaaaattagtaaatcaacccgaactagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatgagagagtgctggatctcagtcccagtcatacaaaacatttttgatgaaggaggtagagaaaacaatttcaatagagagcacaatgggaagggagttcatgtctcttcttcgctgattcttttggtaagagacgcagattcctcgctatgttctctattctctctctgtcttaaatctcttcccataacactctctttttaattaatttttctttattcttctttaccaaaaatgcttttgtatgactggggctgaatataacaccctctcacttttgcgttatctctctccccatcttattttccgccaaaagtcatttttgaaaaattgctttaaattttaaaaaattatcccaattttaaaaatagcgttgatattacgttgatggcataatgttatgttgatattaaataaatatcaacgtcaatgttgatatttattaaaacaattttcgctaagagaaaaatgttgatttgcctttctctaatcagcacttaatcatatgttgatgatcttttttccaattacattgatcaaccaatgtacatatgtcatcttatctctgatcagagaacaacaagcaaaaaaaaaaatgaaggacgatg

SEQ ID NO: 110678 - DNA, 627 bp, Heterodera glycines
  Promoter: Source sequence=SeqID_11369; Location=1974..2600; Strand=-; Gene=SeqID_74759
aagaattagccaaattttgtattattaatttaagcaccattttttatccggaccaatcggttcattgttctgctgctttttctttatttattctgttgattggtcattacaaaaaaaaaacattttgccgtctttaacgatgcaattattgtataatttgtacaaaagaccaacacaataatttgtaatggatgcaacaggaaactaaggctaatccgaacggtttttgtgggattgggggggggggggggcggggagcaatccggtacggagggggggggggggcgttcgggaggaggggcactcccgccacttttgtgtcttccatctttccgaatggccaccgctcattccgcgtcactgttccttccccagccgatggtcccccctgttccgctgcttttcctttcggccttcgttgcttttcatcttggcttttctggtgcccttcccccgtctctttttgggtggggcggtcgcccttctgccgctggtcagttttggccgtcttttttatttcgttgaatttggttttaaggcaatggcccccctcggccttcgttcagtcctttcactccctttttgtccccccaatctcttccgccgcctctctttggaaggcgaatg

SEQ ID NO: 110679 - DNA, 558 bp, Heterodera glycines
  Promoter: Source sequence=SeqID_3370; Location=575..1132; Strand=-; Gene=SeqID_84400
ttcctttttgatcatagtgccaatttaaattcagtaaattatttttattttcaatttttatttcgaaacaaaattttcctttcccttccattaatttaattaattcacatatatttcttttttgttgtcccaatttggcacaacacacacaattttgccgaatttgtttttatttgaattcgtcgagttgggcaaaatgcgcgcaaaattcgcgcacaattagtaattaaaaaaataatcatttattcgcgcacaaaactgcaccagatcattaaccaatgccatcacaatgtgctacaagtgacaacaataatcagagtcagtcatcatcaatcagcacagagtccacctcagcgaatcaacacaaaatacataaattttgaatgtgattatttgttgttttttttgccggggggggggcggcgttttgatcaaaaacagacaacaaaggcggggggacgccaattataaatttggggcgcaattcgcgacaaattcattcattcaatccaataacaaacagtccatcccaaaaattaaacttttttctccataatg

SEQ ID NO: 110680 - DNA, 762 bp, Heterodera glycines
  Promoter: Source sequence=SeqID_332; Location=2463..3224; Strand=-; Gene=SeqID_47501
aattataaataactttattattaaatttagtttaaaatgaataacactaatacaacgaagccagacatacaaattttgaattcccctgaaaagaataatgaaacccttttgcatgtattacttttttctcattatatcattgcatttcctgtgtttttgcttttttggttcgttttaattaggtggcttaaaagccacggtcatctatcgcccagcgaagccgagacagtaatggaagagattaaaaaaatcccccgccagccaccaatatttttcgcagcaaaataatgcaaagaacatgactacggtagattaatgttttactgtagatgcgtgcgtacgcatcaacttactcacgatattcaacgctccagaaatgcgtacgtccatcaaaacatatttattcttgatgcgtacgttgtctacatgactatggtagattaatgttatacggtagatgtgcgtacacatccacatactcacgatatgcaatgctccagaaatgcgtacgtccatcaacacatacgtattcttgatgcctacgttgtctacatgactatggtagattaatgttatacggtagatgcgtgcctacacaatactccaggaatgcgatacttacggcagatgcatcttacgcagacggacccacctctcgccttacggaccctctctcacgccgggtggaccctctctcacgccgtgcggacccctcacacagagcggaaaacgcaggtgcggttttaatttttaaaaaaaatg

SEQ ID NO: 110681 - DNA, 1003 bp, Heterodera glycines
  Promoter: Source sequence=SeqID_13704; Location=1184..2186; Strand=+; Gene=SeqID_77620
ttaaaaggaagaaggataaatgtatttggaaatgtttattcaaaaatttatttaaaaagaaattctatttaattctttaaaattatgaaccgcaaaaaaataaataaattttcaacacttaaaattaattatcctgtctatttgaaaaaccatgggcggcaactaaacccaaaaatgccaaattgggataattagtgcacggacgggaccgtgattatttctcgcaactggaaagacccgacccaattttagagggcgaggggggggggagttttcctttttccttcgagggacaataggaaacatcaacaaattttggttaaatcaacaaaatttggaccaaattgttgcttaatttttagtcatttctctaagaattgataatatgttgattgattctgaatttgtttgattttttcacatttttgtctcaaaatctcgacaaaattccattagcgtttgaagaaagcttttgcttcttcttcatcctttgcctcccttttgctggtcggcttccgctcggcctcggaattggccgtcccatcatttggccaaatgagatttgactccccagcagacggccaattcaaagcatatttttatatcattttaaagggtgaaaaatgtatatattgctgaaactgaaattaaaaaatttttttatttaaaatatattttatttattttacataaagatttattttatgtcattcattttgttaattatttggccttgcataattatgattaatttctctgcgggtaaaacaacaaaaacaaaatccaaaaaacaataaaaatttgcgaaattttagtgtttggtgccaatgacaaattttgttcgtcccaaaatggcgggtcaaaattgaacgagctgacaagccccggcttcccatcaaaatatccgccaaattccgattgtgttcggataatagatggtcattaccattactttcttaaaatgggtaaaatgccatttttatttttattttagcccccgatg

SEQ ID NO: 110682 - DNA, 414 bp, Heterodera glycines
  Promoter: Source sequence=SeqID_1577; Location=7191..7604; Strand=-; Gene=SeqID_74588
aattataaataaataaaaatattattacataatgttaaaatgaataacaccaacacaacgaaaccggccatacaaattttgaattccccagaagagcctaatgaaactcttttgcatgtactgcttttttctcattatcttcttgcatttcctgtgtttttgcttttttggttcgttttaattaggtggcttaaaagtcacgggcacctctcgcccagcgaggccgagacagtaatggaagagatgaaaaatatacctcgacaaccaccaatatttttcgcaacaaaatgatgcaagattagagaaaacagacactgaactctctcttcagtatgacaaaatcgataatgactcatgctggcggtgcattctcaaaactactcattcttttcatcattcattttacaaaaaatg

SEQ ID NO: 110683 - DNA, 171 bp, Heterodera glycines
  Promoter: Source sequence=SeqID_22316; Location=1..171; Strand=+; Gene=SeqID_52995
tcggattgtatcccgagtcgggatccagaccaagtgccgatcaatcccgatgattttggaaaaacgatcggaacggatcccgagtcagggtccagaccaaatcccgaccaaatcccgattattttggaaaaacgatcggaacggatcccgagtcaggatccagaccaaatg

SEQ ID NO: 110684 - DNA, 1003 bp, Heterodera glycines
  Promoter: Source sequence=SeqID_18171; Location=2104..3106; Strand=+; Gene=SeqID_82754
gatcattgattgccacttggcatttgcaattctcactcattatttaaactcatccaaccaatccaataaaccttattaattgaaaaataaataaacatcaattcgttatgcatttataagaggggggacgggaatgaatgagtgaatttttttagaaaaatttagtgtccataagcacggggttgggcactagcaccgtatccaacccttcgccttaatgcgtaggtcggaggccgcaagccgtgaccaggcactagcacgccaaccccaagcacgggttgggcactagcaccgtatccaaccattcgccttaatgcgtaggccggaggccacaagccgtgaccaggcactagcacaccaaccccaagcacggggttgggcactagcaccgtgtccaacctttcaccgcaaaagcgtaaggccggaggccacaagccgcgaccaggcactagcacaccaaccccaagcacggggttgggcactagcaccgtgtccaacctttcaccgcaaaagcgtaaggccggaggccacaagccgcgaccaggcactagcacaccaaccccaagcacggggttgggcactagcaccgtgtccaacctttcaccgcaaaagcgtaaggccggaggccacaagccgcgaccaggcactagcgcaccagccccaagcacagggctgagcactagcaccgtgtccaacctttcgccgtcaagcgtcaggccggaggccacaagccgcgaccaggcactagcgcaccaagccaatatcaaaacaaaaaacataaaaatgaatgaatgaatgaatgatgaaaaatatttagacaaaattcaattcagtaaatattaatgcatgagaaaggtcagagaattgctggacgtgcaaaagaaagagggggaggagagaacggggggttaattatctcataattcagttctgtacgatttttatttaaatattttttttataaataattttaaaaaactttttagatttttaaaaaaaaatg

SEQ ID NO: 110685 - DNA, 115 bp, Heterodera glycines
  Promoter: Source sequence=SeqID_2060; Location=4239..4353; Strand=-; Gene=SeqID_77588
cggcagagggcggcgggtcctcaatgtgattttcggtatctctgccggagcgacgtatggcctgcagaatgcggacaacctctgcctcttccgagcctttgaataaaagcggatg

SEQ ID NO: 110686 - DNA, 90 bp, Heterodera glycines
  Promoter: Source sequence=SeqID_6065; Location=929..1018; Strand=+; Gene=SeqID_60198
ggtgaacaaagtcggcactttggcaatttttggggagacaattagtttgggttaggaaaatacattgaattgtatttccagaagaatatg

SEQ ID NO: 110687 - DNA, 156 bp, Heterodera glycines
  Promoter: Source sequence=SeqID_22107; Location=194..349; Strand=+; Gene=SeqID_52754
ggtactaggggttttgacgggttgggcaattctgatgacccccgggggggccatatgcaaattgggcggaacaatggcaaaagaatgaagaatgagaaagagacacaagacaagaaaaaaagaattggaggctgagaaagatgccaaattcaaatg

SEQ ID NO: 110688 - DNA, 538 bp, Heterodera glycines
  Promoter: Source sequence=SeqID_37992; Location=547..1084; Strand=-; Gene=SeqID_66949
tcagccccttttaatgcatcccgacagcccctaaaaatttattttcagcattttttgatttttggaaattttttaaatttaattgaaattttttcgaatcttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccgggctcgagtcgagagtgcttcgttctctaatttttttgtcccttcctctgctcttgaggttgcgcaattccaatccataaaatataatgtacctatatgcttacacaacaccgaccattcccttccgcctgtccttgacttttaaggattccaataaaaatgtaaaagcattttttaacaaataccagattgccaatttatgcactaattttttgatttgtaaaatttccaattttctctgtgtccccttcggctttgttcgtttgttttggcactcggcagaaaggaggacgcaaaatg

SEQ ID NO: 110689 - DNA, 981 bp, Heterodera glycines
  misc_feature (83)..(83): n is a, c, g, or t
  Promoter: Source sequence=SeqID_43181; Location=699..1679; Strand=-; Gene=SeqID_70912
tgcaggaaaattattaaatttaaaaaattttttaattgctttttaaatatgccaaaaaatgtaggcttaacttttttagtganaattcgatcactcatattttttgctaattgagcagaagcgtaacaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacagtagataatattcccaatcaaattatcgattgattttcgatcgataatttgagtgtgtctactttttttctctgacatccccttccacaaacccaaacctattggatggggtcgagagagagaaaatacagtatttgctctaattatcccccagtctccaattatccccagtctatgaggaggttaaaaaataatcccccccccccccaaaaaaaaaaaaggcaaaacctattgtaaggactgtacacaaataatcaataaacccaagcctattgcatatatcatatccgaagctttaagtaaattagcaaaaaactccaattcattaaattgtaaaaaatgacgtcatcatgcaaagtaaaaagactccgccccttttcttgttggtcacaccccattgatttttgttttgctttactaagaagttgactccgccttttttgcttttagtttcttttgtcccgccccattttttttctatttaatcacagtttttctacataaaaaaatcattcgtccatttaaaaaaaattccatccacattcgttttttctgttcttcctgcaatg

SEQ ID NO: 110690 - DNA, 108 bp, Heterodera glycines
  Promoter: Source sequence=SeqID_14005; Location=2208..2315; Strand=-; Gene=SeqID_77973
ccttgtaaattttggttgtttatggaaagcttacaaataggctccctaattatataacatttccaaatgggcattttctatgggtgaaaagcatcacatttatgaatg

SEQ ID NO: 110691 - DNA, 912 bp, Heterodera glycines
  Promoter: Source sequence=SeqID_16295; Location=1..912; Strand=+; Gene=SeqID_80683
tcaggccgttttcgtacgaacacatgttttttgactataacttttttctttgtcaaccaaatccaacactgttggtatcttcgaaagcctttcagatgctctattagcctgcaaaattccaaaaaatttcgtcaagtttaaaaaaagttcgagccaaaaaagttggaaaatttggttttttgaactcttctgaccataacttttttgaaccttaacgaaatttttccaaattttacaggctaatagagaacacttagggctatcaaatgataccaacaatattggatttggttgacaaagaaaaatgttatagccaaaaacttgggctcgtacgaaaacggcccgtacgaaaacgaccctgaccgagtttgtcccggattttgttatttttgttaaagttatgaattttctacaaaattttatgaatgggaaacaaaaaatgataaatttttggttctattagttcttaagtttttctaattgaatctaacgcttgtacaagaactcgtacgaaaatttcccccgtacgaaaacggcagtacgaaaacgacccccctcggtacgaaaacgaccctgaccggcgggggagggagccagagaaaagaaaaaaaagaatttaaaaataaaatattaaaaaaagtcaaaaatgatctgtcggtaagggacaccctcgtttcggcgccgctcgtttcggcgccagcccagtttttggactataacttttttctttgtcaaccatagcattattggtatcattcgaaagctctaagtgttctctattagtctgctaagtttcaaaaaatttcgttaatgctcaaaaaaaatatgactagaagaattcaaaaaaccaggccacatgtgtacttttggccataactttgttcaaaattgatcaaattttttagaattatg

SEQ ID NO: 110692 - DNA, 145 bp, Heterodera glycines
  Promoter: Source sequence=SeqID_39274; Location=528..672; Strand=-; Gene=SeqID_67882
aagtaagtgattcagacccgattcattaagtcgggcgataatgcgttcaaaataggatttgatgctatagagcatagtttgcctctcttctgaaagaaattaggcacaacaaattcagaagatggaggaatcgtcgtcaaatatg

SEQ ID NO: 110693 - DNA, 1003 bp, Heterodera glycines
  Promoter: Source sequence=SeqID_1974; Location=5309..6311; Strand=+; Gene=SeqID_77119
cacaaattggataataaaatcaaaaacaaacgttgagcacaaatctttgaaaaattttgcagaatttttttttagtttttttttaaattattcgctattaaatgttaattggcatatgactctgtcgtccaatacattatcaaattggctctgctgaatgattaattgctttaatacccgcttatttatgaatgttttctatgagagcagctctaatcgctctgttcggggcactgccgccgaagtttgaatgaaatgacataatgccaatcgatttctgttccatttcatgttccttccctcgcccataaatatgctctctttccccttaagattgtcttcccttctttcattttgcatttatatatttgttccccaaattgttgtgactttattttccttctccaataaattataaatatttaattggacttcaacaaaacccctcggaccgaacacgctctaaccgattgggctgtaaaatatgtacatttaaaattatttcttgtgaagagcattaattaatttatattttttaatgatttttcgcagattcttgtcttttgaaaaccgttttttattactgtttcaccgccttagaaatttccacgataattaaaatggcactctgattttgagcaaactaatttcttactttttctccacaattttacaaatttttctgtaattacctagacgtagccggacatttttagcaaatttttgtatgaacagttattaaaattaaaagtgaatttaaaaaaacaaaaattttaccccgatttagccattttagagatcttcctacatatcaccttgaataattgtaaagtagtatgagcaactaatatgattaccacattttactcaattcgatctccttttttcattcgtttcccacttatcgtccctttcattatctaattaattaaatatgcaatttacggaagcattctaaaaattggtattgttttttttggtctcttcaaaaaacacaacaatg

SEQ ID NO: 110694 - DNA, 391 bp, Heterodera glycines
  Promoter: Source sequence=SeqID_9908; Location=1..391; Strand=+; Gene= SeqID_72937
tttctatttatattaaaaatgcacttttgtcattttgataaataattagccatacaaaaataattaagcctaatacaccttataaaagccctcccccctcctccttgcgtctcgggccaacatttgttcccattaagtgacgagaataggccacgccccgtgccctcctcctcttcccctccttctgttgggcggcaaatccctttaaaagccgtcgcttttcacagtcttacaaatacattccattctaagtgcacacattcatccaccccatttaaaagcaatttcaaacctaagctttcttttaaagcattgttaaaattccttaaatacctcaactgcacgcagtacagcagcgacatcaaacagaacaagcagtacaagcaccatg

SEQ ID NO: 110695 - DNA, 70 bp, Heterodera glycines
  Promoter: Source sequence=SeqID_905; Location=1081..1150; Strand=+; Gene=SeqID_63632
cgtaatccttttatggggattttaaatatattttttaaaataaatttgtttaaggttaccaggcgctatg

SEQ ID NO: 110696 - DNA, 221 bp, Heterodera glycines
  Promoter: Source sequence=SeqID_44972; Location=1027..1247; Strand=-; Gene=SeqID_72373
attggcgcctaattgcctttgtttggggacgccacgcacgtaagaggccaaaagaaagaaaagcgatgaaaattaataatcaaaacccattaaaaacacttcttagaaatatttggaacttcttcttctctatctcagaatgaattggcaaattacttaaatttcttttagacaattcgcaataattccgtgtttaatcgttctttgaaagtcacaaaatg

SEQ ID NO: 110697 - DNA, 1003 bp, Heterodera glycines
  Promoter: Source sequence=SeqID_19857; Location=451..1453; Strand=+; Gene=SeqID_84612
catgcgagccctgctgctgctgctaatggtcggtcatctgttgctggcctaccaattattttgtatttaccgtatttcttgaaatagagcctccgggggttctatttttcaacccccctcaaaaggggggggaaggctttatttcagcgggggtaaattcagggcggagctgtattatatgaaatacggtatgtacatattgtccttgttgtttttatttttcacacttttttgtatgtgtataaaggcattttttgcgtttttaaaattttgtttttggcatgggtaattaaaacataagtgcataaatctataaatgttagacaatttatcaaatgcttaaaaatatgaattggatgcttcatttttgtgtgactcttaggaatccgggtccaactttatgttattttaacccaatttttttaatgttctattgtactttatgaatccaatcgacttttataaatccaatgggattttataagtccaatttaagcaatgtcgaaaactgtacgattgattattagagaccgggtttttagggttttacccattttttgggtagtacttgatgagagaagcacgaaaatcacattttcaaataatttttgatttagagcgactttttagaacttaaaaacacctaaaacgggggttagcaccagggatgtgcctaggtcagggttcggatctgtcctgatttatcagatttgtcctgatttgaagggtccaaatctgataaaattaaaatgtcctgatttgtcagatttgtcctgattttgaggtagcgaccaaattttgtcctgatttgttgattctccgaaaaatctgtcaaatttctttataaatttggattggcgtaatgtttaagcaaatattttttaattttggtattatatttcttttttttgttgttaattttggctaattattttgttatttattgctttattgtttttctcttttgtttttaatttagcacctgcactagtactaacaaatg

SEQ ID NO: 110698 - DNA, 506 bp, Heterodera glycines
  Promoter: Source sequence=SeqID_2207; Location=1..506; Strand=+; Gene= SeqID_78481
gctttgtttgaattttcttgtttatctctcaaatcagattatggtcttatgtgctggtctcggtggcacttccctatttgccttgggctatttgatgatcgctttttggatgctttggcagggcaataagctttacaccatgcataattactcgaggacgttggcgcgttggaatttcttggccatttattccgttgttgtgatgattgtcaaaatttctcttcaggcgagtcgtttgtgtccgtttgcccgattgtcacttttccccttttcagcttctcggctgtgttttcgtctctctccttttcggaatttgccctattcaacaacttttcgctgctttttgtgccaatccaattgcaagagacaatttggcatatttcagcagtgagaatctgaagacgtcgaacagttccatcaaatggaacattggcaatttcacgcagtgcggataccctggagggtcagccgaaaaggcggaaaactcgcagcacaatgaggcgatg

SEQ ID NO: 110699 - DNA, 345 bp, Heterodera glycines
  Promoter: Source sequence=SeqID_11193; Location=1565..1909; Strand=+; Gene=SeqID_74544
ggtgcgttttttttaataattcaattttaactatatttattatcaaatgtaaaatttttttttaataatacaagacattttttcgaatgaattcattagttttaaaaaatgaaaaattcttaaattgattaattaaaaacaataaattatttttccaataaaattttatggaaaaagaaagatgtcaatttaaataaataaaaattgagcatataacagagataaaatgcacatttttatttgatgaattgaatagaaatatgttcatttcttttaattttatttatttaaaattaaaaaattcgaattttttttaaaagaaaacttttttaggtgcttcaaatg

SEQ ID NO: 110700 - DNA, 333 bp, Heterodera glycines
  Promoter: Source sequence=SeqID_23585; Location=1..333; Strand=+; Gene=SeqID_54276
aaaagtaaaattttttgatcaatttttcacaaatttaggagagagatttcgtggttcagcgcgccggtgatttttgaaaatcttagcgcaaatttttacaacggctgccacattttatgatcttttatttcttcatagcggaaaatttaaacaaaataagctgaggagttttgacgaaaaaaagaaaagatagaaaaatctttgtgaaaaaatgtaatgaaaaagctgaaattatttttttcacaacttcaattaataaattttataagcaaaacaaaattaaaaaaaataataataaaataaaaattataaataaaaatacaacaaacaatg

SEQ ID NO: 110701 - DNA, 470 bp, Heterodera glycines
  Promoter: Source sequence=SeqID_15584; Location=1..470; Strand=+; Gene=SeqID_79872
aaaaatgaattcaaattttgaaatgcttttattttaaattacaaatttggttaatcgttcaggtctcgtggtacggtcaattcgaacgctcggattagcggccctttacccggtttacaatctttggacctcaaccgggacgaaacgtcatatgagtttttttattaaggcaggcatatttaattcgttttttaattacattgtttcttattttgatgtgataattatgagtcatttttcaggttaacagtctattgcagaaggctttggtgggaatggcaaatataaaaactggcaagtgtctgggttgggcgagaaataatttttaatttcaaattaagctgggaccatcgcgcaaatcgtggcccttcagaacaagctctacgacgaccataccaacaaaatgcgtgacagccaagccaaattcgacgccctaatggaagagccgcgcctagttcacggcactaatg

SEQ ID NO: 110702 - DNA, 1003 bp, Heterodera glycines
  Promoter: Source sequence=SeqID_3306; Location=34..1036; Strand=+; Gene=SeqID_84152
tttaatttaggaaaaatttacaaaaaattatttttaagaaaaaaaattattaataaaaaaattttttactttatttaatttgtaagtcagtgctaatgagtaaataaatgcaccccttttttcttttcaaagaatttggtcaaattacaaaaaaaactcgtatgaaaataagttatgccctaacttgtattatttattatattattttccaaagttgtgggttttacgaaacggcctgggcaaccccatttttctatgcgaatgaattgtcagaaaattgaaaaatgtaaaaaacttttattacatgcactttttgttttaaattttatcaaaattcaaatctttctaagattaaattttagattattttcattcttcaaaacaacgaaacatttacctaaaacggaacaaatttaatataaaaaaattttccataaattatttttccaacaattaaaaatatttaaatgattttaataatttaaatgattaatagatgggttttttgcgaatgtttccattttttaaaatttcatttcacctatgagtcagaaatttatttgaatatgtaaaattatttttgacaattttatttacatatttttgaatttattataatacaaattttccatcaaataattaaaaactttaaataaaataaaaattgattaccttttttaatatctgtgatttaatcactcgcatttaatttgatggggttccgtgtgtttcatcgagcagaaaataataatgacaaatgttgcgtttgggattttggcgcgtgacgggccaatgccacacaaacaaaagcataaataaaagatgtaaaatgtgattgatatatacccaaattggtcaaaagaaataaagtgggcattttagccatttgaccgatggattttcatacaaaatcaaacatccagcatttattcttggcacaatttttttcgcttggattggtcacttattgttgctgccgtacgaagatttatgtggcaaaatg

SEQ ID NO: 110703 - DNA, 674 bp, Heterodera glycines
  Promoter: Source sequence=SeqID_1170; Location=928..1601; Strand=+; Gene=SeqID_69231
ttgaaaaacgcacggcatttttttttgtccaaccgaaggaagaggaaagtgttgcaaaagtgttcttcgccacgagcagatgtgagcccaccggtccaaattgcgttggcaaccaagcgcttcgttgcagcacgttcggatcactgaaaatgggcaacaaaatgggggaaatggtgaaaaaatgtctaatttcccaaacccaaaggcacacgccccgggggggtgtacggtatcgcatgacaaatgctttccgtattactgtaatctttatgaggtcagcactccgacaatttttgagggtcttggtataccctggcataaattcgtggttttaagaaggtgaaaaagccgcggtctttggtcaaaggtcgagactccgattcgagactgaaaaattcgatttcagcgcctaaaattacccgaaaaatattttgaggggatctcacaaaagggataagtaccgtttttcttttcccatttggctgtttttcttctcacattttgtttgttttttccgttcgccgtcgtcgtccctttcccttcgccggtgccttttcacttcgtccaccaaattttgttaaaaaagttgtcttccttttttgttctaccaatctccctctaccattgaattgcagcactgaaatgtttttattaattatgaaattctgcagatg

SEQ ID NO: 110704 - DNA, 642 bp, Heterodera glycines
  misc_feature (57)..(57): n is a, c, g, or t
  misc_feature (60)..(60): n is a, c, g, or t
  misc_feature (72)..(72): n is a, c, g, or t
  Promoter: Source sequence=SeqID_6874; Location=2466..3107; Strand=-; Gene=SeqID_63174
attttatgactaaaatgaatgaaatttgaatatatcgggcataaattagtatagacnggnaatttgaaatgnccgggacttgaaaaatggacccgggcgagatctcgggactgcccggcaaaatcccggcgggccccggtcccgtccggtctctaataattagtattaaataaaaattgaaaataaaaaaatacattaatatcaattattattaatttcaaatttcacaaattaacaatccaatcaaacaattatttcagctcaaaataaaattaaatttttaaattttaaattaattttatattggattaaaatatttaaatttgatagtcgcaaaaactttccaattgattacaattaatttattttttgaactcaaaattaggagaaaaataacataaatttttttaaatttttattttattatttttaattgcattttcattttaattgtaaatatttaatcaaaataaataaatataaatttatttaccaaccaaataagttctgtttagggttcggcttagtcagtgaacattgtccagctcatacagtaggctgccgaattcgaattcaagtaaaaaatgggaaattttggagaaattaaaaaaatatattttttttttgccctgcagcgaaatg

SEQ ID NO: 110705 - DNA, 256 bp, Heterodera glycines
  Promoter: Source sequence=SeqID_10266; Location=1..256; Strand=+; Gene=SeqID_73425
ttcttgtcaacaattggctgaggacaaggccattgagcgttcgtcatattccaatgttttggcagtcaatcggaaaccatttcagaagaaaagggaaggctcctcaagcagttcttcagtcaagagtgcttcttcgtatggaaatttggcacaacgcggatgctggcgttgcggagtaagccattttccgaagaaatgcaaccatctgaagacgacatgccgaaaatgcaacaagattggccacttggaacgcatg

SEQ ID NO: 110706 - DNA, 213 bp, Heterodera glycines
  Promoter: Source sequence=SeqID_18594; Location=974..1186; Strand=+; Gene=SeqID_83228
aagaaagatgcggaagaaaaggctaacagagaagcagaggagaagagagacgctgaagaaagggcgaagagagaggaagaggaaaaggaagcggcagtagaaacaaaaagagacgcagaagcaacggaaaaaatacacagtgaaaaagaaaaaaagggaaaaagagaagggaatgtctcaatcgatgtggagggcgcaaagaagaaaattatg

SEQ ID NO: 110707 - DNA, 1003 bp, Heterodera glycines
  Promoter: Source sequence=SeqID_1577; Location=5481..6483; Strand=-; Gene=SeqID_46938
ggggtccgcggcagtggaaagagggggtccgcgccgacggacgacggaatggtggggaggggtccgtgccttttgcgagagaggctcggcggcaacggggggggggggagacgtgattgagaagatttataacacaccaatgtacattaaggtggtagtaaaggaaattactgagattgaaattgaaattaggactagggagggaaggcttattccattccaatggggtacaacattacttgtattagcatttaaaaaatctattgtattttagtatttaaatattcattttcacatatagtatatattaataattgaataaatatggtgcatcaaatatttgatccaaactcagttagttttgatgattttgttgtagtagagcagattggctcgggagaagcctttaattattttcgcgggatacctccataccaacgaggatatggaagacagcgaggtggaggagtaggagatgtgttgaggtttttatggagagcacttttaccaaaattaaaatcggctggtacattattaggtagagaggcattagacactggaacacgtgtattggatacaatagagaaagctgaaacaccaaacaaacaagcaataattaatgaagtaaagaagggaatggataatgtactcgaaaaaggtggggttgggcgtcaattcggaacgggaagaaaaaagagtattaaaaggaaaagaattattggaaaaactataccaaagacagtaataaagaagagaaaaagatcagacgtatttggaaaattattttaaaatggtcttcaagaaaattgacaaggaatcggtaaattctataacttcagctttgtcaatatttacccttccaccaactaatgtgtcagtgagtagttcttcagtgcgggaatatttaccgctcaatcctttaacggacattccttttcattttaaaattcaccctaccgctagtttctttgatttgaacaaatgttacatcttaaccgaaatg

SEQ ID NO: 110708 - DNA, 286 bp, Heterodera glycines
  Promoter: Source sequence=SeqID_17084; Location=621..906; Strand=-; Gene=SeqID_81512
agtgttgttaacccacatgcagccgctcttcaagaaggcaagcgattttcaattaatttgcggcgcgctttaacaaaaacggggaattggggactgctgaacaggctggtggcttagctgccgccatgggaagggaaaatcggaatcttttggccatattttgaataaactactaatttttggttagataattggtcttgaatgaagcgatgaaattaggccctatggggaaagatttggaaatttaccgaaatcgttaagataattagtacattttcaggaaatg

SEQ ID NO: 110709 - DNA, 686 bp, Heterodera glycines
  Promoter: Source sequence=SeqID_2689; Location=1515..2200; Strand=-; Gene=SeqID_81089
ttaaacagcgctaatatccccccccccgttcaattagcagtggttgacctcgtccaatgtatcccaagcaatcattcaattccggactgctcgacagcttcgtcttccgttccgttttcactctccacaaatagggctgctcaatgagtgaaaatgtaaataaatatttgctctccgtttttcggtcgtctcgcgcatcccccgggggtgggcggcccattaaagcaatttggggattttttgagcggggcggggagcgccttccgggcacattttgcttggaagagaccgccccaaatggtcactcatcagtcagttgttatttaattgctcctcctcaaaatgcttccactttctcactgtttctcccaattaatttttgtgaaattttttaattttaaagatttagcaaagaatttatgtttctgaaatggtttttcattttctattttgggtgaaatgtttttcgagtcaatggcaactcatacaatgaaaaagcctaaaacttaggcatagcctagcctaaagcttcggcctaagcacaagcatatagcttaggtctggcttaagccttgcacgagttttctgacaccgtttttcttccattttcaaataaaatattatctttgattatttaagaattttcggtcatttgccgtacaatgtgccaaaaattcgtcgcaatg

SEQ ID NO: 110710 - DNA, 198 bp, Heterodera glycines
  Promoter: Source sequence=SeqID_27775; Location=1374..1571; Strand=-; Gene=SeqID_58439
ggtacacatttcgtacaaattctctaaaattaatttcaaagggccgctgtgatgcacgacattttggatatgatgcccgagggcataaaacagaataaagcgcgagtcatcttgcaacatctcagcgaggcgtggcggtgttggaaggcgaacattccttggaaagtgcccggtctcccaactccggtcgaaaacatg

SEQ ID NO: 110711 - DNA, 709 bp, Heterodera glycines
  Promoter: Source sequence=SeqID_33473; Location=142..850; Strand=-; Gene=SeqID_46343
cgccaaaagaacaaatacaaatagtaaaaggtacacactatattttacccttgattttattaaatttttttagcttataactttgtcaataatagaccaaataaaaccattttatgctcattttgaagggaaaattctgaagaatatttctaatttagtcaaaagtttaaaaaattgtttattggcaaataaatgattcatgtgttattttatatgttagagacatggaaatagtacgcccaaatgagagaaaaagaaaaaactttgtcctgggaaaaaaatgtttcctgtgggtacttttcttgaaattttgcataggccaatattttgaccccctccatcgaatccctgtttattttttcgaagttatgtttttaactcgagatcggctcttctaattttacaagggaaaatcccaaaaaaattttaagttttgcaaagttttggcgttctgattattaaataaaaatccagcataattgtacttggagcccaaaattgggccgctgtgtttagtgacaaaaccccaaaatagtgatttatagtgacgaaaagtgacgtccaaatgaaaaaattttaatgcagaaatgcgttttttgagctcctttcttcaaaacaattgagcaaaaaaaaaagttttttcactaaaagttgcggccctagtacctaattattgttcgagaatgtattttatctaatttaggtaatg

SEQ ID NO: 110712 - DNA, 735 bp, Heterodera glycines
  Promoter: Source sequence=SeqID_10551; Location=1..735; Strand=+; Gene=SeqID_73787
ttatatatttatctaataaataaatgctgtttaatgtggatatagttattacatttttagagttgtcattaattgataaattatttatatatattcttttttgtgaaaaaattcaaaaaaatttcgcaaaaatttcaataagttttcaaaagttcaaaaacaggtaataaaaaatatatgaaaaagttgtgaaatttgcattttattttgggcatttcatgcctaatttatggtttcaatgaagatgctttatattaatcctttgtattttattggcttatctgcagaatttataaattttgttttcttgttgaggctcctttgattccattttccgtgttgagtttccatttatttagaactcacattcatttaatttattgcacttagtaagaaatttatcaacattcataatattaaattcttgtttatttaaataaaatttttatgttttttcaaaatttaaatgaatttacatgagtaataatattggtaattaattttttatgttcctttctcggtgcttcccttgtctgagtaccaaaaattattttctccgttgcatgttattaataattatattattcatgttttctaataattaaacttattttacatattttcgagttgcagtaatttatgacattttttattttatgaacaaaaataaataaatatttatgaattgcttgtgaaaagatattttatttctagatattgtattaagattgaatg

SEQ ID NO: 110713 - DNA, 231 bp, Heterodera glycines
  Promoter: Source sequence=SeqID_17322; Location=865..1095; Strand=-; Gene=SeqID_81793
acaaaattagcccaaaatctcaaaatttgggcattttttagtcaaaatctgctagcaaatggcactaaaaatacaaaattttccccggcggcgcctagcggcaccgccggctcccgcgttcgcgaaatttttttgagaagaccgcgccgcaaaaaaaagagattttaaaaagcaaaaaaaaaaaaaggtcgtcaaaaattttggaccccgtcataaggaaaatcgcatatg

SEQ ID NO: 110714 - DNA, 530 bp, Heterodera glycines
  Promoter: Source sequence=SeqID_36617; Location=1..530; Strand=+; Gene=SeqID_65883
aaaatagatggatgacttttacattgtgctaccctagaacacgccggaaccagggaacagtacatcaaaattcacagtacgactccccgagattttggaattgggcacaaatttggtcagtagctctctcatcaattatttacccctactcattcaccttactcggtataaacggtcaagagtttattaaagtatgggaaaacgacagcagtgtcccgactcaagtttatttaccggacatgaattttaaaaccgccgggggcctgggaaataaaattaacgaggcattcagccatcattacaaaatcaaaaaacaacgtggaaggagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactacgagaaacaaatcctcaaattttagaagagcctgatataaaaatttggtttgacaaaatg

SEQ ID NO: 110715 - DNA, 74 bp, Heterodera glycines
  Promoter: Source sequence=SeqID_2229; Location=1367..1440; Strand=+; Gene=SeqID_78612
agtaaatcattaattcattctaatggaacattgtgccaatgttggcaatttgaagcgaaaccaatcgcagcatg

SEQ ID NO: 110716 - DNA, 67 bp, Heterodera glycines
  Promoter: Source sequence=SeqID_42315; Location=1..67; Strand=+; Gene= SeqID_70232
tcattttttttgtcttttgaaataaattgtgaaaaatatacgaaaattattttagcttttaattatg

SEQ ID NO: 110717 - DNA, 1003 bp, Heterodera glycines
  Promoter: Source sequence=SeqID_260; Location=3192..4194; Strand=+; Gene=SeqID_80141
tttgcttttttaaaacattttcactgatttatgcgttaataataatccgatgcgaagcttctaaccaaaataatttttaggttttttatctgaaacgcaaaataaaacattggtaaaaaaccaaaaatactaatatatttatagaaataaattgaaaatgatgacaattaatttattgtaaattaaaaattaaaaagaaaaggtacttttcggttttgggcttacacctcaaaagccgattttaaccattattattcccatagcataaattaacggagcggtaaaggtcctccactcccaattttgcgcataaatttatgcccccaaaatagggcgcatattaaaatgccttcagcgcgccctttgttgacaatttttaaaattttgagctgtaggcccaaaaccgaaaagtaccaaagaaaatacctcttgtaaacaaaaaatttcggattttctaatattttaatttgtgaaattccttttcaaaagggcgttctgaatttttctgaaaaatcgcaaaattccatatttatggaaatacaatcctcccgattttctttattttaagctttatcccactaacattgtccaaccctgaagtgagtttttaatttccaaaaatttgcataaatttcccgggcttaaaaagaaaaatttaaaaaaatttcaaatttctgaaacgcacaggtgttttcaaacaattctccaacatagtaaaacatatacataattttgatcaaaaatgcttaaactatttacaatccaagttaatctccttaaacatcattagccctatgctcattttattcagcatcttttcggctacttttcaagttaaaattttcaaatatgcattatttgaattcatagctgtttccagcagaagtaatgaccgaccaattcattcaattaaataaaatatattttaatcaaaatatttatattatattgattttttttattatttagcattatatatttaattatttgatatggcaaaatg

SEQ ID NO: 110718 - DNA, 159 bp, Heterodera glycines
  Promoter: Source sequence=SeqID_28742; Location=1189..1347; Strand=-; Gene=SeqID_59321
atcacgaaaatgcacgccatcatcaccaaatcgccgctctctccaattttcaccaccgacaaaggccgatcagttttggaaattttccgattcggggaaaatttcaacaaacacactgtttccaaagaggggaaaatgtgtaataatggctgcaaaatg

SEQ ID NO: 110719 - DNA, 681 bp, Heterodera glycines
  Promoter: Source sequence=SeqID_22983; Location=991..1671; Strand=-; Gene=SeqID_53685
ccccccatttgattattacccccaaattgttttatataatttttttcgaataagaaaaattttaaacctaaattttttatcaaaaaaatgaaattttggcaatcaatttttggcagaatttttaaattcttagggatgtattttctgaaaatttttagctcatttctaaggggtgtattttcccgattttattgcatttttaatggaatttttcgggaaaacgcaaaaaaaatgcaccaaaacggcaaaatgccaaaaaaggcatttaaggcacgaaaatcccgaaaaaggcaaaaaaagcatatgtaataaaagtcaacgtagaagcctaaaaccaagtgtaaactgcgttttaaaatcaataaaatcccgcagaatcccgcacaaaaagtcaaattagcggatcccgctgcgggactgggactcaaaattttttgcggtagcggatccggcgggattaatcccgcaaatcccgcattttccaaaaaatgcgggattgcggactgggatcccgcaaaatcccgcgcgggatccggtcccgcgccggtctctattaggaactagtgcacagaaaaaaagcctatgcctcaaaatgcggtctctaatcataactaaattgtgaaaatgtgcatgtaattcatgatcattttttattcaatgcttaattgattttgcttaatg

SEQ ID NO: 110720 - DNA, 193 bp, Heterodera glycines
  Promoter: Source sequence=SeqID_7654; Location=1200..1392; Strand=+; Gene=SeqID_65521
aattgaaggaccaataatttatgctttgaattgtttggttagaatttcacagttttattttataaaaacagtgggacaagaagataaacataagttaaaaaaaatcttcaataatttgggaaaatttgaaccaaaattgttgaatgaggagagattaaattatgaatttaatttgaaagatgaataaaaaatg

SEQ ID NO: 110721 - DNA, 330 bp, Heterodera glycines
  Promoter: Source sequence=SeqID_39452; Location=627..956; Strand=+; Gene=SeqID_68017
gtttacctaaaaatgttattcaaaacttggattttttaaagaaattgacaaaaacaaaatcttttaaaaagagacaacaaatatttaaagaggctactagtgagcaaattggattattaattgaaattagttataatatattaaaggggtacttcccgctcacgaagagacaaaaatatagacttttaccatacgcaaattttgtaagaaaattagcaagagttagaactgagatgggtgcaaagaaagtttttcaacaaaacggtggtggttttttcgttaatttgactcctttattattaccagtacttattgccgcgctaaaatatg

SEQ ID NO: 110722 - DNA, 711 bp, Heterodera glycines
  Promoter: Source sequence=SeqID_8490; Location=4870..5580; Strand=-; Gene=SeqID_68267
gtttggaaagaacaaagattaaatcattccttttagcacccataaaatatagtttaatttttcatttctttacatttttattaaaaaaaaaatttataattataatttataaattggttatttgtaaatttacaattactttcatacagcttaatttagagtaattaaacttaaaaatttgacatttaaataatgtaaatcattttgaatctcttgtaaagtggcgtgaattaaaaagcaaatatggaaaagtgatttattattattatttaattattatttagtcaaagctcaatttcatctatttattatttatttttgaatttttaattaaatcaaaagaataaaaatttaagaacttttaaaactgttaataaattttcaaaaagcttttattagaaatttttggttttaattaaaaaaatttatttactcttcaaaaacagcgttatttaatgaggcaattgttttgtgtccttcacttttaatacttaattaatgatttcattttcatggttttagaatttatttttgataaaaattaatttatattatttgttaatttttactttatcaactttttcaataaaaatatcgtagcttatttttgaagtggataattgacagtatctttttggatgtttatttgtaattcaagtggaaaaatttgaagttttttcattttttaaacaggttttcaccaaaaaaatg

SEQ ID NO: 110723 - DNA, 128 bp, Heterodera glycines
  Promoter: Source sequence=SeqID_3110; Location=1086..1213; Strand=+; Gene=SeqID_83244
ttttcggtttatttttctgcaaatgattttaattttagcaaagaaaaattttatttcatatatttatttttgtctgtttctgttgatgtacataaattaattcatttaatttgtatgtgaggcgaatg

SEQ ID NO: 110724 - DNA, 648 bp, Heterodera glycines
  Promoter: Source sequence=SeqID_253; Location=5345..5992; Strand=+; Gene=SeqID_79770
tccgacgacgcactaatttgcccaaatgaagacgaaacgaaaattggtgttttgtttttgccaaatttttggcattaattttttattttcttgcattcgcactccatgggaaatcaaatttcatccttggatctactttatttaattccgtcttgttgtctgtagtttttcttgcataaattgtagagtcatcgttttgtttggtcgtcttattagaatttgtttaattaaaattattcaaaggccctagctacatacttcgggaacctatttcgtatgtatatattatggccaaaataaatcgtttaggtttacaaagttactatgctaagcgaataaacaaaactcaaacattaaaaaaaagttgaaaggaacaatattcactttaggtatttacaattcaatgaatccttttgacaggtgaaagcgatagcttccaaaataaagaatattggccaaaaattaattatactctgaaattgtatgctggggaaggaaaagcccattgaagcagaatggccacgaacttttacctacccaaatagcatttaatgtttaattattttacttatttcttttttttttgcgcagcactttgtcattatttattgtgtgccactttttcgtcggctttagttttaaaaaatg

SEQ ID NO: 110725 - DNA, 232 bp, Heterodera glycines
  Promoter: Source sequence=SeqID_2633; Location=1017..1248; Strand=-; Gene=SeqID_80833
atcattggacataaaaaacatttttaaatataagaatcattaaatgtgttattaagtgttgttagaaattttttatggtcatgagaagggctattgaccgttgtgatttatgggaatgaaaagtttgattgcgtaaaataattttatctaaaatctttgtgtcattttaatagtttttcgacggggtcatttttgttatgttagcataatatttttttcatttttgagaatg

SEQ ID NO: 110726 - DNA, 220 bp, Heterodera glycines
  misc_feature (129)..(129): n is a, c, g, or t
  misc_feature (152)..(152): n is a, c, g, or t
  Promoter: Source sequence=SeqID_8989; Location=1..220; Strand=+; Gene= SeqID_69926
ttgtattatcacagtgaatcccgttaaaataatttatatgtgtgatttttgtttttgtgaaaaaggatttaattttgtataggatgagtgattggatttgggaaagtaattaatggaatatgattgaanattggtgggggattgaatggaantattttatattttagaggggaaattataataaaatggttgttaattattttatttttattttagcatg

SEQ ID NO: 110727 - DNA, 141 bp, Heterodera glycines
  Promoter: Source sequence=SeqID_12308; Location=1855..1995; Strand=+; Gene=SeqID_75895
cgtttgttaatagcgttccattaatcaaaactatagggaataacaacaaatttcgcatcatttcatcaaataaattaaaatgtctctactttatggatggattttgattaaaaaacgttcaaaaggtccaaggaaaagatg

SEQ ID NO: 110728 - DNA, 1003 bp, Heterodera glycines
  Promoter: Source sequence=SeqID_740; Location=1593..2595; Strand=-; Gene=SeqID_60195
gatttgccgtttgactttcgcgcgccgcgccggattggatttggatcctgaacgattgctgcacacaaactccggagaaccaaaaaccgccgagaaggatcaggtccaagtgttgtgggcggtatttggggcgcccacaatttcggtataacaaaccgtgtgcgaaccacgggaaattggcttgttcagcccaagcacattgtcactgcgaattgttcaattgaacaatcgcccaagttggaattcaattgagcaattgttcaattgatcaattggccttcaaatctcacacccgggcttttatcattcgcacacggcaattttgttagtggcgacccgccgccgtagggccggagacacagcaatccgtaattattaaattgaaaagctgatcaacttggtaataatcccaaaacctattgtaccggtgtaccaataaacaacgcaaatttacaaatcatatttgtgtttacatttattattgttttgttttctgtcttccccacaaatcagttttgatttcaaaatcagggtacagtaattgggaaacaaacactaacccaaacaatcaatctgttcctttctattattctttcaaatcagttttgatctaaaattaatttattaagatttcatttttttttaaattgtacttaatttatttatttgaatttgaacttatttatttatttgacctttttggggggagtgttgattattcagttctgactaatcaattaaatatttcattcattctacagtaactccaccatacatataagacttcgccaaagccaattgagtaaaatttaaatttttaaattttatttgagcattcaattaatacacatacaatttgttatttaaccatataattttttaattcacactataaaccaaggggctcccgaattaccaatttgataaattttacgaataaaatcgtgactattcagtcaaattaaataaaatctgaataaaattttaaaggggactctcaatg

SEQ ID NO: 110729 - DNA, 270 bp, Heterodera glycines
  Promoter: Source sequence=SeqID_34612; Location=252..521; Strand=-; Gene=SeqID_64357
agtgaacgatcaaaaattattgcaatctgtgttacatttttaataggtacaacgaattaattactttttctgtttgtataattattttataaagttccagtttttagcaaatatttttttaaaatacatattattattattttatttaatttaaaattattgtgatttactttgatcgcttgcactttttcttacttcgtctcagcacgaattaaatgacatgaaaaatttatatttaaagcataatatgggaagagacacaaaataatg

SEQ ID NO: 110730 - DNA, 118 bp, Heterodera glycines
  Promoter: Source sequence=SeqID_15874; Location=1869..1986; Strand=-; Gene=SeqID_80205
taatatttctcttagcgattattaaattttacaataaagttttgttatttatatttttccatttcgttgctgtgtgatttgtgggtatttatgtgtctaatgaatgcttttaatgatg

SEQ ID NO: 110731 - DNA, 1003 bp, Heterodera glycines
  Promoter: Source sequence=SeqID_5716; Location=1975..2977; Strand=-; Gene=SeqID_59009
acactccatctattaggaccgaacggtgtggcacaaattttctgcttcatctttccttacatggcccttaaatggcaaagcgcacataatccgggggcgaaaggactcaaccgagtgccattgatatagttgggatcggggttcgggactggcatcaggccgcgataagatagcgggattaaaatcctgggtttgtcgggatttgaatcccaagaccgaaattcattcaaatccccgttttgtcgggatctcgatcccccccccccccccgccctttttcaaaaaagcctgaatcgtggtcccgggaaatcctagcggggtcccgatccctcccaggctctagtctcgaatttcggggggtcaatctcggtctgagtctcgatgtctagtctcaaattatctatgcccaattttctgggcctcaaaggggctggccaacagcagcagccctcttcaaattgtggttccaaatcttagcattcggagataaaagaaaatatttaaaaatgggataatgcatttttaagagcgatggatagattttggggttagatattaatcctttaattaagaaatttttataattaagttataataaaaaaagttatttagcattaaaaatagcaaagcgtacaagtctaaaataaaagttaaggtttttaacaaatacaaaaaagttataaaaaacttgttaatatttctaactagaaaatttttttttaaaaagattcgatcgcttgctggcggcggcggtggtcgctccatttcgacagagtcacgaaatgaggaagatgaagctgcttccgagccggacattgtgcaggacagactgatcgacttcatgcggcacaaaaaggacagcacaacaacaccaacaggaggacggcggcggtagcaggggaagggtactgtagcttgggatgggtttttgtaacaataatatactgtagctagttggcatacagtaagcggtgggccttttggaaaaagttgctactggatg

SEQ ID NO: 110732 - DNA, 185 bp, Heterodera glycines
  Promoter: Source sequence=SeqID_33788; Location=1115..1299; Strand=-; Gene=SeqID_63738
ataataattcaaagtaaataaaattctaattcttaagaaaataatagataattacatgttctattttaaaatcaaaaataatagaatgtaatttattaattaatatgtaaaaaatgagaatcgacaagctcaaagaaattcaattgaagaaaatttgaattttttagttgtattttaacttaatg

SEQ ID NO: 110733 - DNA, 394 bp, Heterodera glycines
  Promoter: Source sequence=SeqID_13848; Location=1..394; Strand=+; Gene=SeqID_77789
aacttaagtccgcgatttgcgagaaagcaaatagcaattatcagggatgccaaaaatatgcaaatgcattttttcccctggattctacgtagtctaattagtaggaaaaacatcttcttttatatatttgcgtataaaagtcgggacttttatttgcatattttggctttttctgcaaatttcatgcatattttgtttttttgtgcatgtttggtgcatattttgcgatttttgtgcatatttgttgcatatttcacgattttatttgcatatttatacgcgtatattggctatttttcgtgcatatccctggcaattatgtaaaaattataaaacaaaaaattttcaatattaaactaatattttttaaaaattatttctcagtgacgaaatg

SEQ ID NO: 110734 - DNA, 388 bp, Heterodera glycines
  Promoter: Source sequence=SeqID_12149; Location=1400..1787; Strand=-; Gene=SeqID_75726
cgtgagttcgtttcgccgtccgtcctccgcgactgtgccaaccttcgccaaattgagtcggacggactgttccctgaaggcatgcaaaaggggaggggggagggcattggatttaaaaatcttatccaaatttaaagtaaattcatcccctttcccccaattgttttcctcattttttaaaaactcgttcgaattttagtttttaaaactattcgattttaaaatttaaaggggaaaagatctaaaattgcagaaaatggaagaaaaacaaataaaaaagctaaattttgaaaaaaaaaaccatttaaaatattttaaatcgtttaatgaagaaccaaaagtaaaactttttaaactccgttgcccaaagtgaaattgaaatactatg

SEQ ID NO: 110735 - DNA, 55 bp, Heterodera glycines
  Promoter: Source sequence=SeqID_39836; Location=1..55; Strand=+; Gene= SeqID_68319
attagtgaccattgacccgtctccgtacggcggtgggggcggtggcggcggcatg

SEQ ID NO: 110736 - DNA, 614 bp, Heterodera glycines
  misc_feature (81)..(82): n is a, c, g, or t
  Promoter: Source sequence=SeqID_18863; Location=411..1024; Strand=-; Gene=SeqID_83566
tgttctatcatcatctcagtggctaataaaaagtgctgctcatatatggttactcatttcgaaaaaagggtgcaacatttnnaacatattgacaaaattatgatgttcaaatcaatgaaagaatcaatgatttttcaaatctgatatcatattcgtgatcgaaaccccgaaacccccgggttggtctttccaaacagaaaaaaacaatttttttgggtggagcccagattctccagtattataatattgtacattatattacatatgtacataataatactaaattttttaaagtatttaaaatggaaaattggtattctaaagaatttatttcatcctcacaaaccgcagcgagactcgtctttaacattaataattggtgagtgagtttgtggtttttcattacatgatcgagagggaagcttgtcaaaattttttgattttacataatataatttttaaaataaattaaattggcttaatgtatgttgcgccacatcaaatttcaaacaaaaatatttatttgcttaagtgttgacctcagcaaagtgctccaattacgaccaaatcgcccgcctgatgccaaagggagagagtcttttgtgtatataatg

SEQ ID NO: 110737 - DNA, 586 bp, Heterodera glycines
  Promoter: Source sequence=SeqID_4010; Location=425..1010; Strand=+; Gene=SeqID_52793
acaggagagattgtgcccccaaaaaatgaccatggaaaagtattagctcctacagaaagttacagtaacaaattatcaggtttctaactgacaatcataattattttttacattaattcagcattatgtaaataaggctgagaattttagtcacgaaaaatcaaataaaagttgactaaaattcaaaaaaaaaaatagcaaagtaataaaatccatattttaaactattttgaatagatttataaaaatattaattttgatttgcaaaatctgataaaattgggcgattgttcaatttcgggatcttctcaacaattgtgaaaagtttctgccggatttcaattctcctttttcttttaagtcgctttaaggccatttcgagtcagcaaaaaaaccaattgacttcaattctcatccaaagtaataaaaaagaataaatgtattttttaacgtttaattaataaattatctctcgcaacatttttaaaaatttaaacaaaaagcatttcaagaactttgcaacaattcgtttctttggcaagaatataaaaatttcattttaaatgattttgatgaagaaaatatg

SEQ ID NO: 110738 - DNA, 355 bp, Heterodera glycines
  Promoter: Source sequence=SeqID_3261; Location=2353..2707; Strand=+; Gene=SeqID_83949
ttctgtaaaggttgagagtttgaactcgaataaaaaactaaaccgaaaagatttggtgactgtgatgaatgcgtatgtattaaacaagtaaaatttaggcagtaattgtccgacttttagagagcaaaaattggagagaagtactgaaatagttttcgttttatacccctaaaacattcaacgcgagtgacactaccacacatttacaaatgcgtagataggtatataaataaggcacatacgcctcgataacatttattttttcgacatttataactaaactgttccctaacccaatgtgtataacacttttaacttttatacaatttcagactttgatttgcacaaaacaatg

SEQ ID NO: 110739 - DNA, 1003 bp, Heterodera glycines
  Promoter: Source sequence=SeqID_6175; Location=2431..3433; Strand=+; Gene=SeqID_60595
attatttcaattccccgatttttccagcatttcctccaattcccattatttccttttttcagttcagctatttttgctcctgaaaatcttacggtttcatcgaattgaaaaaaacctgacaaaaatcgttttcatgaataaatttttcgggtttgatggaatgcttcctgtttgtaactattaaaacttggttttaacgaattttggaaaataaaattattgtaggttggtgcaacgaatatattgtatacaaataaactacatacacctcaattatgtttaaccgaacgacttttgttcacccagcatataagtagcaccagaaggatgacattcaaactcttttttggactcattgttttatggattaacgtgaaaatttaggtccaatcggtgaaattttagagatttttgaattttttcatttcagggatgctttctaagttacctaagtttcatactttttagctgtttaaatattcttgatcaaaaagtgtgaaaaaataaagaaaactcagattttctaaatcaaaaatttttattttaaattattcaaaaaacttaaaatggcataaaaagcattccttaataggaaatagtttaaattttgtgaaaatttcgccgattttacctagattttcacgtcttaaccaaacaaaggagtccgaataaaaaaaaacgaggtagaaaaataaaaaggagttgaatcaaatattcgataaaacgaattgagcaaaaacgaattgaccagaaaatgaaattatcgaatctccttaattcaccaatgtttgacactctccggattacagatgttcaacgttgtcgggcaattgaccagagaaaatattgcgaaaatgtcacttaatcacttaccggattcagaaaaatttaaataattctcaagaaaactacagtaagcataaatggaatcggagcaatatccatatgtaatatagctttaaccctattgcgctaaagatttgctcctgagatagtctaaatg

SEQ ID NO: 110740 - DNA, 488 bp, Heterodera glycines
  Promoter: Source sequence=SeqID_515; Location=1..488; Strand=+; Gene =SeqID_54988
cccccctcttaaaaaaaattcaaaatagaagctttttccacataaaatgggtataattggatcgaaagtgagcccaaatgccccccccccgtctcattatgcacttgtccatgccccgcgggtcggccattttggcggggacggacggacgccccgcagtcggtcgtctcaaaattgctcactttcgccgccccccccccccaactatgcttcatcttcggctgctttttctgccctttccgtccaattcgtccagctgtgatgggatgggaaagggagggacacggcgacaattaccggaaaaatacttgcgcaaaaggaaaagtgaaaaaacgaaaagcgtaaccgaacgaagggcaaagtcagccgaacagaagaagaagcagtacggaagcccacctgattgcttcttaaataggctgtcctgctgcaaaagctgctcatttttcacattttcaaaaacccttaaaaaatttttcgctaaaatg

SEQ ID NO: 110741 - DNA, 475 bp, Heterodera glycines
  Promoter: Source sequence=SeqID_36864; Location=1..475; Strand=+; Gene=SeqID_66079
tttctacggtgaccgccccactaataacgcaacaaaacctgaatggtttttcacccaactttcctactgggcagagatcaacatcgaatacttcgagcagtacattcagcccattgctgatgaggtcaagtcgttatcttcttttcatttggcttaaaattgccaattcgtttttaaaaaaatggcactttctcttcttttttatatccctcggatttcagctgttttctcacggaatatctgaacgaacagcaagagatattttcctgcaacttttgatgtctttggcctctcaaaaagtgtcagaaattattggctccgatcggattttggagaatcgacatcaattgtcacatttgatagacgagacggtcatgtttgagaaggaattccagcagaactttggctattccgaggaggcgccagtgcatgtcgtttcacaactgtgccaatcggaggaagtgctggagaaatg

SEQ ID NO: 110742 - DNA, 1003 bp, Heterodera glycines
  misc_feature (47)..(47): n is a, c, g, or t
  Promoter: Source sequence=SeqID_3856; Location=753..1755; Strand=+; Gene=SeqID_52171
aatattatttatacaattcgccaaaagaaatgtttattttcaccatnacctttgtcggtggctggacatttcgacaatgaccgtttcgccaatgaccgtttcgacaatgaccatttacgactatatcatatcgccaaaatttaaaatatcaaattaaatataataaaatgaatataaaaaataataaattaattaaaaaaaatattgatgaaatttaaagagaaaaatttaattaggtagttatattttttaaatttaatgaatgcattatctatcgcctattgtgtatgattattaatagttaggagtcggatttttaggttttacctatttctagattttttcaatttttaacacctattttcgcacctattttggccttttttggggtttttagcacctaaaaatccgagccctattaatagtgaagaaagaagacaaaatgagacggacctataatataaatccaaaatgaaaccatttatttaacttaatgtagtgtcctctttttacccaggcggcaatcctgaagaatggttgtccctaattttcatttttttttaattttgtgctcaaaaccagtttttaggcgtttttgagggtgctgataacggatcttaactcgggtttgcccaattccgaactccagacccgaattcgaacaaaaaaaaattgtttttttaatcaagaatagttttttcagggtaaaagcttctaattcattatcaactatttaggtgtaaaacaatgtttcaatttttaattaaaaaaaaataagcaatttgcgccgaaaattgacaaactaaagccattctcataatgctattttgaaaaaaaacgaaaaaaaaacttttttatattgatcccaaatccgcaccgtccatataattttgcagaaatttgaattttatttaaaaaaatatatttaattttattgtcgaaacggcattgtcgaaaaggtattgtcgaaacggtcattggcgaaacggtcattgtcgaaatg

SEQ ID NO: 110743 - DNA, 1003 bp, Heterodera glycines
  Promoter: Source sequence=SeqID_16457; Location=272..1274; Strand=-; Gene=SeqID_80857
aaattgttggtttcgactctcagtctcgaccaacaaaggaaggattagcacaataataggggtactctgctacctgcccaacccagcacagtggtggcaaaataatttaaattgattttgtcattagtgttctaaatcggagtggctctggataacttttccggtccgtaatcacggattttggatgtattttctgctttgctggttttcaaaaatcccagagtccaatttttcttgaaaaaataaaatttcatattgaaaatacaaattttactatcactggtaacaaaaatttaaatgtcattggtagctctaagtgtttttgttggtctacataattaaaaaaattaaatcgataataaagttgtaaccaaattagtttttaatagtttcaattttgggtcgtcttttttattttttatttccattcaaagctttcgaatgatattaataaataaattgaattttttcttgggaaatgcttatttttctcctttatttgttaattgtattacgtcaatgatcgttcagccgagtttcttagatttgcatgggaatagaaaaacaaaaatacatttttatttaaaataaaaaatttagcaaatatttgaatttaataaatttgtgtttgaagctttagttttttaattgatacaaatttttgaaatttttaaggaaaaattttttcatgaaatgtttacagtgactaaattatcattcaccaaatcattcatgatctaacgagaaatcttctatattagctgtaatatttaatttttttttgcaaagttaaaaaaaattataacaagaaattatttttttatttcagttattttattattaaattagaaaacttacgcttttgagcaaatacaaaaaattgaaattgttttatttttgccgaaaatgtaattttattttttcattttcttccacttggcgcatttaagaatttttaagttaaattaaaaaaatttaaattttataattaatcagcgctatg

SEQ ID NO: 110744 - DNA, 1003 bp, Heterodera glycines
  Promoter: Source sequence=SeqID_12920; Location=261..1263; Strand=+; Gene=SeqID_76668
ttttatatcaatctttgacgccttataatttatctttttagttattttattttattctttataatttacattttgcatttaattcatcgttttaatgagagctaaaaaacactgaatagttagttaccttacattatgaaacactaagttataacattacgagctcagctattttttttgtaaagcttattcgcaaaaatctgacgaaatctcttcagtgttttaagttgattttaaattgagcaattatccaaattaatgttcccctctttagtttcaatcattgcacaattttaatgtaattcattttcagtgtattcccatccatttattcatttttattttatttgtatatcattttatcatcgtttacttaattgttttatttgttgattgtttgtttgtcttgtttgtttggttgtttgtctgtttgtttgttgcttgtttgttttgtacacaacacttggtcggagtctttactccccagtgtttttaatttcgtattcttatattgcttaaaaattgtatttgtttgtttagttgttttgtaaacaacacttggtcggagtccttactccccagtgttttgtgtttcaataaattttttaaaaaaattatttctcatatttttatcactacaaatataacttgtcgataggtagataggtcttgcacaaaagggccacctcatcgcggtgtgcaagtctagtatccaacaacacaacgaaaaggtttttgttgtgtgttgcttttgttggagaagctaacggcccatagttatgagaaaagataaatatgatttgattgatacatttttttaaatttttatttactttaacaaaatccttaaccttatttttttatatacacaattgtatttttatattttaaggagcatccatcatacgctgctatacatttattgttttttgaaagaatacataatgtgtgtacttacattctatcaataatcctaatagattaaataaaagataaagtaatg

SEQ ID NO: 110745 - DNA, 63 bp, Heterodera glycines
  Promoter: Source sequence=SeqID_24168; Location=173..235; Strand=+; Gene=SeqID_54880
ttaatcggcaataataacatgtccagatctggagacccggatacctgtcttttgcaagacatg

SEQ ID NO: 110746 - DNA, 339 bp, Heterodera glycines
  Promoter: Source sequence=SeqID_6189; Location=1..339; Strand=+; Gene= SeqID_60656
gtccgtgggatttccgaatgaaactttgtgggtgcatagagcacccatgggttcttaagaaaaatggtttcaatttctgccaaataagtacgagtgccgagttatgacgtgccaaactttttttatcccaataaattgaataatctattgcactgttttgtgctgtttagtggtgcagaggttgtgctctcgcctttactttttccccccacaagttcgaatccctcttaagtaaattaattttttttaattttgcccttgaatacccttttagaaatgtaattattttcatttataatatgcatttatatttttttaatttatttttgaacgaaaatg

SEQ ID NO: 110747 - DNA, 146 bp, Heterodera glycines
  Promoter: Source sequence=SeqID_11390; Location=1..146; Strand=+; Gene=SeqID_74782
ttgaatttgtttgcagaaagcaaaattgttattatcttatctcaaatcatcacgagtaaaaaaaccattaaacggcttgtaaaattacgaataatatatattaacaataattaggccttaaaattattaatgtccaattaaaaatg

SEQ ID NO: 110748 - DNA, 1003 bp, Heterodera glycines
  Promoter: Source sequence=SeqID_20826; Location=533..1535; Strand=-; Gene=SeqID_51415
gaataattgtttgtctattgccattatctcataattttgcaacagaaaaacttctgtagacttcaagctctcgaatgataccaagaatgtttgtattgaccaagtaataaaaaaaggtatgacctataaaagtgaggatagtcactgattggacgtgtaaattggaatagagccaaaaaatcaacaatttataaaattataaacagaaaaacttagtggactttgatttgggcaaacactttatttttcctaccatcagttttccatattatttcaaaaaaaaaacaattttttttaatgggaaaggtctgccgaagaagttttgcgctatataaattaaaaatttttttattatttaatataattttttaatttaattataaccaaaaggcattatcataccagcagattatcagtttgtaaatttacataattaattatttaaataaaatttctaactataattgtctacattcttttttcccaaaggcgttttacttttttaatttaaataaaattttgttattagcaactatttctagttttttattttagcaactaaaaaactataaaatttttgaaaaaaactattttcaactatttttacttgtgaataaaaatttgttatgaaaaatgcaataaaaagcgaaaaatacacccccctaagaatcgacccgaaatttttcaaaaatgcaccctaacaaatgaaaaatcaatctccaatatttatttatttattaattatttcttgacaagaatttatgattttaaaaatatttagctcaatactgatttggcctaattttttttactttttgaataaattttgtcattttacatccctaaatttgaatgtttttagcaactatttacccatttttagcaactacttttttgggtcttttagaaactaaaaactaactattttgcagttttttgcaactagaaatataagccctagtaataacatgcactggcgaaataagtattcttaaaaattatg

SEQ ID NO: 110749 - DNA, 515 bp, Heterodera glycines
  Promoter: Source sequence=SeqID_31783; Location=1..515; Strand=+; Gene=SeqID_62079
atcattgttaataaaaattaactatccttacgaaaaaataatacaagctaaataacaattttttataaattccctgtatagatattaattagaaataataacttcattgaaaaaataaatttatttaaattatatagctcaataaaaaagcaaattttaatatattattttaattctacacaaaaagatttctgaattatattgaacttttttaatttgaaaaaagagaaaaaaagcaaatatttataaattaaaataaaaaacacaataataatattgttattttgcgccaacaaatggctaattattaaataaaatctgcattcaaatttaaatttgcttattaaaccattcatttttatataaattaaaaattatatgctgttttttaccgatttgtcgttgttgacaaaatagggaaatgttggggggggggatcaggcggtgccgatatacaccgccgggaaaaatattgaaaaattgtgtgtcctttgttaacagttattcaaaaaatg

SEQ ID NO: 110750 - DNA, 333 bp, Heterodera glycines
  misc_feature (15)..(16): n is a, c, g, or t
  misc_feature (28)..(28): n is a, c, g, or t
  Promoter: Source sequence=SeqID_10080; Location=1..333; Strand=+; Gene=SeqID_73148
tgcaggtcgcacacnntcctatggtccntttgagaaccaaaagaaaactgatcactcactgatcagaccatttttaatgcttgcagtattgttatacatttgaataatttactctacagcacaatagctgtattgctgctgtattcaattacagttttaagttgatcaaataaagatcaaaattataaaggatttatttatgtactgtacataaatcttttttagtgattaaataaaaacaaaaatcaaatttaaattaatttttaattaaaaaactttttggattaacttaatagctaaattaagaattaaatgaacaaaatttaaaaaatg

SEQ ID NO: 110751 - DNA, 221 bp, Heterodera glycines
  Promoter: Source sequence=SeqID_18675; Location=1042..1262; Strand=-; Gene=SeqID_83339
gttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttgggtccgtgtttcaagacgggtcgaacagatg

SEQ ID NO: 110752 - DNA, 442 bp, Heterodera glycines
  Promoter: Source sequence=SeqID_24346; Location=1..442; Strand=+; Gene=SeqID_55065
ctcgtttttcctcttaagcttttttctttgacttccaaatccaacaatcttggtatcattcgaaagctcttaacatgctctattagccttatcaaaaacgaaaagtttttcaagcctgtaaaaattttattaagaaaaaacttcaaaaattttgacttttcgcaattttcatgcataactgttttgataattgtctaatcgcaaagcaatagcttagaaaaagcttctaaatagattaagctttcgaacgacaccaacaatgttgaatttggtttacaaagaaaaaagttatagccaaaaagatgctggcgccgaaacgggagcgccgaaacgcagtggacccttaattacatcaacataacattatgccatcaacgtaatatcaacgctatttttaaaattggtatcattttttgaaaattaaaacaatttttaaaaaatg

SEQ ID NO: 110753 - DNA, 144 bp, Heterodera glycines
  Promoter: Source sequence=SeqID_35722; Location=523..666; Strand=-; Gene=SeqID_65209
gaaaattcctataagaaagttgtgcccacagaagcaatgagccaacttatttagtaggctagagtctcgctcgttatcggaataaaccagacaaatcgctccacgaactaagaacggccatgcaccaccatccaccgaatcatg

SEQ ID NO: 110754 - DNA, 654 bp, Heterodera glycines
  Promoter: Source sequence=SeqID_16946; Location=1..654; Strand=+; Gene=SeqID_81375
gaaatgcataaatgatggttgttcttgccagaacattgtcgacccggtcccgcacattctcgaccatgccattctgatcgagtccgactttacgatggacaccagccaatgggcgggatcagagccatgcgaatactgatcagatcaaccacacgcacgcactagtagcaccaccggcattcctttgatcgtttagtgatacgaaagtgacgggtaggagacatccgattggttttttggggagaaggggggcttaattcgatgaaagcggataattttacccgaaattaccaaaacagcgaaatcaaagcgcagtgagcgcgtaacccggtcttatcatccttatcagtctgtcttatcatttttatcatctctttttttgcccatttgtcttgccttagcttttttgtgcaacccttctcttctcttcccttcctctctttctctgttcctccaattttgtttattatttgtttgttttttcatttttttgtttatattaataattaatcgcattttacgggccaggacgtttgcgtaccgccgttttcgtacgagtggatatgcaaaaaaaaattgcattcaaataatttgttaattttttttaattacttttaatgttttgacagttaagcttttattaactacaaaatg

SEQ ID NO: 110755 - DNA, 67 bp, Heterodera glycines
  Promoter: Source sequence=SeqID_15009; Location=2806..2872; Strand=-; Gene=SeqID_79164
ttaaattttttagaattttatctatgcaattaaaaaaacatttttaaatgcttttttgagccgaatg

SEQ ID NO: 110756 - DNA, 371 bp, Heterodera glycines
  Promoter: Source sequence=SeqID_2385; Location=355..725; Strand=+; Gene=SeqID_79465
attaatgatgctcgggaaagaaaattaaatcggaaaagattcttggtccccgagaaactcgagacaggggattgtgctaaaactcgagaccagcaagggttggaccccccgagacttcggtttgatttctaagacccgagagtgagaccgacagtgagattcgagactacgattgaccccgtgaatccgagactaatatttgaccctgaggctcaagactaatgtttgtcctgagacccaagactaagacttgtcgagactaaggttggccctgagatttgagacctaaacctcacagccaacaaatctcatcacatgctttttcaaaaatgccttttcataaacattttatgtttggcagagactccatg

SEQ ID NO: 110757 - DNA, 246 bp, Heterodera glycines
  Promoter: Source sequence=SeqID_16236; Location=860..1105; Strand=-; Gene=SeqID_80615
ttcattttcggttattttcgccagtgcgatctctttccctttttgttgtttattttgcgatggatttaattgatttcattccccgtgttgttgaaatagggttttttaaatttaaatctgctaacagtgattttcctttttggtttctaaaagcattcttattttgcttgatttcattttttgccttaaatttcaaattcctttaagaaataaaccttttgggccttacattgttattttatcatg

SEQ ID NO: 110758 - DNA, 235 bp, Heterodera glycines
  Promoter: Source sequence=SeqID_28337; Location=978..1212; Strand=-; Gene=SeqID_58970
ggtgtggatttttgaaaatttttgtataatcgacggtgggttttggtgcaatttttaagtataatttgaaaaaaaatttatagtaacgtattcatatcaaaattaatttttgaaaatttgtataattgacgggggattttggtgcagtttaaagtattttaatttaaaaaatggtcagtaccgtattaacaccaaaaatttacaatatttcaggaattttgtttattgattaatg

SEQ ID NO: 110759 - DNA, 1003 bp, Heterodera glycines
  Promoter: Source sequence=SeqID_7468; Location=1012..2014; Strand=-; Gene=SeqID_64918
cgtttaaactgttgcgacccttcgatccgccccctcccccaccgatggacgattttcttttccccgttttcattctattaatttttgcttcgctcatctcaactgacaataaatttgctccgtcaaattgtcaaacaaggggaaaaagtcggctttttctaatcctgaataaacatcagattcggggttccctttctaaattaaatcccggaagggaatcgtcttttagaaaagggcctaaaaactgtaagcaggaaattcccaaccctgggaccaagaacggtaccgtaagacacttggtacggtaaaagcgatttggatcgcttgtggtttccattcgccgattgctgtttagcacattatcccctcacatcaagcactagtgcttgaaatcctggttaatcatttgatcggtcctttgcccgatcagtctcgctccatcgtttggcatttttgtccactgtgttatttatttccaaaataattgttttctcccccttttgttgctctccattcttcactccgctgatcgccgcttggacctttctctgctgaccaattgatcacacttggaccgttcttcgttgaccaactgatcaccacttggacctctcttcgcctctgtccgagcatcaccaggtccggtgttcaccaatcgccgtctgtcaacaactgatcgctgcacacacaagtcgaggaccgattgacgccgttggatcaggtcaagcacagccaactggccaattagccggttatttaaccggctatccctcgcgtgtcaattagtcgattgtttaatcggctaacaatctggtctcaaactcctatctcccaacggcccattcattcacagttgcgcaggcaaccgccgcttaagtcccattccaagcggtttgcgttaccagggaagaattgaaaaattttttcatgaatatctcaaaaagtaaaatttaatttttgatgtgaaattaaatcaaatttttaatatcaactagcgcagatg

SEQ ID NO: 110760 - DNA, 1003 bp, Heterodera glycines
  Promoter: Source sequence=SeqID_6942; Location=1195..2197; Strand=-; Gene=SeqID_63359
cccggtaaaacgggctttttttttgaccgggcggcccgggcccggctaattgtcgaagcccgggcccggtcccggcattttcaaaattccggtctctaatcgtgagtataaaataaaaacatgctgttttgcttgttggtattttttttagaccggattcgtatttaatacaaacaataaagagtagagcccggaattttgaaatggccgggaacgggaccgggacttggaaaaaatcccggcggcgccccggtcccgtccgggctctaataaagagtactaaaagccgttcattatgtacaaaagcaaaagtatactcgcactattcatttattagtgatcacaaaatattgtttaagactttaagatggactcgtcttcatttaaaagctgctcattctgcccaaatgaaaaactcgatctttataaatgcccacaatgttcatctttttattgttctcttcggtgttttcgatgtaaaaagcacataaaatgctcagaggatttttaccgcaaggaatgtgaaaagcataacgaagtaaagttaatttttaaaataatttgaccagcattctattttagttactttcaaatgacccttttgaattaaacccaacagatgacaaacaaaagaaaacgaaagtaatgacttttgaacagtatatggcgcagcaaaatcagaattctggtggcaaaaaagataagagtacggccaatcctcaaatagcagtcaggttggtattctcaacatatttttgtattaattatatgccaaaacattttttaatggtcatttatcatcgtacaacaaatggcacttcaaaatcttcctccctttattttaataaaattcggaaccctttgcaaagtagcgccgcttttcctagtttccttggagactcaaaaaaggatgcgcataaatgaaaatgcatagtcaaaattaagggcggatgaggaaatattattcgattccgacgacgaaccggaatatctctccaaaatg

SEQ ID NO: 110761 - DNA, 206 bp, Heterodera glycines
  Promoter: Source sequence=SeqID_10379; Location=1245..1450; Strand=-; Gene=SeqID_73567
ttttgtgaaattgatgacgttgtggcacgttttaatgacctggcagaaaggttcattcaccggtttgcgacactcaacggcaccaggattttcttgaataccttgaaaacgcttggattggtcgtcagcgtcgcactccgtcatttcgctcgatttttggaattgcaaagacattactgaactccatctgccaaggacaacaaatg

SEQ ID NO: 110762 - DNA, 445 bp, Heterodera glycines
  Promoter: Source sequence=SeqID_16508; Location=1252..1696; Strand=+; Gene=SeqID_47375
aaaaatattaatttttcgaaattaagtcaggcgttacttgaaaatcgaattgatttatcaataaactcagtgttcaccgttgaacagaaatataaagaatttttaaataaagttctgaaattatatgatatttttatacccaataggcctctaaaatcgataataaaacaatcgtatcctcaaaaaataagagacttattttcagagaaattacgtttgcataagcttgtaaaaaaattccctgaaaaaagtgatctcattttaaattacaaaattatttctagggaaatgaaaaaacaattgtacaaattaagaaatgaacaagagtcaaaaattatttcccaggagcaaaattcagttaacaaatttattcgaaataagttatcaaaagttaatgaaattcctacgttaattgataatgctggaaatatattttccagcaatg

SEQ ID NO: 110763 - DNA, 405 bp, Heterodera glycines
  Promoter: Source sequence=SeqID_31063; Location=1..405; Strand=+; Gene=SeqID_61439
taatatatagggatgtgaaaaatatgtacaaaatgtggtcaaaatatgtacataaatatgtaaaaaaaaatcccaaaatatgtacaaaaaacccaaaatatgtaccaaatatgtaaataaaaaatttttaatggttattttttagaaaaaaaaattactctaaaggatgaaataggcacaaaatgccataaaaatcatgcaaatagccttaaatcatcttttaatattggaaaaattaatttttggttaatttttattttttcaacagaatttttaaatttcaaaaattctcaaaatatgtaaaaaaaatatgaaaatatttacgaaaaattgccgaaattttggactttttttcaggattttcaaaaatgtccgtaaaaaatcctcaaaatatgtaaaaaaatg

SEQ ID NO: 110764 - DNA, 196 bp, Heterodera glycines
  Promoter: Source sequence=SeqID_41592; Location=678..873; Strand=-; Gene=SeqID_69677
aagcagggccatgtttatcgtcaaaagcttccatgagcagaacttggcaaatctttttgtcaagaagcattgggaagatttccggtgcgtttaattaattttagttggtacaaatgttagaaacaacttttagttacatgagaagccgggcatcgacactgtgaacacattgctgaagctgttcgaaggaatgatg

SEQ ID NO: 110765 - DNA, 93 bp, Heterodera glycines
  Promoter: Source sequence=SeqID_7885; Location=1772..1864; Strand=-; Gene=SeqID_66277
ggtccatcacataaaaagagctaaattttaaataaaattaatttataaattttaaggcttcgaaaaccctcgcaaacgcaaaaagcgcaaatg

SEQ ID NO: 110766 - DNA, 891 bp, Heterodera glycines
  Promoter: Source sequence=SeqID_22176; Location=1077..1967; Strand=-; Gene=SeqID_45696
ttttatgttttatacactttttcaaaagatatatataaaacatgaaaatgcattactttttctctctttttggcgtactattttcatgtctctaacacatggaaaaacataaattcgaaaattctaataattttggttataagggtacaaaatcgcttaggacatttagaattaatagagaaattaatagttttagcatttttggtgaaaacagcagtttaggacttgagttataacgtgataaaaatttgaaagtatcacaacttttttctgagatgtcaaattgcttagcattcacttagaaaaagattctccttttcaaaatctttttttagatatcaaatttgttcacttttgttgggaatgaagcgtgttatggctgatcaaaataaaaaatacaaaaaaggcatttaccagtgtaagtgcatatactttgtttttgcgtgtgttggcgttttgttttacgccaattattttttggcaatttttttcgttttttaccgtccatgtcttgtgcgtcattttgttttttaacattgcttcgaaaaaaatttcttttcaaaaattttaatagccaatatacaattgatcaaaacttacaagggaacattttgtaaattttcggcttttttttttgcaaaaatttcgaaaatcggcattccgacggctgaaaaaatattggaaattggcttccgaaatagcgtttagggattgacattttggtgtctacatatttaggcacctattgcgatttccataaaacgcattttgctttaatgatacttgtcgagttccacaaatttggtgcatttttcttaagaattccattttttcaaaaactaagtctctaaatttgtttgctcctctagttacatataaccatatcaaatg

SEQ ID NO: 110767 - DNA, 495 bp, Heterodera glycines
  Promoter: Source sequence=SeqID_13469; Location=1546..2040; Strand=-; Gene=SeqID_77360
tttgaataaatgaataacccgcattctccgttgcgctatttgacaaatgctggggagccgaatcgtttgtccgacaatgaacaatggacttgttacaaggttaacaaattgtccaaaaaaaaagactcacacaatcacaaaaaaggacataaccataaacaatttggcaacttgaatgcaccatggctttctcagaagagtctaaattaaacattcttgatttcattcgatagctctaattgtaagaaattcttttatggtcctgtaaactgacaattattgcatacttccttaggctatggtagcgccagcaaatttccaccgagaaattttgagaattttagcggaatttgttttaccatggaaaattcctgctacgaatttgatcaaaaatgaacaaattgagaaaacaccaaattcctttttggtggaatttttattgtccttttagtgctttatcaacaatttcaatggccgtgccaactgcttcaaatg

SEQ ID NO: 110768 - DNA, 151 bp, Heterodera glycines
  Promoter: Source sequence=SeqID_17677; Location=3403..3553; Strand=-; Gene=SeqID_47469
tgtgagtttgttttttgctgctatttataacgaaatttatgcgaccgaaaaattagaaaataataagccgaaaattgagtatataaggcggtcttttcaacgttaaggacacatttcataacggacggacggctgctagcaacgcgcgatg

SEQ ID NO: 110769 - DNA, 355 bp, Heterodera glycines
  Promoter: Source sequence=SeqID_3261; Location=2351..2705; Strand=-; Gene=SeqID_83950
ttgttttgtgcaaatcaaagtctgaaattgtataaaagttaaaagtgttatacacattgggttagggaacagtttagttataaatgtcgaaaaaataaatgttatcgaggcgtatgtgccttatttatatacctatctacgcatttgtaaatgtgtggtagtgtcactcgcgttgaatgttttaggggtataaaacgaaaactatttcagtacttctctccaatttttgctctctaaaagtcggacaattactgcctaaattttacttgtttaatacatacgcattcatcacagtcaccaaatcttttcggtttagttttttattcgagttcaaactctcaacctttacagaatg

SEQ ID NO: 110770 - DNA, 128 bp, Heterodera glycines
  Promoter: Source sequence=SeqID_6779; Location=1670..1797; Strand=+; Gene=SeqID_62881
ttgcgtcaagtccattatcaccttcctttaatattacacacataatttaataccccaaaattgctctacttgttcaaggtgggttctttttgaatagttgtaattccattgcatattcgatgaggatg

SEQ ID NO: 110771 - DNA, 108 bp, Heterodera glycines
  Promoter: Source sequence=SeqID_6457; Location=1167..1274; Strand=+; Gene=SeqID_61659
cctgaaaaagggatttaaaatttatttattatgaattaaatgtatattcctaatttttaaattaaaatattatttttttcatttattttagcctattatttgcatatg

SEQ ID NO: 110772 - DNA, 382 bp, Heterodera glycines
  Promoter: Source sequence=SeqID_6175; Location=5829..6210; Strand=-; Gene=SeqID_60596
taaatttaaaataaatatattcattttttattatgttacttaaagaataaattatatattaaaaaatgtttttttgttatgtttcattctcattttcaagaaatttggccttgttgttgctacaacatttaaaaaaatttcagattaaatctgttaaaaaagaaaaagaccttcaaagaaggataaaagatataaaagatgaagaataatataaaaaaaatgttgttataacgttgagtggtgtcaggaaaaaccgtctatacaaaaagggacgattatttattagcaaaaaaatataattaacaaataaacaaagatttctttctcaaattaaaaacttagtaaatggttttgtagaaaaaaaattaggtacgtttggatg

SEQ ID NO: 110773 - DNA, 313 bp, Heterodera glycines
  Promoter: Source sequence=SeqID_23340; Location=2753..3065; Strand=-; Gene=SeqID_54050
ttgggaagacactttttggggcaaaatggaacaaatttgatgataatttttgttggttgatggcgttgtgtatgatcaccgctaattgataagcgggtggagagagcggcggccggcggagtatttaagcgcaacggcgagagcctggcgaggacgaaaaaggttaaagaacacttggagcatcgaatgattatcaagaagtaaaaaaatgattgcttttttagcattttctgttccaatgaaaaattcattaaaatttttcccttaacatttttcataaattatccaaaattttaaaagttaaaatacaatg

SEQ ID NO: 110774 - DNA, 155 bp, Heterodera glycines
  Promoter: Source sequence=SeqID_3761; Location=1821..1975; Strand=+; Gene=SeqID_51771
cattctgctgatgattaataattgaaattgtttttataagaatttaatgcgttttccctcttttaaaagaccgctgatgacgaaagtccgttgttcgacgcggacgattctcttccacttcccgaatttccgcttccgttcatcggcgatggatg

SEQ ID NO: 110775 - DNA, 131 bp, Heterodera glycines
  Promoter: Source sequence=SeqID_21232; Location=193..323; Strand=+; Gene=SeqID_51822
tttggtcaatgcttggccagcctttgcatttggcccttttgcatcaccaagggcaacaaatcattggaattgattgaattgatatcgtaaagaattgtcggcgcagtgtagcgaaacaaattttaaagatg

SEQ ID NO: 110776 - DNA, 531 bp, Heterodera glycines
  Promoter: Source sequence=SeqID_1130; Location=1492..2022; Strand=-; Gene=SeqID_68305
gtgaatgttcactggtcacatacgtctctgccctatgagagagccgtaaatcattcactcgttttggtcaatttggtatcgatttgttttgtacatgctattccattccgatgctaagaaaatttcgaccatttctgttcccggaccctccaaaaaattgagacttcaaatttcattggtgactttcaattttttccatgtatttacataagccgtttgaaccaaaaatgtgttatttgaaaaattaaagtttctattttttttgttcaaattcggacctgggattgaattggcggatgaaattggtactgtattcgtgatcagcgatccctaaaacccttaaaaaaaatttccacatcttttataatttctaaaaatttaagggtggtttaccatcggcgtcattcttgcctttgtttttctaaaaatataatttaacaaggcttaatccaattttacatattgcacatttttttttctcttctgttgtattacatattaacaattcttctacacataacccttgaaatg

SEQ ID NO: 110777 - DNA, 134 bp, Heterodera glycines
  Promoter: Source sequence=SeqID_5255; Location=1..134; Strand=+; Gene= SeqID_57470
tcataataataaaaaattttttatatatattttggtacatattggagctttttgtacatatttattacattttcggggtaaaatggaaacataaaagattttaatttcattagctaaaacagcaacagcgaatg

SEQ ID NO: 110778 - DNA, 206 bp, Heterodera glycines
  Promoter: Source sequence=SeqID_15114; Location=1550..1755; Strand=-; Gene=SeqID_79297
ttcccggtctggattacgaagaaatttcaatggtattgtttttttggctgtcataatttttctaaattctttgatatttgttaattttttttccaaagtggttttaatatataagcttttgaaatttcattcagaaaataagccattttagaattttctgaaaattaatttttactaaacacataaatcttttcaggcacaccatg

SEQ ID NO: 110779 - DNA, 143 bp, Heterodera glycines
  misc_feature (29)..(30): n is a, c, g, or t
  Promoter: Source sequence=SeqID_3407; Location=2597..2739; Strand=-; Gene=SeqID_84551
cgggggggggggacaatgacaaaaaaacnnccaagcttttataatcaaattccgatattttggtaattttaattttgttaaccgccattaaaattattagtctttttgccttttaattgacatttttgcccctcaaaaaaatg

SEQ ID NO: 110780 - DNA, 630 bp, Heterodera glycines
  Promoter: Source sequence=SeqID_360; Location=437..1066; Strand=-; Gene=SeqID_84432
ttttgatgactattatttctaattctacgcatttctacggtagtgtttcgaaataaaaacattaaattttctcggaaaattcatgtaggcaaacaagttttacgctttatgatttgaaaattaatatgtgaaatattacgcgggcaatgtttggtgtcttaattaattattatgaaacataaatggctaattttgtagcagacattcctaattattaccacagccagacagcagatctttccaagagtccctcctttaaattttcataccaaaaaattctctttcgtcatgaaaatatttttcaaaatttgttaaaagattgttttggcgatgacgcagttgccattaacacaaacaatagtcaattatattttatagtgtcagtcacttattaacagacaatatttaactcaagagttttctctcaaattgcctttattcatttgaacacaaaaattttcattcgacaaaaaatgtaaattttgaggaattttaaaataaatctaaaaaaatatattaaattttcgcacattctcctaagtttaattaaaatgatatattaaaaaactttttaataaattttatcaatgattcagaaaactacaatattccaagggaaaatttaaaatg

SEQ ID NO: 110781 - DNA, 131 bp, Heterodera glycines
  Promoter: Source sequence=SeqID_9612; Location=1..131; Strand=+; Gene= SeqID_72090
aaatgttttctctaatttgcatttttgaaattaaacagagaaactcatagtttatggagtctctctcaactctctgcggttaaacaaacattttcttttggaaaaaccaacaaaattaatgagcaaaaatg

SEQ ID NO: 110782 - DNA, 666 bp, Heterodera glycines
  Promoter: Source sequence=SeqID_19689; Location=1..666; Strand=+; Gene=SeqID_84429
ttctcgatatgtaagccattttagaccaaaaataaaaaaactcgaaaatttagtttcgactttttgcttgaattcgggttcggggtccgacataggtcaaaattaatgtcagattcggtttctccgacccttaaaacccctaatatgatcttctcgaaaaatttttcttaaaattttgtttttcgaaaaaaggggggggggggaggtaccatccgtagcaatctgtacaaagtgatgagcaacagcaaaagcacagcgacggcaacaacaaccaaaaagattcaacatttgctcattttttattgaaaatatattttgtcggcatcaaacatcacacgccaaaagttcagccccaaaagagtgatgcgattgacaatggcacaatttcgccgttcggcaatggctcggcaccgcgacgaaagcctaaaaaatggccaaatttgcaaaattgtaatatgtaaagcatattttgtagagcgcgaatggacggacggattccggcggggatttttcggtaatagtagggtttgccccccccccttttttatttgtccctatttcgaatcccggacccgaattcgaacaaaagtcgaaaattcaaaattttgaaaattcacttttatgttcgtacctgtataaaataaccatttttttgcggttacaatg

SEQ ID NO: 110783 - DNA, 384 bp, Heterodera glycines
  Promoter: Source sequence=SeqID_26501; Location=1154..1537; Strand=-; Gene=SeqID_57231
tgatctgtttctataatgttgcgtctaaacgttcactgataaaattataatgttcaatattcttgtgcagagaaactagtccttcacaccagcaatgaaaaatgctatcaaatttagaatgccagcctatgaacattatcactaactataggacggagacagtgttgtggactcggacgatactgtaggaaaattttatgatttttaaaatttgtattcaattttttaaaattctccccagcgcctaaccacagtacctccatttcaaaaaatgaaagattttaatgccaatttaaaaaatgtatagaaaatagaaacagtgacccaggatttcgtttgctgatcaatttttgggaaattttgagacataattcttttcttatg

SEQ ID NO: 110784 - DNA, 208 bp, Heterodera glycines
  misc_feature (63)..(63): n is a, c, g, or t
  misc_feature (71)..(71): n is a, c, g, or t
  misc_feature (93)..(93): n is a, c, g, or t
  Promoter: Source sequence=SeqID_34350; Location=1..208; Strand=+; Gene=SeqID_64173
attttttaaatttattttccgtcaggagcaagagcataattctgtattcatgcagtattaccnaatttcanaaatagaggctttttgccttgnatctaataaatttacattaaaattttcaatcgataactcgttctgttttacatttttttgaatagtttttttttacatttttctctaactaagaaattctcaaacacaaattatg

SEQ ID NO: 110785 - DNA, 734 bp, Heterodera glycines
  Promoter: Source sequence=SeqID_19248; Location=1243..1976; Strand=-; Gene=SeqID_83993
tcgcagcagcagctgattgcaatacttgaggaaaataaattactccaattttggatgagcgattggatggatgtgcggcggggaaagaaagggtctcaagttcgtaaaaaaattcggttgtctattaattcactccaagtttagttaattatattatattaatttattttttgtcatttcttcacagctaaatatatctgtacagcattgaaggctttaacccaaattactaattatctcattatgtataattattattttagttaaaacatccaatgactgttctattaatccggcacaaaagttaaacgagtccattaaaaatgtcggcttcgtcaaggtgcagcacaaatgcgagtgctggcgagccgtttttctatttttgtcggcctttccaacattgagtttcggcgacgagttacttaattcgtggaggagaagggagttggaaaggagaaaaaacgcagacgaattgggtttggtcttcaaattccattttgttatcttgtttattagccatcctttaattaggtgtccccgagtgcaaatcgaacttcgactgtgtgaccagcggcgtttgtgtgaaggatagaaatggaaaggggcgctgtttctgttcgagttcatgtccattgagtaccgtttttccagttttgtggctaaacggtcgctttgtattttcagttgtgcctgtgcagtgttccgagaataaccattacagttgcgtgtcaatg

SEQ ID NO: 110786 - DNA, 1003 bp, Heterodera glycines
  Promoter: Source sequence=SeqID_20330; Location=549..1551; Strand=+; Gene=SeqID_50841
gaaggacgaacccattctggtgcaaaatctgttaagaaattggaaatcggtcaacatttacaataaatctaagaatttgatacttacaaactacaaaacttaagtttttaaacaaaaatttataaaattgtttcaaaaagctcatcccgcaaaaagggttatgaaaagcaaaaaagaatgtctgctcgcccgctgccccccccccccctctcgcaatcggttggacccgaattcaagagcttttgtactgaattccggaatttatgtattacgcattgtcgagctctaaattactccgttttttgatagttgaacaaaatctctcaacaaatgtggctcaaattttcaaatttttttttggaaccaaccgttaaaactggcaataaattgcatcaagacgaaaaatttggacgatttttttcctcttaaaatgtttaattaatttttccagaaaaataatttatttttcattttacaaataaatcaaaatattacgtaggatttaatgaccgctataaaccgaaaatttattatttctttaattctaaaaatattttttacaaaatattttcaaaattaatttttgtaggatcgattaaaggacatttcagtaaaaaataactaattttttaaatattggctcagaatctttaaaaataaatcactttggtgcaaaacctaacaaatggagacaaaatgaaaaaatcttatttaaatgttaatttcccaaattggcaatcatttaacgattttccatttatgcccaaatttatacgaaatgaataaaaaacaaaagataatgatgatgttcatcagcaacattgaactctttgaagccattcactttgagaaccgccaaaatgcttaccacggagcaaatcaaaaaatccgctgattcccgacgattgcaacggtctgtttgaactgcgcgggtgggcagggttcagttgggtcaaaaatgatgggtctgatttaaaaatacataaattattgggaaaaaatg

SEQ ID NO: 110787 - DNA, 155 bp, Heterodera glycines
  Promoter: Source sequence=SeqID_1636; Location=1..155; Strand=+; Gene= SeqID_74991
attttctggcatttttcaggtacatcgatcaaaatgtgctcatttttctcagccattttcaccattttttcgcctccacttatacagtggatttggacattttcaccgaagacagtcgcattttggaatttctgttgctcaacatttggccaatg

SEQ ID NO: 110788 - DNA, 1003 bp, Heterodera glycines
  Promoter: Source sequence=SeqID_30443; Location=22..1024; Strand=+; Gene=SeqID_60849
cggtcggcgccgaaacgtttgggtcccaagatataaacgtatccaaaattacaagtaattattttgttgtattcaattaggggccggaagtgccaaatgtctctttttgctaatttttgaattgttgatttttgaaaatattatcttgcaaaagaataaaaaaatttaatttatacaaaaggcaaattttttattctttaggatgaataaaataaataaaaagaattttatcattaaggtcattttttttatattttccaatttacggaatttttgcatgtaaaacattcagaaattattatattacatacaaatttcaattcattttcaaattcatagaaatggcggaccattaaaattaataaattaagaaaaaaaatatttaaaatggacaaaatgtgacaattattttgttacttaaaatttccacaaaaggatcatttttgaataaaattattttaacaaatcagaaggaaaaagatcattatgtcattagatagacaaataagttttctatattaactcttacaatttcaaaaaaaaaaaattttttttggtttttgctttgtaaaatcacccaaatgttctaaccattttttacagctaattgggtcattccgttcgcaattttgaattttgcgcaacccaaatataacatccgatggctttaacaaagcacaaattaatccgacccatttattttattttgtgtgtcaatgtcaagtcgttttggtcataattactcatccaataagaagaaattgaagtatatttaagcgaatggataagtaagcaaaaccaaaattacaataaaactttatcattattttaaaaatgaaattttattgacaatgaaaacttttttaaataataaattatttttcgatatttatattttaatctataaaataataaatataaatttttcataagtttttttttggcaattttaaaatatttccattcttctattatttttcaaatttagcacagtaaaacaatg

SEQ ID NO: 110789 - DNA, 151 bp, Heterodera glycines
  Promoter: Source sequence=SeqID_9181; Location=1..151; Strand=+; Gene= SeqID_70506
tcaaaaaatttggacgttggttgaagaaatcaaaagctatggttaaattattggaattgcttattttattttctaacttaaggtaaaggcatgtgcggattacaaaagcgacatctctcggcttattcggcgtgttccattggcttggatg

SEQ ID NO: 110790 - DNA, 307 bp, Heterodera glycines
  Promoter: Source sequence=SeqID_22522; Location=1..307; Strand=+; Gene=SeqID_53188
ttttaaaaaatattaaattttgcaaaaatttaagtcgaagcgatacttgaaaattagatttgatgttttctataaatttcggtgtataccgttggaacaaaaaacatagcgaaatttttaaataaagttctgaaattatatgatactttttatacccaacagacctctaaaatcgataataaaacaatcgtaccctcaaaaaataagagacttattttcagagaaattacggttacataagcttgtaaaaaaattcccggaaaaaagtgatctcatcttaaattacaaaattatttcaagggaaatg

SEQ ID NO: 110791 - DNA, 385 bp, Heterodera glycines
  Promoter: Source sequence=SeqID_14262; Location=1377..1761; Strand=-; Gene=SeqID_78281
gccaaaatggtttatgatagatttattaaataatttaaatactttttagcacattttccaccgcaattgcatcaacaaatggtcaattgaatgtgaaagatattccgtaaaaatgaataattatgcatttttaggttttcattgcttgacagactccgatgccctttgtgtaatcagcaacccaatcgtgttttggttggtaaatttgttgtaattggcaaattttatccaatttaaaatgataaatgatggatgagttaatttatgtttaaaacaaataaaccaatttaattttacaaatttcggattaattatccctgatttagtcaattatttccttttcattattttgcacttcctccgatttgtcctcaaatttgttatg

SEQ ID NO: 110792 - DNA, 151 bp, Heterodera glycines
  Promoter: Source sequence=SeqID_3504; Location=5842..5992; Strand=+; Gene=SeqID_84946
ttgtagcagaacaaatgagacatagctgacaaattgccgggggcttttatactccccggaaaattaggccacgcccactttttaaaactatttaagccaagattttctcgcacaatcaaatcagtcttgcaaaatttcatcaacaacaatg

SEQ ID NO: 110793 - DNA, 501 bp, Heterodera glycines
  Promoter: Source sequence=SeqID_11213; Location=1..501; Strand=+; Gene=SeqID_74571
ttttgtgaacgtaattgttaaccatgctcatcgattaaaacatttgaaaaagtatttgcgaaaaaaggtcaaaaaccatttgaaaatttcgtagaaaaaaggtcataacatgtgtcaaacagatgaataaaacgaaaaaaatgaaaaaatatacgagaaaaggtggtaggtctaaaaacaatgaaacaaatgaaaaattgtaatatatcgcatttgacagcgaatcaaaaaaattcttagagatgaaaactaaataaatgaaatacgcgaaaaatataaagatagaaagacagaaaaaacaacttaaatatgaccgaatttcccgccctccctccagcatccaatccctccctcctcccctaccgcgcttttcgttgaaaacatgtgaaaaacaaatgaaaaacaggtgaaaaatatgtcaatgtcaaattaggataacagctgaaaaagagtaagaggctataaatgttgaacaatgacgcattataaccttaaaacatg

SEQ ID NO: 110794 - DNA, 280 bp, Heterodera glycines
  Promoter: Source sequence=SeqID_36313; Location=250..529; Strand=-; Gene=SeqID_65659
cctgcaaaatctaataagtggaaaatacatgagtatagaatttattttcaaaaagtgtcaacagacttttggaaaaatatatttgcaatttatcaacaattttgagaagtgagttagaaatgataaacttcacgattcaaaccagttttcggtgctctaattaaccgcgataaaaacattcgaatcaattaaatagcttctgagataataaggtttatcataaaatttcatttaaaaataaaccctcaattattggtatgaacgatactttccaaacatg

SEQ ID NO: 110795 - DNA, 1003 bp, Heterodera glycines
  Promoter: Source sequence=SeqID_23596; Location=65..1067; Strand=+; Gene=SeqID_54287
tttaaaaaatctagcaaaagtttacaagttgtaaccaaaaaattttgaaaattttcgactcaatattaatgaattaccgtatatgctctaattatagcccggtctctattaatcccgcagtctccaattatcccccagtctacgaggtgttttgaaagataatccctctatcataatcccccagtctctaattatccccccttttctgaggaggttgaaaataatcccccatgggctataattagagcatatacggtaaatgggccatatttttatcataaaaaatgtaaggttatttaaatgcatgaaacttttaaaaagtttcttttgggaaccctgctattcagggcaaagcacaatatgcttaatattcattcattttctcaatttttgcctttctcttctattgattttcttcgcattatttttaaaggagacatttgaaaatcgattaaataatttattttaataaggcaaaagcaaaacgtaaatattttatttatataaatttgtattttatttagaatttatttattaaatatttttacatatttcgatgaatttacaaaaatattttcttgttattttgtttggtttattttctgtaaatgtgacatcgagaaaaaagtttgtgaaaaatcatcaaaaaatgaaaataattaaattaaacattttaattaattataaattttaccatataatattttaagtttcattaaaaaaaatattcagagatttgaaaccatacaaaaaaggaccagctaaactcataggaaaagaaattaaaatttatagaaggtaaaataaattttattaacaaagcaaagttactgagaagaaataaattaataataaataaaaaaattttatggaatttaaattcgattattttatatttttattttatgtatttattttgtttttttcaaaaagaaaaaaagctgaagggactcaattagaagatgccaaaaatgttaattttgctggtgaagactataaaatg

SEQ ID NO: 110796 - DNA, 58 bp, Heterodera glycines
  Promoter: Source sequence=SeqID_29791; Location=577..634; Strand=+; Gene=SeqID_60250
agtgagtgtttttttttttgaaccaaaccaataaaaatttcaaacaatttaaggaatg

SEQ ID NO: 110797 - DNA, 274 bp, Heterodera glycines
  Promoter: Source sequence=SeqID_9500; Location=1851..2124; Strand=-; Gene=SeqID_71648
ctccgcacataaatttgtcgataaacaatttgtcgacaatatttccgtaccagttaatcaatgacccgttatttgtctcctcataccacagaagagtgaaaacagtcaaactgaccaacaacaacaaaaacaaaaaaaattttcgatgcctcaaaatgtgcggaacataacaacccataaaaatggatttactaaatgcaaaaaaataaataaataaatttaaaaatacttaatggcccatttgatggataatgaataatgtctcaagcaaatg

SEQ ID NO: 110798 - DNA, 515 bp, Heterodera glycines
  Promoter: Source sequence=SeqID_4082; Location=1..515; Strand=+; Gene= SeqID_53104
cactatttcccttttactctgtgtctgtttttctttgtttgttttcatgggcagagattacgaaatttttgccccccacacatgaccatttacagcccgaaaagcacatttcttctgccgattggtcatgttttcccctttcattgtcctaaatacaaaaatctgttcaatcgcttttgctctctccgttggttcactttattaaatatttaccgacaatttcgcataaaatgacaaaaaattttataaaattggcacaaaaaagacaactcaaatttccgacatgaattggcactggcatttgattctcatacattttcacattgctgaattatgagctattaatgtcatttgaaacatttgcgaccaattttccacaatgatttaaagaaaatttgtaaaatttcaaacattgcttaagttttgcttaaacgttggcccatcgctggccaattcctttgaattcataacgaaattttcgaaaaagttcaaatttttaatatccggtatgaatg

SEQ ID NO: 110799 - DNA, 359 bp, Heterodera glycines
  Promoter: Source sequence=SeqID_3351; Location=3226..3584; Strand=-; Gene=SeqID_84324
tttgtcgcaccaaaaatggttgctggacctaacccttcgggggattgtggttcgcaccaaaagtcgtcgctggacctatccctaagggggattgtggttcgcaccaaaaattgtggctggtcctgcccttttgggttatggaccggacatttttgcatctgcattcttaatgggatgtgtgagccctgactgatgtatttcagcattggacgactacactccacagcgaagaatgatgtctttgacctttatttgtgcattttttgttaataaatttttaacatatgtgtgcatttattggttaattacctcatatttttgccgcatttgtaatactttctgatttgttgttttagatg

SEQ ID NO: 110800 - DNA, 671 bp, Heterodera glycines
  Promoter: Source sequence=SeqID_40252; Location=588..1258; Strand=-; Gene=SeqID_68652
aaaaatttatcaaaaaattcatctccaaaataatttatttattttcttaacaagaatttttgttttaaaaattatttagctcaatactgattttggcctatttttttacttttttgaataaattttgtcattttgcaccactaaataaatttgagtttttagcaactattttcccatttttagcaattatttttggggttttttataacctaaaaactaattattttggcagttttagcaacatagaatttttgtttttgaggaaaatgttggtaaaaaatggagcctattgatttcttttgacaaaatgtgtgtcctaaaatgtttgtgaaatgtatttgcggtcggtcgatggtcaacaataatccattttatacaattctttaacacaaatttaaaaaagtaacaaattttgaattaaaattttgaattgccaaaataatatcagattaccgattttgataaccctttgaaaatgttttggttttaaaaaaaattatcgaaaaaatcaatggcgtcactctcaggcggtgctaaagggatgtgaagatggtgctggacattaaaccagtgaaaaaataaattaattaattattcaattaaaagtaattttttatatatttcgattttcatttaacatttattttattgtctcaaagcgcattaaaatg

SEQ ID NO: 110801 - DNA, 663 bp, Heterodera glycines
  Promoter: Source sequence=SeqID_1827; Location=564..1226; Strand=-; Gene=SeqID_76211
tttctcatccaaattaatcattcttggtattattcgaaagcattggaaaaatgctagtatcgtgcaaattttcaaaaattttttatttatgcacaaaaaaatcagagcaaaaaaaagttcgaattgctgggtttttgagttccttctggccataacttttttgaaacttaaccaaaatttttgagattttgcaaattaataataaacacatagagttatcgaacaacaccaacaattcttaatttgattgacagtgaacaaagttatggttcaaaaagtcttccgacgacgtttcggccgacgacgttttggggtgcaccggaaaaaagcggaggcatacccaaagggtgacatgggagaagaaataactaaatgataaaaaggtgcaaggtcgatgcgaaaaaaactcactgattgataaaataattaaatttaattgtgccgtttcgttaaattcatataattatattaataatcaatgtataggtatattttggtataatgtctaatacatttttttattctcagcaaccaatgtttttttaggtagtccacaaatttggccaaaagtttgccaccattttgtcaaaaattggctatatccaattagtggaccaattaaacaaagtgtttgctcgcaataaaaaaaatgatgtaaaaatg

SEQ ID NO: 110802 - DNA, 438 bp, Heterodera glycines
  Promoter: Source sequence=SeqID_21458; Location=1436..1873; Strand=-; Gene=SeqID_52065
aattagtgttagagctagttggcactgaggaggagaaaccaaggtgtggtgtcgagaactggattagtattggaaatctcgtaccccaatttaaactgaaaatatcagatattatgcaatacctttcgaagtgcagtcggagccagcagtgatcaaactgatgcaaagcgggaaaaaattgcacatttatgagtggcatatttttgtggcagtaaaaccaagagggtacagtttactgggtcgatgctcatttgggcacatgaaaatgccgtcaaatttatgattggcgtgccagaatcgtttttggaacaataaattaaatgtagtattaacattttatgtcctactcagttcttctatctaattgtaagcattagtccaaatgtcaagcgcccagtcttatttgaagagtgcataatgccaaaataatacatcatg

SEQ ID NO: 110803 - DNA, 165 bp, Heterodera glycines
  Promoter: Source sequence=SeqID_13010; Location=1463..1627; Strand=-; Gene=SeqID_76785
tgatttaaacctattaaaaataaaataaaacaatagccattttccctttctaacaaaaagctatcctctccatttccatttccatatttgcttacaattagactgatttaagcttttttcgataagatttctcattttaaatttcggagtttggttttaaaaatg

SEQ ID NO: 110804 - DNA, 599 bp, Heterodera glycines
  Promoter: Source sequence=SeqID_15717; Location=531..1129; Strand=+; Gene=SeqID_80038
tattcaaacactaagagtcgacctagagatataagacctgacttcgggacaatatgaatctcaaaaaaccccaaattttttcattatttaagactcgagagcctaagcactcgatcagcattcgatatttttcagcaattttctcaaatttaaaataaattcaatttgttattttataaatcagcttcattcctttttctaatttctaatttttaaatgagaacgaggcactgccgagaaaatgaaacattaaaaacacacataattttcagatttcgcttggactagccgagtggcctacagattaagcattgtttcatgaacagattatgaaaaatatttaattcgaaaggatgatatgaatgttttcttgttgttgttgaattgttaaactgttggggattcaaaaaatttgcaattattgaggtaaatataaataaagtaataaatttttgaatttttaattaataatggaactgatggacccagaaaaaggcttttacgaggggggagctgatttattaacattcagagctgaaatcaatttagcttttggcggctcaatcggaatttttcaaaattttctttttttggatatg

SEQ ID NO: 110805 - DNA, 237 bp, Heterodera glycines
  Promoter: Source sequence=SeqID_17098; Location=1..237; Strand=+; Gene=SeqID_81530
atttaggacatcgacaaattaagaaaaaatttggttttgagtcaaagagtgttggtttatgaggaggaggaggaatagaagggtgagcacgaagtggacgaaggagaggaggacgaggaggaactgttcaaggaagacgcagatgatgacggagagggggaagaggacgacggaagggaggaagagggggaggaatcagtcgccactaacgaagacgacgaagaagaatggttgatg

SEQ ID NO: 110806 - DNA, 358 bp, Heterodera glycines
  Promoter: Source sequence=SeqID_2730; Location=1..358; Strand=+; Gene= SeqID_81296
ttttttcttaagaaattcatataaaaaacagagaaaaatgacaatgacagtcattttttcttcaaatattattattggctaacaatttcaggcaaatgccatgcaaatgcttttcattctttgcttttgagcacctccatattattgcttctctaaaattccaattgttctttcatttattttttcacacacaaaatcaaaaaccaaaactaatccatttaaattgaccagttgtacagtttttttctcttgaatttttataaagaaatgattgatttctttcaatgattttaatcagttttactaagctaatttaaatccaccgagaaccatcttaataatttgccgcgacaaaatg

SEQ ID NO: 110807 - DNA, 141 bp, Heterodera glycines
  Promoter: Source sequence=SeqID_29895; Location=1..141; Strand=+; Gene=SeqID_60355
ttgtattttcaaaagaatcaagtccattttgaatttgtattttagggatgtgccagctggaaatggtactacccttaccactacgcgccgtttgcctccgattttgaactgatcgccgatttccaacccgacttcaacatg

SEQ ID NO: 110808 - DNA, 661 bp, Heterodera glycines
  Promoter: Source sequence=SeqID_119; Location=1955..2615; Strand=+; Gene=SeqID_72906
tttttgagggggaataatgaaaaaaaaattttaatttaaaaactgataattttcaaaatttagcgctgttctaaaacttgaatcaaaaagtcgaaattctattttgttgtttgagttaaggattcgaattggtcaaaaatggatgtcagatttttcaaaatccgagttcagtgattagcgtatttttaagcctagaaaaagtgttacaaatttaaaaaaaaaatttttttcgggaccgcaattccgaaagattgccagttttattgttttaagttagggttggttcggtgcgtttttaccttttacttcgagttcgaataaaaataaaatttcaaaatttttttggcaatttttatggcattttgttttcaaatttcaaaagaactttttttgatctttgattctttgatacttctctttcattggattttggcgattgaattggcttttttcgttttaaaattgatgtataggcccaaagattagttaaaatttttctataactccgttttttttattaatttgtatgaaaaaataaaggtacaatcagaaattcttgaaaatttttgatttaaatgattttaagaaatttggattttgtcatacgacttatttactaattttagcattttacaaattcgtgccaacaatttgagggatg

SEQ ID NO: 110809 - DNA, 394 bp, Heterodera glycines
  misc_feature (119)..(119): n is a, c, g, or t
  misc_feature (130)..(130): n is a, c, g, or t
  misc_feature (199)..(199): n is a, c, g, or t
  Promoter: Source sequence=SeqID_12172; Location=741..1134; Strand=-; Gene=SeqID_75748
agatgaataataaaatgtttcctaagaaagtctaggtttcggtggttcgttcgtctgcgtttttctctgtccatttctgatcttattgttatttgtctcgcacaaaacaaaaaactcanttaaaaccatntattcgaaaatttgttttcgcatattatacgatgtggacaaattcattttgatataaacatctcttccntaataatctcgtgaaaatcttctttgattttctttttaaattgcaacaattctcgagaaaacgaaataaaacataaactcattttaatttatgtcaaacaaaaatgggtggtttaccagttagattataataaccatttaaattacattaaacaaaatacatctaacgttgaagacttaaaaagccattgaaatg

SEQ ID NO: 110810 - DNA, 62 bp, Heterodera glycines
  Promoter: Source sequence=SeqID_20330; Location=1802..1863; Strand=-; Gene=SeqID_50842
cctttaaaatatagaatttttctccctatgaaagttaaaatataataatttaaatttgcatg

SEQ ID NO: 110811 - DNA, 174 bp, Heterodera glycines
  Promoter: Source sequence=SeqID_22798; Location=1588..1761; Strand=-; Gene=SeqID_53499
taaaaaattattataataaaatattttgcgacaaaaaaaggcaatttcgagaaattacaattcaaaaaatagattatattaaatagaaatagtggtttttattaaaaaaatgatcaaaaaatttcttattacttttttgttttttaaaacaattaaataaataaattaaaaatg

SEQ ID NO: 110812 - DNA, 538 bp, Heterodera glycines
  Promoter: Source sequence=SeqID_5539; Location=1450..1987; Strand=-; Gene=SeqID_58388
tcgcggagccattagaacacccaaagactgtctaaactcgaaaaaaggagtcaaattaataatcggaactttgaaccaccccggctacaaataatttctgttttatgtgcccataactcaccgtcaccgctccatttttgggtgaagaaaagcattggataagcagatgatgatgaagttgtcattaaaaaagtaaatagcacagagaaaagtttctaaaatgaataataattgagacaaattgtaaaggttaaacatcaaaattagggaacgtgggagggttgtatatcaaaaaaactcgtaaacaggataattaatcagttcattcctgctcaaaattagctgcacattataaaaattatttttaaagcattttttgtttattcaaaatatcaatagcttacacattaaataaaaagcctctcaaattttgttggttaaaacaatttttcaagaaaactgttcaaatgggtcttggtgggaaagagtaataaaaaagcgtaattatcataattatacagccaaatgagcacaaatg

SEQ ID NO: 110813 - DNA, 1003 bp, Heterodera glycines
  Promoter: Source sequence=SeqID_879; Location=299..1301; Strand=+; Gene=SeqID_63215
gtttttgagattactaggctcaatttgtatggattttctttaaaaaatgatacaatttgtgtcaattaaaaaaatatgagggaaaaattaaaattgtccaaataaaaaaagaattttttaaaaaatcattcaaaaaaatattttgtcgataggaaaccaatgaatatacaaaaagaaaattcaaaatattttaatttctgtagagggattgaacaatgggaaagaagtagaaaatcaaggactagcctctagatcattttcataatttgccccccgaggggtcggggagcaaccctactttaggatctcttaatattttataaaatttaatcagaattgcagcaaaagcgagatttaattgatcgagttcccatctcggactattttccagtctcgacactgatctcgtttttttgatcaaatttcatgctttactattattggacaaatttggacgaatcatttggttaatctttttctccaatttgcttattcatcatcatttccaatcactgggaaattttgctcttctggctaatagctaaaaccaacatgttaatgtgcataaatttatttgattttgtccatttttagtttaaattgatataggaatgggctaggaaatatataattcatttttatagaattcgttccaattttaatttaaatgcacagaaaaaatttcattgcttatctgctgaaattaaattagcaagattcattaatttatgaaattatttcttgtccattttaatgttttcagcggattttataataattaatttgatttttattcaacgtttgtttgcaaaaagattgaaaaaaggtggggcttttttgattaattaaattaatttatttcttacacaatttagtcaaaatgcatgattttgattttgcattgttttttctgtttgtctccgtgcatttgttgtgttcgtcaggtaaaaattatttttaaataaatatatattaaaaattatttaattaaaattaagctatg

SEQ ID NO: 110814 - DNA, 107 bp, Heterodera glycines
  Promoter: Source sequence=SeqID_2956; Location=4199..4305; Strand=-; Gene=SeqID_82494
ccccccccccattgtgcacccatttttatttgatattaattttttaaaattttagctaaaactgcgcaaaatgttcaacggagagcagcaacaacaacaaagcgatg

SEQ ID NO: 110815 - DNA, 286 bp, Heterodera glycines
  Promoter: Source sequence=SeqID_18471; Location=1812..2097; Strand=-; Gene=SeqID_83082
tgatcactctttaagcattaaatcgctcataaaactgctttgaatttgtttgtcaaatcatttaattctttggcaggttgccaaatgtatgttcctcttgcgaagcatagtgaaaatgatcagatcacttcctgataatttgctgcttaactcacttccggagaaacaatttcaagcttcaaaattcgtgaatggttttaatagcacaaaaaaataaattaattacataaaatttcgaataattatttaataatttcctaattatccccccccccccccattaatg

SEQ ID NO: 110816 - DNA, 342 bp, Heterodera glycines
  Promoter: Source sequence=SeqID_8127; Location=2805..3146; Strand=-; Gene=SeqID_67063
ccttaaaatgaaaaaaaaaacattatttgaattttgcttacgcctgttcaaaagataaaaaatgtaaaaacacttaaaatagttgaattttgcgaaaaatagaattagaattttatttcatcatatctgtattatttgcatttattattattattttaatattattaaagagaaattatccaatatttatgatttgatgaatataataaacatgtaaaaaatttgctaaaatggagaatttataagcgataaaatcatttgtaaaaaatattaaattattatttatacatttatgttaaattaaattaaattataatttttattaaaaaattgtcagcaatg

SEQ ID NO: 110817 - DNA, 144 bp, Heterodera glycines
  Promoter: Source sequence=SeqID_23855; Location=1243..1386; Strand=-; Gene=SeqID_54545
accaaacgaatgtagaaattgttgccaaaattgtgagtccgcttgaaaccatgggggcgctaattggggatttcccaacaggatgatgaatcggtcgagaaagggcctcaagattcttctgaaaaggcgaatgctggagagatg

SEQ ID NO: 110818 - DNA, 299 bp, Heterodera glycines
  Promoter: Source sequence=SeqID_6984; Location=2755..3053; Strand=+; Gene=SeqID_63495
aaacatcaaaaacccgagactttgttcggtccgagactgagactcgaaatcgcattaggacatatggaaatcttcagactttgtttaaaggcataaaataccatcgcttcgttttaagatgattctctgcctcatgcaaaaaaggaaataaataaataaaattaaatttaaaaaataaaattccttttcgaaatatttttctttttataataacaaaaaattaaataatttaaaaaacggaaagcaaaaaatattcaaaacaaaattaaggaacttatccaaccgatgaacaaagaatg

SEQ ID NO: 110819 - DNA, 355 bp, Heterodera glycines
  Promoter: Source sequence=SeqID_4999; Location=1..355; Strand=+; Gene= SeqID_56501
cgacctagtccccagttacagacccggtactgaaatgtccaactacccccgggactaaatcgtctaatggcttttttaggaagcataaaaaaggcgcaatttatttattaatttgtcaaaaagaaaaataatcgatgaaagggaagcaaagctccaagactttttgaattactatttcttcggatgtccaatatcccattccgcccggttcttcaagtgtatccgaatatataaagcggaccaaatccccttccagtcatatccttcatcacttttattccatttgtttgataaattttgttttttcagttaatttctttttaattttctgtgcttaccaattcaaaaagaaatg

SEQ ID NO: 110820 - DNA, 193 bp, Heterodera glycines
  Promoter: Source sequence=SeqID_18966; Location=1173..1365; Strand=-; Gene=SeqID_83700
tctcttacaagtgggtgtgaggcgcaataaaaagtttttggcgttcgaaattttttcgcacattttggaaccaatgatgtacacactattaccgcgatttgctcaccacgaattttgttttaatggtattttaatttaagcactcattctgatttaataaattataattaattatgttttgttaccaataatg

SEQ ID NO: 110821 - DNA, 99 bp, Heterodera glycines; identical to SEQ ID NO: 98824
  Promoter: Source sequence=SeqID_1506; Location=708..806; Strand=-; Gene=SeqID_74050

SEQ ID NO: 110822 - DNA, 324 bp, Heterodera glycines
  misc_feature (99)..(99): n is a, c, g, or t
  misc_feature (114)..(114): n is a, c, g, or t
  Promoter: Source sequence=SeqID_12448; Location=1..324; Strand=+; Gene=SeqID_76076
gatggcaactttgtcaaaaaatgaggtcactttccgtcgggcgtcgcattttgcgattttaaattttattgtaaaataggctcaagtgactttcgatgnggatgagttggattngtcgccatatattcacgaaaagtctctgcttcccaacacggcatttactctttatgccatgacggtgaccaaatggctaaaactgtcctaattacgctaattgctttaatgcctttaagaagcatatcggcagtttgcaccttggtcattacacatcgactgtggttaatctgacaagcactgagcagcaatggctaagctttaacgatg

SEQ ID NO: 110823 - DNA, 485 bp, Heterodera glycines
  Promoter: Source sequence=SeqID_18690; Location=604..1088; Strand=-; Gene=SeqID_83359
ttttttttgggggggggggtggggtgtcgactatagtgcacaatttattgcaatttttgttttggattaaaaggaagtaaaacagtggtaaaaaggtagcaatgccaaaatagtaaaggcaaatttttttttttgtaatgacgtttaacttatgaattttcacgcaaaaaaggtgctctcgtgcatatttcgttgaaacaaagctgcaaaaaattaaatcactaagttttcagccctagtaatataaaattaattgtcattttttcattagtaggatggcattcactgcaaacaattaataaattattggtcgaactgccacatattcgtgcgtcaccaaaagacgccatttgatttgtatttacataagcaaattataataaatgagtgtctatttcttattaaatacggcaattttcattttttaaataataaaaaaaaaatctttaattaaatcaaattaataatttttttagaaaaaaatg

SEQ ID NO: 110824 - DNA, 1003 bp, Heterodera glycines
  Promoter: Source sequence=SeqID_10310; Location=502..1504; Strand=+; Gene=SeqID_73490
aactttatttgtccaaaatggtccaaaaaattatggaaaggggaaaatattttattcctacccgatccttgggcagataaaagtagggaatcggggaggaaaatccacgacaaaatttattgggggttaaagaaatttatagtgtcggggagcaacacccactcacgttggggagtaaatttccataaaaagtcgaaaaattatcaatttcccgaggaggaagccctagttatagctataaattttgaaatttatttttattgtgcacagtaaattcgtaaggttataaatatcatcggtcgtaataaaaagaaaatgcccctttttggcccaaaatggaaaagcattgattgacaaattttgcgaacaaaaaaaaataataaatttatttttcgctttttatgccataaaattgattcgtttgttggcataaaatggatttgctaataatgaatgaatgctgccgcataagtaaagcagcataagatttaaatttatcttttagaaaaattccaaatattcaaacttttcataattttaacttacaataaataatggtttccattcgtcctttgtttcctgtgaaattcgtcttttttcaaagatatcatttgaaattggaatttggcccattaaaaatatatattttatgggaaatttaaaattatgcattctattaatgcattctattaatgcatttttttgcatttatttctcttattttttaaattattggcatcattttggtgaaatctcataaaaatagcaacaaaaaattcaaaattttcctgtcggtgccttttgcctccgaaaataagaaaatattcgaaaaatttgttggcagaaatataaatctaacctttattattctagtaattaataaatgtttggatgtgccttttgaattcaaaatttaaaatcaatctcggacaatggcatcaatggcctaagaatataaaaaatccagtgaatgaatggtattttttttaaatttaaggaaatg

SEQ ID NO: 110825 - DNA, 63 bp, Heterodera glycines
  Promoter: Source sequence=SeqID_5924; Location=1234..1296; Strand=+; Gene=SeqID_59698
ggtcggaaaaataatcattaattattatacaaattaatttttaaggcattgttagaatttatg

SEQ ID NO: 110826 - DNA, 1003 bp, Heterodera glycines
  Promoter: Source sequence=SeqID_9019; Location=413..1415; Strand=+; Gene=SeqID_70017
ggaattcaattggccattgtttgtgcacgatacgacgaatttcaggcaaaggaaaaaacaaaaaagagagaaatggacaaatggacacaaataaatggacaaatgggcaaaaacaaaataatataaataataattttgaatttcctttttcatttcacagaatgcgaacagtgagcaaaagcgtcaaatgtatcgtttaattcgccaattcgcgcatataaacggcgctgcgataattgtgggaatttgaattttaattgcataattaaattaagtttatctcagactttgagcattcgcatggacactttgctgaccaaagcgcgcaactttctgtccgatctgatcagtggagttcctctccaccagtttcaaaagtcattgtcaactgatccgcaacagccccttttcgttgtcccccatgggatcgattcgtttgaggtgaatcattttttgaactccctccatctctatcgtgatgctccttccgttcactctgtctcccctcgtttctctcatttctttgttgtctctctagctttttatatttctcagcctccttctctgttcatcattctctcttccttcctgttcattctttcaacgtatctctctcccctctctctcccccctctttctctctctctctctgctaatcattcctcttccttcctctacccctctttatctgctctttcctctctccctcctgtctctctctgctggtcattctctctccctcccactctttctctctctctctgtctctctctgctggtcattctctctccctcccactctttctctctctctgtttctctctgctggtcattctctctccctcccactctttctctctctctgtttctctctgctggtcattctctctccctcccactctttctctctctctgtttctctctgctggtcattctctctctccccctcccccaaggtcattaatccgtcgttgcgctctttgggctctttcagcgaggcgatg

SEQ ID NO: 110827 - DNA, 623 bp, Heterodera glycines
  Promoter: Source sequence=SeqID_2673; Location=1..623; Strand=+; Gene= SeqID_81012
aaaaaagcgttttattgattttaaatttggaataaaattttaaaaaatgatttttgctttatgattttaactataaaaaagtgttagaaaaaatttcgcttttcgcatttcgcttttcgcattttcgcatattttggcttttcgcatttcgctttttttttcatttcgcatttttcagtttcgcaaatttcgcttttcgcatttcgctttttatttttcaatttggcccatccctgatttgcactgcttctgaatttgcacgcacgtgagtagttacaagggggccagggtcccacttttggcgctaaatttgctttggcgccaaatttaaattcaaaattcctgaaagtgttgaaaattgaataatttatgttttaaaatattgtactattatttttgtaaataacaaaattttttattctcctagaaacaggaaattttttaattgttttcggcttttgtatcggaatgggaaattttttttctacgggaattgctgaacgtaattttacaaaatttttaatttttctaatatttttctatctaaagctgacgttgaacagccgtttggaccagaccagcgaccgagtgcgccggtcgtgtgtgtgtgtcgtcgtgtgatg

SEQ ID NO: 110828 - DNA, 485 bp, Heterodera glycines
  Promoter: Source sequence=SeqID_17543; Location=207..691; Strand=-; Gene=SeqID_82044
tttttgttgctgcaattagcacacttttccctttcccggttgattggtgtgtctcaaaagagcaaaaatctgttgttaaacttaaaaaaggagacaaattggaaaaatgagagagcaaaaggaacacaaaaacaccataagatacttttcatttacaccccccaaatttaaaaaatgagaggaaaatgcctgttttaacttgcaacaattatttaggaagataaaaaaggcgcaatttatttattaatttgtcaaaaagaaaaataatcgatgaaagggaagcaaagcgccaagaatttttaattactatttcttctgatgtccattattccatcccccgttcctcaagtgtatccgagtatataaagccgaccaaatccctttccagtcatatccttcttccctttcattccatttgtttgataaattttgttttttcagttcatttcttttaaattttctgtgcttaccaattcaaaaaaatg

SEQ ID NO: 110829 - DNA, 80 bp, Heterodera glycines
  Promoter: Source sequence=SeqID_2646; Location=3759..3838; Strand=-; Gene=SeqID_80879
gcaatttactctccgtcaaaattgaagtgcccatacctcagacggtataagtcatagagtcatgcggttttttgaaaatg

SEQ ID NO: 110830 - DNA, 310 bp, Heterodera glycines
  Promoter: Source sequence=SeqID_15894; Location=2167..2476; Strand=-; Gene=SeqID_80233
ttattgtaatgcacagcctggtgcgtgagtgtttggattggggaccgaagggtgaagccgttccctgggtgtgttttttcacttttaagggaactatatgaattctgatatgccttcaaatctatcaaaagagtctttcatttctaccatttctctttattttctattttacacttgttttttcatttgaatatttattcagaaataaaattgaaaaaatgtgtcattactaatataaattaaccaaacaaaaaggtatttaaggagagaaatagtcagggttttgtaactcaatttagaaattagaatg

SEQ ID NO: 110831 - DNA, 380 bp, Heterodera glycines
  Promoter: Source sequence=SeqID_31940; Location=212..591; Strand=+; Gene=SeqID_62258
atttgaagataattttatcaatccaaaacattcaaattgcattctctaagtgttagccaattaagctaaaaatcaaaaatgtcctatgtttacataaaaaaatgttctgaaaaacaggcaaaatttaaagtcatcaaatttatagattaatgattttctcaacattaaacaaaattggaaatcaacgatttactaattttcatcatcaaattttcttaataattttataacattaagtaagtctgtaaaattgagcataataattataaaatttgtaatactttttgctattgttataatataatccaaaatataaatcattttttaattgcattgaaaatattattttagatcctttcagactgtcattacagaaaatg

SEQ ID NO: 110832 - DNA, 1003 bp, Heterodera glycines
  misc_feature (935)..(935): n is a, c, g, or t
  Promoter: Source sequence=SeqID_25100; Location=522..1524; Strand=+; Gene=SeqID_55837
taaaaagtcgcaaacatgtttatgtgggttttcagggtcggagaacccgaatacaacattcattttgaccaatttcgaatccctgacccgaattcgaacaaaaagtcgaacaaaattttcaattcaaagttctcactctggtttctaattgatcaaaataagctaaatttaatcaaaaagcattgcaacatcataaaatggtcaatatgtatagatacgaacataacaatgaattttgaattttctactttttgttcaaatgggattcgaaattggtcaaagaatgctggattcgagttccccgacccaggaaacccaaatatacatttcacgactttttagaacaaaaattttttgcaaaaaatggggtccaccatctatagtattaccgagttctataataaattgaattcgggtccgggattagaaggtcgaaatggttattatattcgtgatcagcgaccccgaaaatcacatttcgtcaaattgtcgagcaatttttaatgaaaacaaatggccgaataactatcaattcttctaatttttttaaaacaagattgacgggaagcgtttgatttagtcggaacagaacgaaaacgaatcaatcattcattccgttcgcatttttcgccctttcccatttcatcagtttgtaatttcttttattcgtcaaaagtaattttaatcattttgttgtccaaaaactctatatttaaattcacaattattatttttaaatttaaataaaaattaataatttattcattgtccttcgtttatttgcttttgtttcagttgggttgattaaatttaaatatcattagcactcaattaatctccaatggcttgctgtggtggcaaatggttgttctgttgttgctgtcacgtgacaaaggcaaaaatcccttttcaatttctttatgacgaagacaatntaaaattaattatttataaatttaattattttctccaaatatgtattaattaggctgcgcatattatg

SEQ ID NO: 110833 - DNA, 275 bp, Heterodera glycines
  Promoter: Source sequence=SeqID_1309; Location=1..275; Strand=+; Gene= SeqID_72241
cgctttttgtcgattttttttctcgatttccttatcacttttgctatgttttgcaagccaggccagaaaaaaagaaatctctaaggattttaagcttttagggtctttggcgtcggtccaacacttttcttgagaagccaaatgtccaattcaatgaacacactttgttcacctttgaatcactctcacaaaatgaggtcgtccaataacggtcacttattaattattttagattaattaatttacagaaaaaaatatttttttggagtccaatg

SEQ ID NO: 110834 - DNA, 1003 bp, Heterodera glycines
  Promoter: Source sequence=SeqID_23152; Location=128..1130; Strand=+; Gene=SeqID_53857
gtatttctaacaatttttttgtgatagaaaggcttaaaataatgtgttaataagccctacgtgcattgcgacaataaaaatatatgttggaccaaaccactactatgcatttttggcagaaccccggattctgggggtgaaaatttttttggattttttaacaaatttttcctgatagaaatgcttaaaataaggtgttatcacgccctacgtgcgttccggcattataagttcatccctgaccaaactactgtgttccgaaaaaaaatgacatcaaaagctgaacaaattttacaactttttaaacaactttacaactcctgcacaacttttgcatcaaatccctaacaactttggtacaaatttaaaaaactattcagagcaatgataatttaattgagtaattttctatattctttttcgatagaaagtcttaaaataatgagttatgacgccctacgttcgtcgcaacaatataaatatatgttgtaccaaactactacgttgcacctttggccgagtcgcggaattgtggtgacggataaatttttgttttttaagaaaaaacttgcaacatattacgattaaataattaaattattttgattgatggaattttttacatgctagctaagcatttcattttaacgtctggatagcttttgaattctctctgtctttagaggtccctgcgtgcctgcacttatgccccagcatcttgcatgttagaggtccctgcgtgcctgtacacttccattggcgtctcttttcagcgtgttccctcctaagcagatagcacactattcagtataaaagcacactgctttgttcattgtgtcagtacgctgggtccaaatataaaaatattacctctcactttggttcacattacagtgtacagctaattattttttttatttatttttacttttacttaagtctattaatcaatttttatttcaagctagcgctatatttattttgctattattttaataaaatg

SEQ ID NO: 110835 - DNA, 1003 bp, Heterodera glycines
  Promoter: Source sequence=SeqID_5402; Location=769..1771; Strand=+; Gene=SeqID_57899
gaacacgcacactttagaaactgcttttttaaatattcacccttaaatttttctgttattcaaataaagaaaataattgcatcgaaattccttaaattctcataaacgaaatttttgaaaatattagggacgtaaaaaaatatcgagttggaacttcaaaaagtgcgaccaaaaactcgagagtcatgaccaagacgcaaaaaccggaaacttttctcgagtcgagactgagactctggagcatcaatcactacagtggacaatttgtcagcaaatttattttttgagcaaaaatcaaaaatcttgcgaaagtaattgtccacgcatggccttacaatttaattcaaaggaacacgccggagggcaacggcatttcaaaaagcacttttttgccaatggagcgccaaacgacctttttccagggtttctcagacgagcttttcgtaaaaaaactttatttcaaaggattggatacaaatataattttttaaatatgaatgttaaaatgagacttttagagattttcaaattttttcaacgagagctttttgaattagtgaaaaatgccctgttttgcaatacctctataccagtgaacccttccgggcattatttaaatttggcctccatgttcgttagttgaatcggtcaaggttaaaaaaatgattaaattagtaattgtaataaaaaaattttttagtttcgcgctagctttgcaaaaaagtcaatatcaccaccgtgatcactccatcaggtcggagtgatcagaattttagcaccccaagggactttaatctgttcaaccaatgtcgaacattgtaaaactgcattataattatcaaaccaatcaataattgtatagtcaattaatataataaattacatttttgctttattcactgtaactttgcttacgtcagtcattggcattcaatatgatgccacattttttctttgttaatgccttcatcccctatttgcgcgtatttcatttatgggcatg

SEQ ID NO: 110836 - DNA, 584 bp, Heterodera glycines
  Promoter: Source sequence=SeqID_10653; Location=1108..1691; Strand=+; Gene=SeqID_73896
tttttcgtaattttgtaggctaatagatactgtcaatctctttaaaaagatcaaactttttgtgatcaaattgcgagtaaaaatgttttattctaattgctttttttaaatttattttgtttattcataaaaaataaaaaagtcatcagaagggcgagaaccacttactctgacgactatcagataaatgtcgtagagtaagtgacaaaatatatggatgatcacaggaattaaaaaaagacaaaatatgtgaaaataaataataaataaattgaggtcaaagtcaatgaggtcgaaataccaaatcacttagaaatttgttacattctaactttcccggtcttacagattaccctagtgaacttttaagttttattttaaattgatttaaagaatttgtttttattagttctttatcgagttgattccacaattttgttaccctcccagcaaagggaatgaattttttgcccagtttgtattttgtgttaaatctataaaaggggatgttaaagcgtgctgatggattaaaaatagaaaatagtttcagatctgttcggccataagcaattttatgcgccatg

SEQ ID NO: 110837 - DNA, 93 bp, Heterodera glycines
  Promoter: Source sequence=SeqID_38562; Location=190..282; Strand=+; Gene=SeqID_67340
tgtaatttcttttttttattcgataaataaacgatgaagggataaagcatttaagtttgcaaatatttactgttttaggtttatgatcgaatg

SEQ ID NO: 110838 - DNA, 206 bp, Heterodera glycines
  Promoter: Source sequence=SeqID_8275; Location=1..206; Strand=+; Gene= SeqID_67537
cagtttccaatttcattttttttctaaaccaaaaaaactcgttgttttaatgtattaatttttgtttgtacgcctttctcaaaagcttaaaaatatataatcatcttgccaaaaattaagttctaaccaatctgtacagttttttgtacagtatgccaataaaacattaaaaattatttttttcaacagatttactattaaaaatg

SEQ ID NO: 110839 - DNA, 454 bp, Heterodera glycines
  Promoter: Source sequence=SeqID_39847; Location=1..454; Strand=+; Gene=SeqID_68329
aatgaattttcaaatcagttgtaaatttttatatattccttgacaaaaattgaaaatttatatcccccccccccccggtctctccgccgtaacaccgcccaaaataaaatctcagttccgcgaatttgttgccaaagagtcgaagactaatccttcctgattaatgcaatgaattaattattaatttcagcccctaattaattaattaaactcttagcaataatttgtttagtttcgaactgcaaaacgacgagctgtgaaacaattcgaactctgagcatccattcggtcgcacccaaagttgttgtcggactgatcaacgtcgtttgttgcttcggttttctgcttatgctccgctcttttgggatgccagttaatttggtagttttttaataataattatataaacaggaaattaaaaatttttttctagaaaaatcgtgttgtcaaaatg

SEQ ID NO: 110840 - DNA, 679 bp, Heterodera glycines
  Promoter: Source sequence=SeqID_7008; Location=1253..1931; Strand=+; Gene=SeqID_63554
aacatgtccgttttcctacagcttgacaaaaccattagaattttacttgttataaataaactcaatgaaatgtcatacaggattctgggatacatcctaaaacatcgctggccgaagtttccgggacataacgtcaccgcaaaataataaaaattgtaacaaattttttaaaagcttttttgtaaacctaggtgttactgattttgaatacaaaaaatttgctgcatttccagaaaaaaaaacaaaaaaaaattacaatttttgattccttggactttcttaggtggcgttttgtcctgctcccattatttccgttcgattagtccaaccaaactccaattagatgcacctcaacagcagcgacagtctttggcagcttcggttctctcaaagaacagttttgaacaaagtgcgacctttgaagcgatggtcggccgtttctgtaaggcaaaatttaaatttttgactttttgtcagatccgtgagaggtgggcacttcaatacagggaatatttgagcaaagtcaccgaaaggatggaaaatgcaaatttaaatgcacagcaaacggaccaaagccaagaaggggtggccgaaaacaatctcatcggagtcggttctcctgctcactatcaccaatttgcgtattgcttttccttaagagtgccgtgacaaaagaatg

SEQ ID NO: 110841 - DNA, 958 bp, Heterodera glycines
  Promoter: Source sequence=SeqID_4506; Location=1..958; Strand=+; Gene= SeqID_54703
tgtaatggatttccggtactcggataatgcactgtgagagaaaaaaaactttggccgattaagcaatttaaagtgtaaagattaaagtttgtcagcataaaataaaacaacaaaataaatttaattaaaaatcaacaaaatgatactcagcaattaggtaattaaagcatatcgaagatttttatttgatctgacggattatcatggattgatttacaaattttaattttggcctcttacttgacggtactcccaaaggagttcaataaatattaaacttttttttgctgacaaaaaaaaggaatacagaaaattcttatttcttagcaattattcgaagagagcgagcagaataaataaatttcttataaaatggtcacggcgaatggggcagagcaaatagaaacgaattttggcgcaaataaaaaaaaggctcctgcttttgggcgcaacattagacttgccgtttggcgcaaaatatgtaaattggcctattatttttttagcgcaaaatgaatttggcgattttttaaatttattttttttttaataaaacaaaaagccttcccattataggggcaaaaaaaaaaacctgaaataatagacttactgtttggggcgaaatattaaatggtcatttctcttttagcgcaaaatgaaatttgcgatcttttttaaaaataaaatgaagacttcccattttggggcaaaaaaatagaattgccattttgtcgcttgacttgcctttctggcgtaattacttttagcgcaaaaataaaattgtttttttagtaattataaattgacttcccattttcggggcaataaaagtatccaaaatataagttttcccattctggggcaacaataatagacttcccatttttggggcaaaaaattttaaaatattttcaaattagttcgaacttggccatttaatttttttgatccgaacatg

SEQ ID NO: 110842 - DNA, 269 bp, Heterodera glycines
  Promoter: Source sequence=SeqID_3199; Location=5473..5741; Strand=-; Gene=SeqID_83645
tttgtctgatgcccaattttccgggacccagtcgaactctatatcaactcatcataaaatttcttatttttggagattaccgatttttcaaacaaaaaattgtaaatttatgattcatcaatgtcaaaatttcgaaagttttcattttgttttttccagcttcaaacaattcgaacgcggaaaagttcaaccgacgcatctttcggtcgttgtttatcatcattttgatcaatgtttcgggatattacatatgttccgcttactatatg

SEQ ID NO: 110843 - DNA, 174 bp, Heterodera glycines
  Promoter: Source sequence=SeqID_747; Location=4743..4916; Strand=-; Gene=SeqID_60387
tctgaggcaataaaacaaataagcaatttacgtataaactgttctttttttccaaaaaattaaaaagaaattaagcatttaaatttaattgcaaaaatttaaaacaaaacgtcaattttaaaaattaaaaatttctttttgaaaattttacaaacggtttcttttctgcgaatg

SEQ ID NO: 110844 - DNA, 182 bp, Heterodera glycines
  misc_feature (37)..(37): n is a, c, g, or t
  Promoter: Source sequence=SeqID_556; Location=1..182; Strand=+; Gene =SeqID_56134
gactgtcagatggcgaacatctttcctttcgaggatntgaggcgagagaaggaacgctgggagggacgagtggccgaactcaccaaagccactcgacgacgcaaaatggaggttagacaatcattgacaaggcgaatttgaaagaagccacacaaagggtcggagaattggaagcggaaatg

SEQ ID NO: 110845 - DNA, 254 bp, Heterodera glycines
  misc_feature (29)..(29): n is a, c, g, or t
  Promoter: Source sequence=SeqID_36875; Location=1..254; Strand=+; Gene=SeqID_66089
aaaaaatggtgtaagtaaaatcgtattancgctcaaaaagcttctcaaacaatttagcgctttccaattccttctacatcgccctttatacatcccattatgagcgctaaaattatcagagtgccgaaaatcgcatgtgatctaagcctagaaaaaaatggtgtaagtaaaatcgtaattacgctcaaaaagcttctcaaacaattttaacgcttccaattccttctacaatcgcctttatacatcccattatg

SEQ ID NO: 110846 - DNA, 484 bp, Heterodera glycines
  Promoter: Source sequence=SeqID_43436; Location=1..484; Strand=+; Gene=SeqID_71105
tggtataaatttcaaataaatctcataaaattctcccgattttttgctatttttaaagctttaattcacttaaattgaccagtccttcattgagttatgaattttcaaaatttaacccaaatttccaaagaccaaaaaaattaaaaatattttcgaatttctaaaaaattccaaaaattatgaaacttaaaatagacatcatattcgtactcagcacctcaaaataccccagaaaaatatttttcacacactttttcgaccccaaaaaaatttttgaaaatttctagggggcctagctcgaaaatttttgaaaattttacatcatgtagtacaccattcgatagcatttaaaatgctctacaaaaatgttctaagacaatttttcgctaaaatcaacccctgacgagttatgggcccaggactcaaatgtcccgctacaatggtgattagaagaggtacaacggtgatttgaagaggtacaatg

SEQ ID NO: 110847 - DNA, 229 bp, Heterodera glycines
  Promoter: Source sequence=SeqID_24179; Location=1..229; Strand=+; Gene=SeqID_54890
gtttcattacaaaacttgaagtaattcatttgcatcggtcggaaagaacgatcacttaagccataaaatgaacatagatcaaatgaagatctataacaaatctgatcttaaatttcgtgatcactctcgatctcgaataaaacaatagatatgttccactacaagtttttcataatttcgaaatggcttttgatcacaaatgtttttgcagtctgtgacggtgctcatg

SEQ ID NO: 110848 - DNA, 64 bp, Heterodera glycines
  Promoter: Source sequence=SeqID_8681; Location=476..539; Strand=+; Gene=SeqID_68838
tgtatgttttcaaaaaaaaaattttttttgtgaatactgatttttttttactttcaattagatg

SEQ ID NO: 110849 - DNA, 88 bp, Heterodera glycines
  Promoter: Source sequence=SeqID_36051; Location=1..88; Strand=+; Gene= SeqID_65487
gcgaacaccgtaagcacaaaagggggcgttgtgccaaggatgcaaattgcgtacagttgcattcgttcgcgcgaataattgtccaatg

SEQ ID NO: 110850 - DNA, 803 bp, Heterodera glycines
  Promoter: Source sequence=SeqID_40019; Location=1..803; Strand=+; Gene=SeqID_68453
tcgagatcactttttatgaacaggtgggggggggggggggggtgcggtccatctccgctcccctcccggggtgacctgcttgaaggtgagctcgaacagctccaaaaggtacagtaagtcgtctccggcggaaaatgcctcgcctcccaacccggcaattggcagtgccgttgaccttctgatgatgagattttgtcaatcaaacaaataccgtatgactaatcaaaaaatgacttacaacattttactgtgccaactttgatgactcattttaaattgtgttgagtggtaaatggagatgatcgccaatcagaaaaagaagtattgcaccaaaaaacaaaaaataaatcttacatattcgcatttgttgaaaccatggaaaccattttgatgctttgtaccgactttaaattaatgctataaatattttgccaaataaatttaaattagcgtattaaatattttgccaaaaaatttaattaatccatttaaaataaaaaattaattaaataaaaagaaacgtaagcttaaataaagaaacgtaaacaaatcaatagagatgtcaattttatgtaaatacatattttttcctggcttctccatgctctaaatacaggtacaggccaattgggaaatacaggtacagatacaggtacaggcttttttcaaaatgtcgatctctatttatgtacatatttttgacatccctacaaatcaagattgactttctcatttatcagagataattcgcttcagtataattttatttaaaaagtttaaaaatttttagttaagtgggaatg

SEQ ID NO: 110851 - DNA, 83 bp, Heterodera glycines
  Promoter: Source sequence=SeqID_4392; Location=2999..3081; Strand=-; Gene=SeqID_54281
gctgtaaaaatagcccaattttttgtgcccggcaatgtgatgccaaatgttgtgagctcgaaaacagcaacatacaaaaaatg

SEQ ID NO: 110852 - DNA, 452 bp, Heterodera glycines
  Promoter: Source sequence=SeqID_715; Location=841..1292; Strand=-; Gene=SeqID_59668
aactttgactgcaccgacctgatcatgaaacaccaaaaaaaggatgatggaccacagaagaacggaggacggagcacctttttcaagacggaaaagtgatctttgaccattcattcattgatttttcgttaaaatgagtaactctttctttgtaattttgcccagcaatacgccgggatttgtcggcaataaaacgaataaattcaaagcacacttgccaaagaaattagtgtttgatgggccgggatggatggtgggcatgtctggcataatatatcccaacaggtgagtgggtttgcacagttctcattgcccttgtacagtttagctgggcgactgtaggaaccctggagaggcaatacgtagtggtgcacctgcgcgatggtcgcaagttccggttcagagtgccaaggggcagcttcctttcgcctcagcagcttgaacggggaatg

SEQ ID NO: 110853 - DNA, 101 bp, Heterodera glycines
  misc_feature (34)..(34): n is a, c, g, or t
  Promoter: Source sequence=SeqID_29172; Location=1509..1609; Strand=-; Gene=SeqID_59715
cagatttgcgatcactgctgtgcaaaggacacanacgggtaaaattagccctaataattaccgacaaataaattaatcacttcacatcttttcaggcgatg

SEQ ID NO: 110854 - DNA, 139 bp, Heterodera glycines
  Promoter: Source sequence=SeqID_13277; Location=2278..2416; Strand=-; Gene=SeqID_77109
tttttaatgtatgaatggaagtctccaattgatcatattagttgattttttatttgattatttttttcgttttattctgtttgacattttgtccagggcgccgccgtcctatcagagagcatctcatcaaaagggcatg

SEQ ID NO: 110855 - DNA, 401 bp, Heterodera glycines
  Promoter: Source sequence=SeqID_472; Location=4139..4539; Strand=+; Gene=SeqID_53692
agtccaaggatgacgggacaacgacacaatattcgccagtgatcagacttttaagagagggaggtgttgtgtgggcaatcatggacctattatttatatttgtatgcattcctttttcctcttccaaacattgtactctgtacccaatcaataatgccctccacagaccaagtgcataaatacccttcgcttctcctctccctcgtctcttctcccattcattattcaaactcattcctcttccgacttctctcatcacttcttattcccttttcatttattatttgttgtgtgtgaaaataaagtttttacaaagacacaacaaaacacatcccctcccgacagtaaattctttaaactaaatttaacgattttaaatatgtacaattaattattagatg

SEQ ID NO: 110856 - DNA, 518 bp, Heterodera glycines
  misc_feature (49)..(49): n is a, c, g, or t
  Promoter: Source sequence=SeqID_21999; Location=1..518; Strand=+; Gene=SeqID_52638
gctcgtctatgatgttgccaattgaatggcacttttgttgttggtcacncatggtgccatcattgtccatgtccatgtcggcatggtcgtccccgtggtgttgctgctggaaaatggcatgctgcaactcggcgaacagcacacggccaaactgctgggccaaccggaagccgccggcgctgatggcattttcattcgcgtctttggcaccaccgcaaccgatgctgccgacggagccgtttaatgacgaagcaaatgccggtgacaaggacagctttgcaccagcaaaagtgccatttccatgaatgacgcccgctgctgctgctgctgcttcatcttggctcattgacatgagtgccgctgcagccgccatttcttccggccgctggtgctcagcggcaacaacgggcaacagtcgccgctttcggtcgccgctcgctgccgccggtggcgagcagtacagcaactgttgttgttgctgctgctgttgttggtgatggacgagtgcagcagaaatg

SEQ ID NO: 110857 - DNA, 143 bp, Heterodera glycines
  Promoter: Source sequence=SeqID_36771; Location=1..143; Strand=+; Gene=SeqID_66010
cgttcatcccgggtgcatatgctgtacattcggatgaagattaccacccaccttgtgatcgctttgtgactcggtaaaagaaaaagcaaatttctgtccggaatgaaaagttcgaactcggcggcgctgctgtcgacaccatg

SEQ ID NO: 110858 - DNA, 190 bp, Heterodera glycines
  Promoter: Source sequence=SeqID_11149; Location=913..1102; Strand=+; Gene=SeqID_74500
tgactggaaaattgagtacatataattttacaaagtttatgaacaacgcaaacacaccgcgggtatacagaattaggcgttaaaagatgtatccgaccttaaaaattaacatacagtacccataaaaaaactagggcaactaaaatccaccatttcttggtacctttcagatctatgagtacaacatatg

SEQ ID NO: 110859 - DNA, 143 bp, Heterodera glycines
  Promoter: Source sequence=SeqID_15679; Location=1..143; Strand=+; Gene=SeqID_79987
tccaggtcccggcttttcgactcccggcaattccccacccgattctgttcagaattccgggtctcgtgcaattaattctagttcaaataatgaatttgtaaagaaaaagagtaacaattcataattgacattgcaggcatatg

SEQ ID NO: 110860 - DNA, 78 bp, Heterodera glycines
  misc_feature (51)..(51): n is a, c, g, or t
  Promoter: Source sequence=SeqID_35908; Location=1..78; Strand=+; Gene= SeqID_65357
acaacccttaccaaacggtggggcgaacattggcaaaatctcccacaattntggcttaatcaggtgataaaaatcatg

SEQ ID NO: 110861 - DNA, 58 bp, Heterodera glycines
  Promoter: Source sequence=SeqID_44575; Location=554..611; Strand=-; Gene=SeqID_72047
ccgttccttacttattaagctataattaatctttaaaccctttaagtcagtcataatg

SEQ ID NO: 110862 - DNA, 708 bp, Heterodera glycines
  Promoter: Source sequence=SeqID_13881; Location=927..1634; Strand=+; Gene=SeqID_77827
tcgacgaaaaaagccttcggattattgcagacgaaattttgaggtatttaaaaaaagaaaattgaattgcttctaaaaagaaaatgagtaccaaatgttcagttttttgcacaggtaattaattttaaatgttggtaaattcggcacttttacgcttggggccaccaaaaaatcttttaaaccagggctcccaacctaaaattttcaaaatcagcattttgccgacaaaaaattagcattaacagactttaaaaatgaaaagtttttgcgattttgtgtcaattttttatgaaaaaataaaatattgtagccaagcagtagcgacaggctccgccaggaaatttttatttgaaattttcaacgaattttgttaaatttttggtaaaatacataaaaatgagcattattgaggatttttttttcaaaaatcagcaaatttctcaaaaaattagtatccaaaaaaaatcatcacgttgatctcttgaaattagcaaatcccttgaaattagcaaatgatgataaatcagcactataggtcaagcccaatgtttgaacaatgctcgaaacgccaaatagctaaattggcgttattttagcgcgctaattcaaaaattacactgataaaggcctttttgcacaactagcggggtcagcgccttcggcgcatcccccgctaggtagtacgattgtattataggattatgaatg

SEQ ID NO: 110863 - DNA, 185 bp, Heterodera glycines
  Promoter: Source sequence=SeqID_6966; Location=1..185; Strand=+; Gene= SeqID_63431
gcattttttgttttgattttttaaaagccgtgaaacgtttccgtaggtcttctccaaactcaatttgctcattgtctataagtgaaaaattcgacattttcattcaaattcaaaattaccaactcaaaatttaagaattttaaagttagatttggttgttattttctaaaatacatacataaatg

SEQ ID NO: 110864 - DNA, 486 bp, Heterodera glycines
  Promoter: Source sequence=SeqID_18151; Location=452..937; Strand=-; Gene=SeqID_82737
ggtaaaaacccaactcgtactgccccaactcgtactgtttttcgacacaaaaatcgtcataacttttgttaaagtcggccaaattaaacattcttggtatcattcaatagcccttaaaattctctatctatccaccatgtttccaaaaatttgatcaagtttgaaaaaagttatggacaaaaacaaaattttttacgattgttggtcataacttttttgaaaagcaataaaattttcttacattttgcagatagatagagaacgttaagagctatcgaatgataccaagaatgtttaatttggtcgactttaaaaaaagttatgacgatttttttgtcgaaaaacagtacgagttggggcagtacgagttggcctagtacgagttgggtgtcgtccatatgtagtaggtcgtaataaatgaattgcattaaattctttctctaattaggtacgttttttctcatccagacaattaggtaggttatg

SEQ ID NO: 110865 - DNA, 549 bp, Heterodera glycines
  Promoter: Source sequence=SeqID_10402; Location=1561..2109; Strand=-; Gene=SeqID_73596
taatggcatcagcacttttggcttgaggcgcccgtggggtctcctcggtggcagcagcaacagtctcaacggcaccagcgccagcaatacttacaactgcgccagtaacaattacaatgccaccaccatcagcaacagtaccattggttccggcactggcaacagtcacaatggcaccggcactaacattggttccggcactggcaacagtcacaatggcaccggcactttagccttgaggcgcccgtgggggtgtccgccgctggtccgaaacgtggacagacgccggccgcgtaggtcaaggaaacgcacccgtggcccctacagcgacaattccgacggatcggcattcactctttttcatggaatgcatggtagttttgatacttggggcactgcgggcattgacgaatgggaccaatcggcacagagtgtacacaattacggcatggttggttcttctctcatttatccacccaaattgggtaacgaaacacagaaaaataggagaaattatttgccaaggaattgatgactttgccggaaatg

SEQ ID NO: 110866 - DNA, 131 bp, Heterodera glycines
  Promoter: Source sequence=SeqID_13076; Location=2252..2382; Strand=-; Gene=SeqID_76863
tttggcaacagattgttcatgcctcgggcgacgacactccgtcctctttgggcagccaacagacaatcgtctcccgtcccccgcccgcttcggcctttgcgtgccaacagacgcttccccctcccaaaatg

SEQ ID NO: 110867 - DNA, 343 bp, Heterodera glycines
  Promoter: Source sequence=SeqID_2237; Location=1..343; Strand=+; Gene= SeqID_78630
gtatcataaaattttattatttattgcagcgcggcaaaaaatatcgcttccctcatttcaaacaaatattttggtgtttcattgcacaaattgtgcgcaaatgcacacatcgtctgtaccagaaaaagctgtcagaagaagcccacaatgttgaaggcctaaatttggtgcaggtcattgatgaaaggatggtcagtagcctttatttgtggttactggacatttgcgccctgaacatttacatcccggacataagcgctccagacattgcgccccgaacctttgagcataattatcattttaagcttaaattttaaactttgttcaaaaggatgacgaaatg

SEQ ID NO: 110868 - DNA, 370 bp, Heterodera glycines
  Promoter: Source sequence=SeqID_11484; Location=2668..3037; Strand=-; Gene=SeqID_74897
ttttatgggaggaggaagaaggacaaaatattatttatgtgtggtgcagtgattgcgacgaatgaacaacaaagcgcaaaaatgcccatttaaatatccttccgatgtgtgaaccgtgtgcctttccaaaattccgtttcatttgtcattcgtttttttctatataaattgctccgctccgtatcaaatttacatttctttgtttttattttcttcatctactaaattttttgtaatcgtcatttttttaattttttgctccaaaataatctaaaattgaaaaactaaaaaccctaagtatttttgttaatttttttcgttttgtgcaatttcttgtaattaattttcagtccccgatttcagccaaatg

SEQ ID NO: 110869 - DNA, 172 bp, Heterodera glycines
  Promoter: Source sequence=SeqID_34218; Location=740..911; Strand=-; Gene=SeqID_64061
catttttttaatgaacaactttaataatttaaattacaaagggaatttttaatattttttttgctaattattatgaaattttatgtgaaaatttctcttgaatacaaatgccaaaccaattagtgtgctaattattaaattttatgtgaaaaatctctctttaatacaaatg

SEQ ID NO: 110870 - DNA, 192 bp, Heterodera glycines
  Promoter: Source sequence=SeqID_6487; Location=2071..2262; Strand=-; Gene=SeqID_61759
ggttacaggtcagattcatcgatagatttgggttttcttttttcatatgttaatttattcattttgcatttaattgttttaggtataaataaacattttaatttgatagtttaaaaaaaggtttcattgtccaaaaatatttaaattcttaattttaatttgcaaatttagttttattatagattaaaaatg

SEQ ID NO: 110871 - DNA, 67 bp, Heterodera glycines
  Promoter: Source sequence=SeqID_3887; Location=4868..4934; Strand=-; Gene=SeqID_52297
ggttcgcaagtaaccatgatcaaaagtgctgtagtgcgagccttaagcttatataaattgaaagatg

SEQ ID NO: 110872 - DNA, 533 bp, Heterodera glycines
  Promoter: Source sequence=SeqID_26335; Location=908..1440; Strand=-; Gene=SeqID_57083
ttgtgtgaaaactgtgagtatgagtggaaattgtattacgagggccaaacattcagctttgcttaacaaacaatatgcttttcatttgattaaccaaataaactgcgttatgcttttaattaattgttaaacactaatgcacttttatggcccctaaaattttggaaaataattagtatttaattgatctgatgtgtaaatgccggttaaattatacactcttggtacaattgaaggcgtttaggaacattgttttgttttggatttcaacaaatcattttggagaattacaggtgaagaacgacatcagtggtgatcaaacgcttcggcggattcaaagtgaacggacaaagctgactgatcgaacggacatttgacttctgtgggcggacaaagtgaatttcttttcttctattaatcaaattagacaaaaataaacaccaaacaaaagcaagtaaaataaaaagggggaattgaaataaaaaggggatcagaatcaaaaatttggtttgcttcggcagttcaaaagcatg

SEQ ID NO: 110873 - DNA, 369 bp, Heterodera glycines
  Promoter: Source sequence=SeqID_12274; Location=799..1167; Strand=-; Gene=SeqID_75864
ataaataaattaatttatttaacggcctatgattatatatacgtaaatataatagaaaataaaatagaaacttttttcgaatcttctaatatccgtctaataaaattggcggacgaattaaaattttttttttgtctcattttaatttttagcgccccattgtatctatttaaactgcctcgagggggggggggtggcttaattataaggttgtggcactaaattatggaaatattgtgtttattttactattttagaaatctgcgcggcacttgtgccactcttttggccatcggctcagccgttgactttctctttttgctctcattttcggtcccttttgccctttcgttggttggccagaacatg

SEQ ID NO: 110874 - DNA, 77 bp, Heterodera glycines
  Promoter: Source sequence=SeqID_15134; Location=1..77; Strand=+; Gene= SeqID_79323
ccccccgttttttgccgtttgacgattgcggacgctgcctcgcttgcaaggcaaccgaggccgaggtggacataatg

SEQ ID NO: 110875 - DNA, 1003 bp, Heterodera glycines
  Promoter: Source sequence=SeqID_1523; Location=3173..4175; Strand=+; Gene=SeqID_74216
aaaattgggacaatgaatggggctgttggctgggacgattttcgcagcatcaaaagtgtaaccagcagaagcccccccccccgccccgataataataataataataataattctaatggaggtgattaaatgctgataatgagtgtcgcgagaaagttttcgcgcaaaacgcgggaggcgacgacatttgcaggaaaacaaagcataaaacattaaggaaaggtgttgatggaaaaaaaaaagaattttataaactaaaaagatgaaaatttaaatttttaaaataatcgtttttatcagtaaataaatcaacggaacaataaatccattttaaaaaacaacgcaaccaaaagcccgttaattttttctcttcccattaattatattagtaaatatgcgcgtcattaagagtaattaatgaatatataaaggattaattagcacagatattttttgccacttgaatgattatttccagttctgatgataataccactgtgcaaattatcacgtgtttgatcagtcccattaatctttatcaaaagagagtgtaaaatcctaacagaaaaaccacttaggtttatttatattcgagtgcaattagcggaactaaaattacacacaatcaatcattaaaaaaagcaataaaatttgatttcatggttaattttgttttctgaatgaatgcgaatcatactttagctcaatttgcgcaaattatgcctctggcaaggcttttgttatgcgcaaaattttaattcggcaaaatttgattattataaaaataaatttttaattaaaattcattaattatagtttttgaaaaaaattatctttaggtttgtgaaacaggagtgatttcgcaaaaattaaaaattgcaggatattaaattttacatttttaaaacaaaaattttaaataaattatttaggtattttgagtggaggctaatagaagcagacggggaaatctttatgatttcgattatttcttatagtaatg

SEQ ID NO: 110876 - DNA, 818 bp, Heterodera glycines
  Promoter: Source sequence=SeqID_11414; Location=1021..1838; Strand=-; Gene=SeqID_74808
agtaccttctgaccaacatttaccctggaaataatatacacaaagggaccacgcgaattgtgagttgcacgaccaatatttatgaatttcaactggtttcaaaatgcaattatttatttattttaattaatgaatccacaacctttgtttcccctttttgtcagatggtccaggaagtattgaagcgtttcgcgcggattcgttttgaacaatggagaaatgttagacaaatcaaaacgaagttggggtcgatgaaacggaactgttcctttcctcctgttgacgaccactcgtggaaacgaaaaaaagtcggaaacgaaggcggaaaggtggcggaggaggacggttcgatgtcattttatgtgatttttagactgttacctttttaagttatcgacagaattttgttttctccttcacaaattcctcaaaaccttagcgagcgttttcaccgtctgaaaaaggtgatttgcaactctcccctcctcatttttttaaattttgcttacccagatggaccgcatttcgcggcatcaaatgatcgtgccaatttgcgggatgtcgtcgttcgtcggtttgtccaatgtgcgcattgccaaaatggccaagagttccagcacccacaaatgatgctttttattcggatattttacacattaaatcttttgcctttctcttacaattaatttgattaaattaacacaaaaaatactgaatttaaagtccactcgaagtgcgttagttttgctttttattgtttatttgcttgttttggtgggtttgtttctgtgtcttgttgtgaattgtttttgccaatg

SEQ ID NO: 110877 - DNA, 110 bp, Heterodera glycines
  Promoter: Source sequence=SeqID_3167; Location=1876..1985; Strand=-; Gene=SeqID_83502
cgctttccaggtcgtccatctgtgccacggcctttcctatccgatcagttcccagggcaagtcgtactttgaccccgactactccaaggatcacgcgctaatcccacatg

SEQ ID NO: 110878 - DNA, 1003 bp, Heterodera glycines
  Promoter: Source sequence=SeqID_9642; Location=3342..4344; Strand=-; Gene=SeqID_72173
ctttttctgctgctactggtgagctttatggcttgctgtttgtgtgttaatcattctcatccattgcaattggaaatttgtgcctgtgattggccgccgtcagacaaaaaaattcatttgcattttttttgttttgttttgtacaaatgaacgaatgttttgtcagaatcagtgcccctttttgttctcatcggtgggtcggatcggtcactttattttcttttgttttatttccatttaacttttgtctttttaaaatattttctttacttttttatcgaccgaagctttttaaaaggcctaggaaaagcggcttcttaaaagggttttctttgtttgtttttaattcactctttctgctgcactgttccgttctcaaattgtttggaagttttccggggttttaatcactccggtttgagctcccaatcagcctccgacccaatcccaaaatcacttcaaattattcaatatttatttaaaattaagtcggaggaaaatagctatgttcaagaatctcatctcgactcgacaaaagtctcggattttcaatttttgggaaaattacataagaaatgattagggatgggatttatatttattaaaaatcccgaaatatttaaataaacatttacaaaaaatgccgaaaaatgattgggtgaagattaagagacggaaataattggaaagttttatttagtgagatcaaagtacacaaaataaaagatttacattttcaaaagaaagtgttcatcggcgaacactgaactttttcaacattattgcacctgctatttttatgttttaatttaatttaattaaatattcgatgaaaaaatgcgaaaataaggaaaaaaattcttaaaacccgaagattatttaatttataattattttttgcattacaccatatttccccagcagcaggtgtttcccgcttcctccctaattaattatctattaatttcaacaaatcgctttaaattttacagttggcaaaatg

SEQ ID NO: 110879 - DNA, 1003 bp, Heterodera glycines
  Promoter: Source sequence=SeqID_13748; Location=970..1972; Strand=-; Gene=SeqID_77665
gccatttcgtttcagcaatcgttgattaaacaataaaattttcaacataatcactttacattcaattgtccacatgaaaattcattttaatttatcaaagcgatgattgacacagaaattaatgaatgttattattttgacaattggttaacaaattaatattaatgataaaatcactttgactgtgttaaaaattcgtttctttttaattccatttgattattcataaattaatattttttaaaaaataacgctaattaatatatgtatataatttcaaaaaaaaatcatttaaataatgataaaaatgcaataaaataataataatagtaatgaatagataattaacttaaactagggttagtcacggtcgtttaaccgaactgaaaataccgaaaaccagcggtaccaattttttggtatttggttttttgattttaaaaacacaccccttaaatatgtcagttcgctgagaattatgagcaatttttaaactgaaaaatattcatttaacaataaaaaataattcccccgaaggcgtataccggcaccgcaggatttattcgttttcccgaaagttttttaaggtcaaaatcttcgatttgaagttcatttttatcttatttcaaaaaagctagggaaggctgttttaaagacaaataatatccaaattaacaatttgcgcctagcgttatgtgacggaaattttaaattattttcatttttggacatttttatattcatttaaaattaaaattgttttgcatattgcttataagttgggttgacataagtaattgtttttttaattcatttgtgcttttgaaagcacttatcagtccatttaaattaagctgaccattggcaatccctaattcaaataaactaaattaattttaatattttaataaagacaatataaaaatataattaaattttatttgattctttaaaattaatttaatatttggtaattataattttaaaattatcagccattatg

SEQ ID NO: 110880 - DNA, 377 bp, Heterodera glycines
  Promoter: Source sequence=SeqID_11751; Location=1160..1536; Strand=-; Gene=SeqID_75245
tttttggacaaaaaacgaattgtttttttaagttatttgagtctttttttttaataattttcaaatttttggggaaggagcgaggggagagggtcgggcggtgccgatcagggacgggcgaaacttcgagcttcgtgctttcgtgcttcgagcttcgtgaaaatgctcgaagtttcgggaaaaatgcacccctaaagattgagttttcgaagtaaaaatactcccctaattattgatcttaatgtgagtaatggtgataatgtttatgaattttataaattaaatatttcttcaatattacctattttatattctacatattgtatatctctttttaaatgatttttaacacattttacatttttagcttgaaaatg

SEQ ID NO: 110881 - DNA, 781 bp, Heterodera glycines
  Promoter: Source sequence=SeqID_12586; Location=1707..2487; Strand=-; Gene=SeqID_76247
taactttttcagaacccaaaaaatctttttgctttttgtaaggctaatagagcatgtgaagagctttcgaatgataccaacaatattggatttggatgacaagtttcgaagcgcaaatgtcggtacaccgttaaaaatcaattttaatctgtccattaaaattattccgaatcataaaatttgcaagattgttgttcaacttactttggccatgccgttaaatgttaaatagccaccaaaaaactaccacagccacagcactccatgcaataaaagttactgtaaattcaaaaattttggcataatgttctttgaataaaaaaaatgcaatgaaggggcgtacccatagtgctgcgggatcccgcacaaaaaccatattttgggaatcctgccgcgggtttaggattcaacattttaaaaaattttaagtcggttgcttttgaaaataaagctaacagtgtaaatttgtatttattgcttagactattgacaatgctttaatccttgacaaaaatttaaccacttaaaattatgcaacaacaaaagtcgcccatttgggccatcgatttatttgaaagacggcaatttcgaaacggaaacgaagaggctcaatgcatggaatgtggaaaaaggttgaactatttttcgaattaaagtagaatcacgggtatttctctggcagttaggaaagtacagacgagcaaaattcaattagcaaatatcggatgattttatgcttactgttttttaaagctttaattcatgcgaattgactgcgatg

SEQ ID NO: 110882 - DNA, 1003 bp, Heterodera glycines
  Promoter: Source sequence=SeqID_13184; Location=50..1052; Strand=+; Gene=SeqID_77008
ttccgagcaaataataataatacaatgggaacaaatatttttggccaaattcgtaactttatgttcctctcatggccattttttgtgaatcattcgcccatttttaaattattacaatttcaaatggtcattcatttgctgattaattaattaattaattaattatgtaatggttcattttcccattcaattacatagctgaaatgcttaaattccaagtgacttcctccgcttcttcttgctccaaccgtttttctccctcgccccaaagactcagtcaaatctcttcttcctcctcctcttcctcttcttcttcctctttctcctcttcacatccctcggcaattggggaacacaacgtggaccgatccatcgacgaattggaggaatttatcgtacaacaaatggccaccccagcaccgtacccaactgatggcaaatccttttacgatacggtaacactcctccggcggggaggctaaaccaaaaacaagcgccatttacagaacgaatgcgccgctgctgcaagtgccgtccctttgccccgtcgcttcgcttctctgtccgatttgtccccctctttttcctcctcctcctccccgtcgtcctcttctagcagttcgtcctcctctctcaactgcggcactttgggccggagaaagtcgcccgccccgcagccgccaaagccaaaaagaatggcccccggcgaatgggtgagaattagccgggggcatttttgaagtgctgttctgtaatttacttttaaggactatttgcgcgtgtacacggcacaaatcaaaacggacacggactacaaaacgttgcaagtgcccgcgggggtcagcacagaatgcgtcattcgccagttggtgttggacaaactgcgtctgtcgttgcgcgacctgaacctattccatttgttcatggaggttcgcttttcgaatttttgttttttggccctttgaaatgccaaattttccgttaggtgcgaactcggcgcatg

SEQ ID NO: 110883 - DNA, 86 bp, Heterodera glycines
  Promoter: Source sequence=SeqID_25664; Location=1409..1494; Strand=-; Gene=SeqID_56417
ggtacatctgcttgatatgccaagatattaaatgtttcacgtaatccttgtttttaggaaaacagctcgaggacgcacgcaccatg

SEQ ID NO: 110884 - DNA, 130 bp, Heterodera glycines
  Promoter: Source sequence=SeqID_19264; Location=1928..2057; Strand=-; Gene=SeqID_84009
aggcatatatttttcacaaaacttgttgttttcacgaatctttcggttatatttaataaaaaatttagttcccgtgtgggaggaagaaatctgtcgggcgccgcatttcccaattgcaatttggaacatg

SEQ ID NO: 110885 - DNA, 480 bp, Heterodera glycines
  Promoter: Source sequence=SeqID_1675; Location=1245..1724; Strand=-; Gene=SeqID_75252
tattctctatcaagacaaatcctttttattaaaaacagatatttttgttatagaatatttattaattaaacccttgtcatttacatagatgaggacgtaatcttgaagaaaaaaaaccccaaggtctgtagcagaatcagaattccgagttgaacccgacaggttcccggacaaattcctgttttaaaagaactcggggtttttttatgacccgaaatgtacaagacaactatttcaaaaatttttttttatatttttcaaaattttcaattttactccacaacctatacaatagaaagttttcaaaaaattttatatttttcaaaattttcaatttacttctaataaaaaaagattgcaaaacgccaatttattaattttaaatatttactagcaacaaaactgaatcgaaggtcgaacgtctaacatcaaacccttacccctcattaaaacaaattttaatttttagaaacttttatg

SEQ ID NO: 110886 - DNA, 696 bp, Heterodera glycines
  misc_feature (29)..(29): n is a, c, g, or t
  Promoter: Source sequence=SeqID_31389; Location=1..696; Strand=+; Gene=SeqID_61749
agaccgagactcttcgaacagcagggganaaactggggggagagaggctgtgttaggaaaattattaataaactaagcattaaccagcgagaaaattttttattgaatgtaaaatgattgaaaaaggcagccaaaaaagtgtgttgtttttttttattaataaaatattttaattaatatttttaatataatttttaataaaaaattaaggttttatggtgaatgcgaaacatttattaaaaaatatctaattttgtaatgtttttaaattaagaaaagacatttccaaaataatttagcgattgaaatgatagtcattttggaaattttaattttttatttttacatacatttatttatatggacatgaaattaaatttgttgatttaaatgagacacatactgtatgattaagttaacttggttctttttcattttcttcatttttcatcattccgttttcttccgcttttatgccaatgccatcgaacggacaatcgcagctaatcaaaaatattaaataaataatataaatcaaatttgaattaaaaaacaaaaaatttaattataaaattgcttaaaatgcattattgacataatacataaaaactcttaagtaaattcatttttaaaagagattgattttctcaatggcaaatttaattttaattaattattattttttaatttaaaatg

SEQ ID NO: 110887 - DNA, 230 bp, Heterodera glycines
  Promoter: Source sequence=SeqID_36152; Location=1..230; Strand=+; Gene=SeqID_65548
tagaatttttcttttaaacatttttcggcggggggaaacaagctctcccattttcccaaccacgaaaaatttttctaacggagtttggcgccaactcctaattactcccataggcgtcattagtttcttttcctaattcggattgctgttttcatttttcagcggatgatgttgacgatttggcaccggtgccgccgaatgcgcgcagcacactgtacgagccgaagatg

SEQ ID NO: 110888 - DNA, 344 bp, Heterodera glycines
  Promoter: Source sequence=SeqID_22535; Location=1..344; Strand=+; Gene=SeqID_53201
tttgtttttaaagtttttcctgtcaagaataatgaaaagtgcgagaagcattagcggttcttgagctcctacaaaataaatatttgttgggatttttccattagcagaataatgcacatattaatttgattataaaacccattttaaagtactaatggaattccaccaaaaaattaatttactttatatattacaaatattcaacaaattctattgaaataaatcattattttttagtatttttaaaaataaattatacatttttgaattttaatttcatattttcgagagttaaaattttcattttttcctttttagtaaaattttctatatattttgtaatg

SEQ ID NO: 110889 - DNA, 72 bp, Heterodera glycines
  Promoter: Source sequence=SeqID_6179; Location=1454..1525; Strand=-; Gene=SeqID_60610
atattttgcattttcccatttagttcatcaaaaattttctgcaaaacttggcttgtcggtgtcaaaaagatg

SEQ ID NO: 110890 - DNA, 149 bp, Heterodera glycines
  Promoter: Source sequence=SeqID_4234; Location=962..1110; Strand=-; Gene=SeqID_53706
tttcgcacaaaaagtgaacgatcacaactctccgtaccaatccgtttgtcgatcagacgtggttttgttgaagatgaattcttcgtccattcgctgaggttccgatttgatcaatttgcgtcaatcggtcaattcaaagccaaaaaatg

SEQ ID NO: 110891 - DNA, 1003 bp, Heterodera glycines
  Promoter: Source sequence=SeqID_19515; Location=936..1938; Strand=+; Gene=SeqID_84246
aactcgccgtaccgaattggccgtggtgagttagccgtggcgaagtgacccaacccaaaggaaatgctcctttttagctgttcctttggtgctgcgacttattctttggtctttctttcttatttttctctctctctttctctctttgtcttattttttcctttctctgtctttctcctcacccttcctcacactatttcgcggtcactcttttcgttctgtctccaatctcttcgccttcactcagctcagctaatgtccgtccgtttgtctgtccgtccgttgctccattctttctcttcgtctctctgtctctaatcgtgtccctctcccactctctctcccctccgtccccgcgctctctcttccccccccccgctctctccctttctctctcccatttccttttctaattctattgatttcctcttacatatttttggtctttccttcctctcttattattcctagcattattttcgccatcaaaaccctttaatttctcaattttcttctttccccttcattcatttgttagcttttccattcttcggatagctaaaaattaatctttcttgaatttacctaatttctgagtcgcaaattaaaattgaaattttaatgtttttcctatgcctcttaatgtcttattagggggggggggggggtgagggaggcaaagagctccctgaaatacttcaaaaatcaataaaaaaattttcaaaatgaaaaaaaagaagggaattaaggggcggtggtgctaataggcgccccttaaaaataaagatgagctcattttaaatttaggctgatttgacctctcaaaaaagcataaaatgagtctcaattctcgcagttggctgtgatctgatcttttcatacttttttttaatttttttgtcttttccatggaaaatatttatttattggatcatttaacaaatttgaaaatttttaagtgataattataaaattaaattaaaatattttgggcttcgaaatg

SEQ ID NO: 110892 - DNA, 371 bp, Heterodera glycines
  Promoter: Source sequence=SeqID_13491; Location=2456..2826; Strand=-; Gene=SeqID_47133
aaggtcgctaatcacgaatctgacatgtgttttgactaatttctaatcccgaactcgaataaaaatcgaaattttgaatttttcaaattatgattttttgttcaaatttagattaggaaatcggaattgatcaaaataattgaaagattcgtgatcggggaccccaaaaacctaagatgaataaatttttatgactatcacaaaaaaattttgcaaaacaaaagggtccccccttttgaaaaaattttcaaaactggtcactttccatatagcgccactttgcctaactattccctattattgtcctatggaaataatcaaatccattgtgcgtccaagcggcaacaacaacagcaccagcaaagccgatg

SEQ ID NO: 110893 - DNA, 964 bp, Heterodera glycines
  Promoter: Source sequence=SeqID_654; Location=2333..3296; Strand=+; Gene=SeqID_58217
tttttgaatttggtcagcaaagaattttgaagaatgaacgtggaaatgaatagagccgcattaccccgcttaagtttgctcctccctttgccgtgccattgcgattggctcctccctcagcacggctgtgattggctccaccctcagcccgccacggacagcaaacaataatgtgaatgattgatgggggaaatttgaatatgattttgtctttctgtgccatccctcccccatcatcgccactgttgggagtgggcaaaagaaatttttttctcaatttcgttggatgattgatagggaaatttgaatatgcctttgcatttcggtgcgcttctcccctgccaggcaccactccgttattgcccactgcgatgggagggcaaaaatggactgaaagaaaatgaaatttcttcgcaagtttagttttgattgacagttcagtgtcataaaaaagaaaatttgaaggaccaaacggaattgtcataaaaaattcaaatgcgaaggacgaaagaattgcgattgcaaaaaaaccaaaaatagtaacgatggacaaaaaatttttgtgtgtttgtgcacaatttacgttgggcaaaaacgaatgagaacaaaaaaacttgttcgtttgtgcacaatctatgttgggcaaaaaatgacgtttgtatatgattgtgttgtgtaaaacataaatgataggaaaaaattttgcgtttatgcacaattgtgaggcaaaaaataacggagcaaaaaacttgtggttgtgcattttgtgggagaaaagtgacgaaaaaaaggaataatttgcaggagatgtcaatcaaaaaccgaaatgagaaggttattagtcaaatgagcagtagatttgtgtaaaaacttgtccttggtagtattttttggttttgacgtgtcgtttgtgcggttatttaaagcggttgaaagttgttgtgatcatcattcgagcaaaatg

SEQ ID NO: 110894 - DNA, 397 bp, Heterodera glycines
  Promoter: Source sequence=SeqID_21544; Location=1657..2053; Strand=-; Gene=SeqID_52159
tatatcatttattttaactttaatatttcattttacatccattctccaacgaaaaaaccattcgaaaacaaatcaaataaattatttttgtttatctcttgccattcgtttctgtcttaaaatgttcaattatatttttgtcttcgctaattgcatatatttattaattgactaatcaatcgtcctctctcttcttctgctgcgatgagtgttttataagtaatcgcctcgcaatctctgctgagattcccccggcaaaaagtgcgattaatggcaatgataatgcaaaaagaaaacacaaattaacggaccaccgaccgaccaaagacaaagcaaaacaatcgccgcattctttgctttccatttaattccaatttatttcaacaaaatttgaatg

SEQ ID NO: 110895 - DNA, 201 bp, Heterodera glycines
  Promoter: Source sequence=SeqID_18402; Location=2297..2497; Strand=-; Gene=SeqID_83001
ggattaaattcgaacgaattaatcaagttaagctgtttcttctcaatgaccaacgaaccgaacattaacatatcgtcagtgaattttgtccgaattttaatttaatttatttaattaattattgtaaattcctattttgtcccattttcttttcccaattcccccccccccccccccggaaaggtttcccttttccgaatg

SEQ ID NO: 110896 - DNA, 407 bp, Heterodera glycines
  Promoter: Source sequence=SeqID_23608; Location=343..749; Strand=-; Gene=SeqID_54307
actaaaacaaccctggtatcattcgaaagccaagagtttgtagatgtgcacaaacatattaaagttttgatttgaccctttttaaggtatgcaaaaagcgttcaaaaatgggacacccaaaaaaattgcaaattttgactcgttttccgaacgcagttcgaacaattcttaaccgattgggatgccgatagtttttccttatagccagtccaaaaccctatcgaatgataccactcccgacccgtaacattcggtagaaagtcttaaattagtttttaagcttgaaactggggtatattattcttatatagggaataaatagtaacattcttttatattcatggataaaacgccgtttcccaagtacaccttggaaataagcgcattcatttctccaagacgcgatg

SEQ ID NO: 110897 - DNA, 502 bp, Heterodera glycines
  Promoter: Source sequence=SeqID_15621; Location=522..1023; Strand=-; Gene=SeqID_79910
tattcggattctactggtctaaattgtatagaaaaactaggattttgtttaccagctttggtttttgaccataaaaaattcgagaaaaattagtgggccaattttcaattttggcatggtcgggaaaaaaggcagaaaaatctatcaatcaaataaaaagtgaaacgatagtaagatataaaagaggataccatgaagaacaaaataaaaaagaatcatttaaataggcgcagaaataacggagttatgaattttttaaaattggaaaaaatttgggtatcaaaaattatgttccaccctaagtaaaatggcatatttttgacaaaaatttttaattcaattttgccaaaaaaaattgtaaaaataaaaagcaaaaatttcttaaaattcaaaccctgccaagtccaaatcaaagaaagcccaaaagaatgaagggcagagaccatcgaacaattttgttgtcggagcgaaagtgatcacaattggaggatcacaaccgatg

SEQ ID NO: 110898 - DNA, 106 bp, Heterodera glycines
  misc_feature (63)..(63): n is a, c, g, or t
  Promoter: Source sequence=SeqID_24929; Location=1..106; Strand=+; Gene=SeqID_55669
gtacatcgatcactccgtcatcgcttttcttcgttccattcaaagattttcgacaaaagaggnaccgatttacatttccctattccatcatcacactctacgaatg

SEQ ID NO: 110899 - DNA, 803 bp, Heterodera glycines
  Promoter: Source sequence=SeqID_17772; Location=329..1131; Strand=+; Gene=SeqID_82313
tttattcggaagcggtgagtcgtctgggggacccacacgcctccctcactgtatttagtttgttttttttaattttataaattttttaaacagaatttcttttaataaatccatgtagcttgtgacccttttttccgcacgtcgattcgaactgcaaacgtttgttcattttagcgtaacaaaataacttaaaacatttttttaattttaaataattttttcttattttaatgttcattttaaaatagttttatttattaaagaattttgaaaggataacttatttttaaattatcttcattgcttctgtttatttatttttataatttgttattaaaaatatattcagcgtaaatatatttaatttcaaaactaataaggtcataaagtgcaaaattcgatttcttggactggaagttgtttgtgagctcgaccaggtgtgagtgttttgatgaattgcagatcattgtcgattgtcttttttaaaatttatatttaaaaaaaagttcatttttttctttgaatatttaaaagttttaaaaaatatatttaattaacacctaaattgcttaaatactttaataattttcttatatttatattttagaaaattttatgtataaattaacatttgattattgttaataaaattattggacttttatcttgccgcaagaagcagcaacacagctcggtcaagcactaaaattggctatttccgcgctcgtaaaaattatttaaatatttattgtattattaaaaagaattaagagggtcctgacggtatcgacgtggcaaaaatg

SEQ ID NO: 110900 - DNA, 258 bp, Heterodera glycines
  Promoter: Source sequence=SeqID_11874; Location=1..258; Strand=+; Gene=SeqID_75382
ttatattttctagggaacatgtttcgcgcatttggcgcatagccagaaattatcaaaaaatgatgtaccgaaatgcaaaagactgtgttttttacatctgttacacatctcgtaatgacaggggcagtaatgacaacacttaattttatgtggacagttcattttttcaatttaattttatttttggttgctatttatagaaggggtatataaagggagtgaaaggaccatttgattggtacattgtatcaaaaaatg

SEQ ID NO: 110901 - DNA, 362 bp, Heterodera glycines
  misc_feature (15)..(15): n is a, c, g, or t
  misc_feature (19)..(19): n is a, c, g, or t
  misc_feature (31)..(31): n is a, c, g, or t
  misc_feature (38)..(38): n is a, c, g, or t
  Promoter: Source sequence=SeqID_8013; Location=1..362; Strand=+; Gene= SeqID_66683
ataattaatttaatntatntaattattattntaagttnttctcatagagataataaatggtgattacaaatggtttaaaaataagtgattatcatgtggtataaatcataaatttgaagcaaatagatctttttataacgtactattagtattatttattttacatcatcttgtatgcttcaattaatttgttgatttaattattgacatcatttaatacattatttatctgttattatatttataattaatttaaattgacaatttttcactattttcaaatttattaatttttttttttgcgattttacttcttcatcaattttttgttttaccaaatatcattaaactttttaagaatg

SEQ ID NO: 110902 - DNA, 1003 bp, Heterodera glycines
  Promoter: Source sequence=SeqID_21739; Location=797..1799; Strand=-; Gene=SeqID_52339
tggggggggggtgttttttttaaaaaaagaaaaaaaatattttttttttttttttaaacacccctttttttttttttttttttaaaaattatatataccccctgtaaaaattttttttttttaatttttcctttttttccccccccctttttttttttggggcccctttttggggggaaaaaaaaaaaaaaataaacaaaaatttttttgtgttatcccctttttgaaaaaaatattttgttaaaaaaaaaatatttaaaattttttttaaaaaatttttaaatttttcaatttaattttaaaaaaaaaattttgggttttgggaaaaaaaaggggtttccggtaaccagggttttgaaggttcccctgcccaaaaataagttctgcttcaaacttgggatgtccatttttagggtcttttttatggtttggactgtctagcgactgttttcctaaaatcgtgaaaaatatgtttactatctaacaaccaatttttattgttttttgaaaattcaaggcattttgtgattagttcactttttacgaagaattttatccaaaaaaatgaccatttaaaaatttttatttacatattttagtacaatttgggggtttttgtacatatttcatacatattttagcattttttatacatattttatttacataattcgcaaattttttaaataaaattagcagccctaatgataataatttagaagggcgattttctcggactactatctaataataaaaattattattgtttcagatattcaatttttcaaaaaattgcatcctcccaccgacactaagaattaagattcgcaaaaatttttgtatataatttgcttttaaatttacattaattatagtaaataataatttatcgtcatcaccctttgacggcgaatttttcccagtcgcatttactaaaataatataaataaatttatgacaaattaaaatcttttttaaatttttaataccattctccaagatg

SEQ ID NO: 110903 - DNA, 229 bp, Heterodera glycines
  Promoter: Source sequence=SeqID_17404; Location=933..1161; Strand=-; Gene=SeqID_81886
ttttttggcacaaatatcaatatttagcatgggaaaaaataatattattcctactccaataaaggaggcagttttgcaagcatgtttaaatggaaatggcgtctgtaaagtggcaaaagacttcaaaattagtaggcggacagtgtctcgcatactaaaggtaaaaaaaaaatgcaaaaatcattttgttttttttttgtttaagcttcatcatgaaaaccaggacatg

SEQ ID NO: 110904 - DNA, 1003 bp, Heterodera glycines
  Promoter: Source sequence=SeqID_17113; Location=1042..2044; Strand=+; Gene=SeqID_47418
ggttacgctttgaccattcgtttccgattatttttagttttacgtaattaaaaatcatcaatttaaaagtgagaaaaaaaaagagagttaatcccatgtcttttattgagaaagaataaaaaagtgaaatatttttaataacatttttataatttaaaaaaatattatttaaaaacaaataactttggtctaaaattttgattaaaagaaaaaattaatttaattttagaacttttcaacaaacctatttttctcttggggccaatttactattacaaacagaaaattccaattattattttttcttatttttttttatttgtccgatttatttgacgtaaaaattccaattttattcataatttttatatcatatatatatttttgtaaaatatgtatattataatagataataataataattttaaaaatatatttaataattaaattgaataatttaaataaattaaatatcacactaaatgaaattacaattaaaaaatcatttaaagaattgatttccattttttactaattctaataataatttgctcattttgatgggttaggtggtgatgccaggtgaaaattttgagcatttgaactttaaatacgattgaatgaaattgtcaaacagattagtcttttatggcactgtcacaattaattatttaaataccgtaattgttacattatgttttatgacattttcgtacattagaccaaaaatttttcacaaaaatctcgaaaaatttcttcggtttgggaatggatacagagattcacaataactgagtacctaagtcggtgatgaatttcagtgcccaaaaattaagtatgaattgtcggggaattgaaaaggacaaagggtcataaagccatggtttgggaaaaacagtaaatttcacaactcggatggattcgattcgtaggaatttttgtaaatatttaaaaacttttaaaaattcagggaaaactatttttttacaattttttcaacatg

SEQ ID NO: 110905 - DNA, 61 bp, Heterodera glycines
  misc_feature (14)..(14): n is a, c, g, or t
  Promoter: Source sequence=SeqID_21067; Location=1831..1891; Strand=-; Gene=SeqID_51660
gctagttttctgtnattaacaacgacaaaaaacaaatattattttctaattattcgacatg

SEQ ID NO: 110906 - DNA, 794 bp, Heterodera glycines
  Promoter: Source sequence=SeqID_32213; Location=1..794; Strand=+; Gene=SeqID_62536
taaacaaatgggggtaattatttaatctgcctttataagataaaggggaatttaagcgaaggattcaggcaaaaataataatctatagaaattctctaaaaagtagttcctcgcagattcgtggaccgtttctataaagctagagacatatgcgctaaccataaaaaagatgaatcatgtttagaaaaattgatatagttcgactaaatttccaaatcgctttatggtgtacaggatgttagtagaatcataacttgtcagcccttttagatagtcctgccattgctattcctgcaaatattgagtctagtcagctcattggaattgaagaaatattgggtggggatcgtctgccgctaacaccataagatattttttgggcatagaattttaaaaaatgaaaaaaaaccagatgcaaactcatagtcatgaaataaaatcatagacttaatgatgtcatatgataaatctgatgtcatatccgtgatcagcgccctcgattgccatttgttatcattttaatatttcgtgcatttgaattggttttgttgcgtaaatgttgaactttgttgaaaattgaattttcgattttttgtcggaatccgggttcggggttcgaatagggtcgaaatggatgtcagaatcggattcaccgacccagaaaaccccagaaacgcctttttcgcgccaaaaaaaaatgaatttttttttcaaaaaggtgcgataccatctaaactattacccctaattctgtttataaaggccgcttttcccttttagcctcctcggcgatg

SEQ ID NO: 110907 - DNA, 284 bp, Heterodera glycines; identical to SEQ ID NO: 98949
  Promoter: Source sequence=SeqID_11512; Location=267..550; Strand=+; Gene=SeqID_74938

SEQ ID NO: 110908 - DNA, 580 bp, Heterodera glycines
  Promoter: Source sequence=SeqID_7737; Location=890..1469; Strand=-; Gene=SeqID_65786
tcggagaacattacagtgcgggcactggcgaaattttggtggagaaccataaaacgctgacaatccgcaacattacattggaggcaaacagagcgccaggcaaataaaaaaatgcgtaaaatttaaattcaaaatgtttggcataatgtctctgttagatgcttgggtgttcgcggggcgaggcgaagtgcgtcagtcgagcgggaagaaggcatttgttgtgggccgagacacgccgagccggtaggcccaaaggcatactgctggtggcgcttttctttaagctgacatccctccaaaaaatcgatggaattttaaaataatttgaaaagaaaattttgagtaatttaaacaattgaaaaaaatttatggaattttaatgaattttgaaaaaacaaattggatttgagaaattcacctttttgaaaattcttttttcctaaatttttactcctattttaaaaatgaatttttctgaaaaaaaaatttaaaactccaatttttgtcaattttctctaaaatttcttaaaacatttatgtttaaaatttttcatggattttcggaagtgaggggggaatg

SEQ ID NO: 110909 - DNA, 254 bp, Heterodera glycines
  misc_feature (11)..(11): n is a, c, g, or t
  Promoter: Source sequence=SeqID_42165; Location=1..254; Strand=+; Gene=SeqID_70124
ttggacgaatntacgatggacctgtgttcggctttcacttcggcaaacattccatttttcaaattggaaaatcagaaatttcgaggtctgtttttgggatggcccatcaaaaaaatttatttaggctttctggaaaagtattgcaagcgtatggttctcatagggatgtgttgcagcaacgttatttgtcagcatgttttaagcaggtttatccactctacatattcaaaaacttggtcataattcagaaaatg

SEQ ID NO: 110910 - DNA, 54 bp, Heterodera glycines
  Promoter: Source sequence=SeqID_24792; Location=574..627; Strand=+; Gene=SeqID_55540
aacgagtcaagacttatattcacccaacatctctcggggctgcaagaggtgatg

SEQ ID NO: 110911 - DNA, 186 bp, Heterodera glycines
  Promoter: Source sequence=SeqID_27797; Location=445..630; Strand=+; Gene=SeqID_58459
ggtggggatgactttcagtttatcatcttccattactcgcagaaattcatttagcggggcagtttccagctgtttgtccgtggcttcaaagatgccaaatattggctcgaccaatgggaacaatctccggaaaagacattgccaaagccaagccgaagagaattgcaactccaatttgagaaaatg

SEQ ID NO: 110912 - DNA, 103 bp, Heterodera glycines
  misc_feature (85)..(86): n is a, c, g, or t
  Promoter: Source sequence=SeqID_22810; Location=2045..2147; Strand=-; Gene=SeqID_53517
gatttttaggatgagattttcccccggtaaataccgggttgtgccattgaaaaagtctgcggatccgcggaaatcgatccgtgtnntatggaagggccctatg

SEQ ID NO: 110913 - DNA, 497 bp, Heterodera glycines
  Promoter: Source sequence=SeqID_1385; Location=2986..3482; Strand=-; Gene=SeqID_73204
ctcgtcacaagtcgacagcagcgaacagcgagtgaaaaacggcttaggaaacaaatggcatgttacgctctgttctttatagataagcgggaaactttggtaatcttttttggatggggtgtaaaacaggcgagggaagaaagacagttatatgcactatttcttgcacattcgtttctttttcagccacatgataaaaaacgacgtaccatgtcgccttttttcttttcactaattgtaattttacctaattaatccaattcattgaaatgcgtgtttttgtatgctcaaagaggtttcaatttgaataaaataaacatataaaatattgatacattttttattttcgaagatattatcatcaattaaaagttaaaatactttgtagacaaaaattaataaatacaaataaaatttataatgaaaaagcaatttgacacgtagttgtccaattaagatcgcaaaaaacaaatattcctttctaattattcgacatg

SEQ ID NO: 110914 - DNA, 79 bp, Heterodera glycines
  Promoter: Source sequence=SeqID_32671; Location=1..79; Strand=+; Gene= SeqID_62954
ccgtcaaaatgctctattgtcaaagttcaggaagcgcaccaagacggatttttcatcttcaccaacttcgagcagtatg

SEQ ID NO: 110915 - DNA, 86 bp, Heterodera glycines
  Promoter: Source sequence=SeqID_24020; Location=1..86; Strand=+; Gene= SeqID_54724
agtaagcatttgcctttttgctctacgagaggtttccgtcctctctgagcttgccttaggacacctgcgttacgctttgacagatg

SEQ ID NO: 110916 - DNA, 175 bp, Heterodera glycines
  Promoter: Source sequence=SeqID_13927; Location=1654..1828; Strand=-; Gene=SeqID_77883
aaaaaaaaatggaaaaataaaaaatttttaaaggggaaattattttttttccctttttagggagttcattttttcttccaactttttgtaatgctcaaacagcgactggagcaatttaacctcagaggaacgggctgttgtcgcgggtcaagaaagttggatttggttgacaatg

SEQ ID NO: 110917 - DNA, 1003 bp, Heterodera glycines
  Promoter: Source sequence=SeqID_11235; Location=198..1200; Strand=+; Gene=SeqID_74594
tcaaattttggccatataacggaaaagtaccggacattcttttggctttaatgttcttattgtttgggctggcattggcacgcgtttttttgaatgggttaaagagctaaaaaaatagttgaaaattgctcttttttcatcaaaatcaccaaatggtaataggtgggaaatttaaaattaattagatgaaatgttaccattattttttgtaaataggtcattcagtggtgcgcgaaatagtcgtttttgaaaacccaacatctgaaacatcaaataattattaataaaaaaattagagattattaaattttattttaagcttaccaaattgggtttttaaaatatgaaaaaagtgagaattcgcttaaaaggtgcggagtcgttcttttaaaccatcaaatgaaaattttaaccaaaaataatttttaactttgctcaaaagcaacgaaatttataactattgatatcattcgatagctttaaatcttctctatcagtctacaaaattacaaaaaatttcattaagtttcaacaaagttatggctagaagaactcaaaaaatcaagtttttcgaactttttggccatattgctttagagcaaagcataagcaaaattttttattttatggtttttaacgacatagcaacgcttaaaatgccataaaaacccaaagttacactcagaatatttataaattttataatttttcaaatttttaaattcccaaaatcaatattggaaaagtatttgatttttaaagtgtttttttaaaatattctctgggttttcattatttttaaaattatatttaccccaaaatagagacaaatgcatatagctgctacctctatacatggccaaattgattagatatccgccaatgttaataaaaaaaataatgaccaatgaccgtaaaactcgtgtgttcgttcgtctgttgggttactgtaaaaagtattttgaattgttttggcgcaaaataaatgccaaagaaatgaatg

SEQ ID NO: 110918 - DNA, 72 bp, Heterodera glycines
  Promoter: Source sequence=SeqID_18702; Location=756..827; Strand=-; Gene=SeqID_83376
attgaggtcaacggctgccactggcacgcgcacgaccacccgcgtcaccgctttcagccccaaacagtgatg

SEQ ID NO: 110919 - DNA, 369 bp, Heterodera glycines
  Promoter: Source sequence=SeqID_13814; Location=4136..4504; Strand=-; Gene=SeqID_77750
aaaagaatttgatatatagtgccaaaagtcgtcattctgccgtcaattaccaaataataattaataaagccgggatttttatcatagaaaaaattacaaaaacattttatttataatttttggacaaaaaattctttagaaaatatgtaaaaataaattaatatttacaaaaaatgcgaaattttatgaagatatgtacgcatatgtatgtagaaaagccaaaaatatgcaaataaaagtcccaagttttgttcccaaacacaatatttacataaaaatcccagctttgatgattaaactttcaataattaagttgtaatgatttcctctgtattgtttgataattattattaagaagcgctcgaaatg

SEQ ID NO: 110920 - DNA, 86 bp, Heterodera glycines
  Promoter: Source sequence=SeqID_1890; Location=1229..1314; Strand=+; Gene=SeqID_76596
aatttttgttaggaattttgaaataaaaatccgaaaaaggcaccggaaaaaccgtcactttggtggaatgcgttcgacaattgatg

SEQ ID NO: 110921 - DNA, 178 bp, Heterodera glycines
  Promoter: Source sequence=SeqID_33638; Location=444..621; Strand=-; Gene=SeqID_63643
aattttgaaaaaagcctggacttggatttttttcacatttgatctggacctggatttcctggataaatccaggaaccttaggccatttgaattataactgagtcagtgttttaccacaatcatccgttttttcaagatataaatacaataatagctgtattttgttttttgaaaaatg

SEQ ID NO: 110922 - DNA, 1003 bp, Heterodera glycines
  Promoter: Source sequence=SeqID_5952; Location=1420..2422; Strand=-; Gene=SeqID_59789
agctaaatgcattgaatttcttgaagcatggataaatatgtaatttcattaaacacgaatatttcatcagaattaaattgtctaaacaaatttatgtttgtttagccgttacagctattcgaaaaaattcataaaactttcaggcgacgcacttttcgtttatttttaaaaataaagttgatgactaaattaactaaaaagcaatattcatattaatcaatggggggttaagttggcagccaatttcagcaattgtccatttctgtcaaaagtttttttttcggaatcggcgttgagagcattcaaaaaatgaatgaaaatggaagattttttattttagaattaattaataccatctttatttggccaagaatggcgtactctttctcgaaaccacgaggaaaatcagtgcaaatttgggacttttcaacagaaaatagcatttgaatcgatgaggtgtgcatgtaataaacagcagaaagcgaatggaaatggaggaaaaacggggccaacccaaccaaccaatttgaaaattgaaatgtctttttttgccaatcttcgtaactaatttgttaattgcctatttgggattttcgtaactaaaaatccacacctagtcacattttggcgaaaaacgtacttcgaaacgccgaacaaagattagaagagctcaacagaaaggatggttttgcattcaaataaatgccaaaaaagtatgtaagaccaaattaaaatggagcaatcgggtgagaaaagcgtcctttaaatagacattggcgcaaagaactaaaaattttaaaggcaaaacttcgactgaaaaaatgtgtataaaaggagcgaaaatgtcggttggtcactcattcccttcacagcgacaacaacaacaacaacaaacaatcagcaacgacgacaattgcgcaacgcttcaacacagcacatccatcgcccgtgcacacgtcgaatccgatcacttctgctgctgctgctctccaacaacacaatg

SEQ ID NO: 110923 - DNA, 232 bp, Heterodera glycines
  Promoter: Source sequence=SeqID_40263; Location=906..1137; Strand=-; Gene=SeqID_68663
tttttcggctacctaggtttttcctggacgttgatttttatggatttttatccaggtccaggttaatcttgaactccaggtctaagcataaaatttctggataaattcaggtccaggtcggtttattttaaatttttaggaatttgtttgctttataaaataaatttccaaaatatccagctccagcagccaggcctggacacttaatgtctgtctcatttttacagatatg

SEQ ID NO: 110924 - DNA, 167 bp, Heterodera glycines
  Promoter: Source sequence=SeqID_38891; Location=552..718; Strand=-; Gene=SeqID_67586
atttcaatcacacaaaaagttgtttaaatcgttgatttttgttaaggtgtcgaagtgcccttcgttttttaaggctttccgaagtgcgtttgagtaccgtaccatttaaattggttacgataaattaaaataaatcgattcaatatttcagacaatttccacggatg

SEQ ID NO: 110925 - DNA, 473 bp, Heterodera glycines
  Promoter: Source sequence=SeqID_2704; Location=1408..1880; Strand=-; Gene=SeqID_81183
aaattgtataaatagatttttaacaaaaaaatataatttctttttagaatttcaacaaaataattttaaaattaaaatttcaaatatttaaatttgaggcttattcagtcataatattctacctatcattaagaactcaattaactgcatcattccaggcaatatcgccaagattttctcggcctgtcatcactaatgtaaatttttttatgtaaatttttcttagcgaccgccctaaaaattccaaaaaaaaataatattttttaagcgatgaaaataaatttaaattgctcattttatgtgtaaagaaatgtgaattcatttgaatgttttccgtgtccaatcatctcacatttgttcaatttacacaacaaaagccagcagactgaaaaaagatgtctcaacctttgaataaaaaggccaaagattattgggcaatttacaaaaatatttttagccgatgagataaaatg

SEQ ID NO: 110926 - DNA, 487 bp, Heterodera glycines
  Promoter: Source sequence=SeqID_27625; Location=1..487; Strand=+; Gene=SeqID_46058
aagacttactgtttaaatgaactttaaaatgactcacagagctactgaaagtgtgaatttagtcaaagaaaaattcttccgccaaagttctttttaagagaaaaagaatggtcaccttttccaactcttccgattttcagaaactgaatatttaagtttactcaatgctcaattggttcattggttacttaaaatgaggctttgaaaatgcttgttcgactttgactatctttcccccacccaaaaaggaccgttttattccgccacttccgttgggtgcggccgaacggcgcctgacattgcgccaactgaataagttgattgaattccatttggcacaacaagcggcgcaactgtcaccacgaattcgacacattactgtacaaaacggaatggtaatttgcattaattacaatttctgaatttcctaaaaagtgttgccttcttcaataaggcttctctggtggtccccggagaatttgaaatg

SEQ ID NO: 110927 - DNA, 96 bp, Heterodera glycines
  misc_feature (6)..(6): n is a, c, g, or t
  misc_feature (14)..(14): n is a, c, g, or t
  Promoter: Source sequence=SeqID_12425; Location=1..96; Strand=+; Gene= SeqID_76037
ttttgnacatcgtncgaccaaaatgaaagtgccgctgtccgcggagtgcgcgaattcaacccggaatacacggcacccgaatattatgacgagatg

SEQ ID NO: 110928 - DNA, 446 bp, Heterodera glycines
  Promoter: Source sequence=SeqID_16268; Location=1..446; Strand=+; Gene=SeqID_80652
attgatccctacttgctccctctctattactcttctactcttatgacacttcctcacttccctcattcacattcaattaaaatcaaaaacatttgttttttaatcctcatctaatccaattgattgacataattaaaatgttgtttttttggtacaatgtcatccacttactcgttgcacccgtcaaagaatatgccattcaattttcgttggtttaaatattttccaaaagttcatcattcgaaaaagatttaatttaaaacatatttaatttttttttaatttttagggagtcgtaataaatcctaaaaaccctaattatttatttataacaaaaatgcaaaaacataaacaaactaaacatccattagcatgttccgatggaaaaagttattttaaaaaatcattaaaaataaaataaataaatgctttcagttaaccgtatg

SEQ ID NO: 110929 - DNA, 515 bp, Heterodera glycines
  Promoter: Source sequence=SeqID_7520; Location=930..1444; Strand=-; Gene=SeqID_65102
tccgaccattttcgcttcatttgcaacaccaccaatcatcgctttttgccattgggggttgggcgtctcaactcaattttgcattcgactgtttgcggagttggcccctctaatttttcagccggttttgcaaatcatttggtaaagccaaagggccgagtaaaatttgcgcctcatttttgatgattccttttttgataggttcaacatcgctttttttcttcaaagtctgatggtttgaacgtcttcgaaccgaagtggaagaagggtaggcatgggagggaccgacctagtgtaatttccatttgatcattttcagcaattctagttgtactccttgtctctgctgttatcgttttgataatactggtttgttcgcatttgtttccttaaaatttgacccctaatatctttaggaggccagatcgaatttggcgaccgacgaagagggggaaggtttggaggagcaccggcggaaggaagaggagaagcggaggggccgccaggagcggatg

SEQ ID NO: 110930 - DNA, 147 bp, Heterodera glycines
  Promoter: Source sequence=SeqID_31951; Location=1..147; Strand=+; Gene=SeqID_62270
attgataatagcagcagacaactgttgggacgacgcctttacagacaacccattcggtaatgaccactgtcttttgctcttccacctttgtaatttcagagtgagcaagtcgagaaggcgcgccaggacaaagatgatttccatatg

SEQ ID NO: 110931 - DNA, 656 bp, Heterodera glycines
  Promoter: Source sequence=SeqID_35919; Location=375..1030; Strand=+; Gene=SeqID_65373
ttcggcttgttcaagagttgttactctcttttatcggttgccatcggttcgtttccgtagtccttcataatttgactgacaaataagcgtgggggggggaggcatttcgcatggaatttgtgttaattttattgaatttttgggaaccgctggtaatttgagaagacttcaccctgtctgatggattttttatttggggaataaaaaatgaaattttcagaaattttttagaacgttggtctttctttgttttttgagtgtttaaattgccaccctttttcttcagattccattactccgatttgctcattccttacgagaaattctcaagtgcctcccaaaatgcgttgccaaattacttaagtgttaaagccgaccaaatcattgacaattccaaactttgtagcattttaatgccatttcctacttaatgtgattaaaacagttttattaccacaaatttctaataattatttaatcggataaatttgttattttttaaatataattttttctttttggtaatttatgccatcactttactttgtatttttctccctttttctgttcctttttgattaataaaatgactgaagcttctaccgcttccaatggcatcattagccctgaggatggttccgcggaggaagaagatg

SEQ ID NO: 110932 - DNA, 1003 bp, Heterodera glycines
  Promoter: Source sequence=SeqID_12770; Location=1003..2005; Strand=-; Gene=SeqID_76480
attaatgaaaaaaaaattggctgtcttttcctaattaaaaatgccatggtattggcgtgatgaattgccaaatagcatcagcagaaggcagtggagggcacaacaggtgaaaaaagcacaaattaatttttttaaaaatttctcgatcgaattaataattttgaaattatttttcgtttcttttcatagttttgtttttattcttgaataatcatttttggactcatttcagcgtctacatcgtcctatccagcgtgcgcaaggtgttttaaattattatccccccccccccataaagagaattaatgaaaaaattataagtctaactaagaaaagttaatgaggcccgggatttttttaaaatttatttaatttcaagtcccatggccatttgtacaccagcagtatttggggacagtacaatttcctccacctccgcctcatcttgttgatcctcgccatggacattttctcccaagacggtggttttattcatttatttttttttaatttaaaaattttaaattgtttaaaaatttttaaatttaaattctaaaagacaattaatatttttctgacatatcttataaaaaaatatgattgaataagaaaaaaaatataataataaataaattttttatttttttggcggcggggaaggcaaacacagcgaaatcaagtcaatgcaaacgcaccagtacagcggcctccagtaaaactgtttaaaatactgtactgccctttgaaccccccccccccatttttttaaattcaacagtactaatgctttggttttcaaaattttagtaaaaaaactaattacaatcgtaatattgtttaacccttttttcgcaccaaaaatacaggtttggggcagtacaaaaaaatcggattataacttttgggatattaaaaaaaaaaaaagcagcagcagcagcaggtgcctttgttcattcgctctattggtgctcagctgcaaccagtttcggttcagcaggctatg

SEQ ID NO: 110933 - DNA, 323 bp, Heterodera glycines
  Promoter: Source sequence=SeqID_23165; Location=1015..1337; Strand=-; Gene=SeqID_53869
cttttcccatcacttcgggtgctaatcgcaaacatcaaagaaaaatttggttgcagacaaaaaataattgcgtacgatttgggaaatgtgacaacaaacaacgaatgggttaagcaattaataattataattaattcgatttaattaattatttctcattaaaaaattaaagtattgaatttgaaattactatgctttaaatattattggcaaaaatagtaaattaataatttacgtttaatttcattccgcgtttcattaaaaccgtatttatttgcacattttaaatttataatttgcaggtaactgagttgaattcgatg

SEQ ID NO: 110934 - DNA, 137 bp, Heterodera glycines
  Promoter: Source sequence=SeqID_17709; Location=429..565; Strand=-; Gene=SeqID_82240
aaaataattaacgatgcgtcaaatgaattacagtcaagaacagccacaattggaatgataatgccatattatttcggaattaaaaaaaaattcatggagggaaatccaaacaccggtttttgttctatccgcaaatg

SEQ ID NO: 110935 - DNA, 458 bp, Heterodera glycines
  Promoter: Source sequence=SeqID_43597; Location=1..458; Strand=+; Gene=SeqID_46744
tatgaaaataagtactatttactgtcatacctatgttaaatttgataaattagtttgaacttttgcaagctaatagagaaaaattctggctattttatgctactaagaatgtaaaatatgattgcctttaagcaaagttatgccatatgctttgtcgaaaaaattgctaaaaattttgaattaacgggatttctggcgtaatgatgatcaagttcctgatgttggaatacgaaacggccaagcaccggtctacgtcagttgggcccccacgtttgggccccagcatgttatttttggctataacttttttctttgttaaccaaatccaacattattagaattgaaaagaaaagaacaaaatggcgaaacaaaattaaatctatcaaacattttagttctttgattttatcgaataatctcaaatttagattatacacattttctaccgatcaaaaatg

SEQ ID NO: 110936 - DNA, 174 bp, Heterodera glycines
  Promoter: Source sequence=SeqID_15975; Location=1221..1394; Strand=-; Gene=SeqID_47333
tctcgccgcgagaaactcgccgccgggccaactcgccgcgcgctttttcgccgcggggccaattcgccgcggccaactcgccgcgccttgttttttggctatctcgccgccagatttttcgttgaaaaaatgcattaaaagcaaaaattctttaacagttaattgtattcaatg

SEQ ID NO: 110937 - DNA, 560 bp, Heterodera glycines
  Promoter: Source sequence=SeqID_3057; Location=4681..5240; Strand=+; Gene=SeqID_82994
atcatttttgcatattctttgtatttttcattttattgcttgcattattaacgaatggaaaataaaatatgaaaataattaagcaatggaagatgtaacttttaggtagaaaaaatgcataattaacgatttgaaaataaagttttgaaaaaattaaggattagaagatacaagtttttaagccaaaacataattaagcgttgggagtatttgtttttaggcgaaaaaatgcatagttaagaaaaggaagatataattaacaaaaaatatgaattttgtggtaaatttgggtgtagtgctgtgtgtatgtgttcaccagtacgtgtgtgctgatgatgatgatggttggctgcactcaccacgcccagtgttggtaatttcgtcaatgctttcataccatttgcagcctttaccgttaaattgtaaataggaagagttggaagaatgtgaagcttcacttttggtgtcctcctcctcctgctcctcaattcaaccgtccggacaactatggccgcgaaatttttccgacccccgacgactacctcgcccatggaatgatg

SEQ ID NO: 110938 - DNA, 1003 bp, Heterodera glycines
  Promoter: Source sequence=SeqID_3916; Location=660..1662; Strand=-; Gene=SeqID_52433
aaaggtcgttaaaagtaacagtattatgatagaaaagatataattaaacatgcaaaaaataatagttttgctaaatagtatcaggttaaataaaaatttataaatttctgccaactttaattatagttgtatgtgtgttcattgagtttccgatagaacatttgaatttacgccatgaaaaattaccaaactaaaatatcgaagtttaaatggtttaaaatttgacttctctgtctttggttattgcaataaattaataaagcaaaatactttctaaactaaatatataaattgactaacaaaaaaatatttgtcatatatgaaatcgaaagaacttggaagaaattcaagtaattcatcaaatttaaaaaatatataaaataaatgccattattaaataataagtgaaaaaatgccaaatccaaacatagaaagcttttcaaagaacatgacagccgaccaagttgcggacatctagagtaaactaaaaatatgccaaattaatcgcaaaagcaataattcaaattgctaaatttaatattaaaacaaagtttttaaactataatttaaaaaaatttaatactccattttaggataatccataaaaaattctttattacaaataatcttaatattaatatattttattcgaaaaattatacaaaataaaagataaactttcataatgtttcaaattaataaattaaagtcgtagtatggtcttgaggtattcaaatccttcctcaaaaaggcggatgatgagaggttcacacaacaaatctggcaaatatgcgaaaacaaacggcaagagaaacagaaacacattaatagttagtcagatgtaaaacaaataatattatttcaataatattttttaaccattttactttcaatatttatttaaaaactttaattaaatgtgtctttattattaaatatttaagatcgagttatgaagaagaaaaattataactaaaatcattaaaaataatttagtataatg

SEQ ID NO: 110939 - DNA, 69 bp, Heterodera glycines
  Promoter: Source sequence=SeqID_28216; Location=314..382; Strand=-; Gene=SeqID_58856
tttttagctaaacaaattcaattttatgtattagaaatataaatcgcttttcagggaatataaccaatg

SEQ ID NO: 110940 - DNA, 103 bp, Heterodera glycines
  Promoter: Source sequence=SeqID_11833; Location=1080..1182; Strand=-; Gene=SeqID_75334
aggtcgtgtcgcgccatcaaatcaagactattcgatgacaatttgttttaagatttgcaacccggacgggcattgcctgttctacgcgtagcaggcaacgatg

SEQ ID NO: 110941 - DNA, 258 bp, Heterodera glycines
  Promoter: Source sequence=SeqID_2316; Location=3930..4187; Strand=+; Gene=SeqID_79075
ttgaagttgttgcgccgggcacgtccgcttcgtgtgtgatgaagtgttgtagacgatggacgatgataataataataatataatataatatgagggcgatgaagtgaattgtgaggaaaagtgaggaaatgtcgcccttttatacaactttttttcccttaatttcgaaatttttttgcttgtctatataaaggcgagcattgcaaaattttctctcattcatcgcgtccgttcacatttttaaattcttctattatg

SEQ ID NO: 110942 - DNA, 348 bp, Heterodera glycines
  Promoter: Source sequence=SeqID_1749; Location=5397..5744; Strand=-; Gene=SeqID_75680
accagggctggacgcaactggattaacaattacggaaatccgcaattgcggcgattttctcagttgcggaaatccgcagttacgggggtccaaaaaccccgcaatttccgtaatcctcaattgcgtccagccctgatggcgacccatcattacgagccataaccccgaaactcgaataaaaaaccataaatccgatttttttttaattcacatcatttgtttccacacaattgccgaattcgtgatcagactaccctcaaaccttcttttggaaattatagggcctaaacgatattaaaaaacgcaaattttatttggcattttcccaatttttgctgaacacacatg

SEQ ID NO: 110943 - DNA, 342 bp, Heterodera glycines
  misc_feature (49)..(50): n is a, c, g, or t
  misc_feature (58)..(58): n is a, c, g, or t
  misc_feature (61)..(64): n is a, c, g, or t
  misc_feature (66)..(69): n is a, c, g, or t
  misc_feature (74)..(76): n is a, c, g, or t
  misc_feature (88)..(88): n is a, c, g, or t
  misc_feature (92)..(94): n is a, c, g, or t
  misc_feature (97)..(98): n is a, c, g, or t
  misc_feature (100)..(103): n is a, c, g, or t
  misc_feature (106)..(106): n is a, c, g, or t
  misc_feature (108)..(113): n is a, c, g, or t
  misc_feature (115)..(117): n is a, c, g, or t
  misc_feature (120)..(123): n is a, c, g, or t
  misc_feature (125)..(126): n is a, c, g, or t
  misc_feature (128)..(129): n is a, c, g, or t
  misc_feature (131)..(131): n is a, c, g, or t
  misc_feature (133)..(134): n is a, c, g, or t
  misc_feature (149)..(149): n is a, c, g, or t
  misc_feature (155)..(155): n is a, c, g, or t
  misc_feature (159)..(161): n is a, c, g, or t
  misc_feature (175)..(177): n is a, c, g, or t
  misc_feature (182)..(183): n is a, c, g, or t
  misc_feature (191)..(191): n is a, c, g, or t
  Promoter: Source sequence=SeqID_33914; Location=973..1314; Strand=-; Gene=SeqID_63838
attaattcactcagaaattttcattttgcatttaaaccctttaagaatnnaaaataanaannnngnnnntaccnnnacctatgaaacncatnnnganngnnnnggnannnnnnannnaannnnanncnncngnngccgaccccgaaaancaaccnggcnnnaaaggcacaaaggnnncaaanncgcaaaanaatggctgttctgcggagggaaatgttttgcgcttttttgtcatcggtgacatcggtggggaggagtatacggtagagggcaaacagcagcagtgtacggtggaaggacacggtaagttgaagagggagaacaaaataacattttaaaatg

SEQ ID NO: 110944 - DNA, 310 bp, Heterodera glycines
  Promoter: Source sequence=SeqID_8707; Location=669..978; Strand=+; Gene=SeqID_68915
agtaaaaggtgactcaaaaattttttgatctatttaaaagcatatttgctttaaaaaattattcaatgattttcatcaaaaattttacctttttttgcggcacgttttttcaaaattttttaaaacatggcgggggaggtccggcggtgccgataggcgccgccgggaaatttttgaaaatttcagtcaatttattaacaaaatttgtaaaaaatttttaattttttgaaaaaaaaattcaaaaaaatttccgaaaatttccgactttttatcaaaaatttcggaagtcggaattccgactccaaaaatg

SEQ ID NO: 110945 - DNA, 885 bp, Heterodera glycines
  Promoter: Source sequence=SeqID_19035; Location=1..885; Strand=+; Gene=SeqID_83770
atgggtcaagcccaggggaccagtagcgttttgggcccccgtttttatacccccgcgtttgggcccccagtgtcagacaaaattactcataacgccaaatagcgcatttggcgtaaatttttgcgcgctaattcaaaatttacactggtaaatgccttttttatattttttattttgatcagccataactcgcttcattcccgactaaactgaacaaatttggtatctaaaaaaagattttgtaatggagaatctttttttaagcgaatgttaagcaatttgacatctcagaaaaaagttgtgatagtttcaaatttttattacgttagaactcaagtcctaaactgctgttttcaccaaaaatcctaaaatttattctttttttatttattctatatgtccaaagtgatcttgtagcctataaaccaaaattgttagaatttgagagtttcaatgttttgtgactcgttttttacgtgttactcccatcggcacttttaccggcatttctttttttattctctgtcctttaggacatcaatttgctatgagtaactttgtcaagggtctgttgccatggcttgcccttatggcgaccgccccaattttcgtccaatattttcttcgcgttaaatttgatcatagaaaaactcgtcgtggcgatctgcagtttcttggttctgattctgacgcaagtacacgcaattacattctttttaatcacaaataatgtgtatgtacagacatcgggcacttttttacttgggacccccgaaaacatattaaaaattttaaaaaaatatgaattttcttgttcaatttgggtccggaattctgaattaattgaaatagatgacggatttgtggtcagcaacttcgaaaatg

SEQ ID NO: 110946 - DNA, 156 bp, Heterodera glycines
  Promoter: Source sequence=SeqID_43619; Location=688..843; Strand=-; Gene=SeqID_71238
tgttttctttttccagtttcataaactaaacatttttaaattatatataattttttgaacgacgcaattccctgtgttttgttcgttcctcgcccccatctcccgttttttcagttggtcaaccagctgcaggacgtgggctacacagtggccatg

SEQ ID NO: 110947 - DNA, 72 bp, Heterodera glycines
  Promoter: Source sequence=SeqID_16978; Location=1137..1208; Strand=+; Gene=SeqID_81402
ggtcaattattgcatcaatcaatcaactttaatcatttaattgacatatcatttcagatcaagtactacatg

SEQ ID NO: 110948 - DNA, 1003 bp, Heterodera glycines
  Promoter: Source sequence=SeqID_10814; Location=3987..4989; Strand=+; Gene=SeqID_74083
gtataatgtctgtgatggaaacggcatttctcttttctcatctcggcaccgattttttgacttagatactcgcagattccgtagaataaccgcaaagaagcagatttttccaactcggtaccgatgtttcacgtgatccccttactgcagttatttacctaataaatttttttgaattctgttttcggtatatcaacgattagatagtgactagaagaggaacagggagggggggatgatactcgggagaaacggcggagaacgatattcgggagaataacggtacccggggaaacggcggggaacggtaccgggggaaaaagcgattatatcaaatcaaatccattctattattatatataatatataaaatataatatttcttttacataaaaatgtataaaaaaaaatcaattttcatcaattgcatcattcgcgcacatttgcctgtaaaatggatttttttgattaatccacatttatttgcccaaattgctggccaatttcattggcagagagggcaatatatttttttaaagctctgtgccgtaaggcccaaatatttggccccttcccattgacatggaaaattggtgccaattcattggcagggctaaattttggtggccgttacaatcaatcaattagcaattcttcacaaatatccatgcatatccacatgaaaatgatcttgccaaaagcatagaatggcattgccaaaaaattggccaatttctcctcctgtttctcaatgtacctaatgccaaaaaaaaattggcaaacccaattttcattgtcctgctaaaaacggccaatttctgcctccttgggagcagtaccaagccaaaatcgggcactttcttatgcgtgcgtcccattgtgttggcttctgctgttgccacggtggattttctgctttaaaagtccccgcaaaatccccacattttcactattatttgaaaaatcattttgcgcaaaaaaatttttatttttgtccgaaatg

SEQ ID NO: 110949 - DNA, 409 bp, Heterodera glycines
  misc_feature (10)..(10): n is a, c, g, or t
  misc_feature (23)..(25): n is a, c, g, or t
  misc_feature (50)..(50): n is a, c, g, or t
  Promoter: Source sequence=SeqID_13202; Location=1..409; Strand=+; Gene=SeqID_77028
tcattatganaatgtcacaagcnnnaccggtgatcatcacatcacgtgcnaagtttccatcattaaacagatcaaaacagataaagcagccatagaacacagaaacaattgtaaccattaacaaatacaaacgaattttgcatttgttatgcctataaattataattgaataaactaattaaggataatacagtacatttcaccaaaaattaatacgatcagtcggtcaataccggtgaaaagcatcgcagtgtaaatagcacctaacaaattatttaataattataaaaattcatacatatataaataaattaccaaaaccaaatgcagggataaatacaatctttgtgggtaaacgaaaatcaattaaattttgtccagaaaatgcgatgtaaacaaacaaaaaatg

SEQ ID NO: 110950 - DNA, 110 bp, Heterodera glycines
  Promoter: Source sequence=SeqID_7520; Location=533..642; Strand=-; Gene=SeqID_65103
aattgtttttgtttttcaatatttgtccaacaaaatgtttaaacgaaatcaccttattatttaccttttcttaaattattaattatataaaaagtgcacttttgacgatg

SEQ ID NO: 110951 - DNA, 225 bp, Heterodera glycines
  Promoter: Source sequence=SeqID_15696; Location=524..748; Strand=+; Gene=SeqID_80005
atcagtccatcagatcaataagttggaggcggtgttcgtcggcacccaatacccggatgtgtgcctcagggaacagttggcaacgcaaaccgggctgagcgaggcgcggattcaggtgccaagggggggggcaatttggccactctttgtttaccatcccaccttcgcggcttaggtgtggttccaaaacaggagggccaaggcgcgcaagtcgatgaagcgatg

SEQ ID NO: 110952 - DNA, 540 bp, Heterodera glycines
  Promoter: Source sequence=SeqID_34057; Location=167..706; Strand=+; Gene=SeqID_63946
atttaatgtattattttataaagtgcaaattttttttttcattcattcgtttgtttcattttttagtcataatcattatatgatttaatgattcttatatttattaaatatcaaacaaatttctgctttttttttattctcggtttgaacctccataattgccggtgtattcgagaataaccttttctctgttgctcttatttcttacaattagcactagcttacaatttaggcataagtacataactcagacggatagccagagggatttgaccccacccctcccccacgcccaccgggaacagacgcgctcatagaatagcaccgcttccatttttaaattttggcgcgttttccattcgtttattacctttctcatttggttttgggtaccaagaccgtatcgtgactgacttgcgctacttcaacttgtcttgttcatttatcgccaattgacgagtaggatcatcgctatccaatgaatcgctaaatcacttgcatacaggttagtattaatgaaaaaacagcgcagagaccatg

SEQ ID NO: 110953 - DNA, 1003 bp, Heterodera glycines
  Promoter: Source sequence=SeqID_6989; Location=221..1223; Strand=+; Gene=SeqID_63515
tttagtgaatataatttagaatattaataatgatataaataaaattttcatttattttttttgaaattatgtatatcctcaaatgtcggatcctcaaaagtcgggtcctcaaatgtcacaccacggtcgagacacctttgtgcatgtatcatcagtagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaatttaaaaaaacttattttcacctattttggcgttttgcccaaaatttgttaaaaatatgcaaaaaaaagaaaaatacacccctaagaaccgacccaaaaattttttcaaaaaatacatccctaagaatcgaccagaaaattttcaaaaatgcgcccctaagaaatgaaaaatttctcaaaaatttatctccaaaatttatttattttattttcttgacgataatttttgattttgaaaattatgtatatccttaatgacttggcaaaatatttttgctttttgatgaaaattttcgattttacacccctaaattcggaactttttggcacctattttcccatttttagcacctattttgggggttttttagaacctaaaacctacttattttggcagtttttagcacctaaaaatcgaagccctaatcatcagtttcttaggccataacttttttcttacttggtcaatccatacattcttggtatcgatcgaatgcttaaagtttagggaatttacaatacaattgcattaaaaaatagcaatgaaaaaaaaactcaacattcatcatttttcatgtatattcaagaataattactgatcggacgcttaaagggaaatagagccaatttttctatgctaaaaactaaaataattttactttttttaggattttgccaaaaaatg

SEQ ID NO: 110954 - DNA, 308 bp, Heterodera glycines
  Promoter: Source sequence=SeqID_4268; Location=976..1283; Strand=+; Gene=SeqID_53831
agagaaacaaaaaacggaaaacccaagtttaagcgggtcaaacaacattctgaatttaaacacatttttccaataaaaagttatccaaatagaaaaaagctctgctttaaggtgtcgtggtggtttctcacacaatgtttggagatttgttcacgacgtcggtgttgtatccggccaccacttcgatcaaggtttttttaaacaattgaatagtgtctgcacctttttgggacgtcttcccggatttacacaagggataaaattaagaaaatttggtgtgattcgttaacacattttattcaaaaatg

SEQ ID NO: 110955 - DNA, 696 bp, Heterodera glycines
  Promoter: Source sequence=SeqID_25353; Location=1179..1874; Strand=-; Gene=SeqID_56102
aaaaatttatcgtgctttcaatcccggcgggatccccgcggggattggtaaaatggtagggagggatctcggttccgggatcccgatgaaatcccgatccgatcaatcccgatgaattaaaaaagcgctcgggacggatcccgaggtcgggatcccgaatttaatcccgcgggatcccgaagaaatcccgcgggatcccgatcccgtccggtctctagtaggaaagctgttctgtttggcctatcaccgccaaatgatcttttcacatcgaaagatattatcgtgcaataatgtgtaaaataagggcaaaacgtcaaaatgggggcaaacatttttagaggcgaaaattcaaaaatatggaatttttatggtcaaacataagggatttctagcggcatacaggagcgtcgtgcttttctcaatgaattaaagccgcaggaaaaataataaaaagcctaaaaatccgtccccttttgatcacgaatttaacattcaaattggagttttaaaattatcttttttcagcttctgccagctcacaaactcattttgaagcacgcttccaacgtttttgggccgatgttttgttttgacccaaaggaaccaaaaaaagaaaatggtccgaaaatgatggaataaaaatttaaataatattttaatatattttttaatttagcctcttctaattgccccatg

SEQ ID NO: 110956 - DNA, 820 bp, Heterodera glycines
  Promoter: Source sequence=SeqID_9449; Location=3662..4481; Strand=+; Gene=SeqID_71464
attgactgtgatattagagaaagtgttttaaaacacaaaaagtatgtaacaggacaaaacccagccgggaataaaattcaaaaaattttcaaaataggaaattttacaacaaaaaaaatcttaaaaatattcttggaaaattctaagaaaaaaaaattaaaaaaatttccagcgattttttcaaaatttaatggtgaattactaagttttttttcagaaaaattttaaaaaatcgctgggaattttttgaaaatttttttcctttctaagattttttcttgaaaaatttctgtttgaattcccggctgtgttatgtcgggggctgtgctttggggtgcactgcaaaaaaggaccaataaaaaacggtaaattccctcctgagtcgtgtgaccagcaacatggacttccctttacgaagggaactttgccaattatgagtacccaaatcagtttttaatcatgccaattctgtagagcaccatcaattcattattatttaattttggcttttttggccctttaaaaataataataaaaaaaacaaaattaaataaaaagaaattaaaaatgttaagaacattttttcgaatattaatgtaacaaatgataattaattattatggggctgaaataagaagaaagagctcaaaatagcttttcagcatatgcaattttaaattttttgcgcattaaatttttttctgtccaaattttttttaatgttgatttttttttcttcaaattttcccttgaagattcagtaaaaatctagaattttttttaaactgtatttcttttagaaattcattaaatttttatg

SEQ ID NO: 110957 - DNA, 291 bp, Heterodera glycines
  Promoter: Source sequence=SeqID_3274; Location=1697..1987; Strand=-; Gene=SeqID_84020
aatatttgtcgtaacatttttaatatttaaaaaaaaatagttgtgtgaccgattatccgattggacatccaactctccacgtgctctgcgaggaagttgattggcgccgacccgaggacaacccatacccgctcgccattctaaaagtgttcgtcattccaccgcgacaaatcgacatccccgttttgccggtcaaagttgacgatcggctttgttttccactttgcatcaaatgttgcaaaaaatttccgaatggtgccgtcaaatcatcatacagttgtactcacgatg

SEQ ID NO: 110958 - DNA, 330 bp, Heterodera glycines
  Promoter: Source sequence=SeqID_31085; Location=78..407; Strand=+; Gene=SeqID_61457
tgtaagccgggagaagggatgcaactgatcagatggaagggcggcatatatcaaaaggattgctcataaaatgtaagaggggcgagcgatcaaattgatcagatgaaggggctctgcatataccaaactagttaagggtaattatgatgagacaaacaaattccatgctgataaaatgatcagaatacttttctgatcccgaagaaatgggataaaattagataatatcgtcatgatccgttgggtaaaaggttgatcacaagaaattaaaatcgaaaataatgcccccattttaaatccaagtattgcaggggcatcgaaggcgcaatg

SEQ ID NO: 110959 - DNA, 59 bp, Heterodera glycines
  Promoter: Source sequence=SeqID_38573; Location=800..858; Strand=-; Gene=SeqID_67350
tttttgtttaagtttaaacttatttcgatttgttccagagcaaacaacaggcgacaatg

SEQ ID NO: 110960 - DNA, 60 bp, Heterodera glycines
  Promoter: Source sequence=SeqID_41614; Location=1..60; Strand=+; Gene= SeqID_69696
cattttcacattcatcttttgtgatcttgcataatttgtcgttaatgtttaggtgaaatg

SEQ ID NO: 110961 - DNA, 252 bp, Heterodera glycines
  Promoter: Source sequence=SeqID_4838; Location=1..252; Strand=+; Gene= SeqID_55901
agtccaactttcggcccaacgaagtgcaccggtgctgccggggttgaattctgttcaccgaccaatgcgcggccggaaagtgttccaacacgaccgttcagttgtgctgcattcagcggttcctccaggcacagttttagcaaaaatacacacagaaaaatcagtcaaattggccaccaaaacaaacggaaaacttccgatttttgccatccgccgaattggccaaactttgccacccctcaggcaaaaatg

SEQ ID NO: 110962 - DNA, 113 bp, Heterodera glycines
  Promoter: Source sequence=SeqID_22198; Location=1..113; Strand=+; Gene=SeqID_52862
tgggggcacaactgaaacgggcgaggggccgactgatgcctaaatgggccaactgatgtcagaaagaattccttacattcatccctaaattgccaaaaattatttcagaaatg

SEQ ID NO: 110963 - DNA, 643 bp, Heterodera glycines
  Promoter: Source sequence=SeqID_1299; Location=703..1345; Strand=-; Gene=SeqID_71999
tatgtaaaacatctcgatcaaaactttgttaataattttcccgcattttaatgattaattggttcttaattaaattacccaaaaattgatttaacaactgtaactaataattaaaattctttgattttttcatacttcagtagtaaaccatacgccacctctgcagcatgacactaattaaaagtgacagctgaccagtggaggggggctaattagctaattgattgacagctggtcaaagggaaaagtgacagatggggggaattaaaatcaaaacctatgggagggttttcgggtgactaattgggggggggtggtcaattaattaattaattatttgggtggggaaaaagccaaaacctatggggatattgctgacaaattggtaacacgaattaattgtttactgcatttcaacaatttgtttggctgaatttttgagcagggtcggggggacgcgggggtgaccaatcctaatcccatggatgggagggtgggtgattgacagttctgctaaagggtgtggaatttccggcaacgaaggattatgcaaatttgtgcgcggcactagtgctgttgtttggagctgccaaatatccattccgcaaaatattcttaattcagggggcgggctcaaaatatg

SEQ ID NO: 110964 - DNA, 176 bp, Heterodera glycines
  Promoter: Source sequence=SeqID_4577; Location=3936..4111; Strand=+; Gene=SeqID_54964
aaattagttttcgagttattagcagtttttagcaactataaatcgtagccctagtaataaagtcacagttattttaattttttgctaaatcatccgcagatgatagtccggggtatgcgctcagtgcgtggtattgcggtgggcacaacgatgaaacattttgtgccgaaacgatg

SEQ ID NO: 110965 - DNA, 170 bp, Heterodera glycines
  Promoter: Source sequence=SeqID_3691; Location=462..631; Strand=+; Gene=SeqID_45612
ggttactgatcagatatatcgcaaaaatcgccgagcccactgatcagtgatcactgatcccgtatatcacacaaagcaattaagcagaaaaaaggaaattttgtcaagaatttgtgtgcttgtgattgattgtgcctacaacaataatcatcatttcctaaaaattgatg

SEQ ID NO: 110966 - DNA, 340 bp, Heterodera glycines
  Promoter: Source sequence=SeqID_2658; Location=4235..4574; Strand=-; Gene=SeqID_80923
taatttgaaaaattcaaaattccgatttttattcgagttcgggttagggattagaaattagtcaaaatacatgtcagattcgtgattagcgacctttaaaaccccggataaaaaattatcatggttttttatcttaaaaaattttgcaaaacaaaagggtccccccttttgtttcaaaatgcacctctttgtaaatagcgccaatttatctacatccccatttcattttttttaatccatcaaagttttggcacttttttggcgtcctccatttaaataaacaaccacaatttgccctaatttttcaaaaatataacaaacatttttttgtcaaaaaatg

SEQ ID NO: 110967 - DNA, 422 bp, Heterodera glycines
  Promoter: Source sequence=SeqID_19481; Location=217..638; Strand=+; Gene=SeqID_84202
acggtcagtctccaggccccaaccccccccccacccccccaccattaaatttttaaattttttgtggaatttttttttcgtcaaaaaagtaatgacgaatggttggcctatagagaatttcaaaaatatacatttaaaaaacatttaaaaaaatatacatttaaaaaaacaatgacaacgaacgattttttgggcgattttatttgaagggacaaattaaaaaaaagagaaatttgactgaaaacaaattcgatttgagaggattacttttaaaaatgttttgaccaatttttccaaccaaacagaaattgagtgttgcgagtccatcaaatggtactggctgaaccgtcccgtgttggacccggagatggacgactgtactgctccgcgtcgctgaacggggcacatcggcgggcacgatg

SEQ ID NO: 110968 - DNA, 203 bp, Heterodera glycines
  Promoter: Source sequence=SeqID_12298; Location=2039..2241; Strand=-; Gene=SeqID_75888
caaaaactaaaatgaatttttgtacttttttttgtttgttgaaaattttccccacccgctaataacgcgcagaagaatcttaattaatgagttttaattaatgaatttaaaacttcttagtggaccaatttcgtctcctgtggctttaccatttgtttttggcttatctccggcccatgttgtgtttctcctattttgccatg

SEQ ID NO: 110969 - DNA, 98 bp, Heterodera glycines
  Promoter: Source sequence=SeqID_1560; Location=1664..1761; Strand=+; Gene=SeqID_46929
ggtttttattaatttaaagcaccaaatataacccttaccttttctctaaaaaggcatctcgacagttaattacgccacaggccaacaagccagtgatg

SEQ ID NO: 110970 - DNA, 523 bp, Heterodera glycines
  Promoter: Source sequence=SeqID_25500; Location=324..846; Strand=+; Gene=SeqID_56245
tcttaatgtctctgtctacgcaggcagcggcgggtggtaggggcagacaaaggaaaagtaaaagaaatacgataaaagaaatgaaaaggagagacaataaaatttgtctcgcattccttccttatttatatcccatcttttattatttaaaatatttaataaaagaaagaggaaaggaatgcccattgaatccgctttggccataacaaaagagaaatctctaaattttaaatttaatatatggatgagttgggtgtatagatgagttgggtatggatgagttgggtgtatggatcagttgggtttggatgagttgggtgtatggatgagttgggtatggatgagttgggtttgactcccgagcggttcccgtgcgggggatcgattaagcgggtggtgcaaatatacccaaaaagaccagggaaatatccagaaaagcccataaattataacacgattgtctccattgagaaaaagagtactttaactagctaataaatgaaacactttagggtaagggatg

SEQ ID NO: 110971 - DNA, 211 bp, Heterodera glycines
  Promoter: Source sequence=SeqID_29498; Location=813..1023; Strand=-; Gene=SeqID_59990
tttcagaaaaacgcatagctgcgattctgaataaataacgcattgttgcgctttttcttcgagttgaatttgtgtcccacaaataacgcattgttgcgataagtgtggacatcgacaaatcaccgacaaatcgggccgtttttcgaggatcgccgtttaactttgtttttgttttgttgagtagtacctctgcggtagctcaaacaaaatg

SEQ ID NO: 110972 - DNA, 370 bp, Heterodera glycines
  Promoter: Source sequence=SeqID_785; Location=6807..7176; Strand=-; Gene=SeqID_61214
tgtttttcgtgcgtttcaggcctcccacagtccaggaaaaaaatatggatttccatgtaattctattccctaataattagacgacattttcgttgcttttgcccgcttcttctttttctttcgctggtggcgacaatggcctaaaattaagatattttaaatatgatcaaagtgttattctataaattaattcacctaatttttcaggactttttttcgtgactttttggcgatttttagtgccttaaattcccagccttatgcatcattgattgatttgtactttgctttctcattttaactgtctctttttaagttacataacaacagattttaaagggaaaagtgtgctaattgagcctccaaaatg

SEQ ID NO: 110973 - DNA, 279 bp, Heterodera glycines
  Promoter: Source sequence=SeqID_13265; Location=1750..2028; Strand=+; Gene=SeqID_77101
tctccgagtagcagtacagaatttttgcaggcggcgggtctattagttccctgtaatttctcaacaatttcatcaaccattgcgttttgccactaccagtggcccccgacaaaattagagtgaatggcgcaataaacatttttatgcatacgttaatgcatcttcctctttatttatatagagatgttgacacccaatttgaccccattttatccccacttcgacttaatcatataattaaattgttcttctacttttagcaaggaacaataatcaatg

SEQ ID NO: 110974 - DNA, 201 bp, Heterodera glycines
  Promoter: Source sequence=SeqID_8836; Location=277..477; Strand=+; Gene=SeqID_69368
ttacataacaaataatcactcgccactcattcataataaatgaaaagcaacgggctgaaaaaagccaatgttagcatattattcaggcattatcgatttgtttattacgtcaataaaatgagaaaaaattgagcaatattaatataaaaaaacaatattatagaatatttcaaacaaatatttccattttatgtaaaaatg

SEQ ID NO: 110975 - DNA, 54 bp, Heterodera glycines
  Promoter: Source sequence=SeqID_41757; Location=975..1028; Strand=-; Gene=SeqID_69818
tgtgaaacatcgttttttaatttccgtaaattttcatttttcagcttttccatg

SEQ ID NO: 110976 - DNA, 132 bp, Heterodera glycines
  Promoter: Source sequence=SeqID_16011; Location=1374..1505; Strand=-; Gene=SeqID_80364
agtgaatattttaagctttttttaatgaaaatataatttaattttccttttttcagtttcatttcggctgctgaaaattacggcgaaggttcgcgcgacagaccggacttttcgggcgaaattctgaaaatg

SEQ ID NO: 110977 - DNA, 99 bp, Heterodera glycines
  Promoter: Source sequence=SeqID_35744; Location=419..517; Strand=-; Gene=SeqID_65226
tttcaaccacgagtttgtgtatcaggtgccaaccctaaatgaatggtaagaaattaggcgactcatttaaaggccggtattcttgcccttgaacaaatg

SEQ ID NO: 110978 - DNA, 752 bp, Heterodera glycines
  Promoter: Source sequence=SeqID_16978; Location=306..1057; Strand=-; Gene=SeqID_81403
tttgcgcaaattattttatttaaaatgaatatttaattatttaactaaaattaaaatatcagtaagaagaaatgccaaatttccaggcagaaaatcccgccgaagtttggcaaaaatgatcgacttaattgtcttttggatttgacgttgattttgtaagattaggacgttgcagataaggacaaatcggctctactgcaggttatgcgcccaatcgacttttacgcgtccagtcgatgaacatataggcaataactttttccaccttagacacagggacaaaaaattggagaccggaattttgaaaaagtacaggaacagggcaagatttggaaatcacgctggatagtaaatcagcggatttgttgggttcctgtttttgcaaacttctcctcaaaatataggcaggttcaggaccagggttcctgtaaaaagttctttgttcctgtcgggtctctacaaaacaattttattttcttgtatttaaacaaacattttgccaaaaaaaaaattcaaaaaatacgaacaaaaactttcgctttcatttttccctcgcggtgtaacattcgttgtattaggtattattttgcgttgttttgtggataaaagaggatacataggatgatttcaatatttcgaaatctttttctttttctcttaagaattttacccaatttcgccttaatttttttaaattttctaggcttgcttactcttcaacaatttgaaatttttgcatatttttgattatg

SEQ ID NO: 110979 - DNA, 1003 bp, Heterodera glycines
  Promoter: Source sequence=SeqID_7584; Location=3555..4557; Strand=-; Gene=SeqID_65310
gcgccttcttttcactttaccttacaaattagcaaaacaatgtcaatgatgtgattggttggcttttcttcttttctctgtccccctttcgtctctcatatccccatactatttctccccctcttcgaccttttctttcccattctctcctctgtctgtcctccatttctccgcactatttccccaccccctttatctctctcatcctcactttttgccatttactctcgtcactgaccactcattaattaaatttggactcatcttcttcaaagttggcattgtcactcacttcctttttttgtttcttatgtcactaaaatgccgtgccaatgaatgaatgaataatgcccttctccgtcatccaaaataacaaaacctttttcttcctccgcctggtgcgtctgctccttttcttttttcattttccgtcgcaatttctttcctttccctgccaatttcccccgccttcccgcgctgccctcgggggacatgttaatcttaattcgattcaccccccccatttacccattcattgaattggtccccaaataatgagtcggtcggtcgtccctttttttgtttgtccctttcaaaacgaaagaaaatattgccaatttccatcaaaatgtttgtaaaaatgcaataatattgttgtaaaatgtgttgttgcaattgccccgacactttgccattccttcgcccatttttcgcacattttaaattaaaaccgaaataaaacaaacgaaaaaaagggagtgaatgagcaaatgccaaagggaagtgtgcaacaaaacattaatatgtattgaacacaaacgaagaattattgtgaaatttttgcttttacagtaacattaccgtactcacttcgctgcagtttcattactgtaatcccaaccgaacggccattcgccgcttttcatttcctcctcaaattaatgtgcaaaaccttcaacactgcttctgctgctgctaatgagacatatctgctgaaaagatg

SEQ ID NO: 110980 - DNA, 775 bp, Heterodera glycines
  Promoter: Source sequence=SeqID_3781; Location=3792..4566; Strand=+; Gene=SeqID_51855
ataaaaataataaaaaaaatttctgaatattttatgtagtcatcatattgctaaattatatgatattcaccaaataaattgtaggatagattaacaaaaactgaatggtacgcatgtggcaggattcgaacctgtgcaggaaatatccctttgcgacctaaacgcaacgccttaaccactcggccacacatgcggtaaaagtaatcgaaccattgtgttaaaaacaatgcaatcagataaaaatcgcatttttgcacattctaagagtccgttagttgcttttggctttgccattttttggtcaacaaagattgaacatttatgaaaagtttggactcaaaattctgttgatatcacgtcgttatagaatattgaaacagagttaattttattagtgatcaaatttaaatatgtcttaattattttttacggatcgaaaataaatttatatatttatgaattgaaaattctaatgcgtaaatatgtaaatttaaaaaataaataaaattatttcaaaaaaacatattgatgaagaaatagcaaaaatgttgaaatcacaggaaggaaatgaacataaataaggaatatacaaatcaatggaaaaatggttggcattggcatcatttccgggcaaaaaattttggaaaaacatttccaatttcaatgaaaataaacgatttttggaggaatataaaagccaaaagaaagccatgagaaaatcataattattttttaatttttattaattattgccttttccaaatcctttaaaatg

SEQ ID NO: 110981 - DNA, 391 bp, Heterodera glycines
  Promoter: Source sequence=SeqID_2172; Location=2154..2544; Strand=-; Gene=SeqID_78263
tcgctcgggaacgaagtgaccgaaggggagccaaagccccgagaatcgaagcgggggacaatcccccgcagagcagcagcaaacaaggacgggagccagttcccggcggttgacgcagttcgcggccggaagtccaactcttctcccgaacctcaaccgggagcgccggcagctcttcaaaaagtcggtggtgccgttacagcaacaacagccaaccccatcttgtttgtcctccccaccccctccccagttcactcccttgggcacggacccgacggcagcagcaaattcggcaatttgagtgaattgggcccgagggacgggagagaaactcccgcgcacagaccccctagccgtcagcgccggccgagtgagtgcccttgaggcaatg

SEQ ID NO: 110982 - DNA, 188 bp, Heterodera glycines
  Promoter: Source sequence=SeqID_22011; Location=743..930; Strand=-; Gene=SeqID_52645
tgggggaggaagaggaggaaacgcccagggcaaagggaggggggcaatggggggaacaacgccggaggggcggagggacccaacggcggcgcaaagggcgacgacgacacccgccggcggagaagggtgggaacggcacgaaaggtgcgcgagagtgacgcgaccaaggcacactcaccgactctatg

SEQ ID NO: 110983 - DNA, 320 bp, Heterodera glycines
  Promoter: Source sequence=SeqID_16646; Location=723..1042; Strand=-; Gene=SeqID_81060
tctgttttcctccaccacaactgcgggaacaactggcaaaaaatgacaaatcaaacacattttaattttgatttttatttgtttttaattataattttattgcatttttttactgtgtccattccgtccattctgtccacagattgttgttcttttcgcgatcggttgattcgccttaaatttgtacaaaaaatttgatttttaatcgatgaatttcctaaaaaatgccctgttataaattgccaaaattttcaacaacaaaaaaaatggcatccaatttgaatactgtaatttaatcaacgcgggttaccgtaccaatg

SEQ ID NO: 110984 - DNA, 59 bp, Heterodera glycines
  Promoter: Source sequence=SeqID_27255; Location=282..340; Strand=+; Gene=SeqID_57944
ttttgctttgttttgttttcttaaacattatttgcttgtccatcctcaggtggtcaatg

SEQ ID NO: 110985 - DNA, 154 bp, Heterodera glycines
  misc_feature (22)..(22): n is a, c, g, or t
  misc_feature (91)..(91): n is a, c, g, or t
  Promoter: Source sequence=SeqID_29641; Location=671..824; Strand=-; Gene=SeqID_60120
gatccgattcataagcctaganaattccaattttttactttttatttctatcaatataaatcaaaatgcatggaattcaaaatttgcaganagtgtggcattctatcgcgacccgttcaataagcctgagcatgagcacacactccgcggcatg

SEQ ID NO: 110986 - DNA, 504 bp, Heterodera glycines
  Promoter: Source sequence=SeqID_1494; Location=4047..4550; Strand=+; Gene=SeqID_46897
aaacaattttaaatttttggcatttattcaaattcacttcggatgccatcctgtggtttttgctgacaagttttggcaatttttgtggatcaacgtggcggattccgttgaccatttatggaattcatgaagatttaggccagggattcgattttcggtttctctttgcctcgaaaattttgtttttgtttttttgaaacccgtccattaaggtttttcttggcaaattgaagccgtatttttttttaccgatttcagcgcggttttaagccaaacgcataattttgtgtaaatgcaagagaatttttgggttgcctcaattaaaattggggacctcgtaaattgttgaacttggtttttctaattttatcaaaaatttactgtgcccatatttcggtttattgcttttccactcataaaaatgccataatttgcgcagtgacaaagccgagtcggttcagcctgcgcaaagtgttgcggcacggcattcgcattgcccaaatg

SEQ ID NO: 110987 - DNA, 114 bp, Heterodera glycines
  misc_feature (63)..(63): n is a, c, g, or t
  Promoter: Source sequence=SeqID_39307; Location=1..114; Strand=+; Gene=SeqID_67901
cggtactttcatattcctgtctctactgaataccactctacctggattgtttataccaatagnttttcaataataccactttaaaactgattcaccataaattttaagcaaatg

SEQ ID NO: 110988 - DNA, 1003 bp, Heterodera glycines
  Promoter: Source sequence=SeqID_9979; Location=1118..2120; Strand=+; Gene=SeqID_73021
agtgccactgtggtcgtttcgtaaaagtgccaagtcgtttcgtaaaagtgccaacttgggaatgtttcgtaaaggtgccactgtggtcgtttcgtaaaagtgccaactattttattcgattttgataacatataaaatgaatatataaaatatataatttatcaatggcaatttttattttttatctgtgcaaatacgtgtcatccgagacttatacatagatgttagcgagaattttttattttttacaaaaacgctatgattgtgataaaaaatttgcaattgcttatatgaaaacgttgattgtttgctaacaaaagtttgttttgtttatttttaatgagattcttatgtttagaatttgttatgctggtcagtccatattttggagaacgttttaaagaacattgaaaaataacggattttatttgattacagttttcaatattcatagtttactaattatataatatgtataacacaaacataaatttttgaattcataactctatactcaaccatatttttataatggttcttttacgaaacgaccacagtggcacttcacttttacgaaaatcccaaggtggcatttttacgaaacgacttggcaccgatcaaaatcacaacacctgctgttgtgttgttattttgttttgttgctgacaaaagacgtcgttgagaagcaatgcgacgatgagaaaaatgaacaacagaaaattattattgtttgaagccatggcaaaaaaaaaggagaggaaaactctgacaaatttgaaaaaattgtgaataataaatgcgaaaatttgagatacctattttctatataaaattttttagtgctaagtaaagaccttaaaaggtttctttgctacagaatacttacctattacatagaatggcattcgcgtcaaacgacccgttcctttttatacccgacaaacgccgattccgacttttttcccaccccgaattgctacgctaatattttagtataaaaatg

SEQ ID NO: 110989 - DNA, 55 bp, Heterodera glycines
  Promoter: Source sequence=SeqID_45005; Location=789..843; Strand=+; Gene=SeqID_72398
tcttttggcccaccagttcccccgaaaatggtttatcgtcggaatcggcacaatg

SEQ ID NO: 110990 - DNA, 620 bp, Heterodera glycines
  Promoter: Source sequence=SeqID_26667; Location=1100..1719; Strand=-; Gene=SeqID_57421
tttggggtttggtttcagaaaattttttattgctacatatttaaaaaaaaattggcaaatatttattttctcaaaaattgcaaattctcaaaataaaaataaaataatattagcaaattctcaactttcgcatggctatcatcgtttggccaggtggaatgacaactcagacaaaaagcaaagctataataggcaactcgtagacaaaaacaaaaaaaactttagagtttcaaataaaatctcgaattctcaaaaagcaaaaaattaaaatgaatttttttgttagaaaaacgaaaaattctttaatttttgttttttaaataaacttcagaaatatcaaaaatatatttcaataatgagaaaaaaattcattttctagcgaaaaaaattctgattggaaatttgcaaagttttcggtgcacgaattggccaatttactcgcttaacccaaggaaagggaaatgcgcaaatggatactgtatttttaattggtacagtagggccgtaaaattgtttatcggcccaactttgcacttttcgtaaacattcacgcggaaaaacatgaactaatgaagcatttaatgattagggttataagttgtgaaatgaagcatataatg

SEQ ID NO: 110991 - DNA, 90 bp, Heterodera glycines
  Promoter: Source sequence=SeqID_32367; Location=1..90; Strand=+; Gene= SeqID_62683
agaagttacatcagaaatttttgcaggtacaggattcataagacgaaggtaactgattgaaaggtatatttttgtcatttcagaacaatg

SEQ ID NO: 110992 - DNA, 706 bp, Heterodera glycines
  Promoter: Source sequence=SeqID_13831; Location=413..1118; Strand=+; Gene=SeqID_77771
ttgaaaagtgagttcaaaacttcagagcattcttcgtatcacttaatagtcctaaagattctctatccaaaagttacaaaaaatctgattcaagtttgtcatcgtagttttgcaaggtgctaggtcgttccacaaaaaagctcagtgtgggcgttgcacgaaaaactcacagtaatcgataaaattaaacaaataaatttaattattcaattcacaaaacacggtgccgtccggttaaacttgtttcatcaaaacacaaaagactaaaggaactctgatattctttgccacacatcgacccatttttgggctaattagaattgttcaagggggggggggtggcacccaagaaaagcaaaatcctctaaacataatgaccacttagttccttgcctaactcttttcttaattgccaaaacataatttttggtaccaaacgagtgttaaagtctcgaaaatttgtaaatgtaagaaaagagatacggtgagaaaaggcaaaattccgttttgtcccgagtatatttagaaataatggtactttggctttatttgccacaaatttcaaattaattaatttattttttataacttttttgtttacaagcaaaaatagttgaatacagttttgtttaaatttcacaagccaaagtagtgttaaaaatttcattccggtttctttttgaaaaaattccatattttagacatg

SEQ ID NO: 110993 - DNA, 128 bp, Heterodera glycines
  Promoter: Source sequence=SeqID_35511; Location=1..128; Strand=+; Gene=SeqID_65052
taattcactaattacccccccccccccttatgacgacccttcctgttcgcgtgttgtccatcaaacgggccgagtacagtccgctcaatgcccacttggactctcaacgcatcggcagcttcgaaatg

SEQ ID NO: 110994 - DNA, 265 bp, Heterodera glycines
  Promoter: Source sequence=SeqID_1929; Location=3907..4171; Strand=-; Gene=SeqID_76842
aaaggtgtatcatgttttgattacctacgaaaataaaaaaagtgggtaataaaactattcagaaatgatgatatagccggggcgttaagtactctccaccgacacggatagtcttgttttctcacatctacgcgatgctttttagctgaataagatcgacactataagcagttaattgatggaaatcgaagaattctgcactgctggtgcaaaatagtatgcgttggctttaagacgtataaatgttctacatgatgcggaaatg

SEQ ID NO: 110995 - DNA, 336 bp, Heterodera glycines
  Promoter: Source sequence=SeqID_40274; Location=1096..1431; Strand=-; Gene=SeqID_68668
tgcgtttttttcgcaatttttttttaaatttaatgcctcagcggatgggacacagactccgattcaggaattcttcaaattctttttcgaccggaattccaaaatttatgtggtcggaatttccggtttccagagaaaaaattttctgcccctgggttgagcggattttttttatggcttttttggaggggataataaaaaaatttgtttgaattttaaaccaaaattttttttcccaaaaaattattttctaacattaaaaatcagttacaattagcctatcgtattattatttctgctcgcttcaattgtgccaggatttggctgtcaactatg

SEQ ID NO: 110996 - DNA, 65 bp, Heterodera glycines
  Promoter: Source sequence=SeqID_14556; Location=1..65; Strand=+; Gene= SeqID_78622
tgcggcttgcttacgcagacgaggcagaggcggtacacggcgctggcgacgaggcgggcgcaatg

SEQ ID NO: 110997 - DNA, 439 bp, Heterodera glycines
  Promoter: Source sequence=SeqID_18314; Location=1..439; Strand=+; Gene=SeqID_82908
gatttggttgacaagagaaatatattatagtaaaaacattaaatgggatagaactgtgcggggccgaactgaggtatagcagccccacccgtttgccggacggaaatggcattagctcaggcagtggcaccgacggcgccggatgcgtagcgggtgagaatacctcataaaaattagacatttagtcaaacgaccgtgtattatcctatttttaggacaaacttctatgtccattaaaattcattctcattttttaaaagaaatctttaaaaaaatacctttttcaattaaaaatatcaaaataaacatagaaaataataatatgttaaattttatgaaatcatttgcttattttatgaaaattggtaatgcaatgaaaaataataacaaagcgttaaaaattaatccaatttatttacactccactaattttaggatg

SEQ ID NO: 110998 - DNA, 412 bp, Heterodera glycines
  Promoter: Source sequence=SeqID_23276; Location=373..784; Strand=-; Gene=SeqID_53987
actgaaaagggagggagggaaaggacggcgtacacttgggaggggaaaagcagcgaaaattcggcgacaactcacgttgatgaacatctgcttacttggaggcaaacttaattgaagaggaaaaacgaataatctaagcgaaaattaaagccaaataattaaaaaataattagtgctgagatttcgatgcttacgattcaatgatgacggggtcaaaatgcaaatgaattctcaacggacggaagtcacggcttacggccaagtcgcggcgaaagaggcgccgttgtcgcgcacgccgagggcgacggaaaggcgcagggcgcggaggggaaaaagggaatggacggagcagaggcacaccgaaagtgagctgatcagggccagggacctgaagcgggatacagccaaaatg

SEQ ID NO: 110999 - DNA, 346 bp, Heterodera glycines
  Promoter: Source sequence=SeqID_478; Location=3525..3870; Strand=-; Gene=SeqID_53804
tttttttattgaagcattcatgacttttatgttttgtttccttgtatttaagtcgggtttgaaccaaaaatgtgaaactcggaaaatttgaaatttcgacttttggttcgaattcgggtccaggctgcggagttggtcgaaattgacgccatttcgcatcacttgccctccctctctttccttcatttgctgttggtgctgttacctctccattctctttcagcgcctttttgctgcaactcacctctctgtgctgctgttctgccgccaatccgctccgatcgccgctgctgcggtgtgtgactttttgtgttgtgttcgactcgactccgtccgtccgcaaatg

SEQ ID NO: 111000 - DNA, 305 bp, Heterodera glycines
  Promoter: Source sequence=SeqID_8315; Location=1465..1769; Strand=-; Gene=SeqID_67666
caggttcgaatcctgcggcttgcagtttattttttactttttttttaactatgcatatttttggttggaaaaagcatagaaaaaaataaaataaaattattttaaatttttttaaaatattaatcaaatcttcgatgacttaatcacccaaaataataaaaataaatttaaattttttttaaaatattaatccaatcttcgatgacattaatcacccacccaaaacaattattatttttttggttttcactattattcgccttagaaataaattttaaaaaattatcaaaaaagaaaattttatg

SEQ ID NO: 111001 - DNA, 521 bp, Heterodera glycines
  misc_feature (36)..(36): n is a, c, g, or t
  Promoter: Source sequence=SeqID_37302; Location=1..521; Strand=+; Gene=SeqID_66406
tagtaaaaaatattaatatattaaatatagagtatnaactagaaatggccgaagaaataattagctcgaatatttccaaaaaatgagtcaagagactgaaaatggaaacctccgcctaaaaaacgaaattttcaatctaaatatattcttaggtgggtcttttcttaatttattgtaatcacttaaaataattaatttttaaatttccatagagcattaattcattgttcgagagtctaagttgtcgggaatcgaggcaagattgaagtgtctcttttttatttttatgagttttattttcaatttttaaattttcctttcggtttcgtcaccatcgaaatttggttgaaatactgaaaaatttacaccgctaaaagcgatccattttagtataaaaattatttgataccaaaaatgatttgtagtttgagaccgaaactctcgagcagccctaatattaaaagcgactggacatttggaccaatggacatctggacggtggccattactatagtataatg

SEQ ID NO: 111002 - DNA, 1003 bp, Heterodera glycines
  misc_feature (112)..(112): n is a, c, g, or t
  Promoter: Source sequence=SeqID_5113; Location=1340..2342; Strand=+; Gene=SeqID_56959
cacatatagaaatttttaagaaaaactattattttttaaagttcatcaaaaattcaaacttttttcattaatcaaattgaaatcctttatttttctctgcttttacatctanaatttatttactagctctttcaattaaatcatttatgactcaaaagcccaataaaaatgctacaaaaaatgccaaaacattagttcgttttagaatcatccaagctaatcatcagctcattgataaattcatatcgaaatatttaaaaaggaaagtaattttaacatgaatataaatgttgagtataaatattaactcaaaaaatctcgccataaaaagttataattttcaaattaaaatcacaaaaataattttaaaaaatattccacgaatatataaaataatttaaaaactaaatatccaaagtaattttaatttattcactatttaaataagagaaactataaatatattattgtctaatgtcagcagaaaattactaataaaggcaacaaataaaaacttcaatttataaatgaaaaataagaaagtaactaaatggtaaatatttatcgaaattaattgagataaaattaatatttaggtaccataagaattgtctaattatgtatttgtaagagtttggtccaattttatatttatttactcaaattaaatatacaaaattaaataatttaaaaacatatatgaaaggttttaataaaaaagatttcaaaaaattataacaatgaattgattgaagaacttatgaataatttaatgaaggaaaattgcgctcaaaaactttactttaatagaaatttaatttaaaaaagaattaaagaatatatagatagtttcgctggttcgacaaatattttcaaataataaataataaatacaaaatcaagaattatctatataatcatatttaatgcattatataaggctaaatattcaggacaagataacgaatataaaatataactctaattttcgagaattgatatg

SEQ ID NO: 111003 - DNA, 686 bp, Heterodera glycines
  Promoter: Source sequence=SeqID_45148; Location=1..686; Strand=+; Gene=SeqID_72510
aaattatatagctatttttctcctcaaaaatcgccgaaatcgaccattaaaattgtctcttttctctatttttttaattgtttttgttcgttgtgcgctatttttatataaaagtttattttgccattttccctatgagatttaacaaatttataagcgctttgctggtggcgtagaagcattttcggcaactgtgaactttgcggtgctaaaccaaggccacctgccacctaacactaacaaatatgtgaaccccccaacaaacagccaaggggcggccgagacagggttcagtggtcgttactgtggacatgccaccattagaaatgaattacatataagtaaaataggttaaatggcaaaaataaaccaaaaaaaagaaataaaagcaattagacagacaacgaataaaataattataaaaatgaagaaaaacacagattttttttttttggtcgttttcgagagtgagaaatagggcgtcggaaatttttttgttttcgtttttgtgtttgttttcgtatttggttttttttctctcttcactatcggcagtaattatatggctgtaagtttttcgtaagtttggcattcgacaaaaaaaaaacgaagggtcaaaacgattcatttctaattgattcccattcccatctcagtgccgttgaccaacaaaaatagaggaaatg

SEQ ID NO: 111004 - DNA, 105 bp, Heterodera glycines
  Promoter: Source sequence=SeqID_6769; Location=1..105; Strand=+; Gene= SeqID_62835
tatccattaattaagcctaagggcgacgatggatacaaatttggcattccatatgccaaacccgcacaaaaaaagaggagaagtgatcaatgtgtcgagcaaatg

SEQ ID NO: 111005 - DNA, 198 bp, Heterodera glycines
  Promoter: Source sequence=SeqID_27808; Location=1..198; Strand=+; Gene=SeqID_58473
attaccccgtgaatgcgtgataaaattattgcttgtagcaaatcacattaattcacgcttattattagaacaataaaaaattttattttttggaaaaagtaggtccaaaataaggccggattcgtgctcagcatccgaaaataaccccagaaaaattttccgattaagtttattttagagttactaaactccaaaatg

SEQ ID NO: 111006 - DNA, 189 bp, Heterodera glycines
  Promoter: Source sequence=SeqID_5647; Location=4604..4792; Strand=+; Gene=SeqID_58764
aactaattgtggtaaaaaccaagaaattattaattttttgatcaaaaaaagattttagcgttgaccatactcttttagacagttttggcacactttgggaaaattttataaaaattttgtgaaatttgggtgtggcctagtctcagagagggtatgaataagtaaaacctgtaatgttgatagaaaatg

SEQ ID NO: 111007 - DNA, 392 bp, Heterodera glycines
  Promoter: Source sequence=SeqID_22822; Location=2414..2805; Strand=-; Gene=SeqID_53532
actcgaaatttttaaaattaattgggaggtaaatgaaattcgctctaggtgacaaaacgtgcaaaaaaatgagaaaattaaaaataaataaagaccgaaaaatatgaaacccacgagaaaaaatgacagattttgcagcacaaaaagacatttaaataagggtggattccattcccggccccgccatttccccacgaaatttaaatttctaagttttataaaaaaaaatttatgaaaatttcaaaataatttttttgaaaaaaacgtgttgttagaattcattaaattttggaaagatcgccagaaaattttgcaattactatattttttctttaaattttcttataaaaaaattcgaagattttttataattttagaacggaagagatatg

SEQ ID NO: 111008 - DNA, 386 bp, Heterodera glycines
  Promoter: Source sequence=SeqID_4573; Location=1..386; Strand=+; Gene= SeqID_54938
tatggaaaatattgatatagaaatccttcctagaagctttaaaccaagctaaaaacatgtttttcgtgcgtttcaggcctccaatagtccaggaaaaaaatatggatttccatataattaccagccctactcattttactaaaatttgaccagaaaatggcaaaaaatttggtatttttttggcaaaaacgaatacaaatccctgcttttcctccgtgcgctgaaaattttagaacggaaccttggattaatcaacttttgtgggttcaactcacctccttttctttcccaaccaaaaagtgaacgtccgccccatcgcccgtgctcaacatcagcttaaaccgacccagcaaattgctcgacattgaaatttttaagaaaaaatg

SEQ ID NO: 111009 - DNA, 119 bp, Heterodera glycines
  Promoter: Source sequence=SeqID_18501; Location=1376..1494; Strand=-; Gene=SeqID_83122
attcgcaagcatttctctaaaatactgggttcagtagtccgataaatactggcagaaaccggccctgttccgctctttctaattgcctgccgaaacagaaaatttgcaaacaaaagatg

SEQ ID NO: 111010 - DNA, 217 bp, Heterodera glycines
  Promoter: Source sequence=SeqID_5437; Location=3185..3401; Strand=-; Gene=SeqID_58034
taacggaagcggcaacacttcttaaatataatttatttaattattatattttgtttattaattgttcaaattgcctctattttaaaaaaatgtctttggatagacagagcataattttattagttttattaaacaaattcaaacatccttttaatggccaattattgaagataacagaataatctaattatttttagttaatttatccattgaaatg

SEQ ID NO: 111011 - DNA, 1003 bp, Heterodera glycines
  Promoter: Source sequence=SeqID_13947; Location=1204..2206; Strand=+; Gene=SeqID_77908
gtgagctgcttgcgcggattggatacaggtggaaaaactaattttttaggcccgataccccaactcggtattttcccaaattgtgttaagaaaagaaaaacaatcacaatttaaaattagaataaaaaaaagtcgaaattaataagaaattgaaaatttaaaaaatactcccgaagttttctaggataaaatagcaaaaaaaaaaacaaaaaaaaaattgaacacatttttgggaaccaaatgacactaataaatttccaatacccatttggggggtggtcctatatgaaattttctgcatttttgtattaaatgataaacccaaattagttttattggttgacaaagttttctggatatttttattaggcaattaattttcttactacacagctcaatttgttcaatacaattgaatgaagtgaaaaatgcttaaaatatttgttgcctgttcggatgaatccattcataatgagagatataatttggcgaaagggcataaattaaccaaaaaataagtaaaaagctatttccttttgaaaatactgatcattaacgtaactgctctcactgacaaaatttcccagagagccataaaatgcttcatcggcataattacccattgccattgccaactctatcccttttatcatttcgttttgttccatatgctaatacatatttccttgatttaaaaaaaatatttagcaatttgctttaaatttgaaatatttcagaaataatactttaataattactatttaaccgagttcgaactccatctttactcaccggctcatcactcaagttagtgttcggtaaagtgcttcaatgacaattataattaaaattagcacaaagttattattaattaaagcaaaaacaaatatttaattttggagccaaagctcgtttattccctatgaactacacataattttttaaataagaaaatgataaaagtaattaaatttaaacactttcagaattctctgttgaaatg

SEQ ID NO: 111012 - DNA, 273 bp, Heterodera glycines
  Promoter: Source sequence=SeqID_28775; Location=373..645; Strand=-; Gene=SeqID_59348
aacgaattggcaaagcaaccgaaaacggacaatgatttaaaaatgacaaccgaaaaacagaattgttgggtaagtaattgcaactttatttagctcaaaagagcaagcatcctgttcaaatatgtttaccgtgcatttcatttatttttaaataaaattataacgtttttttaatttaaatacttttacattgttgatggcttgccatttgatattttaaaccttttttctttttaacttgcaacgtttaaaaatgtcctgacttcaaaaatg

SEQ ID NO: 111013 - DNA, 1003 bp, Heterodera glycines
  Promoter: Source sequence=SeqID_7036; Location=2966..3968; Strand=-; Gene=SeqID_63649
aaaaaccatcaaatggaaaatttttgaaaaaaaattattgttaaattgattaaatgaaccaaattttaaaatattaatatcacccaagtgttttctatagggttcggaaccccgcccccgtcacccccgcccccgccgggggcgggacaggttttttgggcctcacccccgtcctcgccttcttgtaggagttcgacaccggttgagttttcatttgaatttatttatctgattaatgcaggatttctttatgttcttatttctaagaaatgttctgattttagggcgtattatcatccaaaagaatgaaatttctgaaaaatttggctaatttctaacaaaattcataaaaaaaaaatttcccccggcggcgcctatcggcaccaccggcccccaaaaaacctattttttcttaaaaaatagcataaatcaataaatttggtcattctttagacaaaatctgtgtaatttatgccaaaaggaattgaatcgaggcgatacatcgactaaaggaatgtggagccaacacatcactcataaaattaagcgttaacttccaaaaaagttatgactagggcataaaattatatgcacataaaatcgtaaaatatgcatcaaaaattgcaaaatatgcacataaaaagtgacaaatatgcagataaaattttccaaattgagtgcaaaattttccaaatctcttcaaatttgttaaattaagtataaaaatctcgaaaaatctaaatgtagtatgaataaacaatttaaaactaaaaatacaaaataaatgtaaaatttatttattttgaagaaattgtgaaaaaataatgaattttctattttctgactattttggcataaatttccaattttttaaaaagttacttttttattagaaaataccaaaaaatgatatttttgaaaaattttcggtcattagaggccaaaatggccgttttaatagaggattttgttgaaaaatgctcaaatatgcacataaaatatg

SEQ ID NO: 111014 - DNA, 194 bp, Heterodera glycines
  Promoter: Source sequence=SeqID_18416; Location=1474..1667; Strand=-; Gene=SeqID_83013
gcatcagcgtgccacagcgtggggaaagaaattcgaaatgactgaagtttcgcgcaatgtttcccaattgtttgctgattcacatcaaaagagggtagatatgtgttcgagctaatgtgtaagtagatttttcccaaatcaatttcccggcggcatacataaaattattaacatcggcgattcatgaagccatg

SEQ ID NO: 111015 - DNA, 54 bp, Heterodera glycines
  Promoter: Source sequence=SeqID_18198; Location=1083..1136; Strand=+; Gene=SeqID_82783
attcatgacccgaaaaaactgtgctttatgcaaaaattgaaaattaaaaaaatg

SEQ ID NO: 111016 - DNA, 326 bp, Heterodera glycines
  Promoter: Source sequence=SeqID_5246; Location=5203..5528; Strand=+; Gene=SeqID_57439
tgtttttggctataacttttttctttgccaaccaaatccaatgttgttggtatcattcaagagcccttcagatgctctattagcctgcaaaattctaaaaaaaaattgttaagtttaaaaaaagttcgagccaaaaaagttgaaaatttggttttaagaaggcgtcgaatacgaacgacaaaaacgtcgctgtgccaatgtttatgatttgttgtgccattcttttgaagtattgggaccgcctcaaaaaaccaccaaaacaacgaagccatcgcaaaattgaaaaagtgccggaaattgtcttaacaatttgccccgacgaaatg

SEQ ID NO: 111017 - DNA, 419 bp, Heterodera glycines
  misc_feature (6)..(7): n is a, c, g, or t
  Promoter: Source sequence=SeqID_20476; Location=1..419; Strand=+; Gene=SeqID_51014
ctgcannggtcattttgggcgggaagaaaaaagcgtaaagccgagaaaaatctttctggggagaaaaagcccatgaatatttaatgaggcaaaaaatgggtggttaagcagaaaaagaaaaaacgaaagtcctttcttctctctttagaaattattttattgaaattaatttaagaaaaaagaaattcgagaaaaaactctgaaaaataattagtaaattatttattcacaaattatttataaatgcattaatcattaattgatttccaattttgaaagttttctttttcaatattatttttttactttgttttttattgataattcatctttttcgatatgaaaatgcaaataaatggagaaataaatggcggaacaaagcaaaagttattggtatttatttgccctcacaaagaatg

SEQ ID NO: 111018 - DNA, 472 bp, Heterodera glycines
  Promoter: Source sequence=SeqID_5971; Location=376..847; Strand=+; Gene=SeqID_59874
ggtaaaaggaacgggaaattactgtagaatggctactgtaataaatatatacaaaattattcattcattgagattacggtaccataaaacttcgcgtatttttgaatcgtgaaaatttcaatatattttaaaatcatatggttaattaggtatgtagctcaaaaattttctaggaatcactgtaccattgcaattacggtacccataagtcatctgttttttaacaataattagccaatcaattaactaattaatcgtgtttttcagctatttttaatttaaaaaaacgccctaaaattttttgacgatattttacaatattttaacattttttctgttgtattcaagtgcatacatataattgttatttttctcagaccctcctataataattgcgacttttttaaaatttttattaattttaatactattttattatttaaattacattattttaattttaatttttatg

SEQ ID NO: 111019 - DNA, 945 bp, Heterodera glycines
  Promoter: Source sequence=SeqID_2741; Location=1149..2093; Strand=+; Gene=SeqID_81372
ttttggtcctaattaaaaaaatattttataagtaaaaattctgatcaaatttaaaaggtgaaataaaagaagtaaaaggtgccaaaatgtaacttatcacttgtaattgtttcattggattgcataagtcttctctaattatcactttttcgtccctttttcctccgtttccgtcgtaacttttgccatcctccgcttttcctccccctcccccccccttaggcttcgtcctttacttttcttcgtttttgcttataatcccttcgctctgaaaaataaacaatggacaaaaggcacaaaaagtgccgccaaagcccaccaaaacccaaatgttgttaacgcgcgtgtcattcgcctcccatttttggcgtgaccatttgtttctctcctttttattattcatttctccgccggtccctggcaaaattaaaatgcgaggaaaggcgtgcaaatggtccaaatgttcccataaaatccgtcctccccttttgttcgcatcccttcgcccgtccattcgtccgctgctgcactcttacgattagtgccaaacattccctctacacaatgctttatctcaaatccttatccccccttgagaccaaatgcgcagcatttgctggttgatctgccctaccaaattgacttttttttgtacttcactaatcagacaaacgaacaatatttatttaacagctgagaaaaatataattaaattcggcagattatccttttttccatttttagaataccgaaaagactatcccttagggttaaaggaactgaaaatccgaaagttttcttgactaagagataggttcttgagaagccttcccttttatggcacagtacccgagtatcaccaacgtttgtgtcaaggaactgtttgtcttggccattcgtccgttcgaatttcgcttcttcccattcccttggcctttgccaatg

SEQ ID NO: 111020 - DNA, 1003 bp, Heterodera glycines
  Promoter: Source sequence=SeqID_24053; Location=532..1534; Strand=+; Gene=SeqID_54747
aggcctaataatgagatacgtacataatttttaatcaaaaattctcgtcaagaaaataaataaatttttgagaaattttgcatttcttagtggtttatttttgaaaatgttagggtcgattctttggggtgtattttttagagctgagcgggaccgggaattttgacaaaaaccgggaccgggacttaccgggaccagaaaagtcgggaccgagacctcgattttcgcccgggaccgggaccgcgagaaaagccgggaccgggaccaaccgggacttttcccaagagaaaaattttttgaaaaaaatttgcaaaattctaaaaattttttgagaatttttttattgttttaatagattgaaatcttttaaattttttgtttttaaattactctttttgtggcgctgttttttcaaaaaacttttgtggaataaggggccggctgtgccgattggcgccgccgccgggaaagttttataatttttaatgcgaattgttaacagatttgaccacaaaaatgaccaaatatttggttaatttttgggtttttaggctgtttaaaaattaaagaaaaattaaagttggaatatttctttattaattaaatttaaattgaaatcatgtaaagataatatgaaattatatcccagtggggaattgaacccaagcgaaaaataatgaaagtcagaaggtttagccattacgccacataacgacataaacaaaactgggattcgtttttttcaaaaaccgggaccgggacctgaaaaaaccgggaattcccgccccggtcccgcgctcacaatcagctctagaatttttcgttcttattgcattttgttaataattttgggcaaaaacaatgtttaatttgagtgcttgaagaaagtcatgaagcgttgaagttggcagtttattttaaaatttttaatatttattatgtaaagttaaaaagagtaaatttaaaaattaaaaaaaatgaattttaggatggattgctaatg

SEQ ID NO: 111021 - DNA, 431 bp, Heterodera glycines
  Promoter: Source sequence=SeqID_6433; Location=2141..2571; Strand=+; Gene=SeqID_61558
aaaaatttaggcttaaaccttcgggtttcgaatttaagaggggaggtgttagagaaggaagtaattattgattaggtgtatgaccccacgccacttcgccatcttccccctccgattcccctcattcaattattattgtgcccaccaatttgacctcccaatttattctctgcatttatttattattttattttcttcggcaaataaacttatttaatttgttatcttcggacataacaaattttggcgcagtcagcaatcaactgcacatcaccggcaacaacaattccgagctttatctcgtgttgatattgctcgagagggaaaattagaaagctcgtgttgatttctaattttcgcagatcatcaaaaacttttctctccgtgtgagattaaagtctgccgtgtgcagttctcttcaattggccatg

SEQ ID NO: 111022 - DNA, 526 bp, Heterodera glycines
  Promoter: Source sequence=SeqID_3595; Location=3819..4344; Strand=-; Gene=SeqID_51013
ctttacgcctcgatttgaagcattttaactgtccgccgccggctcaatccttacaatattaaaaagtaatgaaagagcaaacgaaaacagacaaatttgaaaggccaaatttgggaatttggcaattggcccgaggggaaaggcactgaagaagcgaccctcggggcatttggacgggcaattgtgaattggatgaaatgggaggaaaggcaatgaatgcggcggaggaggaagcccttccttgcccaccaattaaaatgacaaaaccaaacggaaggaagggaaaaggggaaaagggagggggggaagggtaggggaaaggggagcatttgttggaacacgcaattggacaacgaaaaaaaccaacaaaagtttatttttctaacatttggtcaattgatacaaagtaaaaggagattcaatgtgctgacaacatttccttttccatttttttaaattcgtcattttctttttgttatttatttttttattttcatttccctcagatcattcgtttcccaaaatg

SEQ ID NO: 111023 - DNA, 250 bp, Heterodera glycines
  Promoter: Source sequence=SeqID_1392; Location=892..1141; Strand=-; Gene=SeqID_73235
atttgttattaaaatattcttgcttataaatttacaatttttttcaaaaatttttacctcaaaaaagtaccggttagtaccggttaccggtatcggtatcggttgaaaacctaagtaccggtaccggtctcgggttttccagtaccggctagtatcggtaccggttttcgtcaaaagtatcggtaccgtgctaccctaattttaactatttttttatgtacgcaaacccacccttccatattctcgcatg

SEQ ID NO: 111024 - DNA, 84 bp, Heterodera glycines
  misc_feature (23)..(24): n is a, c, g, or t
  misc_feature (77)..(77): n is a, c, g, or t
  Promoter: Source sequence=SeqID_28055; Location=970..1053; Strand=-; Gene=SeqID_58715
gcagttcatcaatcatttcttannatgttagtcctaaaaaaatctgatttggtttactcgaaattgtaaataagatntagcatg

SEQ ID NO: 111025 - DNA, 139 bp, Heterodera glycines
  Promoter: Source sequence=SeqID_8328; Location=2919..3057; Strand=-; Gene=SeqID_67707
ggtcacactaatcctttttggcggaatttgagtgattttcttcctgtttttaatgaaaaaaacaggaaaatgataatatttattaaattttattgcatggatttactagagtacaaactcatagattttcattagaatg

SEQ ID NO: 111026 - DNA, 117 bp, Heterodera glycines
  Promoter: Source sequence=SeqID_5841; Location=1946..2062; Strand=-; Gene=SeqID_59413
gaaatataattatatttaaaaacaaaataaataaataaataatagaatacaaatacaaaatgaagaataaaataataataattattatacaaaattgtttcttttttagaagatatg

SEQ ID NO: 111027 - DNA, 805 bp, Heterodera glycines
  Promoter: Source sequence=SeqID_9249; Location=303..1107; Strand=+; Gene=SeqID_70748
tatcaatttcacacgctcggagaagcgcttgttggggcggggggttaattgaggagagcgaacagctcaacaaacaatgaaattataatacaaaccgaaaaaaacggggacaaaatgcccgaattatccggaaaagccaaaggtatccgcaaatgtgaactttcgaattttataccaaagattaaatgtctaatgcttaattggatttaaatatatatggatatgaaataattagggaaagattttgtttttgctttgtcaatttgtagtttttctcgttttgacaataattatccaacagaacaagaaaatataaaactaattattattatttttatggcttaaccacaacaaaatgtttggttttttggtgggttggcacttccgccgccaacaccaaagcagcagcagttgtgaacgaattgcgagcggagagaagggagcgagcggatgcgatgtgttaatatttaatttgtgttaatcggcttagttccggaaaggccggcagctgtgagaaaatcgacaaattttcaaattccgtcgccggcggagtccaaaaaaaagcaacagcagccgttgccggggggccattaacttctcagggagagagagaggggggagggaggcaggggaaggcaagcgaaattacacggcccccccggggggtgttttgttttgccaggggaactaacagcgaaagtggggggggggggaatttgtaacatgcgaaatgatgaggaggagaagcattcattaacattagccaacattgggcaggcgaaaagccatcggacgaatgaaaatg

SEQ ID NO: 111028 - DNA, 619 bp, Heterodera glycines
  Promoter: Source sequence=SeqID_15800; Location=1..619; Strand=+; Gene=SeqID_80127
ttttcatagttgttgatgcatcatttccaaaacaacaacaacaacaacagtccagcgatgatggagaaaatgttagcaatgaaaagcagcacgatgaaggtgaaaaagtagcaaaaggtaaagccgcaaaattttaatatatatctatatacatattattaatttttttttgttttaattttctttgattacgtatctccttaaatagagcgcccgagggctttatttttcaaccctctgctgaaagggggatttttatttcaggggggggggggggctctaatttaggagtggcctgtatttttattttattttaagggggagtactaaatttttatttttttgcttcatttcgagaaagtttctctagttttttttttttggtctcagtattgttttctgctggagttttgaaaattgctactacgaaagcccaaccgatgaatttttaataatttttaaattagaccgtgacatcatgcaaaaggatggccagcctttgtatttgccgccattcaatcgaccaatgctaatgccaggcaaaattcacgaaattttttaaattttataatgccaaaaatatttggggaattcagatgggagagaaagtgacacaatg

SEQ ID NO: 111029 - DNA, 62 bp, Heterodera glycines
  Promoter: Source sequence=SeqID_18905; Location=136..197; Strand=-; Gene=SeqID_83614
atttaaactgcttaatttaaataattattagccaagcaattttcaactttttcgacaaaatg

SEQ ID NO: 111030 - DNA, 466 bp, Heterodera glycines
  Promoter: Source sequence=SeqID_25044; Location=1242..1707; Strand=-; Gene=SeqID_55778
tgaaacgtgggattagaattacaacgatgaaaataaaagaattgttgttgataaaaatgttgtcactttgggtgggcaccgcaaaagtcggcgccgcaagtgtcactttggctgggcgccgcaagtgtcggcgccgcaaaaaaaatagccgcaaatgtcgggccgcaagtgtcggcgccgcatgtcggcgccgcaagtgtcactttgggtgggcgccgcaaatgtctgcgccgcaagtgtcggcgccgcaaaagtcgcatcaccctccgaaatagctgtttcacttagtcaaacccacgggcaacctacctcaataagggccttttctaaaaaggtggtagttgtagaaaagccgtggtcctctaaacagtggagggagaggcttgcaaaatttgtacggcttaaggaagccgtacatgctccctgagacttcgtgagttggaagccgcccgaggcgagcaaaatg

SEQ ID NO: 111031 - DNA, 117 bp, Heterodera glycines
  Promoter: Source sequence=SeqID_8747; Location=1243..1359; Strand=+; Gene=SeqID_69095
atataaaaattaaaaaatgtaattaattaattactttcttaattaggatggcgctctgtttttgcgaaatttccaattacgaacttttgtcgtcccggaattttctacttcgaaatg

SEQ ID NO: 111032 - DNA, 693 bp, Heterodera glycines
  Promoter: Source sequence=SeqID_37760; Location=349..1041; Strand=-; Gene=SeqID_66750
ttcgggactaatgatctagacctatgccgattggaactcattttggacggttttttagcgggcaaacttctataatttttcacatttttgaccattacttttttgatcttgtcttttttatggtcatgtgaaatgcaatagagccaaaatttttcatcacaaaggaggcccccttaaatcattaatgggtcaaaataaataaatgtctttgatcacgactcagaaaaaatacaaattcaaaattattgaattggtcccccctttgggtttcatcgtcccatcgaaagtgccggtcattttgatttttaagtcaatttggcattttttgaggatttaaaacaatttatgattattttttagtctatgtttgctcataattgggttattagtccggacttcgggcttttttcgtctatattttttgtcatttaggagttttttagtccttaaaacttatagccctaataattaccataattgatgaaaaaggataattaaaatatattttttatggaaatttgtttttcaacatacgaacggaagcgtaggcattcttcagcttcagcagggcggatgaattatttggcaatcaattagaattgattgttttattatatttttccatagataaatttaaaacatttattttatttgatgttttaattttttttcatttctttgctcataaaaatg

SEQ ID NO: 111033 - DNA, 870 bp, Heterodera glycines
  Promoter: Source sequence=SeqID_4573; Location=1807..2676; Strand=-; Gene=SeqID_54939
catacgggtcggtagtctcggaattggataaaaatcgcccaaatttggcaacggccactccgttctggtcaaagggcttggaaaaattaaggaatccccgtatctcagtaggtgagcccttccacgcttttaagggccgtgggttcttcggtctacctcagttgggcccaggcaggtttgggccccagcatgtttttggactataacttttttcattgtcaaccaaatctaacaatcttggtatcattcgagagctcttcagatactctaatagcctgcaaaattccaaaaaattcgtcaattttgaacaaatttgtggccaaaaaagttggaaccttttcagttttttttttaatataaatttgcgtgttgcgcccagcagatgagcgtccgttcgcctgcgacacgtgcggacgccgcttccgtctgcgcacgacgctggcggaccaccggcgtacgcaccaggaggtggacgcgtcccaatttcagtgcagcgcgtgcaacaaatgctttttgtcccgctctgcgttaaagctgcacatgcgtgcgcatactggcgaggcgccgtttccgtgcgcggacgcgtcttgttcactgacgttcaggtgtcaaaagcgggtgattggcataagtgatcagatttatcggatcacttccgatcagcagttaaattgaaatttgctcttctgacaactcttgatcgggaatattaagtggaagaaaaaaactggcgatgatcaaccgaccatgtgatatggttctgatatttatgaacgtgatcgcgactgaattatcgagtcccaaacgaatttctcgacttgaaacgctaaattaccgatcagcatttattttagaaccaagaaattaatg

SEQ ID NO: 111034 - DNA, 133 bp, Heterodera glycines
  Promoter: Source sequence=SeqID_19788; Location=1..133; Strand=+; Gene=SeqID_84525
gagaaacgttgaggtatcccggacccgagacgtacactttcttagacatgaagaagttcatgaagaaaccgcgagcagcaccacgcttagcgagctgttcactgtctccagacgctccgattccggcttcatg

SEQ ID NO: 111035 - DNA, 161 bp, Heterodera glycines
  Promoter: Source sequence=SeqID_14488; Location=2942..3102; Strand=-; Gene=SeqID_78532
tttgatttcatgtgggtgttggtgaagttggcaccggcgatttgtcgataagcgttcttcgagaatttccaaccatcacaaaatatgtcggcacgcaaagcacatctccaccaatttcgcaatggaaatatttgggctatgacagaatagttggcgcaatg

SEQ ID NO: 111036 - DNA, 61 bp, Heterodera glycines
  Promoter: Source sequence=SeqID_7880; Location=2859..2919; Strand=-; Gene=SeqID_66261
ctatccattaccatctaattaagaattaattcaataattttccaccattaaccctccgatg

SEQ ID NO: 111037 - DNA, 59 bp, Heterodera glycines
  Promoter: Source sequence=SeqID_29022; Location=698..756; Strand=-; Gene=SeqID_59593
tcgtttccgctagttcgccattcctttgttgatttcaccccatttcccaacccaaaatg

SEQ ID NO: 111038 - DNA, 407 bp, Heterodera glycines
  Promoter: Source sequence=SeqID_6104; Location=7022..7428; Strand=-; Gene=SeqID_60351
cggaggaacggaaagagaaagaacacgccctttgggaacggttgaggcggagggtggaggaagtgcagaagaaaaacctctttctggccaatacactcgcaatttgggctgaacgaatgccctttttggtgaagcgactgtctgaccaaaaagtcggcacagaaaattgtgataaattggtgaaagcgattgaaagtttatgcgaatgtttaatcgatctgaaatttccatcgtggaaatcattttgtgaggagtttagcaaattgaaagacaaagagcaaaaacagtgggacgaacgaatcgcccggagcaatcggacggaggaaaaaatgcacgaaatttttccgtcgccgaggggggatgggatttggagtggagcgattacgtcacccctaaatgaaaaaatg

SEQ ID NO: 111039 - DNA, 155 bp, Heterodera glycines
  Promoter: Source sequence=SeqID_2346; Location=101..255; Strand=+; Gene=SeqID_79249
tggccagccttcttcagcccgtcattccgatgttcaccgaaaattgccgagaggcgttccgcacgccgcgctggggccgtcgcctgacgcggcccatctacgaacacacgcggctgcccgtctgtcccatctacggcggattccccgtcaaaatg

SEQ ID NO: 111040 - DNA, 654 bp, Heterodera glycines
  Promoter: Source sequence=SeqID_11460; Location=1..654; Strand=+; Gene=SeqID_74859
aattttaaactcagaaaattgccaataaaggtccaactgattggccatttcccagcacttatctggcgcgaagaataattaattctttttcaaatggccatttgggtcagcggaaaatgttgctgaaatctgagtattaaatgaccatttgggaaaatgggttttagtttatcccaaaagcacttaaatttccattaatagaatttaaaatggaaaaattttttagtttcgaaaattataaaatttaggttaaattctttaacggatttgagcaaaattatttaagatttaaaactcgaacaaattttcccacctctttcaaattcattaaattagaaaaattaattgcacttttgggttttcaattaatttgttttaagtttattttaaaataataataatattttccatttttgctggactcatttgccagtactgttttttaaattcgtcataaatgccaatatggatttattggtggttttctgccactgaatggagaagggcatttgttcaaatttttctggcatcaaatatttttttctaaatattggcatgaccatgaatttattttttcaattttaaataataaaaagatattttattttgaaaatttagttagatctacatttttaattataaatcatttaaatg

SEQ ID NO: 111041 - DNA, 320 bp, Heterodera glycines
  misc_feature (55)..(55): n is a, c, g, or t
  Promoter: Source sequence=SeqID_20188; Location=1..320; Strand=+; Gene=SeqID_84981
gacgaacattatgtctctgggttatgccccgaattgaataggtccatgatttcanagccgtggttgtgccgtggattgattacccgacacatccggcttttttttgtcaatccgactcgacttttctcgccccggtgtaatagcccttgattttaatcccctcaaaatcggattaaaatgagaaaactttttcagttaaatcaaacttttgccccttttggcaaatcattttctttccaaatctgtaggtctcccatcgccacactttcaaatttttttggcggatttatttaaattcagtgaatttttttggctaaatg

SEQ ID NO: 111042 - DNA, 445 bp, Heterodera glycines
  Promoter: Source sequence=SeqID_9156; Location=3666..4110; Strand=-; Gene=SeqID_70433
agctcaaagtctataaaagggagtggaaaatcgcttcccggatcatttttgaaaaacctagcgtaggaatcctacgctgactatgacctagcgtaggattcctacactagcctttcctacactaggctaatgtagttatcatactcgagctcaaagtctataaaagggagtggaaaatcgcttcctcggatcatttttgaaaaacctagcgtaggattcctacgctgactaatgacctagcgtaggattcctacactagctttcctacactaggctaatgtagttatcctactcgagctcaaagtctgtaaaagagagtggaaaatcgcttcctcggatcatttttgaaaaacctagcgtaggattcctacgctgactaatgacctagcgtaggattcctacactagccattgggattgtggtgaaccaagacctgccccttatg

SEQ ID NO: 111043 - DNA, 144 bp, Heterodera glycines
  Promoter: Source sequence=SeqID_30060; Location=1..144; Strand=+; Gene=SeqID_60511
aggagtgccgttccaagtctctggtccgagattgacaccaacgaacctgtcgaggagtaagcttcttttcttcttttttttttgcttgcccccattcatccgtttcttcccgttaggttggtctctctcgaaagaaaagcaatg

SEQ ID NO: 111044 - DNA, 564 bp, Heterodera glycines
  Promoter: Source sequence=SeqID_33101; Location=1..564; Strand=+; Gene=SeqID_63262
aattcaattttcctcggaattttaataaaatttcatttcccctggaacaaagcaaacactgaaaagccccaatccataggatgtggtcaacctcaaccagcctttgcatatctttaaaaatccaacatcaatacttacctgatgtttctgttattctttatgattttggtttcataatagacaatggccaaatgcgggaagagcacgaatttggcatacaaattttgattggctgaatttaaatttatttaaaaaagttaattttaatctttattgttgctaccattctttcttgcgcgatacacagctttcaaatgattgggttttattaggaagaaatcactgtttacgctccatcggttttttggctaaattacaatttatttcctttaaatttcactcttaaccggattgggcttcttttgtgttaaatttgacccgagcacgggctgctggtgttcctcgtgttgaccaaagtttagatgaaaatccttgaattattatatcattttaatttaaattataaaatccttgtcattttttagctaatagttttcccaaatg

SEQ ID NO: 111045 - DNA, 115 bp, Heterodera glycines
  Promoter: Source sequence=SeqID_16027; Location=1684..1798; Strand=+; Gene=SeqID_80384
ggtaggcagcagcagcgaggcacggtttatgtgttcggcaggcacttttttgccaaatttaaatttttttagcaaaaaaaatgataaatttttcaggaattattgcccaatgatg

SEQ ID NO: 111046 - DNA, 771 bp, Heterodera glycines
  Promoter: Source sequence=SeqID_6598; Location=1430..2200; Strand=-; Gene=SeqID_62149
actaaaaaaaattattttggaagttggccactaaaatcatttttttccactattttggcgtttcgtcactatttttgctactatttttgcattttttggaaaatttcccaaaaaatgcaataaaaacgaaaaatacaccccaagaatcgacctaaaaattttcaaaaatacacccctaagaatcgacctaaaaattttcaaaaatacatccctaagaattggaaaaatttcacaaaaattcttcccccaaatttttttttcttgttcaatattttctaagaaaatattttgtaactgcaatcagtgaataaaatctttttccttaattttaaattattttcaaattaaaaaacagctatttaaaaaattacacccctaaatttggaactttttcgccactatttttgccactattttggaatttttttctcactatttagttaattattttgggattttttatcactaaaaatccgatccctagtaatcagctaatgagttctaattgttgccatcaaaataccgttcgaaattggcgctgtattcccagccattcccgacaaatacacaatgccatcattttgaaaatgccgcgttcaatttattacctaccgatcacaattgtgtccgcgtccaactccaactgttgttgttgcagctgttgctgcttctgctgatgatgctggtgatgttggaggtggtgattgtgccggtgccttttctgtcccctgctgccggtgttgtcattgttgccaattgtgcggcaacatg

SEQ ID NO: 111047 - DNA, 78 bp, Heterodera glycines
  Promoter: Source sequence=SeqID_18716; Location=1083..1160; Strand=-; Gene=SeqID_47539
ggtgacgaaacagcatgtgttgttgtgtgaatgtcgcgccaatttcgattcggatttatataaaatatgtagtaaatg

SEQ ID NO: 111048 - DNA, 59 bp, Heterodera glycines
  Promoter: Source sequence=SeqID_25190; Location=828..886; Strand=-; Gene=SeqID_55928
tcgttttccaggtcaaattgctgttcaccttggccaaagatggcggcgtcgcgcggatg

SEQ ID NO: 111049 - DNA, 194 bp, Heterodera glycines
  Promoter: Source sequence=SeqID_37040; Location=1..194; Strand=+; Gene=SeqID_66222
tatttctttctaacatttgtatgtatgtacgattttcttattttgcgatttatgtccgtattttgcagaattaaacgttaaagactaaaagaacttcatttgcacagctttgcttttccaacctgtccttttctccaaatgttgtttttatcgttgaaacattcataaaataacaaaacaaaacatataaaatg

SEQ ID NO: 111050 - DNA, 1003 bp, Heterodera glycines
  Promoter: Source sequence=SeqID_904; Location=2656..3658; Strand=+; Gene=SeqID_63631
aaaattagcatttaaataaacggcatccgattttcactgaattttttagtttttgtttgaaaaaaaaattcccattcgtttactcatcgatgtttgcatatttttcgtttcattcactcgcttctcgcattacaaatgatgtgaaaattgtacatagataatcgattaaaatggaatggctttgtgctgtttgaaaatacataaagcaaaaagcgaggattggatttaaccaatttttggaaaaccaaaattttttttatttccgtattactaaaccaatgcgatttattttttgctttgttaagatcggagaatttagatttgagttgaacggacggacaaagacccccattaaatttgcttgtaccataaattttttcttttttgatgacatcaccgcaattaacgacgacatggccaaatttggacaaagatgagaaatggcggagacgacggcggaagggccaacaaatttccgtgtgcaacaatgggaagaggaagtgggaaaaataatgaaaattttacatttgttttgtaaggggtaaacaacaattttttgtcgatcggtccaacattgtgaatttgtttagtctggatagtttcgatcagaggccaaacgcaatttttttttatcggggattgcttgaatgagtccaagccgacttttatgagtccaaacgctttttatgactccaatcaattaaccatacctgttttttagcttctttagactttgtgctctcgaatgataccaaaaagattgggtttgttcaagcatgaacaaagttttgtatagaaaccaggtatggttaattggttggactcataaagtgcaatagaacgaaaaagtcgctttttgatcgggtcaaccgaaaaagttcgggtcgtcaggaaaaaggccgaaattttcggatatcgagtttcaggcatggcaaccttgttttgatgaaaaattcatcccgcctcccacccaaattgatttgcacaattcttccacaggatg

SEQ ID NO: 111051 - DNA, 380 bp, Heterodera glycines
  Promoter: Source sequence=SeqID_550; Location=6404..6783; Strand=+; Gene=SeqID_56031
tttaactaatgagaaaaattgtatttggtgttgccaagtggacattttttgccttcgagggaaacctttggggtttttagagaaatttgaatttaattaatctataaatatttaattaacgtcatttttagcgtatatctgatgaaattcataattcgagaaaggatttataaaatgccaaaacatttaaataaatattttcgaaaaatggtttaaatatttacaaaaataatgactaaaaatgaaaatttcgagaaaataatgaacaatgcattgaatattatgaaaataaaaacgaaaaaaatcggttttcactttgcattttccaaattttaaataatttaattttaaatttatgccgccatttgttaaggaacatg

SEQ ID NO: 111052 - DNA, 139 bp, Heterodera glycines
  Promoter: Source sequence=SeqID_13224; Location=1924..2062; Strand=-; Gene=SeqID_77051
tcgccgccgacccaagtctcacccaacaaggggagacacaaacggccaccagcagccgaatcttcgagtcttcaccaacaagggttaaaggactccggccatcagcagccgaacctcccaaagcaggagaatcaacatg

SEQ ID NO: 111053 - DNA, 118 bp, Heterodera glycines
  Promoter: Source sequence=SeqID_22022; Location=1399..1516; Strand=-; Gene=SeqID_52657
gctgtacaggttgggggaaagggattcaatccctccgcaggaatcaaatatattttgattttttattggttttttatacatttaccatttttttaatgtaaaaatttcagccaaaatg

SEQ ID NO: 111054 - DNA, 1003 bp, Heterodera glycines
  Promoter: Source sequence=SeqID_6649; Location=1462..2464; Strand=-; Gene=SeqID_62325
ggacgcacgaattccctgccatttgcgaaagggcgcggctgtggcggaaggaacacaattaagcggggcaaggggctgtctgtccattggaaaacaatggaagaaaaagtgggaaagaaataggaaaaagagaaaatagttgtgcaatttgatgttgcagagaaagaaagtaaatggagaaaccatggagagcgcacgaattccagggaaaaagaggcaatgaggaagggagagggaatttcatccattggaagaaaaaggggaaagaaatggaaaagaagaaaatagtatggctaaccaaagaaatagggaaagagtgaataaaataaaatagagaaattgaaggaagcgcacgaattccaggggaatgccggaaaatgaagggatgagggacattctctcattggacaaaagcgtaaaacaaatgatgaaagaatggagagcacaaagaaatagcagagagttaaaggaggaatatttgaaaacgcacgaatttttggggaaataaaaatgaacgctttgtgtgagatgaagaaaattgcctggttacataaaatttgttagagacaaaaatagcggggagggggggggggaatgagtgacggacgaaacagcgaaagagttggcagaaataaaaaaatattaaaaattaaaaaaacttttggaagaattaatctgactccccaaactcgaaaccgctcagacggttgggaccgaattagaacggctcaaaaccagggctcccagatcaaaattttcaaaagcctcatttggcaggcaaaagcctcattttgggtcaaaaagcctcatttttacaaaatttattcaaaacacatttaaaatgttcaaatattatttttttttatttccatgatcaatttgagcaattttttatttggaaataagcattttgtggtactaattgggtttgggtccccttttttggccagaaattttcaaattttttttcttttttattatcagaaatgcttttagattaatg

SEQ ID NO: 111055 - DNA, 265 bp, Heterodera glycines
  Promoter: Source sequence=SeqID_12745; Location=2190..2454; Strand=+; Gene=SeqID_76453
taattaatcaaattcaaaagctaaaatattgtaaaaattaatgaagaaaagatgtaaatttagggagaaaaagagcagaattaacgaagtgaagaataaaactgaaaaatataagtgtgcatcaactatttataacaatcttggttttgtttttctgggttaaacaaacatcaatctgtataaaaacggtgaacaagatcactttattcaatcctttattctaatatatttaatttattaaaataaataatcctagctaataatg

SEQ ID NO: 111056 - DNA, 1003 bp, Heterodera glycines
  Promoter: Source sequence=SeqID_12790; Location=961..1963; Strand=-; Gene=SeqID_76503
ttcgtatattttggcattttcaaaaaagctttaacaaaatgcaataaaatttaaaaaagcacccttattgttttgttatatactgtataggataaaaaaaaatttttccatttttttttgtaaatttgagaaatgaggtcaaagaatattgagactgaactggcccaagacggaactggctagataaaactggctcacaatcagacggcgcccccacaaaatgtccaagccacgaaatgtccaaaagagtaaaaacccacgaaatgtccaaaattttcaaaatttataaaaacaaaatgagtctaatttggggtttttaggggtttcggggtcgctgaatacgaatatagcctttatattaccccttgcctaaccttaggcccatccgaataataaaaaactcaatttcgagacttggacatttcgtggcctggacattttgtgggtcagcgaatcagacagaactgacttctaccggccgataggcgccgagtagaaaattttaggcggaaaaataatcagttcattaatttttgtcctatttatttttctccactcttcacatttaattctttctaactcattaaaattgccgataatgtgtaattaataatactaatctttattcgtttattatgtcgttttcttatcaatttcttagctgcaaaataatttttctttttcttcccattacaaccgattaatcaattaatcattgagcttacgttgaaatttgttaattttttacttgtctaatttatttactttacctagaaaattgattttatgaaatttggaatttttatctttgattgatatgtttatggtacatacccaatatttttgttttgtttttttatttaacttcgaaaattgccaaaaactagctttttgaggttgaacctgtttggttgctaaaaaagaaggtgaagttatgtatgtatataactgcttgtgcctggtaatgataataatgtaaatgttgaattaagatttcggcatg

SEQ ID NO: 111057 - DNA, 124 bp, Heterodera glycines
  Promoter: Source sequence=SeqID_10866; Location=955..1078; Strand=-; Gene=SeqID_74145
ggacacagtggaactcgaccaaaccccagtggtgttccatgtcggcatgcgaacgcccaacagagcgagaccgctaaaaatggaatttcccacaaggcatgcggctcggcatgtgctcaaaatg

SEQ ID NO: 111058 - DNA, 368 bp, Heterodera glycines
  misc_feature (43)..(43): n is a, c, g, or t
  Promoter: Source sequence=SeqID_17473; Location=1..368; Strand=+; Gene=SeqID_81978
cctggttcacattgggttgccgtgtattgcgagcatcaaaatncgggtggaatactacgattcgacaggaatttggccaccgctaagccctttcatccaaaaatttttaaagagttttgctcaaattcagtttcatcaactttcgctccaagcaccatactcacactcatgtgggaagcatgtgattttctttatatttggacggtgtatggggatgcactttgaagcaattttgcaactgctaaaacgcgcaaaaatatcaccagatttttttgtaaacaaatttatgcaaaaaaatgtgtttaaacaaatataaataactagaaaactcaatttaaaaagcgcaaaaaaaaaaagaaagaaaaatg

SEQ ID NO: 111059 - DNA, 293 bp, Heterodera glycines
  Promoter: Source sequence=SeqID_7020; Location=576..868; Strand=-; Gene=SeqID_63586
ttgttttacatcaaaatgattgttgttaaacggattagaagcttttactccagaaaaattcacacttgaaaaattttttcaacctttttgttcgaattcgggtccggggttcggaattgggtaaatccgagttaagattcgtaatcagcacctcgaaaaccattaaaattggttttgagcacaaaataaaaaaaatgaggaccacaattctttaccattgccgatatctttcatttcattgcttaggacttcatgatttgatgggagcgcacgtcgaatggaaacgcgaaatg

SEQ ID NO: 111060 - DNA, 545 bp, Heterodera glycines
  misc_feature (19)..(20): n is a, c, g, or t
  misc_feature (56)..(56): n is a, c, g, or t
  misc_feature (110)..(110): n is a, c, g, or t
  Promoter: Source sequence=SeqID_21051; Location=1..545; Strand=+; Gene=SeqID_51639
ttttttcttcatttacaannatatcagaatttgtttctaagttaaaatttgttttntaattattcttgcaatgattataccaagcttttaaaaattatcgattttaattntactactttttgccagccctactcattaattatcttatactttaaatgcccagcaggatctttgttgattctcataaaaaaccttttctatttttaagtctttctcccgaaaataatcaaacaattggtccgggagtttcgtgccatctgcaaaaaatttttagtacttttatctctatcttcgaattctctgaagatagtatataaaacttcttttagcaatattctcaaatctgttgtgcacgctttgaatatatattttttatcatttttagttgcatttgaaaaaagttacaataaaaaattggtgggtgaaagatttatttgtcaccctgctaatgaatttgcattgccatttattacggacaaaaaattgtaatgattttaaaaaagtcgataaatccttgtgtcaaaaatattgtcgaattcaaaatg

SEQ ID NO: 111061 - DNA, 403 bp, Heterodera glycines
  Promoter: Source sequence=SeqID_31096; Location=875..1277; Strand=-; Gene=SeqID_61478
tgccttttccactagggtacgcaactgtggtgcggtatgacataaacatctatcaagtattatctttttatttatgttggactcgctgggtcatcccagtgtgctactgcatgctttccaacaagacgcacgctacatacgagcgtatgtttagtattctcgttgctgtgtgaccagacttcaacccggacagcgccccccccaaatacgagacagcggcaatcactgcgctgaatgtagtcttcccattcactgaagtgcgcggatgtctgttccacctcgtccaaaattttcacaaaaaaatttctgaatttgggctgaaacaggttgaattcatgacaaaaaaaagtcgaattttcgaaaattttagcgctatcaaaatgacccgacattcgcagaaatg

SEQ ID NO: 111062 - DNA, 501 bp, Heterodera glycines
  Promoter: Source sequence=SeqID_9310; Location=515..1015; Strand=-; Gene=SeqID_70956
agtaaatgaccttatttgttagtgattgtcggacgacgattagtaattattctattttctgtaaatttggtaaagataattttgttttcaattttcattgatttatttactcttttctttagaaaattaattattattttaaatgatagttttattttttcattttatccaccttttattttttgttttgtttaaacctcattgctttaacaaataaataatgcactaatttgtaagaacagtaagacgcaatggtttggttcctagcagaaaattaattaattctaaaaaggtctaattagcaatttcccaaggtaaataatttaaaaaaaaattttccatcgattattttctttcattgatttttgacatattcttatgaaaattcaattattacataagcacatttttataaaattgagcattgttaaatagaaaaaaaatataatttcacttttaaaatacctttataaatgaaaaaaatatatttaaggcaaaatg

SEQ ID NO: 111063 - DNA, 55 bp, Heterodera glycines
  Promoter: Source sequence=SeqID_19499; Location=796..850; Strand=+; Gene=SeqID_84216
atttttttttatatgacaaaatcccaaacagatcgccaaacggactgcggaaatg

SEQ ID NO: 111064 - DNA, 187 bp, Heterodera glycines
  Promoter: Source sequence=SeqID_12548; Location=4342..4528; Strand=-; Gene=SeqID_76199
tcggttcccatcggtcattcttcttctcccatttcacactttgctgctgcggacaatgaacagattcgcctcattttatttttgttttcctcgtttgattacaaaaactaaaataaataaataatttttatttttaaaattattttagcatttattgcattagcattttttgtcggtcataaaaatg

SEQ ID NO: 111065 - DNA, 337 bp, Heterodera glycines
  Promoter: Source sequence=SeqID_12320; Location=375..711; Strand=-; Gene=SeqID_75916
ccattcctccacaacagtttctttattcattgggaaatttaaaatggaatataaaacccaacaccactcattcaaatttttttccattttttaaatttgtcgcagtttgataagtggagaaaattatgcacgaaagcacataaattatggtcaaattttggggcgaacattttggtggggaatgaacgtgatggaattccgtccaaaagtttagcctcccaagaatttttgcacgctaatgaatatttggggggggggggagagagatattccttgtttagagaattttagagttcaaagtttccctcaatttgaagactgtcaatttcagcaaatg

SEQ ID NO: 111066 - DNA, 558 bp, Heterodera glycines
  Promoter: Source sequence=SeqID_14573; Location=534..1091; Strand=+; Gene=SeqID_78642
cggacgacaaaaggccaaaatttgacctaattaaaccaattaaggacctaattaatacaatttgtcgtttcattttaataaaatggctgtttgccctttcattgtttgcttttgctttttttaacaacaattgccaattcgcttttttttctcccatttttcaaatttcgcccccccggcgaatttcacaaattcatttccgtcttctgtctccttatatatgcattgcgcaatgccactatttcctataatttatttgctttttcgtgctctccccccccccccccaatttccaattttaaggcattcattgcctttctttttcattgattttataaaattaaatcaatttgccatctttattttaaaggtgtatgcttatgacatttgattcaaatattctcttaaaatgcaatattcgatatataattgccctttaataattattttcattataagacactgatcactcattcgttttcattctgttcggtttcatttgatcactgatcagtcccatgcccttaagccttaaattctctttgcctgcgggcaatg

SEQ ID NO: 111067 - DNA, 353 bp, Heterodera glycines
  Promoter: Source sequence=SeqID_15168; Location=453..805; Strand=-; Gene=SeqID_79365
tttgctattttacattttatattttgtactgcatttctcctccgacataaattgtgtttattattttattgtgtgtccaaagtagagacacaacattggcgcagtcagcagccgtgcttcacccattcgaagacacaccgaactgcaacccaacctcaacaaaaccaatagtcccaagacgggtgaggtccgctaaatttagcggttaaattcgacaaaaaccaatagaccctaggcgggtgaggttccgcaagacgcggttttcttcaatttcgacatccaatagtccctaggcgggtgaggagccactctgcgtggttaattgctgatcatcggacgagtcaaagccaatg

SEQ ID NO: 111068 - DNA, 194 bp, Heterodera glycines
  Promoter: Source sequence=SeqID_29509; Location=1..194; Strand=+; Gene=SeqID_60000
acggtcagtggctattttccttttcttccacaatttccccttccgcttcattcttccatattttactcttccgccttatcccccgattccttcggcttttaacaccctgccccttccccgccccgcttctcctccgctttcctcgccccttttcttccccatcccccgtttcagttccgctttcccccgctatg

SEQ ID NO: 111069 - DNA, 936 bp, Heterodera glycines
  Promoter: Source sequence=SeqID_31239; Location=1437..2372; Strand=-; Gene=SeqID_61613
aatttttatacgaaaaacgatggacttggattgtttgatatttccaaatctctccgcaaaaaattgaggcaaatttttcaacaatgtaacaactttgtttctgaaatttacaataatcacgaattcgagaatcaaataataaaaatttatgccaaatttaatatcaatgaattgattatttttttaattttataaattttaagagcaataatacatatattttctaatttttttaaaaaaataaattaattttatttcaattaattttcttattttctcattataacttttatataacaagaatttttttttttgcaatttgacagaaaaactgatttaggcatttttaagaattaatttctgcattttatgttatttttgtacataatgccattcgcaataattagggttgcttttgagcaatgttaagacaaacctgtttttaaaatacgaaacttgaatagattacgggttgaaaaattaaagtttttaaatgaggcttttaattttttgacgataatttaaattgctcttttaaaaatttttaactttttaaaattatatcacatgaaaaaaaattttacattgtttaaattattatttttaaaaattttaactttttttttaattatatcacataaaaaaaaagttacattgctttaaaaaacattattcccaacgcttagcatcacacaaaaatggataatcgaatttattattgattagggataattataatataattattttattattttagtttaatattatattataatttttatttaataaatattataaagtcaaataaataagaatattttctgatccattaacaatcacaaaatataacacaaaataatttgattttcagtttaaaatttttaatttacttctcataacttattaattacagcgattctgtgtcaattaatg

SEQ ID NO: 111070 - DNA, 523 bp, Heterodera glycines
  Promoter: Source sequence=SeqID_8863; Location=204..726; Strand=-; Gene=SeqID_69453
cctttggcagagggaggggtctgatggatggtcgagaatcgctacccctccgccccctcccgtcactcactgagtctctgtcaatttccacctccaattttatctccgttccgtcgtccatccaatccttcgctctcaaaaccttttgtcccttctgctgactctcttccgccacatttttcaacaattgtctcactgcttcgactgcgttccgttggatatgtttcatatacgctttgactatgggcagcgaatattcacggacgagttcatgcagaaggccaatgcccttttgattggccgcaatttgcgcatttaaatcggccaaattgtcgcgcagattccgagtgcctgaacagccggccactctttgtggtgccatcaattgttccaccagctcagactccttgaacacaccaccgtcgataattttgaaactgtgaaagacggccccctcctgggccaatgttgtggaatgtgggggcattgagccggggacaaggccaccaatgtccgaatgatg

SEQ ID NO: 111071 - DNA, 311 bp, Heterodera glycines
  misc_feature (5)..(5): n is a, c, g, or t
  Promoter: Source sequence=SeqID_16027; Location=1..311; Strand=+; Gene=SeqID_80385
ttttncaattgatcaaagtttgcaacaaaaaacagctcaaacatcaatcacaaaaaatgtgattgattggcgatccgacagatggtttttgagggcggcggcgtacgtatgggggggccggtgcaaggaaaagcaacaatttctaatgtgttcattattcattcatttaatttctgtcattcttctgcggctaaattcaccattttgtctctgttttaaaaataaatacagtatttctttaaattttttttgaaatgcaaaaatttgttcaccgctcttcttgtttttttccttcaatatgtcttcgaatg

SEQ ID NO: 111072 - DNA, 119 bp, Heterodera glycines
  Promoter: Source sequence=SeqID_39146; Location=466..584; Strand=-; Gene=SeqID_67785
actgaaaatttacggataaaaagtcaatggattgaccggaagaattcaccagaagaatttcaattcctccaaccaaatacatggaagttgcaactgtgttggccagatagaatagaatg

SEQ ID NO: 111073 - DNA, 481 bp, Heterodera glycines
  Promoter: Source sequence=SeqID_8589; Location=1777..2257; Strand=-; Gene=SeqID_68622
ataattttttagatcgtttatcataaattaataatttgaaaaaaatcgcacatttaattgggcaattttttatctttatttaatcaatttttggttaaattttaggttggttttttcaaaaaataaacaaaattttgagatccattggaccatttgtttgcttgtccattttaggcttatataaaaaatttttacttaaaaaagctaaaagtggcaaattttgaaaaaaaaattggatgttcacttggacaatttgtctctgtttaatcaattttttggttaaaattttgggtggattttttcaaaaaatgccattttatttattttgcacaataataaaaatttgaaatcaatggaattttttttgtcgcgtttcgcataattttttgggtccattttaggtctttttaaaaaaaaaaaaaattataaaagccaaaaatttccgtccaaataaaaatcattaaaaaattaaggcctaatg

SEQ ID NO: 111074 - DNA, 243 bp, Heterodera glycines
  Promoter: Source sequence=SeqID_44844; Location=1..243; Strand=+; Gene=SeqID_72261
ttttgcctttttattccatatttcggctatttttggcaaattttcacaagaaaaatgcaaaaaaagaagcgatttttgacgtttttagtccatatttcgggcatttttagtccatgttttatgtccatatttgacgttttttagtccatataatttcgagccctattaatatgggacgggtccgggtttttgactttggtttttggcaaggcttaaattggatggagagatgaattaattatg

SEQ ID NO: 111075 - DNA, 59 bp, Heterodera glycines
  Promoter: Source sequence=SeqID_12950; Location=2428..2486; Strand=-; Gene=SeqID_76705
cgagaaggaggcacggacaggacaccaccgcccggccaccaccgtccggcgccgaaatg

SEQ ID NO: 111076 - DNA, 161 bp, Heterodera glycines
  Promoter: Source sequence=SeqID_31411; Location=829..989; Strand=-; Gene=SeqID_61764
tggtcaaatgaccaggttagataaccatgcacccgtcgtggttgctcatttgctacgggtaaaccatgatggtagtggttattcaaccataaccaccttctttgactacggcccccgctcttctcaggtatttgttgccaccaccacccgcgcaacggatg

SEQ ID NO: 111077 - DNA, 369 bp, Heterodera glycines
  Promoter: Source sequence=SeqID_18951; Location=722..1090; Strand=+; Gene=SeqID_47554
atcaattaacattttgtgatttttcaaaaatgccacacaaatacctgtaaaaattctatacattcattatcccactgctgattgtgaactgtgatgaaacaattttatgatagatttttgattggcatttgtctttttaaaaatttgcttctttgacttggaactttctgtcattatccaccattagttcctaattatgtccaagaagcaataaattttttatgaatcaagctaattttgcataattaaaaagtcttggggcgcatgcgtctgtttgcctatgttttttcgatgggatttggttttataataccctttttttcctcggttttcatttaccataatttgcccatttttattaaaaggatg

SEQ ID NO: 111078 - DNA, 624 bp, Heterodera glycines
  Promoter: Source sequence=SeqID_10946; Location=1481..2104; Strand=-; Gene=SeqID_74253
gctgaaatttatgaatgccaagattttgcaacaacaaaaaaaagaagctaaaaaattttaaaaatcatatagtaaaagaaaaattgaaaaattttaaaaattaattaatacaaaaaaaaaaaaatttttttttaaatgggtgccaaattttaagataataattgcctttttaatgtccttgcaaaaatcggtggccttgtaaaaaagacatattaagcaatgaattttttgaaaaatttgttaaagctaaacaatcattatcgttgggccggagcagttcatttcctccggaatattttttaattgcaaaattgaaacttttcgaaaaaaattgaaaatttttttaaaattcaagaaaaaaaaattaaaattttaaagcgatgtttttgaaaaagcatcatcaaatttttgaaaaatcgctagaaaatttttaaaattttttcgtaaaatttctataacgacaggggggggggggggcgtagtgcatcccgcgccgagatgcgggcccgcgccgatctttatttgtggatatctctcttaaggccatgcgcctattgtaccctgccgcatcgtgtgtattacatagtccgggctggtggacaggctcagtttggccaggtgatg

SEQ ID NO: 111079 - DNA, 72 bp, Heterodera glycines
  Promoter: Source sequence=SeqID_4302; Location=1906..1977; Strand=-; Gene=SeqID_53957
atatttttaataattaaaaaaatttcgaaacactgtttatattttcgacaaaaaatccaaataaattaaatg

SEQ ID NO: 111080 - DNA, 88 bp, Heterodera glycines
  misc_feature (8)..(8): n is a, c, g, or t
  Promoter: Source sequence=SeqID_23451; Location=2772..2859; Strand=-; Gene=SeqID_54158
aaagcatntttggaagaagaggtggaaaaaaaggaggccccccgaggggagagaatgtgccaaagaaaaaaggccaatgcttaaaatg

SEQ ID NO: 111081 - DNA, 87 bp, Heterodera glycines
  Promoter: Source sequence=SeqID_35500; Location=1073..1159; Strand=-; Gene=SeqID_65040
aatatatagtaagggaatataaaatactgcattttcttttatttatcttagaataagtttattaaattccctttgcccttcaaaatg

SEQ ID NO: 111082 - DNA, 228 bp, Heterodera glycines
  misc_feature (8)..(8): n is a, c, g, or t
  Promoter: Source sequence=SeqID_27504; Location=1..228; Strand=+; Gene=SeqID_58195
tcataaanagtcgattgggactcataaaagtcgattggacccttccagtgcattagagccattaatgttttattaagaaatattgttttttcatgattttgcttttgtggattgttattaatatttttttacatttggcctttttcgccaaagagatttttttattatcaattaacgttaaatttaaacattaaaaagaaacctaatttattctgtacctataaaatg

SEQ ID NO: 111083 - DNA, 1003 bp, Heterodera glycines
  Promoter: Source sequence=SeqID_6101; Location=206..1208; Strand=+; Gene=SeqID_46182
tctctcttttctctctctctctcttttctttcttctctctttctctctctctctctctctctctcttctctttggcccctttctgcactctttttcctgtttcttcacttttttagtccttttaaacatatctctgatctaaccaatcaatcaatcattacgatgttaatttttgtttcgttttaagcctgccctttcatatttccctctctctctctttctctctctcttttctctctctctctctccctctctctctccctaatccggttcacttttaaaatacgaattttgttttcttcttggctttatttcgattgaatgcatttttggatttttgccctttcccatttttatttcttttgtttcatttaatttttgttgttttcgtgaataaataattaataatacaacatattgatgaaaatatattttataataataataatttgttggtaaaatgagtcaaataatcgaatggaccaaaaagaaacagctgaccatcctcagaaaggggaaagcccgcctttccctgtccaaatgatcggaagaagccaacgggagcggcaaaggcagagaaagcgatcagaactagaaaaatgggggagagagagagagagaaaggggaaatgagggtaaaggaaaagagaaagaggaaaaagaatggaagagagataagagaaaaaagaaaaagagggggagagagagggaaacaacaaaataaagaaaaaagaatgtgaaatgaagtgagaaagaggccaaattggagaggaaggagaaaggagcagaagatgaacgaatatccgaaacagagaaagtgggggggggggggggtgactcagacaacggtgctctcgcctctctcattcaatcatttcaccaacggacggatcgacgagaagagaccgactgactcaatgctgccattcccctccccctaaacaaaggcaaaagccaaacagatcaacaaataaacacgtcagattagggtcgattcggaatg

SEQ ID NO: 111084 - DNA, 1003 bp, Heterodera glycines
  Promoter: Source sequence=SeqID_3673; Location=584..1586; Strand=-; Gene=SeqID_51386
agtaatgcagcagcaaaagccgccactttccaaaatgttgctgaataaaactgcaaaaagtgcccgtcctccattatttggtaatattccaaactaaaacaattaaaaaacaaaggcaaacttcgataaaaaggaaaattttaacagaattttatttgtttttcttcggcctcacaattatttcacaacactttctaacaccaattctcttcagctgctgcttcttctgggcttgtgtattttaattatttattgtcgtttattttgttatttttacagaaaaacttattttttaataaataataaattgagtttggctaaaatgaacaaaaaactttaatcgctttatgcattttacagcgttggtgggaccggaacggaaataacaggacaagaacccgttttccgcggcttttcgggtcctttaatccaaaaacgggacctggaccggaagtcccaataaaattcgtttggaccccagtcttagggctcgaataattaatattttattaattgggattccgctttacaaacgcatagaaaataaattaattaatccaattaataatcgagtcaaaaaaaatataaaaatattctctatattctttgttatttatattgtacaatttataacattcacatgtgtattgcaataatgtttcaatttttatattttttaaaaatttatacattaaatgtgagaagacaatgcaaaaaagaaattaaacatagaggaaaacaagaaataacacaattatataataataaaaatgaattaatttatgtttataattttctttgtgtctgttttcgaaaaaaatttaattgagtcaaaactttttggtcataaaaatgcatttttattagagaatgtgaacaataacaacactgtttggtaagctcaaatgaccctgagagaaggaaagagacatttatactttcgcatgacataattaaacagttaattgggtaattacaatagtaaataatttttagcggaatg

SEQ ID NO: 111085 - DNA, 1003 bp, Heterodera glycines
  Promoter: Source sequence=SeqID_2887; Location=1256..2258; Strand=-; Gene=SeqID_82190
ttttcgccccctctgttttcgtttttcctttttttttgtgtgctcttccctgttaagtcatcaaattggtgtcatggcaactcgtacaaaaaaaatttctaagaattttcaactaaaaactagaatttttagattaaaaaaaatctaaatggattttttagcctagaaaaactttaaaaaagattctttaaagttttttactagtttttcagctgctttttttaatttcttaaattttttgaaaatttaagtgttttaaaaagtttttctaggctaaaaaatccagttagattatttatctaaaaattataaagttttagttgaaatttttagaaattttttttgtacgagttgcctttgtacgagtttgccattgacccatcaaattcttggataggttggtgggaaattttttaatttactattttttgatgaaaaattttattttatttttttctttttcccggtgatgacatcattctcatctattaattcagagagtgctctctgattctctcatttcctatgattagggcggggatttatatggacataaaatcgagaaatatggctaaaatatggaccaaaagtcgcgaaatatggacataaaatgccaaaaatatggacataattttttccaactttagggtataatttctcaaaatttcttcaaattcgctatacgcgaagtaaagctttcaaaaatggctacatattgtattaaaaatcattttagaagaaaaaacatgataaaactaaaatttactaatttttagcgcaaaatcaaccacaaaagcgaaattttcgcttttttgcttatttttgacataaatttattaatttttaagaaaatttaaatttattcaatattctcgagaaattttggcgaaaaaatgattttttgaaaaatttttcggtttttgggctcaaaaaggctaatttagctgctgggggccgttctaatagaggttttttgaaaaatgccaaaatatggataaaaatg

SEQ ID NO: 111086 - DNA, 129 bp, Heterodera glycines
  misc_feature (22)..(22): n is a, c, g, or t
  Promoter: Source sequence=SeqID_35350; Location=1..129; Strand=+; Gene=SeqID_64924
aattaatttgaaaaggcaaaanaatgcttcgaccaaatttataatttttcgctcagtcatcgacagttatttaattattttggaatttgcattgacattccttcgacaattgtttacattttggaaatg

SEQ ID NO: 111087 - DNA, 432 bp, Heterodera glycines
  Promoter: Source sequence=SeqID_41048; Location=1..432; Strand=+; Gene=SeqID_69265
ttctttggcgatgatgatttgaatttgcctccagggccacccaatcttcgtccacagccaaatgcccctccgtcacttaacagcgaccaacagaaggtctttgatgctgttttgttggcaatacagtcgaaccctagggatccgactgtcccccgccgtttcttcatatacggcgatggaggtacaggaaagacattcctgtttggccaaattattaggcgcttgcgaaaggccccatacacctacaaagtgcttgccacggcatccactgggtgtgcagccattttgctgccatatgggaaaacagcccattccacgtttcgtctgggtagagaagtgtcattagacaagctcccaagcattccgctggagagcttctttgcccgtcggattcgtgaggcccaactcatcatcattgatgagatcaccatg

SEQ ID NO: 111088 - DNA, 64 bp, Heterodera glycines
  Promoter: Source sequence=SeqID_26678; Location=572..635; Strand=+; Gene=SeqID_57437
ggtttggcggggaattgcgacgcttttggcaatttgaagaatttttgaggatttccgcgcgatg

SEQ ID NO: 111089 - DNA, 382 bp, Heterodera glycines
  Promoter: Source sequence=SeqID_739; Location=5942..6323; Strand=+; Gene=SeqID_60193
tctgattaaattttcatttttcccatacttgtcctttaataaggacaccgagagatcataattatctctggagaagggcaaaagtccttgaatgacttttttggcttcacccccaacagggaatccaaataactcattttttgtacgtaatccaaatcggcatcagcatgtattgtcgattcgaataatggccaaaagtcatcccaattactgccatcgaactcctttaggcttaattttggcaaggcaatgtttcggcgtgccgttcctccgggcccatcttgaagaagacgatcaatgttccctttcagcgtgcgggtatcggccaatttatgatttgcccttcgcaaaaaattttgcagatcgtttgcattgaccgatg

SEQ ID NO: 111090 - DNA, 336 bp, Heterodera glycines
  misc_feature (130)..(130): n is a, c, g, or t
  Promoter: Source sequence=SeqID_23630; Location=1..336; Strand=+; Gene=SeqID_54328
ctggcggtttttgaggatttttgccctcagatacacccaaaaacaatttagcaatgtgattattaactgctgaattgatcgatttctattatatatatgttatattgggtaaatattttctttaatattntaattttccattgctttaatgattcatcgctaaaatgtgatgttcttgcaaatgtccatttgataataaaatgttcgaatgcattcccagtaatttattcaatgttttttgaacgctaatgtttatattaatatttattcatttttcgatgttatttatttatatttttcatttcataatttttaacaaattgaataattaaaatg

SEQ ID NO: 111091 - DNA, 190 bp, Heterodera glycines
  Promoter: Source sequence=SeqID_7508; Location=1385..1574; Strand=+; Gene=SeqID_65055
atgaacaacagcatcaacaactcatttctttcatcattgccatttttgaacactttaactgtttaatttaacatttgattttgccaattcttttttttaccaagatttgttctgtctgaaaatggaccaattacaaatttttctaatttatttgtgtgggatttgaaaatgttgtgtttaagagcaaatg

SEQ ID NO: 111092 - DNA, 488 bp, Heterodera glycines
  Promoter: Source sequence=SeqID_3464; Location=1127..1614; Strand=-; Gene=SeqID_84772
tccctttttatagagaatttttacacggaattgacgggtaggaaaatgtttgtataaaagggacgatttaagcgcagaaacaatcattcttcatttgtcctttactgacataataagcgtctgtctccgggaaccggccactttggcgccagccattttggcgccaaacgctataacatttttatttctcattcaaattaaataagcttgatatcattttaaagcgcttgatagtccctaatagcctgcaaaatttcaaaaaatttaattgaaacacaaaaaagttatggccaaaaaacctcaaaaaactgactttttctggccattttggcgccgcacgctatatcttttgtcaaacagaatttattttttctaatattttacaagctaataaagaacacttaggtctatttaatggtatcaaaattattttatttggttggataagaaaaaagttataacactttaaagttcgcggcgccaaaatg

SEQ ID NO: 111093 - DNA, 101 bp, Heterodera glycines
  Promoter: Source sequence=SeqID_40285; Location=393..493; Strand=-; Gene=SeqID_68669
ttggctcctccctgtgcggctcttgctccttcctcccccctcctccgccctatcggccacagcagtgttcgtccgggagcgaaggggccattccgagcatg

SEQ ID NO: 111094 - DNA, 298 bp, Heterodera glycines
  Promoter: Source sequence=SeqID_27647; Location=1..298; Strand=+; Gene=SeqID_58323
cccccccccccccccaccgactgatccctccgtcagcccccccccccagcacatttatcggctgcttcggcccatcacccaccgccgatgagctctttcctcagtcctaacgatcgattggcggaagcaaaagacacaaacagaaaaaggacaaagggccaaaaggtgcggcgacggaggcggcggcggattgataggcggcgatcgacggataaacggcggaagaacgccgacccacacacaaaacagcagcagccaacaaattcacttcagctgatcactccgaacgccaaaaatg

SEQ ID NO: 111095 - DNA, 187 bp, Heterodera glycines
  Promoter: Source sequence=SeqID_21763; Location=1748..1934; Strand=-; Gene=SeqID_52357
caacaaaagaagttgggggcaggacagccgagtcactttgagggatttgcaacaacagaaggtggagcaggacaatgcgaggactttccaaggagagcaacaacagcagcagaaacagaagttggagcagggcaacagcaggactttccaaggagagcaacaacaaaaactggagcaagacagcatg

SEQ ID NO: 111096 - DNA, 774 bp, Heterodera glycines
  Promoter: Source sequence=SeqID_5733; Location=2007..2780; Strand=-; Gene=SeqID_59061
ttttggtgactttctcacagaccactgagacaggtatttaaatcttttttggtattggagctcatttctgggatggtggacagcaattttgaaacccggaaataccaaattttcaaaattcttttttcatatctatactgaatgaccatttttgttttgcaatggtttgtcactattgaaaattggaattttcgactttttgtagcaattcaggtccaggattcaaaatggatcaacaaaatgaatgccaggttcatgatcagcgatcctgaaaacccccataaacctgttttacgactttttaaaacagaaaaatttcttacaaagggcggggggggggccatcggcagtattaccgttaccgcgaactctcttatatttctcactaatttgttttaattggttttattttttgagttgtaatcaattttaatggcaccgccttccgagaaaaagcaaaaacttttgtccgccgttgaaaatcagcagcaatcgtcgtcgtcgggttcttttgtatgcgccctccctttttgaaaaaaaaaattcaaaaatttttttctcggaaagactcatttaggggtttttagggtcggaaaatcagattctgataactatttctacgcaattcgacccccaaatcttgattggaacaaaaaatcgaattttatggcagtggttactggcacggatagaattgagaaaaatccaaccaaacattataaaacactgcagaaaaataaattagggcaaataaatatcatacacttcaaaatg

SEQ ID NO: 111097 - DNA, 368 bp, Heterodera glycines
  Promoter: Source sequence=SeqID_17438; Location=1..368; Strand=+; Gene=SeqID_81923
tcatcaataactcccattcaaagttacagaaccaaactaaaaaaactgtggagaccaagatcatatccaaatgtgtaagcggcttttgtccttcttttggattctttatttgaataaatttgatttgacttataaaaaaacttaaaaatacgtaactaatttcttttaaagaattctctaaataaattctcaaaaattttgaaatctacatatgtcgaaaacttattagtttttcaaaatttaacgaagaaatttaattttttccaatattacactgaatttatgcgtaattttcttaagcacaataaaatcacaatcaatttttttttaaaaacgccttactttaacttatttaaatctgagaaatg

SEQ ID NO: 111098 - DNA, 332 bp, Heterodera glycines
  Promoter: Source sequence=SeqID_5144; Location=1223..1554; Strand=-; Gene=SeqID_57071
gatttgtcaccaaaatttttgcactcctcgcatgacaaaaatatatttttattattatttaatcattttcctttccctcacaatttattatcacatcatttatgggtctttggatttttcgttgatattttgaaaattttccatgttttcgcccaatttttcatttatttagcccagaaaaatttaaaaagttttaattaatacacaaaatcgattattcgatcatgtggagaaaaaaaataaatatattactgcatttttgatcattttataaatgaatttttcaacccattcaaaatattgttgaaattttggttttgaagaaaaaaatg

SEQ ID NO: 111099 - DNA, 103 bp, Heterodera glycines
  misc_feature (9)..(9): n is a, c, g, or t
  misc_feature (22)..(22): n is a, c, g, or t
  Promoter: Source sequence=SeqID_45159; Location=1138..1240; Strand=-; Gene=SeqID_72518
agatgacanaatttcagtattncaatctcaagaatgtctaagcgcctaacatacagtatgacagtgccaaaaaagagtgaaatttggtgtacggtaagaaatg

SEQ ID NO: 111100 - DNA, 86 bp, Heterodera glycines
  Promoter: Source sequence=SeqID_24629; Location=1394..1479; Strand=-; Gene=SeqID_55369
ggttggcgagcagttcgtctccccgtattaatctcgtaaaagtaatactttttcaccaacagactgatccgttaatgttccaaatg

SEQ ID NO: 111101 - DNA, 249 bp, Heterodera glycines
  Promoter: Source sequence=SeqID_30791; Location=1..249; Strand=+; Gene=SeqID_61176
caacaaagacataacagatgctccatctgttgacagtttcaaaaaaacgtataaataaatggattgagttaaccaaaaatttagtctgtaaaagagctccttggactcgacattaatttactaaaatctaacgtgtaagtggtcaccccttcgttggatattttatttcttctgaataaataaataaatttttctgcttccacagtgagcgtgctctgcgcactgcgaccgccgcgttcatcgaaaatg

SEQ ID NO: 111102 - DNA, 1003 bp, Heterodera glycines
  Promoter: Source sequence=SeqID_2569; Location=2214..3216; Strand=+; Gene=SeqID_80446
agcatgggattcgaccataccaaaacacaaatgtaaaacatctcgatcaaaactttgttaataattttctcgcattttaatgattaattggttcttaattaaattacccaaaaattgatttaacaactgtcactattaattaaaattctttgattttttcatacttcccacttataatatgttcaatgcttcatcattaaattcatcaattactacaccttctcatctaaaaacaatggtatatagatagtgattagttgtgaatcatatatcatgtcgttacaaactgacactaattagaccttatggttgtcgaggactcattattcacaagcatatactagaaaccattcttggtaatttgtcataattaatcacataagtttgaagagtctcacccaaacgataaacttcctatgtaaaatcatcccaataaaaaataattaattcataaatttcccaaatttaataattggatgttaggagctgatagttagttaaacttacaccaaaccgtttcaaggaagataattaaaaatgacagttggtcaatgagacaattagcccactacaccgctactcaccattattggtaatttgtcataaatcattaatattatttctcacccatgccataaaattcctccgtaaaatcattttgacaaaaaaatgttattaatttctcaccatttaatgattaattgcttcttaattaatattacccaataattaacaactcgtaatcattgattataatccttgattactttcagatttccctataatattaaatgtttcctcattaaattccatcaaatacccctgccttcttctcactgaagaaaaggccagatggctaagccaatagtagtaagtggcccgtgaccgacgccgcctgtcactcctaattaatgtcaaacacgccacctgtcacttctaattagttatttttttcaattagacattaatatacatcttctaggtagcgctaattgcaggcatg

SEQ ID NO: 111103 - DNA, 105 bp, Heterodera glycines
  Promoter: Source sequence=SeqID_7787; Location=21..125; Strand=+; Gene=SeqID_65961
ttcaaatttccgtctgtccgttcacctttctgattttgatcagcctcctgataattctttctgacaaacctcaggtgatcagttttatggttgtgatcaaaaatg

SEQ ID NO: 111104 - DNA, 420 bp, Heterodera glycines
  Promoter: Source sequence=SeqID_22836; Location=862..1281; Strand=-; Gene=SeqID_53543
ggtgatccaaatacccagaaagaaattatgggaacaccttttaaataatttatctgaagattttttgactaaaaaacctgaacatatcgcttataaattagctctttcacgtataaatagaaatttaatacaagaaggtaaatcgttatctgattttaaaaagttgcctcaagacacggtcatagattatgacgacattaaaaatataaattttgatgaagaaaaaaaaattgctgatgatttatacaaattaatgaatagtgatcaaagattaatctatgaaacaataaaaaaggtagtaacaggagagataaaacaaaaattaatttatattgatggacctggcggaacaggtaaatcatttacactaaatgcgctttatcatttaattcgtggtaataaaaacaaataacaaacatg

SEQ ID NO: 111105 - DNA, 1003 bp, Heterodera glycines
  Promoter: Source sequence=SeqID_14093; Location=2682..3684; Strand=-; Gene=SeqID_78069
atttggccattcccacaatattatcattaaaatgaaggcaattttaatagtaggcgggccctcaacatcattccattgcttcatttacaaaaatagtttccaattggattttgtgggtttttgggtcgtgccaacgaaaagtgccgccctcggttcgagaagtgaagacagacggacgattgatgggtcaaaatcacgctaggccacgtcgcataataattgcgcgagttaattaatgactgactgggcttgacgtgtcctcaggcaaatggcacttttttgggcgccaattgtttctttttggcgtctacatatgacaaactcacaaatcagtacagtcattatcgagaatctcgtttttggcattcagtgccaaatttaaaccctccttccccgcagtttctttctgttttccctcttaatttgtccaacaaatgaaattcttttctctccgtcagcccaaaagtcccctccatttaagcatctttcgtcccttccgatgcttattctgttccttgcgctgctcatgaagacaatgttcagcaacggctttgttgtccaacagcaacaacagaattttaaggtatttgttttataaagagcgagtgcttgcgtgtgtttgtttggctcagtgggttgtcactttggttctcacttctaccctttggatcggttcaattcctttgctttgttgaatattttcgttaatttattgtcgtgcgctgtgatgagataaacgagtgaacgtacgcagtttccattcgaactaatccatgtggacctttgtcatttctgagcgcacattttttacaatttaattattttttttgcccatttaaacaattaggaccttaatggatttgctgacaatgacaaacaattgccgcctttacccgctgttcaattggtccgttcgcctgccaattcactcgacgcttcccaccgattgctttttgaacgattgtcgtcggaggcaaaggatcgatttgcgcacaaacaaatg

SEQ ID NO: 111106 - DNA, 144 bp, Heterodera glycines
  Promoter: Source sequence=SeqID_36174; Location=649..792; Strand=-; Gene=SeqID_65563
aaatttgagattttcagtgcccttccatttaaatttaaatctcctgaatgacttaaatttttctattccaattttccttcacagattcttcgctgatctgttcaaagccaatttgcgtcttttgcactctgtgccgggccaatg

SEQ ID NO: 111107 - DNA, 77 bp, Heterodera glycines
  Promoter: Source sequence=SeqID_40428; Location=1..77; Strand=+; Gene= SeqID_68769
aaaaaatacagaatttatcagcgttcacctccacggctcccttccccacctcgcacgaaaccaaaaccaccaccatg

SEQ ID NO: 111108 - DNA, 795 bp, Heterodera glycines
  Promoter: Source sequence=SeqID_998; Location=2798..3592; Strand=+; Gene=SeqID_65663
ttttcgtattcagctattttgaagatattaaagatctttaaatactgaaactaaaaaatatcaaaatgtaggctattattacaaatgcgacaatctgagtaaactgccgagacaattttattccttttttcaacaaaaatttgactatatttagggctcggaacgggcaacatttttgaatttttctaaaaaaatacctatagtaaactgaattctcagccaaatttatgaagatatattttttagtggtacacacgacttatttttgactctatgttctatgtagaaacaggcgcaggataggatcatgcgcgcaattttgtgggatccaaagccgccgcaatctgcaggattctgcggggttaatccctcgggattccgtctcgaaacaaaaaaagttttttcaattatcagaacgccaaaattaaaagaaatattatttaaccttgtaaaagtgcaagagtcgatctcgaattatttcataaaataaaaagagttcgatcaaggttcaagggagtcaaattatgggcctttgtaaaatttcaagaaaatcggccgatgggaggtaaggtctggagtccccatgacttttattcaactaaagaaagaacagtaaaaaaaaaaatcatttttatacgtcgcaaacaaacaggaaaattcattcaagaaaattgcttagtttaataggaatttttttgtataaaagaaggaaatttagtcgatggcaatcattcacttactttattattctattgcgctattcttcttctgcaacacattaaacaacgacgcatg

SEQ ID NO: 111109 - DNA, 156 bp, Heterodera glycines
  Promoter: Source sequence=SeqID_965; Location=4501..4656; Strand=-; Gene=SeqID_65067
accataatgcgaagaaacttaaaaaaagtacataactttttgcgcagttacatcgacggcagtgtcatcgaatttctgcgccaaaatcggcaccttttcaaattggacatcattttgagcatttgtctgcttgaaggacaatgttgggaggtcatg

SEQ ID NO: 111110 - DNA, 89 bp, Heterodera glycines
  Promoter: Source sequence=SeqID_18514; Location=582..670; Strand=+; Gene=SeqID_47522
ggtgttgtgagcggcgatggatcgaatggatgctttttccggatttccctgttataatttccctccccccatttcaggtggccgaaatg

SEQ ID NO: 111111 - DNA, 603 bp, Heterodera glycines
  Promoter: Source sequence=SeqID_28786; Location=449..1051; Strand=-; Gene=SeqID_59365
taaatttgtcagttcttagtactttcgcggtttttcaatttacaaaataaagggaattttaaggctccggcgttgccaatttttttaaaattatccattttgattaagaattattagggctattgaatgatatcaatcataaaaatttttcggttccaaaaatagttatgatgatttatcgaatttttgcaaaaaatcgaattatttagggggtccatttgagcgtttagacataccaaatagtggacataatatgaaatttaaaacccaccaaagaaaaatggtgattaaaaaaatatttaaaatgccgtataaaaacttttagcaaatttattcatataattcaaaataaacattgctaattgccactggtaaatgttgaacagcgacataattaaaaaagaaattaaatcgatgtccaatttatcatttatgtccaatttctacactgcaaaaaatttgattcaccatccaaattctaatgtttttgccagcagcgagcaaatttacttcggaaactgtaattatctttaaatttttgaaaatttaaatccaagtctttgaaaaattaaacttatgtttaacttcagaagaacagaaatg

SEQ ID NO: 111112 - DNA, 81 bp, Heterodera glycines
  Promoter: Source sequence=SeqID_23890; Location=1473..1553; Strand=-; Gene=SeqID_54582
tattattatatgtactacaatatatttatatctagttcatttcatcgttaatggactccgtcgttcgacaagcatggaatg

SEQ ID NO: 111113 - DNA, 53 bp, Heterodera glycines
  Promoter: Source sequence=SeqID_7467; Location=3751..3803; Strand=-; Gene=SeqID_64917
agtaaaacgcctgtttagctaaaacccggtaaattgatgtagcatggtcaatg

SEQ ID NO: 111114 - DNA, 246 bp, Heterodera glycines
  Promoter: Source sequence=SeqID_34484; Location=1..246; Strand=+; Gene=SeqID_64262
caattactaattaaattaaatggaatttgggttgcttcacccggatgaaatcccctttatgggcgacctatactgactttcactactgatgctgatcatgccaaaatttataccccccccccccgccactgtgcgcatttcatccgacccaacgcagtttatggacaaattttagttcaagaaatcactaaatttatccttataactagggctgcaaaaaatatggatataaaatcgcgaaatatg

SEQ ID NO: 111115 - DNA, 293 bp, Heterodera glycines
  Promoter: Source sequence=SeqID_15020; Location=1418..1710; Strand=-; Gene=SeqID_79181
ctttagaaaaaaatgcgatttttcttattagaccgagacttccggcctagaatttcgacaacggcaatttcgtctcttgaattttgtaattaaattaatttgaattttttatgatggaaaagtgatcaatcagcagaagaatttcgatcgcgcattaacacaaaggcataaacaatgtactaagtattaaaaaggaaaaacattaacgaatcggcggcggcgggaggcgagcggattattttgtcattttccattgtttatcgatccccaaatgagaaaaagggataaaaatg

SEQ ID NO: 111116 - DNA, 63 bp, Heterodera glycines
  Promoter: Source sequence=SeqID_790; Location=572..634; Strand=+; Gene=SeqID_61294
tgtatttattttattttaaacattattgtctaatgttctaactttttttttattttagtgatg

SEQ ID NO: 111117 - DNA, 758 bp, Heterodera glycines
  Promoter: Source sequence=SeqID_25788; Location=1..758; Strand=+; Gene=SeqID_56531
tgtaaaggaatttattcaaatcagccttctcccgacaattggtaaaaaataataatttgcgcaaaaattattttgttaatttaattatgaaaagctggaaaggaagacgtcaaatacgccaaaaagtgaaaaactgcgtgttgtgtttaatgctttcaaaatccagtaaataacattttcattgaataaataaatcatttaatttaaaatacataattttttcaaaagctgcaatgaatcattataacgtttggacttttaattatgaagaatattttcgttttctaaaactccttaaaaaaggtaattgaaattttgaagtctttttttaaattttgatgattttagcttttatgcataacattttcccaaatcgtttaacaaattgcaaaataagccaaaattgttgtcctcgaatcgccggacaataaatttaatcaattcaaaaattggcatttttgaaaaaaaacataataaattatgtaaacattcaatatctttcggcattgtttaaaccctttgaaaatgaaattgaagatttaaaaaaaaaagttattcacgttttaaatcccactttaataataaatttcaagctaatttataaaaatagcacaccattaatttaaagttattacaatttttttaaaaacgaaaaaatcaatgaaaattgaaaataaaatcacattttttgacaaataagcgatgcggcacatttttcggagaatggtcaaaagttggcacgttttatcagcgacatg

SEQ ID NO: 111118 - DNA, 277 bp, Heterodera glycines
  Promoter: Source sequence=SeqID_23001; Location=1..277; Strand=+; Gene=SeqID_53701
cagtgcggaaaaacggagagggggggcatttgcattggggtaccaaggtctgcggttgtttttttttaggaaaatcactgtcattttagggttccgattcactcgcagaaagggaaggtggttccgctgctccaaccgggactgtgaggcaactgcagcattgagtaaagaaggcggaactaatggtgtgctcggaagaaaagagcacaaccatctgccggacccagcgtgcttccacgcggaggtaaaacgcaacggaattaagacgacaacgatg

SEQ ID NO: 111119 - DNA, 469 bp, Heterodera glycines
  Promoter: Source sequence=SeqID_33660; Location=465..933; Strand=-; Gene=SeqID_63661
ggattttcaacttccatttagatacaagtaatttttttttgtttatcggtgtcctataattggataattgctttattcaatggtaggaagataggaatgtagatgactgggacttttgcaaaatttttgggtcctctaaactgcaaagaaccgataaattaaattatgcttaaataagggagaaaatggcgaaatgttttaatgtaaataaaaagttctgaaattaaaattttacatagaaaataaattgaaagtgatgcaaacaactttattatttattcacttgttgcaaacaaagactttatatttgaagaatgaaatgctattttttttcttgggctaaaagttaatttttgagcaaaccgaaacgccaaaagctgaagataaattactacaacttccgttaagattgtttatttacatacattttttattgctgtttcctttctctttcaaattcgtcacaatg

SEQ ID NO: 111120 - DNA, 192 bp, Heterodera glycines
  Promoter: Source sequence=SeqID_12830; Location=752..943; Strand=+; Gene=SeqID_76552
tctgaaaacaaacaaacaaatgttgacaatgtaatgaaaagtacaacaaataaaagatttgcggaatattgggatttttgtggcattatttttgttttactagtgtaataagagggtccgatgaaatttcaaatcgaaagggtccgtcttcgtgcggtttttcagttggacccactaaaataaaaaaaaatg

SEQ ID NO: 111121 - DNA, 242 bp, Heterodera glycines
  Promoter: Source sequence=SeqID_38423; Location=1..242; Strand=+; Gene=SeqID_67243
ttataaaattatgtatagaaaaatggatttttgttttactttaggagaaaaaaacattcttgggaaaaaataaattaaagaaaataactataattttgggaaatatagccctgcccttatttgtaaaaaccgtttttgtaattagttattttaaccgtacttgtattcaaggaccattccagccaccttttgacttgcttgtgatgggacaaaaatttttggattcggtgacgcaaattatg

SEQ ID NO: 111122 - DNA, 502 bp, Heterodera glycines
  Promoter: Source sequence=SeqID_13617; Location=3325..3826; Strand=-; Gene=SeqID_77522
aagcccagtttttgaaaaagaattgctagattgaaagctcggcgtaaatttgaagagaaaaaaaagtgtttttggtaattatccatattttggctgtgaccgcaaatgtccgaaaatagcccttaagaaatgggccgcaaaagtcggaccgcaaatgtcgagacacgaaaattttgggaggggcaaccgaagagttttttcaggccagaattgtttagatttcagcgccatagaaaaaaaacggaaaattatggccatttgagacctattttggaaaaatataaaatatgggaaaatttggacccgccgccggtgccgttaggtgccgccggggaaaatttagagtcaattttttcaagaaaattgactaaaatttaaacacgtatccgaatttttctctgattgtgagtacccgcctataaattattcagggcaatgcgttggttccgatgcttttttgaaattaatttttaggttcaacaatggctggttggtcaaaatg

SEQ ID NO: 111123 - DNA, 92 bp, Heterodera glycines
  Promoter: Source sequence=SeqID_6000; Location=122..213; Strand=+; Gene=SeqID_59975
ttggccgagagggtggccgaaaaaatggcggtaattcggacgatggacggcattttgtgaccgcattttagaagtttttgagcagccaaatg

SEQ ID NO: 111124 - DNA, 65 bp, Heterodera glycines
  Promoter: Source sequence=SeqID_24880; Location=1191..1255; Strand=-; Gene=SeqID_45892
agtcagtggacaaattcacagaaaaaacgattagttttgaaattttttaggtacgaaagcaaatg

SEQ ID NO: 111125 - DNA, 525 bp, Heterodera glycines
  Promoter: Source sequence=SeqID_7568; Location=1..525; Strand=+; Gene= SeqID_65252
tcccggttttgaccgggaccgggaccagtcccggcccccccacgggttttcccagccaaaaattcccggtttttcaacttgaaaaggtcccggtcccggttaagcccaaaattcccggtcccgctctactctaatttatatgtataaaaagcttaaattaggtttatttttactttatttttttctttttctttccctattttatacgccacatttcacagttaattaagacaacaatttttattgttaaaattcttctgatttgcaatttttttttatcgttgagaaattcgatggatcggatgaaacatttgttgagcagcacgggtgagcattcggatgtgcactttttggtgggggacggagacgaaaaagaggcgagttaaattcttttttttttttaattttttttttaattttcaatttaaattttaaatttttaaattaccctttttatatttaatttcaattatgtaattttccacatttttaaagattttaccagcacataaacacattttgatg

SEQ ID NO: 111126 - DNA, 280 bp, Heterodera glycines
  Promoter: Source sequence=SeqID_1439; Location=1..280; Strand=+; Gene= SeqID_73550
tttttttttaaatttctcttaaaacattgttttgtgttttcgggattgttaactttagacaaaagccgtttcaaaaccaaaaaatggtcattctgtaaagatacgaacaaaaaaagaattttgataattttgaattttcgattttttgttcgagttcggatccggtattcgaaattggtcaaaatgaatggcagattcgtgatcagcaatcccgaaaacactaaaaacaatgttttaagagaaactttaaaaaaatttaaaatttagatctcgaaaaatg

SEQ ID NO: 111127 - DNA, 237 bp, Heterodera glycines
  Promoter: Source sequence=SeqID_3279; Location=2508..2744; Strand=-; Gene=SeqID_47575
ttcctttccctctctcttctctctctctctttcttgctcaccactccattcatccacttcaaatggactaagcgggggtgggggacagagtcatggcatggccctgtgccctccccccccccccccgggggattctccgctggccactgacccttccgtcgttttcatccgctcatatgaattcctggaatattattattatagtaaaacttctgaattcgtctaatttgcagcatg

SEQ ID NO: 111128 - DNA, 126 bp, Heterodera glycines
  Promoter: Source sequence=SeqID_31655; Location=1273..1398; Strand=-; Gene=SeqID_61971
agtgactaaaagaggtaaacagtgattagaagaggtacaacagtgattagaagaggtacaacagtgatcagaagaggtacagctgagattaacagaggtccacctgtgcttaggagaggtacaatg

SEQ ID NO: 111129 - DNA, 1003 bp, Heterodera glycines
  Promoter: Source sequence=SeqID_3982; Location=1123..2125; Strand=-; Gene=SeqID_52686
ttcataaaattttgttaaactcaaatttatttttaaaaaaattcttgaatttttgcttgggacggagttggccttttttgtattgggacggagttggcgggacggagttggctgggacggagttggctcgggacggagttggcctgggacggagttggctcgggacggagttggcctgggacggagttggcgggacggagttggctgggacggagttggcgggacggagttggcgggacggagttgacccgcttcgtgaaatagtgcacttgccaatgagctgctacatttcttttataaaatcctctttagcaaatattgacattttttaaatcaaacattttctcatgaaaaaaaaaaatttgggggaagaatttttgagaaaatttccaatgcttagtggtgtttttaaaaattttcggtcgattcttaggggtgtatttttctgaattttttagggccgattcttaggggtttccgttttattgattttttttaacaaattttccaaaaaatggcaaaatatgcaaaaaatctgaaaatatgtacaaaaaatgtcaaaatatgcatgaaatatgcaggaaaacccctaaatatgcaaatatgcacaaaaatcccgaaatatgcaaaaatatgcaaataaaagtcccgatttttatactcaaacataaaaaagaaagtgtttttctgctatttagagcatggagaagccaggaaaaaaatatgcatttgcatgttttttgcagccctgctaattataataaacttcggtctgctatcctccatttgtattttttcagctttctctgttagaaaaagcacgaattgagttggcttcattattttcaataaattcactttattgggttctcttgcgatgcaaaggtcttgacccaaatgaagatgccgatctgtcagcagaactggcaagttttctatattgtctttattattttcatgaagaaaattgaaagtactttagaagcgaattaaagaatatatg

SEQ ID NO: 111130 - DNA, 127 bp, Heterodera glycines
  Promoter: Source sequence=SeqID_24212; Location=749..875; Strand=+; Gene=SeqID_54925
tgtgaacaaattatattaaaaaaaatgatcattaattcaacagcaaaaattaaaaaatccacaaaaaaaaattgtcaattaaattaaattaatatttggtttaattaattattgaattttggtaatg

SEQ ID NO: 111131 - DNA, 1003 bp, Heterodera glycines
  Promoter: Source sequence=SeqID_12565; Location=2196..3198; Strand=+; Gene=SeqID_76227
ttttgattataatacatacgaaaaaaatctgatttgatttttgatatttgtttgaatgaaaaaaatgttttgtatagtaaaaagagaatgaacaagcctttaatggattgaaagaaagcaatgtaaatctacatctcaaattttcctgttcgggtggataattatatgcagttgggatatattacgtgccgcttgctgaatgaccgcttgctgaatgaaatttatatggaatattttaaattaacgtttacaggtcagtttttgttttgaatttgggggtgggtgcaataacgattctcttttatatgtttttttaaaaaaaacccctcccccatctgcaaactattaacttaattactgctttttttgagcgaaaaaagaaaaagttgaaatgcttcttttttttgtttttgtgtacattcttttattctcaaagtttgtttcaaggtttaaaatatctaccgctgatttttgtaatgaatttaagacctagaattggaattcagatttgattgtgtttgtaaatgctaatgaattgtttgtgaaaaaagtcacatttaatttttttaaatatgaatttaattgtttggttatcagcagaaatttttgtttatgttatgattaattgaaaacgaattgttagtaaatgaaagttttgttgtttgatatgtatcatgttgtgctgattcaagttgcaatttttttacaaatggatgttttacgatatcgaagccaatctacaaaatgtgatgtttttgaaaattttaaaaattaacgggataacaggtcagtttgattttttctctttttattgagagataatttgaccttgcattatttttgacccactcatttttatttttaatcattttattaaataaatattcacacttgcttgaatatgttgtttggttcacatttatatatttgttattttgtaaatgattttgttatgtaatgttctttcaggtttaaactttctactgcctcctttgttataatg

SEQ ID NO: 111132 - DNA, 174 bp, Heterodera glycines
  Promoter: Source sequence=SeqID_7906; Location=2171..2344; Strand=-; Gene=SeqID_46500
tgccaaaaccgaatgtgtttattcaaattggcatttggcgcgttgggaagccacgcccatacaaaaaaagaaagaaaaaatccttttaatcactccgatttacccattcccttactttctccattctcaaagttctttgctgtttcgctttttgctctccaaccaacaaaaatg

SEQ ID NO: 111133 - DNA, 94 bp, Heterodera glycines; identical to SEQ ID NO: 97954
  Promoter: Source sequence=SeqID_37456; Location=352..445; Strand=-; Gene=SeqID_66526

SEQ ID NO: 111134 - DNA, 214 bp, Heterodera glycines
  Promoter: Source sequence=SeqID_5463; Location=4672..4885; Strand=-; Gene=SeqID_58147
ggtggaccagaaaatgcactaaaacggatcttccattttatcaaaaaaaagaaaattcaaatgtccgtaaaacggtttgggaacggcgataattttagtgttaattttttctgtttttattcaaaggctggtcattatcctccatattaacgagtgtttctatagtataagtttgggttgaatatgatttagagtttttgtttcgtaggcaatg

SEQ ID NO: 111135 - DNA, 189 bp, Heterodera glycines
  Promoter: Source sequence=SeqID_10501; Location=1737..1925; Strand=-; Gene=SeqID_73725
ttgggagcccagccgcttcatcgaccaaaggaaacgacctttttttgttcacagagggatcggacaattcagtgctgtgctccatcctccaatggaaggccatgccattggagatcaactactcgacgcgtatattttaagtgcccacgtccctccgcaattaccacactaattagcggggaaattatg

SEQ ID NO: 111136 - DNA, 423 bp, Heterodera glycines
  Promoter: Source sequence=SeqID_19065; Location=495..917; Strand=-; Gene=SeqID_83810
ggattgagcatctgatcgaaattttgtttaacacgcgaatatttaggtaacacatttaatttaattaatcatactaatagatggtatacggtatgaaagtaattaatattttttatacggtaaggaatttaataaagtattttcttttaacaaagaatacggtatcgagcggattggtgaattcgaatttaaattttaaattaattcatttaaatatttttgtttatcataacaatattgaggtagcaaatttaaatcatttactataataatagtttctatatatggttaggaatttaataaccgtatttagttttaacaaagaatacggtacagagttgagcaatgagctaaatgttaatttaatttttttttgttttacatgcgaacattgaggtagcaaatttaaatgaatttgccatg

SEQ ID NO: 111137 - DNA, 165 bp, Heterodera glycines
  misc_feature (35)..(35): n is a, c, g, or t
  misc_feature (39)..(40): n is a, c, g, or t
  misc_feature (80)..(81): n is a, c, g, or t
  misc_feature (96)..(96): n is a, c, g, or t
  misc_feature (140)..(140): n is a, c, g, or t
  Promoter: Source sequence=SeqID_44436; Location=958..1122; Strand=-; Gene=SeqID_71924
agacaatgagcgcaaaaagttcaaatttttgctcnaatnntaatttcttcaaaaattgctttccagtttttttggtctcnnggaaagaatttcatntgctaaattaccaggaatttgaataattaaattgggttttgctntaatgaatatccttttttaccgatg

SEQ ID NO: 111138 - DNA, 964 bp, Heterodera glycines
  Promoter: Source sequence=SeqID_14675; Location=635..1598; Strand=-; Gene=SeqID_78784
gttattttattttatcaatcatgaattttttttttttggatcgactcagcatggcttttgacaatcatttcctttgaaataatggaaattaacgccacaattttcggcgtttcctaaatatcaatctagacaaaaaaaaacaacaaaaattagtgttgaaatcattaagaatagggtaggacctcgacctttcagggtgcggagcttcggggtcggagttgggggtataccccgaaaaacaaattttcggagtccggttccctgcactaattagtattttgggagttttaattcagccttattttcaacctccttcgaaagggaggctttatttcagggggggaggagggtgtggtttatttttcaaccccctcgaaatgagagctttatttcaggggattttttttaaaaaatttaaaaattagggaagcaatctgaattgtccacatgttttgaatttcgtctggtgcctaacagttgcaataccatccatcagctggcgaaattcgaattttattttattcgaattttattttattctcgtttttatgtatacaatcaaatagcatatattttagataaagctaaatatttgcttattgattttttgattttataattgtatacaatgaaaaatttcttgcaaatttgtaaaattttctgaagaataaaataatgccctttttcatatgattattgttagtgtttgttatccacgcgaaaatcgttatccttttttttattaaacattaaatttatttgctaatgtcatttttttattaatattctttaaatgtgccctagacaggagtttggagccttgcaaaaggtggctaaaaatttttctagaaaaattatgaaatgcactctatataagagccaatgaaatttacatttatataatatgtttatttttttaaaaagcaaaataagttaaaataaatattatctttttgttactatg

SEQ ID NO: 111139 - DNA, 1003 bp, Heterodera glycines
  misc_feature (565)..(565): n is a, c, g, or t
  Promoter: Source sequence=SeqID_17015; Location=709..1711; Strand=-; Gene=SeqID_81436
gctatcctctataccacagggatgcgattgaaaatttttctaaatcagaacagcaggctcaaaaaatcagattttagggtcgaaaatcagaacgtttgcgaaattgcgtcaaaacggttatttttacaatttattcgatcaaaaatgtattaatattatattttccacctcccataatcgattttaacaatttttggggagaaataagcaaattctaaatttcagtgcattcgggatcaaaaacgagatttataacaattttttgcggcgcatttttccaaaaaacttttggtgaatgagcgaggggagggggtccggcggtgtcgataggcgccgccgggaaaattttttaaatttttaatgcgatttgttaacagattttcatcaaaaaagcccaatttttggaattaaaagccaaatgacgactttttttcgctttaaaaaacgcttttttacggcgcgcttattccaaaaattttgggggcgccgatagggggaacgggtcgtttcggcgccgccgtttcggcgccagggtcgtttcggcgccaaaaatcagaaacgcagnaatagtaaaaaaaattttgttttgtttcaaaaaatgaagtcaataaaataatagtctatattaaatttaatttctccattttcacgttcattttttgtgatcttgcataattttgtcgttaatgtttaggtgaaatgaatcgccaaattgatactaaaaggcaaaagtctaaaatcacgcatgaagggcacctttacacttttgataaagcaagtgcggacgggatgacaaaattttggagatgcgaattcaaggacctgtgcaagggaagaatctggacgaatttggctgatcaattcatacgtttggcgactccgcatacgtgtcctgcaaatgcatcaagcgttgaggtgcaaaaagtcaagacggcaataaaacggcgtgcgctcgccacatatgaaccgccagcagtgatccgttccgaggcacttcaaaatg

SEQ ID NO: 111140 - DNA, 395 bp, Heterodera glycines
  Promoter: Source sequence=SeqID_34903; Location=1..395; Strand=+; Gene=SeqID_64590
atcccttataatcttagacgtaaagttgtgttaaaacctaatccagtaaaacttcaaattcttttatcaacagaacggccttaatatggtctaaactcaacaaagatataacagatgctccatctgttgacagtttcaaaaaacgaataaataaatggattgagttaaacaaaaatttagtctgtaaaagagctccttggacttgatattactttactaaaatctaacgtgtaagtggtcaccccttcgttggatatttttatttcttctgaataaataaataaatatgtttataaatttattttaaaagttattgaaggcaaccatttcgaccgtctcagaacctcggatttttttgtcagattcggaccctgggtttggaattagtcggaatg

SEQ ID NO: 111141 - DNA, 1003 bp, Heterodera glycines
  Promoter: Source sequence=SeqID_10853; Location=353..1355; Strand=-; Gene=SeqID_74128
aatctcaaaatatggacataaaatggcaaaaatatggacataaatttttctaaattgaggggtaaattttcaaaaaaacccgaccaaaaaaccgaaattttccattttttgcttatctttcacataaattaaccaatttttaggaaaatttaaatttattcaatattctcgagaaattttggcgaaaaaatgattttttgaaaaatttttcgggttttgggctcaaaaaggctaatttagctgctgggggccgttctaatagaggttttttttgggaaaatgccaaaatatggacataaatcgcaaaatatggaaaatatggatatagaaatccatcttagcttcaaaccaagctaaaaacatgtttttcgtgcgtttcaggcctcccacattccaggaaaaaaatatggatttccatataattaccatccctaatcataacgtttgccaattttcaaaatttgaaaagggcggatttaacctttacaaatgaaaaattatccgtcaaattgatttatttgattgatttgttggtggagggtagggtaaaacgcccggcaaatggtcataattttgcaaaatattctcctgtttgatgggtcctcttatgttgcgttccctttttcttcctcttccaatcggtcattttatgccaaaatgtttccttcacttccgtttttgtcaatgatttttcgtttcccatttaaacattgtccaaccccatttaaggcaaaaaacttcaaaaattgttttaataaaatgtgattttcgtgtttctttcatcaagtacaatccgtaaaaaataggaaaaatctaaaaaaatcagagctctctctattcatatacaaaaaatattcaccaattcccttttcatgactataaaaatcttttgttttccgctttgactcattaaaaaaataaagtttccaacgaattattattctgttcttttgtttgacatcattcagaatttggccaaattgtgctaattgcctcaaaaatg

SEQ ID NO: 111142 - DNA, 399 bp, Heterodera glycines
  Promoter: Source sequence=SeqID_8622; Location=1510..1908; Strand=-; Gene=SeqID_68701
aaagtgacaccaactccatttgttctcccaaatgaaccaaatgaagaaagtcccaccactgtcgttacaaaaagggaaatcccggatgacgaagagtcggaaaaactttggaaggaagaaaatcttgaccacgaaaattctcgtcttaattatttgggatggaagacacatcggacaaaaatccaaaatgcgcgagagaaatggatgagcgactgtcacgaacgaaataatgcactttccatcgcaaaggcattagcacgtcagatgccggaagatgcagcccgctctctttacaaaagggatgacataacggcattttggaccagatcatcacaacttgatcaaaaatggtcaattgctgtaatggctgatcgaaaatagctatgggagctgaaaatg

SEQ ID NO: 111143 - DNA, 195 bp, Heterodera glycines
  Promoter: Source sequence=SeqID_13242; Location=2023..2217; Strand=-; Gene=SeqID_77071
acaaatttgttaaaatttacaacaacaaaaaaattcaccgccagactacaagattttttaaaaatttgacccaaaaatgcttaaaattgatcaatttatgtaaaaatctaaacagtgatttttttcaactctatgcctacgtttttgaaaattaacatttgctctaaaaagcataaaaaatgaccgttgacaatg

SEQ ID NO: 111144 - DNA, 214 bp, Heterodera glycines
  Promoter: Source sequence=SeqID_22033; Location=1366..1579; Strand=-; Gene=SeqID_52669
attaattaattattgttcgattgtccaaagcctagctaatatatatgtaaatgtgttttgtttgttatttaccaaaattaagttccattatgtggttgttttattttcatgctttgtcgattaataataaatttttggtttctcatttatcgcattttatttttgtgaaatttttgcgaataaatttaaattttaaaatatttcaattcagatg

SEQ ID NO: 111145 - DNA, 138 bp, Heterodera glycines
  Promoter: Source sequence=SeqID_34079; Location=401..538; Strand=-; Gene=SeqID_63960
tgcttcacaacacggtgatagaggtcattgaccgtgtgtgcaaagtttcaaaagtctccgttgtttggtcaattcaccacgattaaattgaccatcaaccagagactgggccaaggtcagcaagcgtacttgcaaatg

SEQ ID NO: 111146 - DNA, 590 bp, Heterodera glycines
  misc_feature (49)..(49): n is a, c, g, or t
  misc_feature (82)..(82): n is a, c, g, or t
  misc_feature (85)..(85): n is a, c, g, or t
  misc_feature (93)..(93): n is a, c, g, or t
  misc_feature (120)..(120): n is a, c, g, or t
  misc_feature (131)..(131): n is a, c, g, or t
  Promoter: Source sequence=SeqID_21065; Location=1505..2094; Strand=-; Gene=SeqID_51655
ctcaattataaattaattttaaaaatttcgcccttattaatttcaattntaaatgaatttttaaataatgttatgacgcatntanaatatatntagattttaattcagagaaattaattnaaaaatatatntagccaagttcaagcaataaaagagccaaaaatgaacattatcaggaaaacgatgtaaaagcatattttgggctttcaatttttcaaacgatttaaaattttttaattttaattctattaaaaatattatatatatataaattaatttttattttaactaaaattaaatatttatgtatttgataaaagaagaattatattttgggcttttcttttttaaatgattaaagaataattatatttaaatttaactgaaaacgagtaaaaagattattttaaattttattcaattaaaaataaattatttaaaaatatgtctagccaacttcaagctataaaagatcaaaaaatcaccaaacatcaaaaaatgaatttattcaacaaattgattcgctgctggaagcaaaagaaaatcttacacaaatttacatggacaattggtacgttgtggacgacatg

SEQ ID NO: 111147 - DNA, 1003 bp, Heterodera glycines
  Promoter: Source sequence=SeqID_20028; Location=411..1413; Strand=-; Gene=SeqID_84802
aaaactaccagaatataagtttaaaacctccaaaaattctaaaatattaatatttattcaatatttgcttaaataaatttaaaaaaaaatttaaacttattttttggttgtccgatgtataaactcctccagggaattcgaattaaggcttaacacgattttgaaattttggcatttcagaagcgatttgtccaaatttgcaaaagttcgaaaaaaattctcatttcaaaaaaagataaaataacaaaaaatagttaaaatattgattaaaaagccaaaaaagacgcaagtttttcttgtttatgggggtgtgtttaaaaaaaattccataaggttgatccttcttgatgtattttttcgcttttttgcatttttattgtcaaaatttcctaaaatgaccgaaatatgggatttattcccctaacccccccccccccccccatattatggatttatatggaataaaaccaaaaatttaccttctgatgatgattgtaattaaaacgaaagttttttgagtaactgaacactattaattaataattaaataaattcgttttgggcatcatattcaaatatggaattatttattcgaacaatgagtaccattgtaacgaaattctcctaattattttatgagccaaaagtgtcattttcaaatgcatttttggccattgtcctgctgattagccgtggccgtttaaaaataatgaaattggacaaaaaataataaaattaatttagaattgatttcaatttaacaaaatcaaaacaattaaggcattatattttgccgtgtcattttacaaaaatttaaaaagatgaaaccgcggaaattaaacctactgttatgttaaatttttttgtcaagaattttttagtacaaaggattttaggcatatcaaaatgcgtcagcgcctcgaggattggcactcataataaacaatgagttgttcgacgactcgcagaaaaaccggcacggctccaatgcgatgccaggatg

SEQ ID NO: 111148 - DNA, 1003 bp, Heterodera glycines
  Promoter: Source sequence=SeqID_4329; Location=470..1472; Strand=+; Gene=SeqID_54075
aagatcaaattaatagtgacaatggaagacaaagacggaatgaaatgacgaaaatttaaagtgtcaaaatgctttttatgccgcccaatcaagcactcccaaaaaaaggtgcaggatatagtccgaaacttggctaaaattcaaaatcggtcccaaatttttttcgagcgacccggagtatgaaagtgcgaacttgacatttttgcatgccacccatttttattatatgtacgtctgacaatttcatagttgctctataaagtcaattttcgtggtccatttgcgctgacaaagctatcggcgccgccgaaccctaaaaatcttatgttttcttaaaaaataactcaaaaaaccacaaaattttgacagtttttctacaatgttatgggagttgaaaaatacaaaattgggtgtattttgaaaaacggtaatactggagaatctgggctccatcgcgtaaaaatttatgatcgtctcttaataaagttcaaaatgcataaaacaaggagagtattttattgagcattatacatacatacagagtacatataaaaaacacacattccattgtacaaatacataagcatatacagaaaacagccgaacaatgggatacaaatatgatcacaacaataaagaattttttataaatttgaaaaaatttttatttggggcccaaacgtggggggtccaatcgtgagggccgaactgacgtagaccgggacaaatcactatttatcctacggatcatgattcgggcgcccattcgccaaacttcttgaaagatctgatttaaaattgttgatttctttctttgccacctcggctaaaaagtgaccaattgtttgtttatttcatattatttctttattttcggcgtcaagcttttgcgtataaatgattgattcattaaatttataaacattatattattctgtttacatacataattcaattccgtgaaattgcatccaaatgccaacaatcaaaacatacaataatg

SEQ ID NO: 111149 - DNA, 99 bp, Heterodera glycines
  misc_feature (19)..(19): n is a, c, g, or t
  Promoter: Source sequence=SeqID_9499; Location=4126..4224; Strand=-; Gene=SeqID_71647
taaaagaaaaaataataanaataattaatttttttagattaattaatcgccacgatacccaaaaataaaatacaagaaaaaaaaattgaaaatataatg

SEQ ID NO: 111150 - DNA, 400 bp, Heterodera glycines
  Promoter: Source sequence=SeqID_17704; Location=2792..3191; Strand=+; Gene=SeqID_82238
actgggaatgggatgatttaaaaaattatttattttttatttttttcaacatttaaaacggatttaatttaattgaaattttggctaaaacaatttttaatcttaaaatattattataaattcgtttttttaaataaatttaaattaattatcaaaaaatttaaataaataaattaaataattttttattaaaaataattatttttgaacactaaatttattcttaaaataatgatttttcaaaaataatagaaaataatattttaaaaataaattattttcctttttgctttaaaatttaattaaaaataaattatttaaattaaaatttaatataataaataatttaataatttaattaaaaatattttttttcaaccctaaaattattcagaaaatg

SEQ ID NO: 111151 - DNA, 66 bp, Heterodera glycines
  misc_feature (40)..(40): n is a, c, g, or t
  misc_feature (49)..(49): n is a, c, g, or t
  Promoter: Source sequence=SeqID_10461; Location=1..66; Strand=+; Gene= SeqID_73663
aaattaagattatttttataattaattttaaagcatttcnaattttatntagttaaataaaaaatg

SEQ ID NO: 111152 - DNA, 497 bp, Heterodera glycines
  Promoter: Source sequence=SeqID_7096; Location=1730..2226; Strand=+; Gene=SeqID_63826
taaatcctattaaaaagaaaaaataatctaattttttaaatgttagcataattaataataaaatcagcattaaacggtgcagaatttttttctctatagatatgcaaagtttgaaaaggattgttttggtaattgtctaatcgtgaagcagtagcttagaaaaagcttctaaacatgttaagctttcgaatgtatcaaaaatgttggatttggatgacattgaaaaaagttatagaaagctttcgtggaaaaacatgctggcgcccaacgagcgcgcccaaacgcagtggacccgggcttgccccaaggggacccacgcgtttcggcgcccgcgtttcggcgctcgcgtttcggcgccgcgtttcggcgctcgcgtttcggcgccagctcgtttcggcgcccgcgtttcggcgccaaacaaaaatataaaaattcaaatatttggttaaaatcaacaaaaataaaacttttttagttaatcaatttcatcgaatatg

SEQ ID NO: 111153 - DNA, 773 bp, Heterodera glycines
  Promoter: Source sequence=SeqID_16577; Location=1570..2342; Strand=+; Gene=SeqID_80985
aacgacgagacgtctcgaaggaggagagggattgcggtgtctgcatttcggtcttttttatttttgtttttggcatttttgcattgacccattttccaccaattctcatcgtaaacattttatccatccacatctctcaatccttaccaaatccttctctcaaaaaaattctctctccgctttgtgtaatgtggcctagaccattctcacccgcttggcttcgcttgactcctcccaaaattgtgccgtatttaagctctctttctgctttggatttcacccttcttactgccattctcccttcctacttactctccctttgcttactcttaaccaattttgctataaccaattttgcttattcttactcttaaacgattttgctttgctttaataactgttttgctttaataaaacctcaaaaaaaaagtcgaggaaaaaaagagattgaattgggtcaaatttggaaaggttgtcagaactgagaaaagtgcgtttgcctgaaactcgtggggacacaacaatttttggtgccacgacccgggaagaggagaagcacgggttaaaccaggcgctgaacaaaattcagcaggggtaaaggctcggtgccattaccaaaacaatctctgtgagctggtctagttgtgtactaccagccgggctgttgtgcaaaatacaaaaaataaattttgagctggtcaagtgtgttttccagccgagctgttgtgctaatttttaattttcaaaaaaaaaccaaaaagtgaatcaaaatg

SEQ ID NO: 111154 - DNA, 151 bp, Heterodera glycines
  Promoter: Source sequence=SeqID_4152; Location=3156..3306; Strand=-; Gene=SeqID_53382
ggattcagacctggatttttcctggacctggattttcctggatttttgtccaggaaatccaggtcagtttggaaatccaggtccaggcatgaaaaacctggacatgttaatttaaaattctttattttattctttattttaggcactaatg

SEQ ID NO: 111155 - DNA, 748 bp, Heterodera glycines
  Promoter: Source sequence=SeqID_1379; Location=1..748; Strand=+; Gene= SeqID_73141
ttgttttgataggatttagttatgttaaattgaaccttcagatagaaggtcttcaaatggctttgaaattacaccaaagtctttgcacaattttgccattgaacatatctggctgttacagctgttcaaccggagcacaatttaagtatgtgtgctcaacaaattttggcaatgcatttgctgaaattacatgcgacgatggaacacatttttccacaaaatgtgattccaacgccacaatttaccaaacaattttggctttcgataaagccagaattcaaactaagtgccaaacaaaatgtttggcaggaaaaacatcatttgaaattgctggaacattgcattatgtccagtatcaacaattggaagattttaattctaatctttccaaaaaacaaatcggccattcaaattggctgaattggaattttgattggaaggccacactttggtccttaattggcctccaatcatccttacattcttaatgattattggtgtaggcattatttgcctcatcattttcattaaaatttcacccttctataggctttggaaattaatttcctggtctctgatgagaagggactacggtacattaaatacagcaataatgatactgtatttggcggggggaggatcctttggatatgatgatgagtcacgtccgatcagtcctatccccgcccacattctgaaaaatcctataaataggatagaatttgactccaacacatcattcacaatg

SEQ ID NO: 111156 - DNA, 127 bp, Heterodera glycines
  Promoter: Source sequence=SeqID_14915; Location=1343..1469; Strand=-; Gene=SeqID_79079
tcatcatttatgcaaagttcctttatacacgaattagtttattaagggacgggatttatacccaaattggcaatgttgacaaccagaattcgaggtcttcttgactccaaatgtgagggtctttatg

SEQ ID NO: 111157 - DNA, 101 bp, Heterodera glycines
  Promoter: Source sequence=SeqID_5292; Location=1934..2034; Strand=-; Gene=SeqID_57584
aattatcccgtccaggtcgacttcattgtttcttttaacctttgcattttctactaattcagttgctctacgaaaagggcgccctctccgccccctcaatg

SEQ ID NO: 111158 - DNA, 296 bp, Heterodera glycines
  Promoter: Source sequence=SeqID_17213; Location=369..664; Strand=+; Gene=SeqID_47424
agtgcgttcatttatttaaataatcttttagaatttttattgtacttatataatgattaatataaatattactttatttttaagtatttttttaaaattaatgccaaatgttgtctcaaaatgaatacaattttctgttaacattataaattcaaagctttaaaataataaaattctaatttttcattttaacagcataaattcatagttttcaattaaaaaaattttactttaattttttattttaattaattaattttacttaaatgatttattaattattttctcaggcaatg

SEQ ID NO: 111159 - DNA, 636 bp, Heterodera glycines
  Promoter: Source sequence=SeqID_3131; Location=2232..2867; Strand=+; Gene=SeqID_83334
agatgtatgggataccattttttgacgatcctttttgttgttgatgtaatgcgttatcattaaaattttgttggaaccaattagaaaatccacaaaagtcatttccttaagaaatcatgaaaaacgccaaaaacatggatccgtaaaatggtaatgtaaaaccaggctaaagagggcaaaaaaaaaattgtttgaattaatttggctttatgtttatttgaaaataattaaggtaaacaaatttaatttcgtaattaggggtacctaattgaaatctcgatttggataaacatatggggaaacgaaagccacgtttaaattttaaacgtaatggtattctcacgcaaaaataaagccttgtgattcctttcttgttcgaacgttttattgctgatagaacttcgctttcaattgatgaaaaaattgattattcatcattttttataagcaacggtttgtgtttgtgtcatccatttattgccccatccatttgttatcaattcgtgggtattattccccatttaatttttgttgtttgcaatatttgaattttatctaaacaagattggttttttaaatttaattatggtatatgaatgattatttacagaaaaaaaaattaacttatgcgatatg

SEQ ID NO: 111160 - DNA, 689 bp, Heterodera glycines
  misc_feature (300)..(300): n is a, c, g, or t
  Promoter: Source sequence=SeqID_35046; Location=714..1402; Strand=-; Gene=SeqID_64703
tggtactgcttgcatttgctgcagttcatctactggccatcactgttgtcattgtgattcggtaattgaatggtagagcaaatttttttttataaatttcatagttaaaaaattcaaagtttattttttatgagaatccattcgaaaacatagccctttctattagaagagagtaaatttcttgaaatatctctaaagtctttaaaattaattaaaaaattttaaacataaatttataagaagtatagttatgtatgaatagggacgctacttttttcataaattcttaggacctgaaanctacagaactctgcaataaaatgttaaaagcacacctagaaatgattttttaattttcaaaaaaattttgccctctaaaaattggcaccttttcaaaaaaaaattattaatttaccaaataattttatacaattttattttgaaaatttttgattttattatcacttttcatcttagctattttgctgggtttcgggtctaaaaattccattcctatcgacaaaatcctaatgtccacacataaagaatttcaaattaaataaataaattttccggctgtcagacggcgaaaacagcgcttgaattgccaacagaacacgccgacgatccgcagcatgttcatcaatgccatgtcgttcggtgctgcggggagacaaatcccaagcatg

SEQ ID NO: 111161 - DNA, 1003 bp, Heterodera glycines
  Promoter: Source sequence=SeqID_9335; Location=2202..3204; Strand=-; Gene=SeqID_71041
ataacgcctaatgacatgtttttggaagattttgggtgaaaaaatttttccactcaaaaatactggtcacccccctttggtcccgaatcccaaaatcacttttatttttatatctttttttaaaaatgtgataaaaaggtcaaataaaattctctttatagagaaaaaaattgcggattatatgaatatttaaatattctttagcgccttttttgaaatgagttataaatttatttctgaaaatttaaaatttttgagaaatccaggcctaagtttgtgaatttttaaaatatggaaactcaaaaaataacttaaaattctccatatttttctcgatttttattgctttaaatgagctgaattggacaattttgaggcgagttatgaatttttaaaatttaggttgaattttcaagggccaaaaattattgatttttcaaaatttttttaccaccctccaaaaaatccaaaacgcaatataaagcgtatatacgtattcagcacctcaaattatgccataaaaatgcattttggctaatttaggagtaaaaaaatttttcataaatgcaaaaccatggggtcccccctatggttttgagtttcaaaatcacaattaattttataactttttttaaactcatggtaaaaacatgagataaagcacattagatagagcttaaaattctctacaaaaatgctctaagacaaatttccgctaaaatcaacgcctgacgagttataagcctcaaacggaaatggggagctcaattccggaaaatttttctatttccggaaaattttgaaattttttcaaaaatgccaccaatcgatagagctcgaaaaacggttgcttgaaagtggtctccgttttcttgggaaaaatcggcaaaaaataataaaattcaaaaacgaaaaattttcgagggggcctagctcgaaaaattttcaaaattttcaaaatctgaaaacgccatcggatgcagctttaaaaactacacaaatg

SEQ ID NO: 111162 - DNA, 61 bp, Heterodera glycines
  Promoter: Source sequence=SeqID_19513; Location=1..61; Strand=+; Gene= SeqID_84235
ccccccctttccattccggtttgattttttctatgctttcaaagcgcacaaatgcattatg

SEQ ID NO: 111163 - DNA, 251 bp, Heterodera glycines
  Promoter: Source sequence=SeqID_26369; Location=476..726; Strand=-; Gene=SeqID_57104
tttgtcagttcggcacttttctcccctttcaaatttttattctcaaccattcgtcagccaatcacactttcatgtcactacttaacatttctctgcaatcacccttcgcctttgatttgttcaatttatccattaaatgtttaatttttaattgtgaggattaaaaatgcacgcaaattgttaataataaaattaacactcttttaaaattaatttagcaattgattttttctgcttattccattcaaatg

SEQ ID NO: 111164 - DNA, 190 bp, Heterodera glycines
  Promoter: Source sequence=SeqID_40058; Location=891..1080; Strand=-; Gene=SeqID_68492
tatcaacaattttgagaagtgagttagaaatgataaacttcacgattcaaaccagttttcggtgctctattacccgcgataaaaacattcgaatcaattaaatagcttctgagataataaggtttatcataaaatttcatttaaaaataaacccctcaattattggtatgaacgatactttccaaacatg

SEQ ID NO: 111165 - DNA, 370 bp, Heterodera glycines
  Promoter: Source sequence=SeqID_25236; Location=475..844; Strand=+; Gene=SeqID_55984
aaattttttgcttttctagctttcttagatgttttttcttgaaaaaaatctctatcttttttttcacgagatgcgacgagttttgtttaaaagttgattttattaatcatgactcatcattatgtgccattaattcacataataaatttgaaaccatagtatattctcccgaagtgattaaatgtgattaataatgtaaatttaaatttgaacatttttttaacttttctaactttcttagagattatttccttaaaaaaactgaaaattttttttgaagaattctccaaataaatttaaaaatgtgaattttatttatcaaaattattaatcatttttcaagctaacttattaattacagcagcagatg

SEQ ID NO: 111166 - DNA, 683 bp, Heterodera glycines
  Promoter: Source sequence=SeqID_44751; Location=675..1357; Strand=-; Gene=SeqID_72187
tttctttcgatttgtgccaattttttcgctattttctctttatttttttccattcttttgctgaatattttcttcctttttgtttgatcctttctttaattttgttgaatttttgaacaatttctctttttttctgttcattttctttttcttcccatttttctccaaatatttcttcaaatgttttttgttccaattttttcttttccgctacaatttcaatttgagcaattaaaaaggcaattaaaattgaaaataggcataatttcattgttgacaatttttctttttattaaaaattaaaatttataatttattcgatatgaaaaaaagaaataaataataataaaaatatttctcaaaaatgaatttttctcttccttataaatttacattaatggtaaaatattgacaggatcactatatcaattaaattgtaaagtgaattttttctctctactgaatgatcgaaattaataattttataataataataataatataaataaaaactgtttcgccattaattaaaattctaattctaactgatcaaaaaattcagatatttatcataaaaattaaaccatatccgcgaatatactccttagtcagttaaaatcaatttcatcatgggctttgtcatttgctccaatttttaaagacaaaagtcgcttcaaaaaatg

SEQ ID NO: 111167 - DNA, 212 bp, Heterodera glycines
  Promoter: Source sequence=SeqID_10187; Location=1218..1429; Strand=+; Gene=SeqID_73302
atcagaaaattttataaaataaaagaaaaaattatgcaagaaggaagaaaatattcaaaaaagaatggaataaaattgaaggaaaaatagcaaaaaaattggggacaaatcgccaatatatttataaatggattaaagaatttggcctatataaatacaaatcaaaaactaatgaaggaaaaatagaaattgttcaaaaatttattgaaatg

SEQ ID NO: 111168 - DNA, 326 bp, Heterodera glycines
  Promoter: Source sequence=SeqID_4659; Location=3494..3819; Strand=-; Gene=SeqID_55261
tgggcactaaagaaattcaaacactattaaattaatgtttttagtgtaagttttgcattttgccaaaagcggaggcgttgacctgcttgcgtcagctgttggtgtccatgcgcggacctaaggtacagtccgataacacggaaatgttgctttattaagacccatctcaaagtcggcgattccatttattttgattaaaatcataattttctaccactgttgtattgtttcaattcccttcatttgtgcaggtcgacatgttgagtgtgttcgtcgaacattgtggcccttttctccaccggtcgccggatgcacacgcaaagatg

SEQ ID NO: 111169 - DNA, 87 bp, Heterodera glycines
  Promoter: Source sequence=SeqID_23301; Location=2163..2249; Strand=-; Gene=SeqID_54007
actaaaatagacaaagagaaaaaccattattacacgcataatctaaaggttgcaagttttttttctaataaaaccttaataaacatg

SEQ ID NO: 111170 - DNA, 84 bp, Heterodera glycines
  misc_feature (50)..(50): n is a, c, g, or t
  misc_feature (68)..(68): n is a, c, g, or t
  Promoter: Source sequence=SeqID_4505; Location=4688..4771; Strand=-; Gene=SeqID_54702
tattaatttattataaatttcgtcttcatttaaaaattaacaaataaatntaaaaaaataaaaaatanaacattattgagaatg

SEQ ID NO: 111171 - DNA, 334 bp, Heterodera glycines
  Promoter: Source sequence=SeqID_13303; Location=3075..3408; Strand=-; Gene=SeqID_77151
acccgagcatcgaaagactaagaaaaagcagaaaagtggccttttcaattgtctaatgttattttaatttctataaattgccgaaaacgaaattaagaaaatttattgttaaacttatttgataatttgttactttcaattcttaatttgcaggaattagtttttattttgtgtattaattcgaatttttggttagtcttttagttttgtcaccgaatccactttttctcctcctcctctcctcgtgtttgctggtggtggtggtgactgtggcggaatcggccacgagtttggcacaacgctggcacgcgattgtggcaactgtgctaaaatg

SEQ ID NO: 111172 - DNA, 226 bp, Heterodera glycines
  Promoter: Source sequence=SeqID_878; Location=2964..3189; Strand=-; Gene=SeqID_63214
ttttgcagttgtacgtcaaaaaattggaagaatatttagcaataatactaaatagaaagaagcctaattgaaccattgtatccatttataaatcagttatttattattttccctagttttctaagcttttaagaaactgaaaaatatgaaaaatgtgtaaattatgcgataattaagcttctccttcatttaagctaagcgcaaaattattttaaaataaataatg

SEQ ID NO: 111173 - DNA, 1003 bp, Heterodera glycines
  Promoter: Source sequence=SeqID_2483; Location=3135..4137; Strand=-; Gene=SeqID_79972
taataattccgccgcgttctgctctcggctctcgctcgccgattaactgcccgctcaactgactccttatcgagagaatgctcccgattaaatagttggacttatggaacggaataaagatggggaaaagcggggataaatggtgtgagaaagagattgaacggatgtgataaattgcgccttacacgtccacccttcctttaagtttgtccacaaactttgattgagctacttttgagttgaattaatttttaaaaaataagcatcaaaacgtgactgattgaccaaagtcatgggaataatgatcataaatgattagattttgactgaaaatattagaatcggtgtcaaacagacagtgattgggttaatttttttaatcacatggaatgaccagaacaaaacttttattttatatccgataggtgaataatgtcatgattatgaaatgttgagaaaaaaaaattggttttataggcacggattttaaggcgtttacttgctgaataagtgctggctaaaaatgtatatattagagtaaataaatcaaaaattaattattttttgtcaatagttttttaaataattcaaattatttttttgtaaacaagaaaaaataattgcaaaatgatttcgtgagactttgaaaatggggtctataatttcaaatttaagttttgatccattttggataaattacgctcaacaatcagttacggcttcgttataattgtcttgtcaaatgttcaataaaaacttaaattacaaaaacctcttaggttttaaggcattcattttaaaaggaacttgcatgactgatgtaccaaagtcctttctgctatgagtttgcctttttctcaatgcttcaccgctcttttcacattggaattctaacaacacatttcaaaacactgagtttataattttctaattctaagtccgtttgcttccgtcaaagtttaactcattaaaaaaaattatttattctaaacaatgacgaatg

SEQ ID NO: 111174 - DNA, 1003 bp, Heterodera glycines
  Promoter: Source sequence=SeqID_6546; Location=2888..3890; Strand=-; Gene=SeqID_61961
aggtttgcaaaattacgggccatattgcgaaatagttggacccaaaaataatggagacatttaaataagaaaccaatcaatcacattttattgacagttgacctaatttaggggagatattgcgaaataatttgaacaaaaagtcacgtgcagattgagaaataagggaagaaaaataaaaaacccatcaatcaatttttagttgacaggtgacctacttttgaaaaagttttttaatttatttattcattctttgattttacttttaaattggatttaaatagtaattttattgtccaattcataatcaaaattatttgctgccaatatcaattaatttgcacttcttccaaattccgttatcgatttttttttgcgcgcgactcggcatcgcggcgcatcggcagggagtgagtggaaatgaaaaaacctcacgattttggctaattttcaaaaagaatttttaatttcaggatcaaaaaatcatcataaaaaaaatttcaggattgagaaaataaaacgctaaaaggttttgaaacaaaagattaaaatttgcaaaagttaaattgaatttcctccacctgtcactttggtgacaggtggatgattgatgaccttcccgcggcgctgcgcggcgcgggaaaaaaacacccgcaacaatttgggaaatcggatttggtcaggcggcaacttcaaagtggtccaataggttttggttttgaaacaccccccccccccccatcgtggatttttgatggggcggcaacttcaaagggctgcacccctcccataggcacgggctcgtgcgggaaacacccgcaaccaacccgcaacctttaggggtcctatactacttctataattaattgttttgtcttcaaatgattatattttttaattttgtcagattcctccccctccgtcgattgtgccagcggtgccgcaatccttgtcaacagtgcctcagcaggtcaggacttgtcagccgtccacgtcagcaatg

SEQ ID NO: 111175 - DNA, 375 bp, Heterodera glycines
  Promoter: Source sequence=SeqID_22382; Location=1322..1696; Strand=-; Gene=SeqID_53052
ttgagacggctcagtaaaatctgacaaaagatttgactgaggaaatcaaaacagatttgctcgcagagagacaaaatctctgtagagcagtgtcattgttggagaaaaacaatgacaagtgggaggcagtcttccaccgagttaaaggtcctgctcttcaggaggaagagcagaactacaaggactacaaacctgaaggaaaagcctaaaggaaagaattcccttagagggaaagatttcctttccagtgattttttgtccattccgcgacaaaaattggagccccgttggggtcaagctccagtcgtagcttaccccctcaactgagagaagtccaagctttgaacaaagcttgtccaacattcgtaagagatg

SEQ ID NO: 111176 - DNA, 68 bp, Heterodera glycines
  Promoter: Source sequence=SeqID_14042; Location=438..505; Strand=-; Gene=SeqID_78020
ggttggttggttgacttctttaatccatcaattaattgcttatttgggcaatttttaggttgcttatg

SEQ ID NO: 111177 - DNA, 1003 bp, Heterodera glycines
  misc_feature (110)..(110): n is a, c, g, or t
  Promoter: Source sequence=SeqID_1793; Location=831..1833; Strand=-; Gene=SeqID_75998
ttcttttttattgttaatgtatctttgtctaatattttttatttgtgactaatgtgatgtttttacttattcattttacatttttaaccttaataaaattaatctaatgnattaaagtcttgaaaagtgttccaatttgtaaatgctttgcgcaaactgccagaaagttaattaatgtcgctagtaagttcttaattctatagacaaaaaaagataataggttaaatttcttgaatttcgctacatctaaactcttcatctgggccggtttttctctaaatttcagcttggccaaaacatgcggaatccaaaaattaaaaagaataattatatactgatgaaaaggttttaaaatgctttttaatttatttaaattcacataatttatagatccagtaatgaagttgggactgagttttaccgtttctctaatcgcctaaccaccgatttggcgatcagaacggcgatgccaacacatctgtccgtctgttcttttttgcccccgccccctccgcttccaaaggattgattgcccattccttccatcgaacggagctttttcatttttacttggcttagaacggcgccgatttcaaacaaaaagccgaccgacttcatttttgttcactttttccggcggagggctgttcaaaagctcatagccccgtcaaatgcttctcctccgtacgccccctcgttcactttttggccaaattgcttcacacttccgtctctcctgtgcttttgcttttcattttgagcagcatttccaatcgctttccaagttccattttgttaattgccttccaaatgttttgggatgggcttttatatttctaaaataatttctactaattattattatttttttactgtttttattcccttgtgtacgtattaattttaatgcttcattcattcctccatttatacactaatttatacattgattttgtccatctgatttagattttatttcatcgctaaacaacaacaaaaaatg

SEQ ID NO: 111178 - DNA, 344 bp, Heterodera glycines
  Promoter: Source sequence=SeqID_4998; Location=1922..2265; Strand=+; Gene=SeqID_56499
atcagaacagcggaaatgaattgattgattggttattgatgcgattattatatgacccaaatgttgggcaaagatatttaaatattgttgtatttgattgttgctcataaattcataaaaacgagtttggtatttttgcgaattttcttcggattttgaaccggtacaaaaggcaatttttatttttagcaaaggatcttttaagtcattttgggtgcaaatgagtttgctgggaacaggatttagctgattttaacaatactttctcccagaacaataaagatttttaaatttacaataattttaaaaaaatatttttgtacaggcttttcttacataaaatg

SEQ ID NO: 111179 - DNA, 231 bp, Heterodera glycines
  Promoter: Source sequence=SeqID_42746; Location=63..293; Strand=+; Gene=SeqID_70569
tagttggggggcatgccctccaatgtgatggctttgggccggaaggttaaaacctcgtgtagggggtgacctatgcgcgtttttggctctccaaaaatggcccaaatcatcgctcaggagaggggtcatgcccgatttttttgggtggccattttctttcattttcgatcaaatcttattgttttcagttttcataaaataaaataatcaaaatcaattttagaaaaaatg

SEQ ID NO: 111180 - DNA, 130 bp, Heterodera glycines
  Promoter: Source sequence=SeqID_11671; Location=1160..1289; Strand=-; Gene=SeqID_75138
ttttcataccaaaaattttcgaaatttttcggcaaaatttcaaaaacagaaagggggttttcaacattttgatgtttctcgtaaattataagacaataatttttttgtttaagttatagattagaaaatg

SEQ ID NO: 111181 - DNA, 442 bp, Heterodera glycines
  misc_feature (144)..(144): n is a, c, g, or t
  misc_feature (156)..(156): n is a, c, g, or t
  Promoter: Source sequence=SeqID_15398; Location=1189..1630; Strand=-; Gene=SeqID_79659
aaatatgttaatttattgatttaatttttaagccactgcggatcaattgtcaaaaattttggaaaaaccagagaattggagaagcagcgagaagaacagtcaaaaggcggcgagaaattaaaacaaaaataaaatttgtaaatntaataattgatntaatttttaagcttctgcggatcaattttcaaaaattatggaaaaaatcactgaattggagaagcaacacgaaaacatgcccaaaggcgaggaagttttaagcgaagaataaattatttcttttaaattatttttgtagaagaaattaattacatgagttaagaatattttaatttaattaaattttccatttttaattttaaaaattaatttcagcaacttcggaacaattctgaaaagtgcaaaatgattaaaggattttttttccgacaaaattattgggatg

SEQ ID NO: 111182 - DNA, 81 bp, Heterodera glycines
  Promoter: Source sequence=SeqID_9595; Location=389..469; Strand=+; Gene=SeqID_72009
taccggcttttccatcgacaaatacatacaaagttttttaaatattaattaaataaaattaaataatactatttagccatg

SEQ ID NO: 111183 - DNA, 537 bp, Heterodera glycines
  misc_feature (31)..(31): n is a, c, g, or t
  Promoter: Source sequence=SeqID_6124; Location=1..537; Strand=+; Gene= SeqID_60444
tttttaattcaactgacacgtaaacagattntgctccaaaatagtcattttcaataattttaatgaaaaatttgccaacaaagtgccaatagaaatttttcaaaaataacatccttaaaatcttaaaacccattatatagttggaaataatggcaaaaaaacggatagagtggcaaaaagatggtatgcaaaattgataattttcttaatcattaacctgacggagccagaagacacctccaggcccaaaatcgtataaatttttttgagaattttacaaaaaaaaaattataaaattttcattttattttatttttagtatagttgccatatttattaagaatatagttttttatattaaatgtttaattataataatattattttcttaattaaattgattttattgacaattggatttattgctacacatattccattgtaacattctgatttcctttccttcacatcctcatttacattttttaacatttttatatataataataaaataaaaaattccaaaattatccaatg

SEQ ID NO: 111184 - DNA, 95 bp, Heterodera glycines
  Promoter: Source sequence=SeqID_3702; Location=1501..1595; Strand=-; Gene=SeqID_51530
ggtgggcgtatggatcagcgaaaaatactcccgccctgatcagttgaaatggtcgagactcgaattttgaaaatttctgagattggacaactatg

SEQ ID NO: 111185 - DNA, 964 bp, Heterodera glycines
  Promoter: Source sequence=SeqID_2924; Location=1354..2317; Strand=+; Gene=SeqID_82359
aagggtccggaccaattggcggcacacttgttaaaccggatgaaatgcccattttgtcggacgggcatattaaatttttggcttttttctcttgagagaaaaagagtggttccggtggctcagtggttggaactgaacattacgaaatgggtggaggaggcgtgggttcaattcccacccggggccaaccaaataagtaacactttgtcacggtttgtttaaagggaaacctttccaagttgtcaaattccgctttcccattgctatgtgacgaagcgggccaaagacttgggaaattgtcatttgatttggtcggcatatggaatatggggaatacgcctttccttggcatttcccatcagatgcgccggcacattttgtcaatcgcattcctatgggcttaatcgaattaatttgccgtaaattctaaaacaaatactcccgaaattattgtttttttttttgcaattttagccgtaagtcaactattcctggggctttaactgagttcacttacctaattaggctaattagttaatagtttttttcagattgctctttcggccaactcggcattcgctgcggccattctgctgatgtgccattccgttgtgcgggaacgaccgcaattgctcaaagtgggaagggtcgcgggaccataaccaaattgggcgttggcaaaattgcctttttgtcaacatttactaacattttgtgccaaaaagatcatcctacacactcactatacatgaaaaaagggagaggaaaagacttgatttgcgattttgaaccaattttggttttttgaaaatataagattttagggtccagagatgccgataggtgtcgtcgtgaaagtttttatgttttttgaaaaatttaagcgaaatttttcaagaagatacccttaaattccaacaattggccaatttgcttttttcgccctaaagtttgttaaagcatg

SEQ ID NO: 111186 - DNA, 157 bp, Heterodera glycines
  Promoter: Source sequence=SeqID_18094; Location=590..746; Strand=+; Gene=SeqID_82680
tctgaagcaaattcaaataaatctcgatttatctcttgaaaatataaccattggttgatgaatgaatggaactggcggcgggagagagaatggcatggaaagggtgctgatgagtgatgtcggtcactgaagcgaatggacggactttagagagatg

SEQ ID NO: 111187 - DNA, 536 bp, Heterodera glycines
  Promoter: Source sequence=SeqID_7493; Location=927..1462; Strand=+; Gene=SeqID_64996
gaaggaagtcacttttctgatgatgaggaatttcatttgggtcttcctttgtttctgtccttaccaattcacattttatttcatttattcgcatttggatgctcttttccagtatgagaagacgttaccaaaaaagattactctcattatctatttcaagcataacaatgtttgtcatttcaatctgttgaatggggggaaacaatgattgtgagatatgtgtggtgtgttcttcgctatttttctcagttgcataaattccttcatttcttcctattcagtcagtgtatcataaaatggtgatagtttaataggaaagtcaccggaagattggaaattgggtcaaaggtgtgcgagggaggagtaattgaaggggaggggatggaagatacgctggtggagatgatcagatcaattgggtaggggggaaagagtcgctcgggggtgtgcactttggcgattactcaaaccgcttattgaatgacggcgggctacggatccgcgcctgtgttaaaagcactccttccccggaaatg

SEQ ID NO: 111188 - DNA, 1003 bp, Heterodera glycines
  Promoter: Source sequence=SeqID_17130; Location=224..1226; Strand=+; Gene=SeqID_81565
aggacgcatttcaaagttaggggggggggagggaacgaatttgagaggagtgagtgagtgagtgagtgggcggattggagagggcaggaaaagaaaaaaagtaagggctgagcggggggggggggagacggcaaaacaactgctgaaaattgagaaaatgatggaaaatggggggcgggagggggtgaagggaatgaaatgaaaagatgccaggcaattaaaattaaatggcaattaaggcaaggggacaacacaataacgtagaatagcaaaaattgaaagaaaaattgagaattttcaaaaaccaataaatttcgtgggaaaacactgaccaaataattttatttctcaaaaatttagagagaacaatagaaatttcgtgaagaaaatcggcagacactcggttgatgtttttatttcaaatttgtttttgcttttaatttttaatggttttcgtaacacaaaataaaggcacaaaatgtaaacaaatgccaaaaaaaatcaaaaatctcacaaaattggacacttcttttggttattaacacatgagatagagaagaggaaaattaatagatattgaagcgaaattaatcctaatttgatcgagcaaagggtcggtggttcagctggtggaactctgatccggcagaaaatcagagacgccggttcaaagccgtcccgccccattgttttccctcaaaggctttgttcattcatagaaaatatattcacacataataaataatcacatcattttcaatgttttcttcttccctttttctcttttcattttgcaatttataaaaatgcaaaagaaataaatattcgaagaacaccgatcaatcaaagaaaaatgaatgcattgggcaataattgtcatttgctcaacaaaataaccctttcactgattaatttttgtgtgttaatacacaaatttaaatttaaatattattttaaaattattagtttgatttccctccattttttgccattcctcacaatg

SEQ ID NO: 111189 - DNA, 148 bp, Heterodera glycines
  Promoter: Source sequence=SeqID_11294; Location=1..148; Strand=+; Gene=SeqID_74666
actttcttaatttacaatttagaaaaaaaatcggcggcgacattttgtcccgtccccctcacacaatgccatggattggcatgggcacaattcatgagtatcatggtactataacgtattcccctcttttttcagcgcttggccaatg

SEQ ID NO: 111190 - DNA, 255 bp, Heterodera glycines
  Promoter: Source sequence=SeqID_39014; Location=1..255; Strand=+; Gene=SeqID_67683
taaaatcccattccaaatgagtaatttccattccttttttgcttttttaaaattccaccatttctagtgtcgcaatacgctcaccgccgagctgcaaattgttgagcaggaaatgctgccaatctgcgaccaaattcgcaccgctttcaaggagtgtttgcgcgtcgactcggagtcgcccccggccgacccgccctgttcatcttcgactccgtttcatcagggtatcgttaaaccgtttttgcattccctatg

SEQ ID NO: 111191 - DNA, 498 bp, Heterodera glycines
  Promoter: Source sequence=SeqID_16860; Location=1883..2380; Strand=+; Gene=SeqID_81289
gttgccaagcaggtgttaagcaatattttaaaatcgaagattctccaataatttgagcgaatttttaagacggtttaaattaagaaaaatgcaaaaatttaatattttatgactaattttatccatcttatgaagaattttcaatccaaacgagtctatcctccctttggttttaatacataattttgtaataagtgtcactttaaaagcacataaattttttttttctaataattaagaaaattcggaattataaacattttttacaaaatttatggaaaaagcttatcagggacaaatttttgagaaaaaaacaacctagtattcatatattatatttacttatttcgtgttttagcacatataaatcccagccctggtcagaatttttcattggaggcgatcaatcggataaaggtgaatgaatgagacctgaataattcagcactgaattaagcaaaatgttaaatttgggtgtttaaggtccaaggccaaatg

SEQ ID NO: 111192 - DNA, 1003 bp, Heterodera glycines
  Promoter: Source sequence=SeqID_8959; Location=2327..3329; Strand=+; Gene=SeqID_69813
atgagaacagaagaaaaataaacaaagggaggcgaaagtggcgaagacaaaaaatgacttatgaagcgattggagaagtgaaaacaaaaagagaagagaaagtgatcagagacaaaaccaaaccaaactgatcagaaaggaaataaagagtgaacagaaggaaaggatgaccagaagagagagagagaaattaaaccaaattaaattgatcagaatagaaagaaggactgatcagaagggaaggatgatagaaaatagtcgggaaaataattgaaaaaacaattctattttaaaaatagttcatgaaaataaaacttaattttggtcatttaaatgattattaaatattttatttattacattttaatggaattttttaggaagaaaaggtcaaacatagaaggcattaaaatcgtaaaaaaaacacaaaaaaatttaaccatacaaaatttatttaaaatttaacaaaaaattaaaataaaataaaagtttgtcattacagtagtcatggatagaaaaacattcctacgaattttactttgatttaaaaacaagtttttattgaagaaataagtaaagagaatgcgcagatgcaggcaagtgaccaataggaagatttaattggaagttgtgataatgagtattgtgcgcggttaccgtggaggggggaggggattgccgccgaaaggccatttaagatattgtaaacttttcattaatattgtgccgccaaagagaaaatgacactccgcgaatttgtgaatgataaataacaacacattcttttcttcaatattttattttaaatttgttttgaatcaaacaagaatttatatgggcgggcgtgaattcataacatcaattacgatactattttaatagcaaattgttaaacactcttatcatttcttagaatttatttattaatttaaatattatatttaatataaaaatatttttatatataattaaatagaaataattttttatattagagaaaatg

SEQ ID NO: 111193 - DNA, 138 bp, Heterodera glycines
  Promoter: Source sequence=SeqID_28482; Location=1..138; Strand=+; Gene=SeqID_59096
atacaaagttaaatcatagtttgaaaatgttttaaatttcagttttgacccaatttttcgaagcgccccattttccgctctctcctaaaaagagaggggggggggggggggagggactcttatggccttggtgaaatg

SEQ ID NO: 111194 - DNA, 482 bp, Heterodera glycines
  Promoter: Source sequence=SeqID_7410; Location=661..1142; Strand=-; Gene=SeqID_64737
attaatgaatttttttaccaagttaatgttgagcctctatttgtgtacaaaggtgccaaacagtatgccctaaaaatggtggatgagagtaccggcgaatgcaaatatgtacaaaaaattcgcggaataacatttgatgtgcagaatagtcaagcgctccagtttgagcacttcaaacagaaagtgttaaactatggccgtcatggagagcgcccggcggtgtttagctatgacaaaatacaaccgaccaagagcagtcggatagtgacaagagagcagttgaagcgctatcttccagtctgccagaaggggataataaaagaaaatctgagcgttcttccttttggtttcgagtgattctgaatatgtaaatgtaaaaaatttttttttttttactggtatttgtggtggaaatgcctaggaaaatggcagatatttaatgcgttataatgataaactagtatattgaataaaagaaaatg

SEQ ID NO: 111195 - DNA, 175 bp, Heterodera glycines
  Promoter: Source sequence=SeqID_15185; Location=1..175; Strand=+; Gene=SeqID_79384
ctatcctgtcgctcccttgccatgtttcgtgcattatacaactttctcccacactccattttcttcttctggcattacatttaccattaccataaaatgggaaatatgattaacaaatttcaaatttattataattttttggcattgagtcatcaaccaaccaattcaaaaaatg

SEQ ID NO: 111196 - DNA, 137 bp, Heterodera glycines
  Promoter: Source sequence=SeqID_21196; Location=1043..1179; Strand=-; Gene=SeqID_51786
ttttgatgattttgttttaaaatgaaatctgagttttttggttagaattcccaaaaaaattgctttttcatttattagtgatcttggttttcctttaccttattcttattaattttcattagatttcacaacaaatg

SEQ ID NO: 111197 - DNA, 54 bp, Heterodera glycines
  Promoter: Source sequence=SeqID_22659; Location=1..54; Strand=+; Gene= SeqID_53339
gcagtggtcgatgatgccaaagaacacattggggatgttaatgcagagccaatg

SEQ ID NO: 111198 - DNA, 1003 bp, Heterodera glycines
  Promoter: Source sequence=SeqID_13089; Location=360..1362; Strand=+; Gene=SeqID_76875
actcagcaccctatgaaggattttcgatattttatatattcaccaaatctttttaattattattttatttgcattaaaacgaaaaataaaaaattgttttctgtctctcacttattaaaaatgattttactttggcaaatcaattacatttagtaacattggtctgagcttctagaagatgcacttttataagcatttgctcatttcggcaccccaaagaccgattatttggaaataattctatgaattaaattttaattcatttgaataatttttcagatttaatgaatttgagagaatttttttaattttttcaatattttttttagtttttttttacgaaaaatgcattaaattttagaaaaaatatttaataacaaaatattcggcttttttacttgtacccattttcacaatttatttctaaataaaaaattttctcccctcgcgcaaattttccaacggacaaatcaattaataggcatcttttggcatcccattttctgtcctccatggcaaatttttttttcacgatacatttttctggtggatttgattagcgagcactttcatttgtacgcaaacattcaaaagatccgaatcactcccccccccaccaatggcactttcttttacccattcattcattcgcaaatataagcctatttattggaccttctcaatttattgagcattaaaaaattggcattgactgaaataaaaaatattgcgcttaatatttttaaggatttattttttctcctgggtaatttcgggcactttatccattgacaaattctgtaattgaccttttttaaaacggttaatttagggaatttaaagcagtttggaattccttcatacttttcgtcaattttcttctttatgatgcataattattttctgttacctcttttgcccctttaccaagacaatgggctcagaataatgcacgaaaaactgagaaacccaattttggacactttgacgcaactgcaaaatg

SEQ ID NO: 111199 - DNA, 702 bp, Heterodera glycines
  Promoter: Source sequence=SeqID_1736; Location=1496..2197; Strand=-; Gene=SeqID_75599
agttaaatcaaattgcatatttaaaaaaggaaacttatgcgacctttgattttaattagtttcatttaaattcaaatcttccccccccttaatttgcaaaagcgttgtaacattcgcccattaaaaattgttttgtgagaaactggacacaaatttgcacattagtggaagtgatcaatctccaatgaaatatgctaaatggtgcgtgtttaatgggaaatttaaaaaaaagagagcacaaagacgagacgaaggactttgttagaaaatgaacaaattacctgcccataattcacttttgtcacagattactgaaaattgaccaaattgcctcactttttgccaattagcgtaaagagatcgatgagaggaagtaaaaatgaatttgtgatttaaaaagtacaccatgcgggattggagaatccgggaccgtttcaagttgtccagggtcgaatttaaagcattgcgaggcttgaaataaaaaagaaaataaatattacagaaaattttaaaaaatttctccatccaacaaatattatctttccccccttttcaatttgacttttgcgatttccctttaataaatacaaaatgaatgcttctctgaatgagaaggctcattaaaaagccactttaactttgtcgttttgtgatgccagcaaaaggaagcggagtgtgggagaaaatgggataaataatatg

SEQ ID NO: 111200 - DNA, 61 bp, Heterodera glycines
  Promoter: Source sequence=SeqID_17161; Location=1..61; Strand=+; Gene= SeqID_81600
aaaagaaatcttaaaaatttaacatatttctcaatctcgcattgcaaacggaagaaaaatg

SEQ ID NO: 111201 - DNA, 267 bp, Heterodera glycines
  Promoter: Source sequence=SeqID_19139; Location=843..1109; Strand=-; Gene=SeqID_83892
tttcgtccatccctccaacctttccccgtccgtccctttatatgcacaaataaaaaaaagcttggaattcaatttcaatctttctttttatattttattaatatattaattagtttattgttgattgatttacgcccccccaacaattgtccctttgtcaattttttaccccttcgatttttagcaaatttttccttttgcaattaaccgccttttgccaacgaattcacgccaattgccccgaggcagagaaacacctgcgaaatg

SEQ ID NO: 111202 - DNA, 1003 bp, Heterodera glycines
  misc_feature (7)..(7): n is a, c, g, or t
  Promoter: Source sequence=SeqID_13676; Location=872..1874; Strand=-; Gene=SeqID_77592
aagactnttgagtaaatattcttctttgtatttcactttttcggaagggaaattgagaatttataagaaaaattatttgcttagccatctccccccccccctccgctcaacaaatttgttttatatattctgcccgtccacctcgtaattggacgacggacggacaaacaaaaggccaaatggcgggacggtcagacaaattcaatcaatttgaccgttttgatgccgtatatctcgtccacatgtacatttttactttaccccaaaatcaattttctccatcgacggcggcggcggcggcggtgagggcgggcgacggcggcgatgacaaagacgaaaaacggcgcgtcggttaagagaaactcactcattcactctctcactggcctgcccattgcccgcgctaaattccaatttgactcacaataaaaatatttaaaacttcattaaatttcaaaatttttatcatctcttgaatttttcctttttaaagcctcaaaaagtgagcatattcggtgaaaatttataaaaattgaaatcatttgtttctctcgtggcctttatagtacctgtccccctagaaatcttcaaaatttaacccaaattttttgtatttatttttaaaaatttcgagaaaatttaatttttctcatgtgcgtctgtgatgatgactcactcattgattgggaatttatgtcatggaaaattaaggtcattacgaatcggcaaaaaaaaaaagacatttcacttaattcccagccctactcattaacggacattcccagattaattataattaccctcatcaggcatcaacctcttcaacctaaaaaaacattttaatgttccattttgtgcataaattaccattaaatattctttatttctttatacatacacagttttaaattattttcaaatttaccgaaaaaattatatgacgactcaaaagaaaaaacttttagagacactttttttattcgcaaaataatacctgaaaatg

SEQ ID NO: 111203 - DNA, 487 bp, Heterodera glycines
  Promoter: Source sequence=SeqID_21419; Location=1027..1513; Strand=-; Gene=SeqID_52027
acagtgacaatagtttaggaggaaattctacaagagactcaaacagtaaaaaaaaattattaaaaaaaattattaaatttgtaaagtacagtccttaaaaaatcttgaatgctcaggaccaggttttttggtgaaatttcaaggacaattcattcttgttgataaaacgacaaataattatgaaaattaacaagaaatgattttatagtttagtatcatttttgaaattaattaaattttaattatttctgattaagggacatctaaaataaaattataaaaattaaatttgtaaagtacaatccttaaaaaatcttgaatgctcagaccaggttttttggtgagtgaactttcaaggacaattcatttctgttcgaaaattaaaaataaatgaataatttttggaatccttttttttttttgatggcaaattaaattatttttaatttatttttaaaaataattttttaaaattaagataaccatg

SEQ ID NO: 111204 - DNA, 850 bp, Heterodera glycines
  misc_feature (842)..(842): n is a, c, g, or t
  Promoter: Source sequence=SeqID_28625; Location=89..938; Strand=-; Gene=SeqID_59226
attgtaccagacctcaaagcaatttcttcaaaaaatactaattcaattaaaaataatatttctactacatcaagcttttcttacgaaagttttcctttgctagaggtcttacttttcaacttttctaactttttggcacctattttcccatttttagcacctatttgggggttttttagaaccaaaaacctaccaattttggcagtttttagcacctaaatcgtatcactagttataattggtagatgtttaaagtcgtataaagtaattttaattgattttatattttaaaaactattatgcttttgtatttttaaatcagttttaattcgtcgaacatagcagctatgtattctaaatctcttgattctctttgaaattcaaaataaaaatgttcgagaataaattaattaatttaaaaaaataaatttatagtttttatctagaaacatttctttaagaaaaggcagaaataaatttatataaattcaaaagtttttatttaaacgacattacatttttataaaaatatataaatttaattcatttttataataataaaaatttatgcaataacaacattaaaatttttctagtaataattaaatcgaagatggtcgagaactttatttcaaattataaaaataatacccagaaggtttagaacataatcaaaattaaatataaatttcttctatcaattttttgcataagtccattaaagattttaattataaattaattctgtttaatatatatatatgtagaagaatagtgaaaaaattcgaatatttttaaatgataatagtattggcaattactattttattaattgattttanaagaaatg

SEQ ID NO: 111205 - DNA, 183 bp, Heterodera glycines
  Promoter: Source sequence=SeqID_4638; Location=1..183; Strand=+; Gene= SeqID_55187
atatcattaaaaaaaacgtggctcttaaattctgtcccaaaatgaggtcaaggtcccgaaaatcctcacgcgcacacacacatttgtcataattcatgaggaacaattcacaaccaaacggaaagcattttcatgtatcgatatttatttaaaaaaaagaatgctttttaggctggcgaaatg

SEQ ID NO: 111206 - DNA, 582 bp, Heterodera glycines
  Promoter: Source sequence=SeqID_14760; Location=1894..2475; Strand=-; Gene=SeqID_78892
atgatatcatgatacctttcttttattattattatgtgatttgccctcaactaataaaaaataatttaattcaatttgcgcaatggtggctggggatgggggggggaaggtagccatctgtcggcagctacatcgcatggttgttgttgttgttgtgttgttcggcaaatatcctcacacactctgccctcatccttttccttccttatttttgcattttatctcccaccctcttcacggttaataaaaatgagtgcaaattccgcatcggttgaaagtgaaattgcgtcactgaaacaaattattggcgcacagtccgtaaaattgatgcagatgcgtcatcattttgtgaactaccgcttcagacttgagcaacttgaggcttgggccggggaagtaaggtattcaatgttttttgtgatcacagtttttaacaaggtaaagacaaaaagtttgttcgttcaccaacacgcaacaaacgattttctgtggacgacgagccagcaacatcggccgcaacttccggtaagggtagtgtaatattactgggaacagtgcgctttttcagatgggatggcaatg

SEQ ID NO: 111207 - DNA, 259 bp, Heterodera glycines
  Promoter: Source sequence=SeqID_1580; Location=6178..6436; Strand=-; Gene=SeqID_74609
ggtaggtacagtacagcacgaactctacatagtccttttaccggttattaaaccaattttcaatgtctgctggtcaattcatattgtatcaatttgtgttctgtttcgcggtagagcgcagacagtgaaaactggaatgatacagtatgcattggaatacagtactacgcacaatctaaatcgtctaatctatttaacgtaatcaagcatcttttctatcttacttcttgaaaaggtaacactttgcgccgttctgatg

SEQ ID NO: 111208 - DNA, 327 bp, Heterodera glycines
  Promoter: Source sequence=SeqID_13558; Location=2485..2811; Strand=-; Gene=SeqID_77463
aatcacaatgaatcaatcaatggattttaatagcagggaaaccaaagcatttactaatttcaattattcctttcggcagatttaattttaaaaaacttcaaatatagtcaattataatgcaaatgttcacattctttttgtttttcatcgtttccattcctcaaatgttcttcgccattagcccaaatgattttgagtcaatggcccaacgacggataaattccgccgcaattacaatgggaaaatattcggagagagaagggttggtagagaaaaagagaaaacaaatggaaattacgaaatgaccaattgagtgaccgggacatg

SEQ ID NO: 111209 - DNA, 150 bp, Heterodera glycines
  Promoter: Source sequence=SeqID_26938; Location=443..592; Strand=-; Gene=SeqID_57674
taattatacctttctattgttatttatcggtgtttaataccaaaaatctcagcttttataaaactgtgatatgcgactctctcaaactaatgaagagagctttcttacgccatccgccaataataccacaaaactataacgaagaaaatg

SEQ ID NO: 111210 - DNA, 339 bp, Heterodera glycines
  misc_feature (31)..(32): n is a, c, g, or t
  Promoter: Source sequence=SeqID_21169; Location=1..339; Strand=+; Gene=SeqID_51746
tttgagcaaaattcgtaaagacgaattagcnnaagagcaaaaagcagtctttgcgaagctacaaaaacaagataagcatcacaaaaagcacatttgagaatgaatgacggttttatcaaaatcattgtaattatatttaactaaaatgattcaatgttctgaaaataccttctcccatttcacttccgtcgctaatgcgcgcgcttcaaaaacatttgacgatcaaaaacatgagaacacgcattagtgccttcactgttctctcgcaccttgtcaggtatttactgattgatcaatgagataatgattgcttgtttcagaactttcccaggaattatg

SEQ ID NO: 111211 - DNA, 395 bp, Heterodera glycines
  Promoter: Source sequence=SeqID_2241; Location=1..395; Strand=+; Gene= SeqID_78664
tgactaagtttacgtgggggatggggaatggaatgttccgtttttaaattcgtacggtctttggcaaaataccgtaatgcttttttggatgttgcgtattacagtgtcccgctgtcccaatttttgttgaaatccctaaactttcagctcctccaccgcatcacctcccaatgagtaccgcttctccgtccccggcttcttcagcttctgcttcgtcttcccaccaaaaccgtcgtcctttttccatcagttcactccttaacccctcacaaaatgccacgcaaaaatgtcctccacttggctctgtcgccgcattttccgatgccctccagcaatgtctgccgatgcttttcgctgtgcggggaatgatcggcgaaggcgcaacgaacgcaatg

SEQ ID NO: 111212 - DNA, 69 bp, Heterodera glycines
  Promoter: Source sequence=SeqID_1308; Location=1923..1991; Strand=-; Gene=SeqID_72239
cgtacgttttgtttttgggtgttatgattacgatttgccaagggtgatgtgccacgtgccgacgcaatg

SEQ ID NO: 111213 - DNA, 1003 bp, Heterodera glycines
  Promoter: Source sequence=SeqID_12526; Location=231..1233; Strand=-; Gene=SeqID_76174
ttaagttagttaattatccttctaaaaaatcataaaatcaagctaaagccttacccctttaaattccgataattattaattatatcaattaaaaaataaaaaaggcttaaactttccatttgcgaatttttgattatagcatatgttaacatcataattaaatcggattttcttttaatgttgtttattttttaaattcataatggttcgaactaagcaatcctttcctcctgcggagcaatgttcctcatcttcgttacaaaatattaatctatctacttctggaaatccgacggttattggattgttttgaggtagaacatattaatgaaagaaagaaaactaaaagaaatattgaatttgaaaatgtgatagatttggataaaattgatttggatgtaataaacgaaagcaatgaattcgaacagaccgtgaaacttttaccaatcggttatttgtttaaaaaaggagcggagtttactgacgtaaaattattttcattgctaggattaaatgttgaatgtaccttttgcaaagcaatgcattttttagaagaaaaacctacaaattcaaaaaaaaagaatggttttaattcatgttgcaattttggaaaagcaaaaaatttgttggaattatttgctgaatatccaactgaattaaaagatttattttcagaagataatgaaatttcgaaaacttttatgaaaaatataagagcttataataattcattcgcatgcgcttctttagcctgtaataaatttagttttacaactccgggtccaagttgttttaaaatatcaggacaggtttatcataaatataatccagtggcacaaccggtagacaaaaattttttgccaacaaatgggcaattatattttctcgatagtaacgaagcacaaaatcttagattagattctcataatttagatgttacattaacagaaaaaatagaatcatctctcagaaaaaattatccttttgcaaagcctataaaatg

SEQ ID NO: 111214 - DNA, 339 bp, Heterodera glycines
  misc_feature (151)..(151): n is a, c, g, or t
  misc_feature (156)..(156): n is a, c, g, or t
  Promoter: Source sequence=SeqID_38434; Location=1117..1455; Strand=-; Gene=SeqID_67250
ttcgaaataaagatatccagacgatttttttgcagtttgaataaaatgtgacagttgtctacggaaatgattgattaccctcaaaaattaaggcaaacccagaccagtcacgtgactagacccctccccccttttgcctatttcgcacacncggcncaaatcgcaaatcattcaactaaatagttggatttcattaaactctcttcacgctctaattttatttctctccgctctatttttatttgcattaattaaatctattactatttacctacgtctttttcttttcaaatctctgctctctttaattcttctgtttcaatttcttgttttaaaatg

SEQ ID NO: 111215 - DNA, 527 bp, Heterodera glycines
  Promoter: Source sequence=SeqID_25989; Location=597..1123; Strand=-; Gene=SeqID_56743
ggtccgctataaaagccacaattgcgcaaaaaattttcttttttcgagaaaaaatattgctttggaaaatatttcgcaaattgaattttaattcaaatttaccaataaaatatttattttatatacaaaaaaaaagtccaataaaaaaacaaaaaatgtctcaggcgcaaaaaaaattcctgaccgtcccggctgaaaaaagaaaagaaagaaatataaaaaattttttcaaaaaaactatcgacgaaataaaattaaatgaaaataattatatcgaaatatcatcaaccgaaaaaagtatgcccgattacgggattgaagaaaatattacaagatttatatttaaaaaccctaaaaaagaaaaccgaaaagaaacatcagaaaattttaaaaaaataatagaaaatttaattaaaaaatcaatgatgaaaaaaagaattgggtggaaaattcagcgtatttctattgatttgttttgtgaaattttaaatgacccaatcattttaccggccagggacccgaagatg

SEQ ID NO: 111216 - DNA, 323 bp, Heterodera glycines
  Promoter: Source sequence=SeqID_2808; Location=613..935; Strand=-; Gene=SeqID_81728
catgaacttggggcgttttgataacaatcatagagaataattaccgtaatcccattgggaagtaacaattgtcataatcccttggagcgtaggtaattaccgtaatcccatcggagagtgaataattaccctaacctattagcaaattgacaattatcgtaagcccatcggagagtggttgattacagtaatcccattgatggttgattacagtaatcccattgacgatttagtttctacattaatgccgtaattcatccccttttccttgttttgttgtgcagctgcaccaacgccagcagcagcaacagtccaacagtatg

SEQ ID NO: 111217 - DNA, 1003 bp, Heterodera glycines
  Promoter: Source sequence=SeqID_21507; Location=1046..2048; Strand=+; Gene=SeqID_52116
gtttttttaccatgaaaaggtcattcaaaaaatcaacccaaaagacatttgcatttatttgtctaccagtttaaaaataaataaatgaattgattgttatggatggggtgcacttttcaaatgatattatattaaattgaaagcattttataacttatatgtacatattaggtacatttttttatttatccactttttattggtcccttccttctcacacttcttcctctgacttaacatatcactcttttcgccgtttccttctgccgatggatttggtcgcttcgtctctgcattatgttggcagtttttttgacgtggtatacaaatcaaatcattcaaattcatcgtcattttccctctcaaatttcgcgtttccttaggtcgatttggttgtgatcggtgcgctcgctgtctttgccattgcctattatgtcagaagtcagtcgctgtccgcgcacaacaaaatcaaattcccggagagcacgccgacgctgcgcaacggcggcacgctgcaggacagcggcaggacggaccgttcctttttgggccgcatgaaatcggaggaccggcaggtgcattcttttttgtttcatccttgaaaagacccctaatgggggtagtgaaaccctggttacagaatccatttcgtccacctcccccatttttgaaatttcccttaattctggcacatattttatgtcaaaaatggaagaatttaatttttgcttttgatattcgtttggcaaaaataaagtaacgcaaaacaatccactgaaaatgtttgccaaatttaatatatttcatcaatttaaaatgctccaaaaagatcgtttcggcacccttaaaatttttattcggctttttttgaaaccgattatgctaatatatttcttctcaaaagcatttgccttgtattttttacatccccccccataaaactcagattttgattttgttcggctcccaaacgggcaccgccgaggaattggcaggccgcatg

SEQ ID NO: 111218 - DNA, 605 bp, Heterodera glycines
  misc_feature (28)..(28): n is a, c, g, or t
  Promoter: Source sequence=SeqID_29764; Location=1..605; Strand=+; Gene=SeqID_60231
tgtttaatattattttacagaatattantttgcgaaaaaattgaatatattaatgtgaatcattcattcagctgattgaccaaaaagaaaaaattaaacaaaatagtcaataataaaatgggaacgacataattgatcaaatggcttattatccggtttaaaaataagaaaaatacagcagaaaatgatcagaaactgagaatttatcaaaaattgaaacaattaaaaaaattatttaagaaaaaccttatccattcaattagtggatgttaattgtttttcttcacctgttcctttcccttggggcccgaattcggatggattgatccttttgctcaaacaaatatcttccaccctaaaatttagatgaccatcttgatattgtgctggttttgctggtcatcggccccgtgttcttcccaacttttcaactttgttcagtaggaaagaagcagaaaattttttcagattttttttttataaaatcaatttaaatatcttattttaaaactgagttttatttcgccacactaaagtcagtgttaattagcgataaaaaaaacaaattctattttaattctgcgccgcaagtctcattttgaatg

SEQ ID NO: 111219 - DNA, 898 bp, Heterodera glycines
  Promoter: Source sequence=SeqID_60; Location=495..1392; Strand=-; Gene=SeqID_58487
aaatgttcaatactttttcagatgctggttaattgcaacaaaaagtaatgatgggcgccgcacaaaacattttttgtaagccaaaattggtcacatgcttttcaactgttcattgctttttgctttttcaggtgctgtattttgtcaccaaaaatttgatgatgaaaagagcacgcataattttattgaaagcaaaaataaacttactgtttctttaaatgccccaaataatttacaggcgctgcttttgttacaaagttattgatgcgccagagcaaaatttttttgtaaacaactaactttatttagtccgataattatttatttttttataggcgctgtgtattgaattttggtcccggattggactggagcgaaaaaactccaaaaaaactttttatttaaattctttaatacttgtgtttaaataattgtcacaagttttattggatttgaataaatttgtttataactattacaatatttatttctactaaattaaaaaatgatatcccatcacaatattatctgcctgaaattcatttcgtacgtccgcccgtccgaccatccttccttccttccttcctttctttgctcctacattccttccttgtcccttttcagttttcaaatgtttaataattactgttgcatcttcacaaaaaaatgcttcgcgcaaaacaatattaatagaaaaccaacatttacaacattcgttcacaaaaaatttcattaatacaatttagaatttaataataaaataataaccgcactttttttgaattttcttatttaaaactttttcaaagtgaatattggcgttcataaaccattcagataactcaaaaatctccacgatcaatttcctactgtttacctatcccctattgcaattatg

SEQ ID NO: 111220 - DNA, 179 bp, Heterodera glycines
  Promoter: Source sequence=SeqID_5886; Location=1453..1631; Strand=+; Gene=SeqID_59561
ttttgttggaaattttttgatttttttttgcaaatgaatcgtgattttggacggatgaactttgcgaactgaaaagtgggcggagcctaaccgattgaaaagtataaaattggcccgcttttgaaattccaccccatttggcgaatcattctaaatttttctcgacacaaaaaaaaatg

SEQ ID NO: 111221 - DNA, 1003 bp, Heterodera glycines
  Promoter: Source sequence=SeqID_9440; Location=112..1114; Strand=+; Gene=SeqID_71421
actgagtttcgctggataaaagagaggggggggggggaatttctgaaaatctcaattcacaaaatgtgccataataaagccaagccaatagcaaggacaaaagagcactggcaaagtgcatttcgtttcttctgattttaattcattttacaaaattgcgttcatttgcggcgatggtaattgcagcggcaaatttgggcacgacgtctaacttttgtcctatttttattctcttttaaatccatcaatcctatttgggttcatttaagtcttttaaaccgaactttcgagaaatgccagcggtgcaaagtcgaacccgtaaaattaattattattcaaagcaaaatttaatataatttttaaaattctcggatttcatttttcgggatcgatcctctcggggttcagtctcattctcagggccaagaaaggcttttgaacatcaaatcgctttcctttcctcgtcttctctgtatctttctctccgttctctcctcctttccctcgtccctcgtccctcctcccctattcccctctcctcccgtttctctctctccctctttctctctctcccctttctctctctctctcctttctctctccccccctcctctcctctccctctttctctctctctctccctctttctctctctctcccccttctcttctctccactcttcgccccccccccatctttacgtttctttacaccgacttcctcgcttaactgaactcatttctctcatcagttccgctgctgttagccttgcttctcctatcccttcgttttcatcccattcactttcttcttcttctgctgcttcttctccccatggtccctcctcctccgatcactttttgacttctcccttcttactaattaattgtggccagttccatggatgttattcaattggccaccccctctcatttcgcctcaaagggccaaattgatcgggttggcctcaaccgtaacaaattgttcgttgccctgcgaaatg

SEQ ID NO: 111222 - DNA, 153 bp, Heterodera glycines
  Promoter: Source sequence=SeqID_35462; Location=1..153; Strand=+; Gene=SeqID_65005
acttcctctcttcaccatttcaagccccggccacttacaattagcattagaacccacccccatctccataaatgccattccaattttttccaattactctatatatttgcctattccaattccctcccaggtgacaatttgctgacggcgatg

SEQ ID NO: 111223 - DNA, 539 bp, Heterodera glycines
  Promoter: Source sequence=SeqID_14224; Location=1..539; Strand=+; Gene=SeqID_78239
gggggcaaaaagtcagcaaattattggaaaaataggggggctccccaaaaactgttcaatttgtgatccagcaacattatgatgttgttgatggccaaagaaaaggccagctaattatgccttaaaaagttgaaaatagatcaaagcgggtagagggggggggaggggattgggatcacttccattattttggccaggcaggggtttcccttcatctgtagtgaatgtgaccgggggttggtatgctaccatcccggtaactatcgtaaacccatcctctgtttacactccagtattaacaacctaaccgagtttttgagggagggcaagactgaaacgacatgtccaaccgagacaacagaaacgaccagcagcacaatcatctgtcctccgcctccaccaacgacaactcacagcattctactgttgttcatcacttctctcctccttttggtctttttcgcgcaggtccacccccctcccccgtctaatcattaattattttttaatcctttttcaatttacaggctttcaaaatg

SEQ ID NO: 111224 - DNA, 110 bp, Heterodera glycines
  Promoter: Source sequence=SeqID_1736; Location=5974..6083; Strand=-; Gene=SeqID_75600
ttggctgatcgtttccagcggtggtgatccaatgacccaaaagcgatgttcggcactttgtttggtcgtgccggaagtgattgaagcaaaattggcatttttacgaaatg

SEQ ID NO: 111225 - DNA, 437 bp, Heterodera glycines
  Promoter: Source sequence=SeqID_11034; Location=219..655; Strand=+; Gene=SeqID_74366
ttttttttgaatctttttattgtatacctcgcattaataaatggtgttattatttttaaacaaatatattttcacctgattttttcttgttttaagctctatggtaaaataattcgctccttttccgcaaatatcactgtgttcatttgctgtcgatgcaccgccagcaccgtttgttgtttcgtgtactgcttgccgacgcggccgttgccgcgtgaactgctgattttccgctacgcgtaaacatcgcttcccaaaactgttccgcgccgcccgcacctctgaacggcgttgcactgttgccttacgtcgcgccgccgccgctgccgcgacaccgccgtcgtttcaacgacgacattccgcagcagaaactgttcagcgattttggccataccgcggccgccttcgttcgtcgccgagtgcagcagcaaaaaatg

SEQ ID NO: 111226 - DNA, 66 bp, Heterodera glycines
  Promoter: Source sequence=SeqID_7829; Location=2835..2900; Strand=+; Gene=SeqID_66093
ttttacttttttatgtaattttctttttatttatagttttggataaacaccgcttatcccgaaatg

SEQ ID NO: 111227 - DNA, 299 bp, Heterodera glycines
  Promoter: Source sequence=SeqID_5902; Location=1..299; Strand=+; Gene= SeqID_59617
acttttaaagaatatattaatatattttttaaattttttcctttaactccaatttccatctctaattttcactcagacccccattcttaccagtgcttgttttcccggttcccggttgccctaccgggaccgggacctgagattttcaaaacccgtggcgaggaatttttcgggtcatcaaaattgagggcatttatgttactgtgattagttgcacttcgccaaattcgaacccaaaaagacttcacttaaaccaaattaaaaagtgttacgaaattttgggccctccctgcactatg

SEQ ID NO: 111228 - DNA, 109 bp, Heterodera glycines
  Promoter: Source sequence=SeqID_39891; Location=1554..1662; Strand=-; Gene=SeqID_68355
aagtcaattggcatttcgggaaggattcagctgcttagaattgagcttgaaagtttcgaaattgatctgtcttttgtgccagtgccagaaaaatatttggaacaaaatg

SEQ ID NO: 111229 - DNA, 164 bp, Heterodera glycines
  Promoter: Source sequence=SeqID_11167; Location=1..164; Strand=+; Gene=SeqID_74518
tggtttgggatgcgtttggcagccacaagagcgagagaacgacgaaggtggtgaagggattgggagtggaaacagtttttatccctggcggctgcaccaaattcatccaggtaccaaagcatccttctcaatgaaattcacttttcttccctaggctcccgatg

SEQ ID NO: 111230 - DNA, 443 bp, Heterodera glycines
  Promoter: Source sequence=SeqID_31666; Location=1..443; Strand=+; Gene=SeqID_61981
tattaaatatttataaatctcttttcgttgcgccttagtcattatgtttgcgcaaatatgccaaaaaattcgcctctccacgattagcaattgcccttccccgttatttgaattacgctttcccttcaacactgagaatgtttatattagttgcgctgttgggttaatcgtcggtagccaaaaagggatttacggtcagcagttcaagcactatggcaaaaaatgaagatgagagcggagaagaaatctgagacgtcagaattgtcggcaaattgggttgactgtggatgggcgggatcaaaacgataaatcgagaattgactgtggttttgatcattcatcgccttttgtgtctccaaaatttttttatattttcgtttggacgatttgcttataatagaatacaattattgttttccagctaacaactgatcaacaaaatg

SEQ ID NO: 111231 - DNA, 1003 bp, Heterodera glycines
  Promoter: Source sequence=SeqID_17760; Location=358..1360; Strand=+; Gene=SeqID_82298
accgaaaagcgacggagaaaaagacaaaaaacagttgttgaaaatatgcaaaaggtagcgaattctaaaaaactgtgctcacaatcggcagcgaaatatgatacagcgggcgaagaactgaagaaaatggcaaaaaataaaataaaatgataaaattaggaaatgcaaaaaaaattattttttattgaaaaaatacaatttttaaagagggataaatcaaaataattaccgaaaatggcaataaattgggaaaatgaaaaggaaggaaataaaaaaggacaaattaaggaagattaaatgagaaagtgtaacacggacagacagataataattaattttttatgaagtgaatacacattaattattagggctgcaaaaaaatgtacaaaaagtgatccaaatatgtacataaatatgtaagaaaaattccaaaatatgtacaaaaaaccccaaatatgtaaataaaatttttttaatggtattttttgggaaagaaattccccgtaaagtatgaaatagccacaaaatgacataaaaattactttttggtatttttaggcaacattttcaaacttattttttctttataaattttcaaaatatgtaaaaaaatgaaaatatgtacaaaaatatttgccgaaattttggattttttttttgaggatttccaaaaatttccataaaaaatactcaaaatatgtaaaaaaatgaaaatatatatgaaaaaaatccaaaatatgtacaaatatgtaagaaaatcccgaaatatgtaaatatgtataaaaaccccgaaatatgtaaaaatatgtaaataaaagtcccggtttttgttcgcaaacacaaaaaagaaactgtttttcctgctatttagagcaaggagaagccaggaaaaaatatatgtatttacataaaattggcagccctaataataactaattaaattaaaaaagaaaatttgatgtgccgttcgtgtcggttggacaaatgtttgttagtcggcatg

SEQ ID NO: 111232 - DNA, 749 bp, Heterodera glycines
  Promoter: Source sequence=SeqID_9823; Location=1501..2249; Strand=-; Gene=SeqID_72832
tttgttgtatgactttcgtgtgacacaataatgtgggtcatctttttgataaaaaattagtgtttgttgtatgactttcgtgtgacacaataatgtgggtcatgtttttgataaaacattagtgtttgttgtatgactttcgtgtgacacaataatgtgggtcatgtttttgataaaaaattagtgtttgttgtatgactttcgtgtgacacaataatgtgcgtcatgtttttgataaaacattagtgtttgttgtatgactttcgtgtgacacaataatgtgcgtcatgtttttgataaaacattagtgtttgttgtatgactttcgtgtgacacaataatgtgcgtcatgtttttgataaaacattagggtttgttgtatgactttcgtgtgacacaataatgtgcgtcatgtttttgataaaacattagtgtttgttgtatgactttcgtgtgacacaataatgtgcgtcatgtttttgataaaacattagtgtttgttgtatgactttcgtgtgagacactaatgcgtgtcatgcttttgataaaacattagtgtttgttgtatgactttcgtgtgacacaataatgtgcgtcatgtttttgataaaacattagtgtttgttgtatgactttcgtgtgacacaataatgtgcgtcatgtttttgataaaacattagtggtttgttctgtgacttttgtgtgagagataaataaatgtttttgacttttaattttttaaagcaatg

SEQ ID NO: 111233 - DNA, 88 bp, Heterodera glycines
  Promoter: Source sequence=SeqID_14760; Location=2769..2856; Strand=-; Gene=SeqID_78893
tcatttatatacctgagaattaggactccgcccactttaagcagattaaatttacccgctcaagccccaaaatcatttttacaaaatg

SEQ ID NO: 111234 - DNA, 496 bp, Heterodera glycines
  Promoter: Source sequence=SeqID_3270; Location=1..496; Strand=+; Gene= SeqID_83991
aattggcactgatttcgccccgtttcgatgttttagtggacaaacatttcgatgggcaaacgcgaattttttcaaatttcggtaagtcttttgtttttgctttttttgtaagtgattggtttttttttgtttacttaattgaagtcgtaagtttcattttttcaaattggccatgaaaatattttctatctaaaattttgattggattcggtgcttaaaaaggaatttgtaaatattttttaagaaatttgcgattttacttatgtttcagcatattttatctatgttttaaattattttatttgataattaaaaacggtaacaccttaagggaaacttttttctcttaaaattaaaattttttttggaaatttgatatttttaatttagttttatggccctttttactcaattaagactaaaaatggattttctatgaacaaattttctcatttaactaacatattttttcaaattttcagctgggtttgcaatg

SEQ ID NO: 111235 - DNA, 195 bp, Heterodera glycines
  Promoter: Source sequence=SeqID_14522; Location=434..628; Strand=-; Gene=SeqID_78573
ttttgagaggtaaattattgagaattgccaattgaacagtttgttattttatgaaacttgcactttaataaatgaaaaataatattttttgtatattttcttaattaaaatttcgatgaacgaattaaatttaatgaaacaaaagaaacaaatttatgctaataaaatttttaaaaaacaaaaattgtaaaaatg

SEQ ID NO: 111236 - DNA, 219 bp, Heterodera glycines
  Promoter: Source sequence=SeqID_1971; Location=2308..2526; Strand=-; Gene=SeqID_77099
aaatttcattttaaataattcacagagtcaaaaatttaaatattaaatttaaatctcaaaaaataaaagatgccaccgttcaaattgacaattggatgcccaatgatcttttgcccaccgttatgaacacttttttccgctacaacggctctctgaccacggggggctgccacgaagcggtgatttggtcagtgtacgaagtgccgagattcaacaatg

SEQ ID NO: 111237 - DNA, 544 bp, Heterodera glycines
  Promoter: Source sequence=SeqID_13982; Location=111..654; Strand=-; Gene=SeqID_77943
ttcgaacaaaaaattttaattgggctatccctagttgaaaaaaaaaaaaaaaaaaaaaaaaaaaaaaaaaaaaaaaaaatttggaacgcttcacgaatttgcgtgtcatccttgcgcaggggccatgctaatcttctttttactaaatttagcttgacatgatcaattaaggaacaaaaatgagaattttagaaaatttgtatttttcaattttttcgagttcgggtccgggttttgattgattgattgccctgttttgacgttgatttgacctttccctcccccgcccctcattgccaactccttagcctttttgctgccctttcctaattatctaattgatcattacactttcttatcgtccttttgctgttgtgttctgctgactttttccttctttcatttccctttcctcccaaccctaagaaatgaacaaaacaaccataagaattaataatacatattatttgcacgattattagttttatattgttaaataaattaaggatttttaggaaaaggtacacttactttctaccaaatg

SEQ ID NO: 111238 - DNA, 1001 bp, Heterodera glycines
  Promoter: Source sequence=SeqID_20213; Location=1125..2125; Strand=-; Gene=SeqID_85011
gtcactagaaatcactattttggcgctttgtcactaaaatagtgaaaattcattattttggcgttttgtcactattttttcactttttcgacattttttggaaaatccttaacaaaaatgcaataaaaacaaaaaaatacacccctaagaatcgccctaattttttttaaatacacccctaagaatcgacctaaaaatttttcaaaaaataccagttagaattggaaaattttcataaaaatttttcccccaaatttttttcttacaaaatttttggtttaaaaatttcaatatttgctaaaaaatgtaagaaagggatgcacctcatttgtaactgcaatcagtgaataaatattttttttgctcaatttttggctgaaaattatgtcactattcgtcactattttggacttttttcactattttgtcactattttggcactttttcgtcactattttagttaactatttcgggatttttcgtcactaaaagtcggttccttatttattagcccctcttactgttgaattgagtttaatttttttttggaaaatgtgccaaataaattattaaataattctatttccccccccccctggcacataaatggagactggtagattatttttcaaccttctcagaagggggtatataattggagaccggcagattaatggagactggcatataaaaagagtatatacggtaactggcgtaatttaaatcgattattttgactgtctctgaatatattgagtttatttcatggtgtttcatatgtattcgcaaaaaataacatcaaaaaatataaatccgaacaggtaaatatatatgaaaaatcatgaaatacactaatgtttttagcttgattttatttgcatattgtacaatatatggctcagaaaaagattaattttcgaaaaaattattaaaaagttaaaaaactcttttaattcgtcgtgaaaatttcaaccgttaattatttgtttttttgaatatg

SEQ ID NO: 111239 - DNA, 853 bp, Heterodera glycines
  misc_feature (103)..(103): n is a, c, g, or t
  misc_feature (760)..(760): n is a, c, g, or t
  Promoter: Source sequence=SeqID_19080; Location=2567..3419; Strand=-; Gene=SeqID_83823
caagcagctcaattcattaatcgatacaattgtgaagatttgaattaaagaccagacttttttttgctgaaaggctaccaaatatattaaggacaaacaaaanttcaagctgagaaacttgaatctcttttagctacccaaagatggaccatttcaagcgtttaatttggtagttcaatggctttgagtgaatgaggcttcaatgcaattgaatgttatttttttacaggcaataattattattttttagttcttttttgtgaggcaatttaattcatatcagcaaaagcctagacatttaaggaacgtcgctccttcgggagttctgtcatgttgaatggcgaaattgaaaatttatgtgccaaagagccttaagaatccaaactaaggcagaattgttaaacgggcgatttaaaattttgaaatttaatcgccaaaaaaaagccttataagagaaaaaaaatccgcttttgatgttttttgtttggacataatattggagacattttgctgagctttaccctgcgtgcacgcactaaaacagactgctccggaagttattaggccactcaaattattaaaaaaaaatattattttatatgcttccaaatttaaacagaaaattaaaaccgctcacggccaattttttttttttcaattttttacattgaggaactttcagaccgccctaacattgttatgatcagcagaagtacaattttttttttgtgatgatccattttttgcataaggcaaaatntagttgaaaaaaggccaaaaattctgattctgctctctcggctctctgaataaaaaaaatattcacggcttttgtgccttttgtcaaaatatg

SEQ ID NO: 111240 - DNA, 155 bp, Heterodera glycines
  Promoter: Source sequence=SeqID_3860; Location=1..155; Strand=+; Gene= SeqID_52183
ttggctttacattctttgaaaatgatattgaaaaggcaaaaaggaaaagcttcatatctcggccagaagcttcatttagcaaaaataaaaaaaaatttataatacaaagggggggtaatctacctaccctgaaagtttcattcggaagtcccatg

SEQ ID NO: 111241 - DNA, 1003 bp, Heterodera glycines
  Promoter: Source sequence=SeqID_14281; Location=2040..3042; Strand=-; Gene=SeqID_78301
cgaccgatggtggcgggcaattatcgaataatatgtgtgtagtccaccagcagcagcagaagagcactcttagcctctccgattttgtgtgcccccaccaaaaatgtttgtgtttgtttagtgggtacgttctctccggcggaccctccgcgccgttgcctgcccatatcagtttccactcaccatgtcgcccccccccgctccccacctaaaaaaataaaagtcaaacaggaattttcgaattttctttgaaaatatttttttaatttttgaaaaatagggatggaaaggatacgggtgagggagctaatccgggggggggggggggggtagggaacgagtggctccccagcgacactgatttgaaacgatcaattttcttccttttttttctcttccctcctcctccccctgtggtctctttcttttgcttaatcttttgacaatgaatgagaagaatgatgattaaatggagcggaggaaagaggaaaagctcacgcatttgtcaacagagaagcagcaagaagcttaaggggagacaaacaaacaaacaaaaaaccgaatagagggaggaaaaatggaaagaaaaagaaatatgagatttttgaatgcgattttgcaaaaaaaaaaaaaaagcctttggaagtgggttttctggatttagtgttttagtgtctgacttaattttgcatattctgatcaaaaattcagaaaacctaggtgcccaggcgcctaggtcaggtttggtacatgatttgaaaaaacgaaaatggatcccgaagagaccgaaacagcccagaaaatggggctagtgtaacttctaagatcttgacaagtaagggatttcttgtttcttggcattaaatgtttaaccccgctttggctttttcttttaccattatttgtctccattttcatttaccttttcaaatgccaattcatcggtgagttttcattttaattgtttatttaaatccattttcattagatttaagatgatatg

SEQ ID NO: 111242 - DNA, 896 bp, Heterodera glycines
  Promoter: Source sequence=SeqID_29216; Location=1..896; Strand=+; Gene=SeqID_59749
gtctttttttgataaatcatttctataaattgaaagttccagcagagaacttcgaaatccaaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctattgatcaccattatcaatgtgttatgtctctgtgttatcatttcaaatgacttgtgatcaattgtttcgcctaatatgtattaactgtgatgaaacgtgaattttattaaagacctatagacctttttgattgcgaaaaaatgtttccgataataaatcgatgaaaattcattcatggattttcggggttgctcgcatcagcaactggcaattgtctaaatttgttgtcccgataaaaaatagccagaattttggttttcctttgcagcgattttagggaaaaagttctgattaagaatatttcgttaaatgatttatcgaatccaaatttttcacattcattttttcaatggcggcgagaaagccataaaacaaaggtgcggcgagttgggcggtgccctccacaaaatttagaaaaccacagccaatttaaaaatgcacattacagttttattgtccgaataacctatttatg

SEQ ID NO: 111243 - DNA, 388 bp, Heterodera glycines
  Promoter: Source sequence=SeqID_10134; Location=655..1042; Strand=-; Gene=SeqID_73227
tttcttattcatataaacttgctaatgcgatctaaaatataaatagaaagaaaatgtcaactgcgcagcataaacatcattgactttcatttttaagaaggaaaacaaaaaaaggtaaggttacatcctatgtacatacaatacaatacatacacacatcgcaagtctcaaaagtcatttcttgaaaattaaaaatttaaatttgttttttaaatagtggcgttatgttcagcagcgtaaatcttcaattagcatcgattatgcttacgattacgtatcctatcaagcaattgatgtaggcttttcctttatcctttatttatatcaatttaatgtcattttttaaatgtaaatttcatttttagttaatgatttctttttagatatg

SEQ ID NO: 111244 - DNA, 586 bp, Heterodera glycines
  misc_feature (7)..(7): n is a, c, g, or t
  misc_feature (42)..(42): n is a, c, g, or t
  Promoter: Source sequence=SeqID_30946; Location=337..922; Strand=-; Gene=SeqID_61312
aaaacgnaattttgaaataataaaattcattcaaaaaagttntaattagcaataattttgctcaaaaacaactaaaatttaattattgaaatcatttgtatcactaatttttttttttgcaaaattcaagaaatttcattaattttcaaaaaagttttattggtcgccatgcttttaaggttttttatttgtctgaatcaactttatcgatgaaaaaacttttaattagaaggaatattaaaatgaattaagagattttattttgaaaaatgcgaattaaaaatttcttttgtttgggtgaaaattgtcgtgtggcattatcagcctagaggtattggcataatctttgctaaaatgacacgtcagatgatcaatacaattcgatgaatggcaaaaaaaaaatgaaaattagcatttgcatttgtaaaaattgtttcgaataattgtaaatatgaaattactaaggcactcttcactaacttttattttaattgccactaattgggcagttaattttgggcgcgcgcaaacttatgaatgggaagagcaaaatttggccaataatatcaacacattggccaaaatg

SEQ ID NO: 111245 - DNA, 51 bp, Heterodera glycines
  Promoter: Source sequence=SeqID_41475; Location=268..318; Strand=+; Gene=SeqID_69581
ggtgaaggaaatgtaggggtagtctaaaaaggtgggaaagagaagtaaatg

SEQ ID NO: 111246 - DNA, 88 bp, Heterodera glycines
  Promoter: Source sequence=SeqID_8651; Location=1915..2002; Strand=-; Gene=SeqID_68776
ataagggaacttagattttttatatttttaaagttttctcgggcgaaatggcatgttacataattgttaaggtaatttgactcctatg

SEQ ID NO: 111247 - DNA, 140 bp, Heterodera glycines
  Promoter: Source sequence=SeqID_13262; Location=1..140; Strand=+; Gene=SeqID_77091
taacttcgtctttccgtagcgcgcagcacagtaccttttcgctatataaaagcacgcaaatatgatgcaaaacttcattttaatcagacgattttttgcaaaataaaatgaatacttttaataatgttcagcaaaacatg

SEQ ID NO: 111248 - DNA, 51 bp, Heterodera glycines
  Promoter: Source sequence=SeqID_32805; Location=1..51; Strand=+; Gene= SeqID_63044
taattattttcgatttatttgcctaattaacttttagctgatctttgaatg

SEQ ID NO: 111249 - DNA, 601 bp, Heterodera glycines
  Promoter: Source sequence=SeqID_2077; Location=2011..2611; Strand=+; Gene=SeqID_77716
atcgcaaaacttcaataggaattaagacttaaaaatttactacgacaattttttagtaactgaaaaattctctgtattttttttttttgtaattttagataaattttcgtcgacgttttttacttttttcatttcgtatttacctaaaatatgtttaatctaatatagatatgtttatttgtaataattaggtattaatttgaatctgtatcatttcatttaatcatggatattttaattattaattgctcaaatacaaattttattaattctaaaaacttaataaaaaatctattaaatattacgcattttaattgattaattaacaatcattgctttttcctttcctctagactcagccggctcctcaaccaccgcttccgcttcgtcagtgcgcgaccgcatcgcgcattttgaagcacttaaacggggtgaagcggaggcggcgccaactgcgattcctcgtcccacagccgctgctgcggccagtcctgtggcggatcgtccaccgtcgcgcgagcggcctccgtctcgggaggaggacgaggcggcacgtcgccgcttcggctggcgaccatcgaccgccgaacggcgcacaatg

SEQ ID NO: 111250 - DNA, 101 bp, Heterodera glycines
  misc_feature (18)..(18): n is a, c, g, or t
  Promoter: Source sequence=SeqID_7069; Location=4743..4843; Strand=-; Gene=SeqID_63735
ggttagttcattaaaatntaattttggattttttgcacctaaatcttttcacgattcctttttgttatttttctattccagcttcttgttctgctgatatg

SEQ ID NO: 111251 - DNA, 60 bp, Heterodera glycines
  Promoter: Source sequence=SeqID_4365; Location=1..60; Strand=+; Gene =SeqID_54185
taaacaattcaaaagttatttggccaaaataaaaaagttgaaaaagagcagaaaccaatg

SEQ ID NO: 111252 - DNA, 510 bp, Heterodera glycines
  Promoter: Source sequence=SeqID_25388; Location=759..1268; Strand=-; Gene=SeqID_56127
gctgggaattcatcgccctctttcgttcccccgggggattattaagtgccttttttatcttttgccgcatttgttctctctttccacctcaacgaacacaaagatcaaaagtgtcttttttaatgattgaaattagcaatttagcaaaagtaattgcaaatccatcaatgaatttcgaacgaaacaatttgtcggccatttttcctgaagatggcacttttgacgattcggcactgagcctatcgtttgaagaattaagccaagaattagacttccaccaaataaatcccaaaaacattgtgctcgtttggaatctgccgcccgttttgaatttggatttgctgcgcgtggagtttttggcggaatgcattcagaaagtaaacaatttttggtacttttttttctcgcgggacccaaaagccaaatttacacattttcattctcaatttttttaacgttttaaattaaaaatttatttgtttcctttaggtgcccggcctgtcgattatg

SEQ ID NO: 111253 - DNA, 104 bp, Heterodera glycines
  Promoter: Source sequence=SeqID_4110; Location=2809..2912; Strand=+; Gene=SeqID_53229
gctgaattgtcttattaacaaaagaagaattttacatttttttaccattcaaattccttctttgatccgtgcatcggttggtgtcttgtgtacgcgatgacatg

SEQ ID NO: 111254 - DNA, 74 bp, Heterodera glycines
  Promoter: Source sequence=SeqID_675; Location=769..842; Strand=+; Gene=SeqID_58771
ggtaaaccccagtcggagttgcgttacctacgtcaaagactgtttcgatttttttagacgacgcgtccggcatg

SEQ ID NO: 111255 - DNA, 153 bp, Heterodera glycines
  Promoter: Source sequence=SeqID_36744; Location=914..1066; Strand=-; Gene=SeqID_65992
atattttgccattttttttacatattttcagattttttgaatattttgccattttttgtacatattttcagattttttttttttgcatattttgccatttttcgtcaaatattttccgatttgattatctcttaggaaaaaattttgaaaatg

SEQ ID NO: 111256 - DNA, 160 bp, Heterodera glycines
  Promoter: Source sequence=SeqID_18573; Location=461..620; Strand=+; Gene=SeqID_83208
tgctcaacttagacaaaaaggacatcgtttcggttatttttctttttttaattttttgaggaagttcagttgggttttcatttaggttatctttacagtaatagttagcattaatctgtatatttagcggtttttctcaaatccttatgcaacgacaatg

SEQ ID NO: 111257 - DNA, 518 bp, Heterodera glycines
  Promoter: Source sequence=SeqID_645; Location=3439..3956; Strand=+; Gene=SeqID_58006
taatattattaaataataataattattattaataaatatttaaattaattttccctttttatttctaaagactaaaaagttaaaataaatgaaacaattaaacatgaaatgaataaattattattttttgttgaaaagggactcttttttgatttgttcagctttttcaaatgaaacattttcttgcgaatgaatgcgactttttgtttatcccttctcttctctttcccaccaatgaaatgataaaatgcgacgacaaaacaaaacactttttatttttatcttttaaacgccgcctaaacaaatgaaaaattcggagataatttgagtttattgagaaattttgtattaatattaaaaattttaatgggacattttaagtgagtcatccattaattaattggttaattaattaattaagcgattttcttttggaaattcatcgacaaaagcattggacaaagcatttggcctcctccgtccgtttcttttcgttgttcgaaccgccgccaaaaatg

SEQ ID NO: 111258 - DNA, 192 bp, Heterodera glycines
  Promoter: Source sequence=SeqID_49; Location=617..808; Strand=+; Gene= SeqID_56547
aaaatttatttttcatcaaaattcacccaaaatcgaaaaagaaccaacggcagcagaatctgaacaggagagccaatgacgactaaccaacggtctttcatgcatttcaatcgattttggggtaataaatgtgaattttggtgaaaaatgaattcgactttttattcgaattcaggtccggggttagaaatg

SEQ ID NO: 111259 - DNA, 193 bp, Heterodera glycines
  Promoter: Source sequence=SeqID_23122; Location=2480..2672; Strand=-; Gene=SeqID_53833
aaagcactttttgatggtaaaataagaaaacacaaggagtataggaagcaagaaataaacgtaaaatggaacaaaagattcttgattagcgccatcgataacctccgaatgcaaacattgttaagatcacctttttcacactttttatgggaccggtaaaggcaataatatcaaatgttttgaatacacaatg

SEQ ID NO: 111260 - DNA, 237 bp, Heterodera glycines
  Promoter: Source sequence=SeqID_8802; Location=874..1110; Strand=+; Gene=SeqID_69277
ttttcccttataaaagtgcaacagcaagacgaattaaaagcatttctttataaacaaatcattatctgataggggaggtaaaatattgggctatacaaaatttaaaatcctcattttgacgcactatttccatgtctctaacatataaaataataaaaatcaaaggttggcattaaatcgtcatattacactactaaaaggctcatcattttgcttttaatttacgcgtataaaatg

SEQ ID NO: 111261 - DNA, 1003 bp, Heterodera glycines
  Promoter: Source sequence=SeqID_5324; Location=571..1573; Strand=-; Gene=SeqID_57683
cctcttttctctccctctctctctcctcttctctctctctcttctctgtctctctttctctctctgtttttttttcaatccattaatttcataaacattattatttgttaataaattttctttctgccattttctattttttttgtttgttttgtaatagagggaactcatttggcatgcaaataaacctcattttgggtcaaaaagcctcatttttacaaaatttattcaaaacacgtttaaaatgatcaaatgttatatcttcgatggtccatgacaatttgagcaatttttttgttcgaaataagcatcttgtgagattctgagcatgaaaaatcgaagttgatttttttgcggcgctttttccaaaaaaacttggagattgaggggcgggcggtgccgataggcgccgccggtgggggaaaaattgagaattttgaccatatttttagcagattttcatttaaaaaaattcataattttgtggatttcgaaaaaattgtaattttctggctaaatttgggtgagatttccgtttgatactctattaaaacccaaaaaattaaataattgtcaaacattatgtcaatttatcaaaatttaaaagattctgacgatttttcccaaaagcctcaaaaatcctcaaaatttctcaaaaagccacaaaaatcctcaaatcacatttcaaacaaaaaaattctcattgattttatattcaatatttgcttaagtaaacttaagaaatacaatagacaaccaaaaaaaatggatttaaaatttaaaaatgcaaaatttttattgtcgtccgttgtataaaaaacacctccaagtttttaaaaaaagagaagttcgcaaaaaaatggtgaaaatattaattaaaaatgccaaaatgacaacaaaaactcattgggggtgtatttgtaaaaatttccaaaaagtcgatctttaggggtgtatttttcgcttttttttgcatttttcttgtgaaattttgccaaaaatg

SEQ ID NO: 111262 - DNA, 131 bp, Heterodera glycines
  Promoter: Source sequence=SeqID_33772; Location=1..131; Strand=+; Gene=SeqID_63731
gttcaagaattatcgactattttttaaaattattattgttttttgtcaacctaccaacaatgagcacggcacaagccaaatcacgcctgtacaaattcatcagcaattgcaaacgctgcgaatggcaaatg

SEQ ID NO: 111263 - DNA, 213 bp, Heterodera glycines
  Promoter: Source sequence=SeqID_12366; Location=1222..1434; Strand=+; Gene=SeqID_75970
attaaattatttggtaatctataccatttcaattaaataaaataatagagagttcagatatgtgaggatttatatcccgattttatggtttttttgatagaaaatgaggattttttgagtttttttgtttgtttgagatttttggataaaaacgtagccaaaaaaaaatttttttttttcaaatatacttaagatcattttgccaatataatg

SEQ ID NO: 111264 - DNA, 165 bp, Heterodera glycines
  Promoter: Source sequence=SeqID_42614; Location=1..165; Strand=+; Gene=SeqID_70464
taatcattttattgtttcagcttcatctctgctgactgttggcttaaggtgttcgatttgcttccgccctctcaacttggccttggcattgcgttgatcagtcgccgctttgactattacgtcgacgaacactttaaaactcgcaaatggacattggacaaaatg

SEQ ID NO: 111265 - DNA, 220 bp, Heterodera glycines
  misc_feature (5)..(6): n is a, c, g, or t
  misc_feature (29)..(30): n is a, c, g, or t
  Promoter: Source sequence=SeqID_23314; Location=1..220; Strand=+; Gene=SeqID_54018
atcanncggtcactgattcacggtaccannattcacggttccttcacttgaaaaatttacactggataaaaccgaaaaattttaccaattacatattgttttcatatagaaatttaaagccttttttggcatgatgatattttttcattctattttaatattttttcatttttttagtggatttttgaacctggaatttaattacacttttagaaatatg

SEQ ID NO: 111266 - DNA, 267 bp, Heterodera glycines
  Promoter: Source sequence=SeqID_30326; Location=1363..1629; Strand=-; Gene=SeqID_60748
tgcggcacatatttcatcactgtggactcacattctatattttttgaaaatttgacaccccaaaattgcaaaatgaatatttaaagctcatgctttttctctcagcgcttgaaaattttgaaatagcactgatgaaaacaaataatgttgtttttgtttgcttctccgtctaattgtaagcattgagttttaacaaagactatgtatactgtatttttgctgtatttatattttatttttatactagacgagcaaatgcttaaaatg

SEQ ID NO: 111267 - DNA, 69 bp, Heterodera glycines
  Promoter: Source sequence=SeqID_917; Location=1432..1500; Strand=-; Gene=SeqID_63997
ccccccccttttcatgtatgctctccacaagaaaatttagactaattttgggcgctagagacgaatatg

SEQ ID NO: 111268 - DNA, 539 bp, Heterodera glycines
  Promoter: Source sequence=SeqID_2519; Location=1..539; Strand=+; Gene= SeqID_80184
caaattgtagtaattatttgacccgggagccgcgcaagatttttgtcttgggctctcgtacttacaattcaatgacattgaaatggttttacggcaaaatcaaattgttactgagattctgacctcatatgctttggtgccataaaagccccccccccccccttgaaacccaaaaaataaaattttccagtacggatgattttctgatgattttgccaataatttgtaaaaataatgaatgaataaattacttttgtcatttatcggtgtccacaatctctgctacaaaatgtgtggtcgtttgtccgctttttcttctgctggtggcttttcccccacttttttacacgtcgacacagaaaattcagtgatttgtccaacgacggaatttactgcaccaaccaattccatcccaccattttcatccattcatttcatttgatcatttgggaataaatattttattcgtaaaataaaataaaaatattttttaatagtaaataaattaaatataattaatattaattaactagcaaatg

SEQ ID NO: 111269 - DNA, 67 bp, Heterodera glycines
  Promoter: Source sequence=SeqID_41790; Location=1..67; Strand=+; Gene= SeqID_69837
aaaaattttattggacgcataaaaattgatgggactcataaactggacttgagccggatttggcatg

SEQ ID NO: 111270 - DNA, 620 bp, Heterodera glycines
  Promoter: Source sequence=SeqID_6461; Location=1408..2027; Strand=-; Gene=SeqID_61667
ggctgggtcctttccaatcatgaaatgggctggggattaaatcggattaacaatttaacatcaactgcatacatagattaatattgagtgtttgtagtgggcaatttatgttgttgatgcattcgcatcatcgtttaattgctttgaacgggcacgggtatttccggacccaaaaagccgggtacgggtccgggtccaagcatctgggtccaaccgggtattaaaaaatccaattttttttaaattagtcttttttttattaaacgaggggaggccggcggtgccgtcaagcgccgcctcgttaattttttttttttgttgaaattttgtaggatttgataacagcacagaaattaaccatttttgtttatttcgacaagttttaagcaaaaaatcgaaaatggagaaatagtaagtaattatattgttatgaagaaatatttaaaaaagaaattatttttattcaaaaatttttatttctttcaatttcataaatatttttgaccaaagccccgcccccatttcactaataatgattctatctcgactaattattatttatttaatttgcattttaaaataaaaactttaaaaatgaaaaaaaaattcacagaaaaatg

SEQ ID NO: 111271 - DNA, 147 bp, Heterodera glycines
  Promoter: Source sequence=SeqID_39992; Location=1145..1291; Strand=-; Gene=SeqID_68436
ttgaattgttttgcagaaagtaaattggtaattagcttatctcaaatcatcacgagtaaaaaaaccattaaacggcttgttaaaattacgaataatatatattaacaataattaggccttaaaattattaatgtccaattaaaaatg

SEQ ID NO: 111272 - DNA, 1003 bp, Heterodera glycines
  Promoter: Source sequence=SeqID_6661; Location=1375..2377; Strand=-; Gene=SeqID_62374
aaaaaaattgcgcccttgcaacaacgtttcaaattcgttgtcattcattttgcgtacagccattaatattatttctctttaaaaaaatatagtcaaaattatttaaaaataaaagtagttgaaaaaggaacaagaagtcaaaaaaagggaattttaaatccaaagaattttttaaaaactaccgctatttttaaaaacgaatatttcctttttaataaaaattgctctttttaacaaaattttttttaataaatttaaaaaacggaaaagatgcaacccatgctgttttaatataatacattgggatcaaaattgatatttatgaacaaatgattttaaatttaaattcatttatatattaattctgtctcacatctttcttaacgaattggattatctttaagttctaactcaaaaacgtcagtcaatagaattgctcagggcaatgtgaaactactttttttttaaaataatgcatttttttaatgtacatatctaatgtacatattctgattataaataatctgagaaagaatgcttctctttcatcagttttttatatgaaaagacaattcaaaattaatttgcaaaaaatgttcagtatgaaagagcgaaaagagcatgaaagacaaaatttaaaatcattcgttcataagactcattttgattccaacgtattatatttgcaagagcattggttacatctttccctctacttaaatttattccaataaattcatttttaattaaggaaaaataatttttcattaaactgaaatgttcctatttttgaaaaaatagcggtattttctaaaataaaattcatatttaaatattcactttttatttcttttcttttttcggctatcttatataactataaaaatatgccaattttttttgtagtccaacatttttactttgtatataaaatttctaccatcgttacaacgatataattttttatcagcttaattttaatttgaaaaaagtttaaaaaatg

SEQ ID NO: 111273 - DNA, 640 bp, Heterodera glycines
  Promoter: Source sequence=SeqID_11359; Location=1087..1726; Strand=-; Gene=SeqID_74751
cgaaacgaggtggaccctgtagcagtgccctagtttttttcaaaattggtaacaagggaacattccgaaatgtcactgctcagatcgctttaaaaccacttttatcgtgtagagcatagtcgatttgctattgccaattttcggcttttttggccctgaccccaaaaatgatcagaaaaagtcgatcaaagtcccgaaaaatcgataaaagttagcaattttttaaaaattcataaaaattttagaatggtgctagtcaaaaactttttttttaaaatgatcagcaaacaattctctatcaaatagcatcttaaaagaaattaacataactgaacaaaaatatgctaggtcgaataataaatagttttaaaaaaattcaaaataatccatcatctgtcgagcgggtccgaacccttgcaaatggccattaatgtgtaagaggaaaaaatgaatcaaaatatcaattttttgctgggtttttcatttgatcacttttttctgatcatttttggtgactgcaccaaaaaagcagaaaatttacaatagcaaatcgactttgctctctacacgataaaagtcgttttatgcattttttgaaaaaaaccgactctgttcgaattcgggtccgggttcggaaatg

SEQ ID NO: 111274 - DNA, 184 bp, Heterodera glycines
  Promoter: Source sequence=SeqID_4707; Location=285..468; Strand=+; Gene=SeqID_55458
tccgttgcgttcccgcgctgtctgtcgcgtggattccccggctcgccaactccgaactttcgacggggctcagttggacgtgcacttttccccctgttggactgtgctggccaaagattgttcggccgagggacgcgcgcaatttgcggtgctggtcaaagcgaaagcgaacagtgaacaaatg

SEQ ID NO: 111275 - DNA, 1003 bp, Heterodera glycines
  Promoter: Source sequence=SeqID_14694; Location=15..1017; Strand=+; Gene=SeqID_78808
caaagcattgactaaatgaaaaacttattttcattaattttctcaatttgtcccctcattaaaatttacgattttatgcaaaaaaatgttcgctctctgtgccgcgtggcatgcaaaagcgaccgcgcaattttgtccgccgtctcttggccttcgtccgccgattgttccacggcatctttcgcagcggaagtaattgcgtggatttgaaagccgaaaatgaaataaaatattattaaaaaaattaataatattgacaggaaaaacaattgccattgcgcaccggtaaaccaattgaaagagcgccacaaaaagaggggaatgtgaaaagagcaggcctggagggccaaaaggaaaggcacccactgaaaaagggaagcgaacggagggaaacgaattaattgtgattaattcattttcttttataaatattctacaatttcacttttattttctttcactttccttccccacttaattatgtaattactcacaacaaaaaatggaaatgggaaagtgagtttgataaaagggccaaaaggggggggcggcgatttatcgtttattttcgatcgcgcaattttgtgggacgaaaggaaatgtgggagaggggatgataaatgaacaaaaaattaaaattgacaaatacaacgaccgatgagagaaggggagggaggggagagaattggcgagcattttgggcattaaattcccttctgttggagacaaccaccaaagaatgaatgaatgaaatggatgaaaaatgaatgatacaaataaatggggggaaacgaacgaacgattggtggccaattagagaaaaggcacacaaaatatcagtttcatatattatttttccttttgaagggatattttaattaaaaattaaaaggcaccaaatttatttgtaaaaatgcaaaataacacacaaaattttcatttttataatttcccatattttaaggtggttataatcttttaattaaaacaattacgcaaaatg

SEQ ID NO: 111276 - DNA, 290 bp, Heterodera glycines
  Promoter: Source sequence=SeqID_29216; Location=1004..1293; Strand=-; Gene=SeqID_59750
tctgaaaatgtatgtaaaaagtaccctgtaaactgtataagtgtacccctgtttttgcctttaaatcctttacacggagttggtattcagaatttagcacccgtctcacggactgaaattccgaatgatgttttagccatttttcgaatcttccgcttctctgttgtccctattttaaagcatatcccgatatttgtttttggccccattctctgttaaatttcactttcgtcaatttacggaattgtatcattcgggaaacgccgtgtttgagggcgcgtacaacgatg

SEQ ID NO: 111277 - DNA, 51 bp, Heterodera glycines
  Promoter: Source sequence=SeqID_14063; Location=1..51; Strand=+; Gene= SeqID_78038
ataaaagccccagcaatttgtcagctatgtctcatttgttctgctacaatg

SEQ ID NO: 111278 - DNA, 113 bp, Heterodera glycines
  Promoter: Source sequence=SeqID_8163; Location=1791..1903; Strand=-; Gene=SeqID_67180
ttccgttgcggacaatttgacgacactcaaacagaaaaacaatagactggagagagaagtgaaaatgtaaaacaataaataatttaaaaaatagttaatttttatttaaaatg

SEQ ID NO: 111279 - DNA, 91 bp, Heterodera glycines
  Promoter: Source sequence=SeqID_32228; Location=650..740; Strand=+; Gene=SeqID_62555
tctgaattaatattaattaattgcctttaattgtgcaggtttttctgttctgccgtccttactcgcccctcttccgcgtcccattggaatg

SEQ ID NO: 111280 - DNA, 358 bp, Heterodera glycines
  Promoter: Source sequence=SeqID_18227; Location=2374..2731; Strand=+; Gene=SeqID_82823
ttttcattaagaaaattttcaaaaaaatactgaaaaaggcatgaacaaggcatcaaaggtcaaaaaagattacaaaattacgtgcccagcattaggcatcaaaatcgcaaaaagcgcaccaataagttaaagctagaagcttcaaaccatgttaaaaactcgtttttcgtctgtattaggccgtagcaagttcgcaaaaaaggcataggtatgcttcaaaatccggtcgctattgataacctaacaaatattctgataaaataactgcgttgttttcgcaaatcccactagcatatacatatatatatttattgtataatcttttgctaaactttagatcaaaaaataataatttatg

SEQ ID NO: 111281 - DNA, 1003 bp, Heterodera glycines
  Promoter: Source sequence=SeqID_7069; Location=1615..2617; Strand=-; Gene=SeqID_46359
aaaatttccccttccaatcggcgccggtacgggtcaactccgtccctgacaacttaagaagccataactgtttttctcactcacaaaaaaattgtcagttgaaaaccgcaaaaatccaaaatttttgaagtttataatttctcatttttttttacagttctacctatatactctgtaatttttagtaggctaatagagcctgtgaagagctttcgaattatgtcaagattgttggattcggtcaataaggtaaaaagttatgatgctcaaaacatggctgagacggagttgtcccgttccgctcggcgctgcccgcgtagacagacagtgcgctattacaccttactctcgcttcttttctgttgccatttaccctccttttttcccactccctccccacacgcacgcgtctgcttactatctgccccttccacccgcggcgccccgcgtagacagacaagcaggcactgcactatttactccttcccgtagtggttagtcggaggaaatagtccattgtctatctactcggagcagctacaaaaaatttaaatttttggacttttgcgtaatacctaatagcagtttcctgctttttgattacaggtttctgtcattgattttttgcaacagttgccttacttttatttcgcttctctgccgcactacaggaacctgttataaataacaggtttttttccatcatattcctacctaaagcattgcttactgctaccaattgcttagccggttttgctctttatatgctgcacaatcaaaatgattttttgtttgttttaatgtttttcgattccctgaaaaatttgtcgtgtgcaaactgctcacaatcagaatattgcttaattgaacacacaataactaacaataatgaccgctagaaaagattgctcgaaaataaaatgcttttcatagaattggtcacctaatccgctttatattaattttatttttcctcagctttagtgtaatcaatatatcaatg

SEQ ID NO: 111282 - DNA, 996 bp, Heterodera glycines
  Promoter: Source sequence=SeqID_9617; Location=837..1832; Strand=-; Gene=SeqID_72099
tttgtagcagggatgtgcctaggtttcgcttttcgcatttttcctttcgcattattcgcattttttggcatttcgctttttggcgcgaaacgcgacttttacacccctaagaattggattaaattcccataaaatttttcaaaattttacctataaattggctaattttcagtgaaaaactgtttataaatgatcaaaatttccaatttttttcccctgcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgataaaaatcacaaaatttgatcattttttagtgaaaatctgtcaacaaattttaatcaaattttcaaaaattttcccggcggcgcctgccccctcttcccagtttttttttggaaaaagcgcgcctcaaaaaagcgttttattgatttttaaatttggaataaaattttaaaaaatgatttttgctttatgattttaactattaaaaagttgtagaaaaaatttcgctttcgcatttcgcctttcgcattttcgcatattttagcttttcgcatttcgcttttttttcatttcacatttttcagtttcgcaaatttcgcttttcgcatttcgctttttatttttcaatttggcccatcccctgctttgtgcctttttacaaaaatgacttccgagcttttagagctcgctgtttacaaacgtaagctccaaagcagaattcgaacaaaaagtcggaaattaaaaattggaaaaaatgaaaatattaattttctaaccttaatttgtttgaaaacttggatttttgcaaatatttctttaaatatataaaaaaataggaattattcgttgaaagaaattttttgaaaaatctgaatattaaaattatttttaactttgtattggtagaaaattaaaaatg

SEQ ID NO: 111283 - DNA, 100 bp, Heterodera glycines
  Promoter: Source sequence=SeqID_13730; Location=1..100; Strand=+; Gene=SeqID_77647
cgaaaacccccggaaactgattttaagcctaaaataaaaagttaaattagggaccctcattctttacgattgccgctttgtcattgtgtatgtacatatg

SEQ ID NO: 111284 - DNA, 155 bp, Heterodera glycines
  Promoter: Source sequence=SeqID_19057; Location=1690..1844; Strand=+; Gene=SeqID_83798
tctgaacattaaaagcattaagaaaaataagtgagtgccaaggaaattcggactttgtaaacggcggggaaacactcggagtcgagcctggcaattttgcacaacgccacgaaggcaatgcaacggatttcttccgttttgcgactccaaaaatg

SEQ ID NO: 111285 - DNA, 704 bp, Heterodera glycines
  misc_feature (27)..(28): n is a, c, g, or t
  Promoter: Source sequence=SeqID_2966; Location=1..704; Strand=+; Gene= SeqID_82543
ttttttactatttatccatttaatgtnngagtaaagggggagggcccgaaggtgcccgtaagccctccacgaaaatgatcataggcgccgtcgggaattttaaaaaaatgttgagaattttaaaatattcagcataatggatcaattttcttagaataaatagaaaattctgggggctggcggtatacacagaaagagagaaagaaggtgggtgggtcaaccaaggtttttcgaaaaatccgggagtcgtaaagaggtcggcagtcaaatttgtaaatttaatataaatctgaaatttggtggttttttacgccactttttctgcgcgtttatttcaacaaacttttgaggatggaggcgtacggcaaacagggtggcggaggtgccgaccccgggaaaatttgaaaattttattgtgtatgatttgttaagaaaattcaagaaaaattattatttttttagtaaaattttcgaaaaaactttgccaacgaaagaattgattctcttttccctttcattccattcacatatatgtatatttcgcctaagcaaaaattaataaattaatgtacttgcacattcgcgggcgggcaaaaattgattttccccctctcatacttttaaataaaaagttaattaataattataattaaaattttctagatttaaaaaaatatcaatttattagcaaaatttcgccaatg

SEQ ID NO: 111286 - DNA, 1003 bp, Heterodera glycines
  Promoter: Source sequence=SeqID_3737; Location=1329..2331; Strand=+; Gene=SeqID_51683
atggacagaaaataaatggcgaaacattttataaaaatggcagagataagtgaatttttgtggctttcttggaaaacgacgaaagattggataaatacatatatttgttgctttttaatgattagtgcacggagttgtagacaaacttaaaaatgaaccatttttaatacaattatttagagaccggacgggcccgggggcccggcgggcttttgccgggcccccgggcccggtcccgtttttttttggaaaaaaacgggcccgggacgcccggtaaaacgggctttttttgaacgggcggcccgccccggtcaattttcgaagcccggtcccgggcccggtcaatttgaccgggctaaaacgggcttaaatttcaccagcgaaactgcccaaaacttgaaaaaattaattatttatttatggcgaaatgtctttaattcaaaatttcaagataaaactttggatttttgaaaaattaatgattatcgacgttcgagattaaagccgaaaaccgcagaaatgttgatatttttgaacaaggccatcccaatgttggactacaaatactgatttaattttgttggatgataaaaagttcataaaattttccataaaattttggtttagaacaaagaaaaggaattacgcaatttttttatatttataaatgcatttttaaaatttgaaaaaagcccggtcccgtacgggcgcccggtcaaaattttggaccgggcccgggacgcccggtaaaacgggctttttttgaacgggcggcccgccccggtcaattttcgaagcccggtcccgggcccggtcccggtactttcaaaattccggtctctagtaattatacgtggataattgaatatgaatgagagaaacgacagatggaggggaggggtgaaaaagagggagagaacaaaagtgagacgagagagagagagagaaacaaaaatgaggcgagagagacaaagtgaagtagagtaggtggagaagcgtaatg

SEQ ID NO: 111287 - DNA, 1003 bp, Heterodera glycines
  Promoter: Source sequence=SeqID_18111; Location=1212..2214; Strand=+; Gene=SeqID_82693
attattttcttctatttggaaattttgaagcctaattaatacaaaagtacacattaatattgtatattttaaaatgaattttttgataaaattttatacaatgaaatttctaataatttaatttattttcagcttttaagtcttttgtcttattagtgtgacttttattagttaaatattattattagtattattgtataaaattataaaagaacaaaaggttgaacgttattcgaaccaatgtgcgtttccgaaaaagcaaggaccatttggataggctaatttagccttgaaatatttaattcaatcatttatgtaacaatattatgtagtttttattccacaactttcggtctgcaaatgtcgcactaattgtagaagttaattaattgagaccgattatttttaatttttcactgcgatatcatcttagtccataccattaactatgccttgaatatcttaaattatgctttcgattttgactaatttttgcttaaaaatacattctattctgttttgatcaaaccaaatacatgcattaaaatgtggataataggggtgctagatcgtttcataaaatccgccaaataaataaataaaaatacaatacctaaacactaatattaaatcattttcataattcaaattttttaataaaatcaattttattttaaagttttcaaataaaacataaaaaaactcggatctgtttatatttattttcttcatgatcagttgactcattcaaaataaatgattcgaaaaataattcatacaaacaatttttggatttttctttgggtttttaaacctatgttttattggtccataataattattcttaaaattttaatttaaaaatttttttctaaaggcggttataaacataaaaaaattgaattttcttatttctttttaaatatagaaaacctattaaaaagtataaattctgtatatttttctcttttatagcttttcgcattataattgatccacaatg

SEQ ID NO: 111288 - DNA, 597 bp, Heterodera glycines
  Promoter: Source sequence=SeqID_7713; Location=398..994; Strand=+; Gene=SeqID_65710
tttttcaaattcctgggtttaatgggtggaattgttgcactttgtgttaaatttagatgaactgcgagattttagaaagcccattcaaatatttgaaaagatctttcatttcattttatccgtataaaaaatcctcattttaaaaggctctagtaaatccgatactaaataaaaaatttttaaaaagaactcatgagaatttcgaaattaatttttaacttattggtaaaataaaattgggaaaattgaatataaatctataattttaatttaataagttctaaattgattttaaaatagcttggagcaataaaaaatcattttgctgaattttatttaattcgaattctcaaaaattatttttaaacatttaaatttaatgtcagattttccggctcccttttaaaatgttccgggtcggcttggtctaattcccagaataccttatctatattcggatatgataagaaaactgaaaaaaatctgggagagagagaaatcttttcggctgcactttttctctctctacgaaaaagcgattaaaaaaatatttcattcatttcggaagaaaatattacacacactttcagcagcatg

SEQ ID NO: 111289 - DNA, 56 bp, Heterodera glycines
  Promoter: Source sequence=SeqID_29359; Location=1737..1792; Strand=-; Gene=SeqID_59867
ttcgtattgcctttaaattcttgtcaccactcaacatcaagtttatgggtgcaatg

SEQ ID NO: 111290 - DNA, 148 bp, Heterodera glycines
  Promoter: Source sequence=SeqID_14667; Location=614..761; Strand=+; Gene=SeqID_78769
aaaataaagcttcaaatcccctttttaataaattataatcattataataattaatttaattaaatcattttaaataaacaaaataattattggagggaattaagtgaattattaaaaaaaaacaaaaatatctttttttctagaaatg

SEQ ID NO: 111291 - DNA, 144 bp, Heterodera glycines
  Promoter: Source sequence=SeqID_16927; Location=2340..2483; Strand=-; Gene=SeqID_81357
aacaacgaaggaatcgccgaaccgctcctggaggaagataaagcattaattggaatgataaaattactgacagcggaagaagttgaagcgtcaattgaggagaaaagagaaaagtggagtcgagcatccgaataaagtgaaatg

SEQ ID NO: 111292 - DNA, 421 bp, Heterodera glycines
  Promoter: Source sequence=SeqID_3535; Location=1..421; Strand=+; Gene= SeqID_85068
gggggaatggggaatgcagcgcgagttatcgcaatgcgcgaaaacaatggaaatgaatgagggggagtgcgctgggtggcggcggtgacatctggcaacttgtcgtcgctcaacggaattttgacaggatgcggggggggagagagatgtcagagaaaggatgaaagggtataatatgcagtggattttgctgaggggggggggaattcaatggaaaatttggagaaggaaatattattaatgtgaagctggcggcaccgtcttttgtatatggcggccattgttcggacacttctgttgatcgttgacagaattataagtatctttgggagaaatgggtcgcttggacatcactttctttccccaataaacatttttgtacttttttttcgcttttccaataaattcctaaagagaaatg

SEQ ID NO: 111293 - DNA, 406 bp, Heterodera glycines
  Promoter: Source sequence=SeqID_3582; Location=1..406; Strand=+; Gene= SeqID_50946
gatgttgactggcgccgatccgaagacaatccatatcaccttggccattctcaaagtgttcgttattccaccgcgccgaattgacgttccagtattgccagtcaaagtggatgatcggctttgctttccgctttgtatgaaatgttgcaaaaaatttccaaatgggggtgtaagggagacgtacaactgtacacacattgatcgtcaaagaggatggattagtacatgcacgtctttagaggttaaaagcaaaactgttttttgttggtatatttgttaaatttagctaaatgtcgcattggatgaggggtacagagtaaccgagttattgcgtgttctcgaatacagcaagagtgacaaccagctatttcggccttatatgagcgaattcatagccgaaaaaatg

SEQ ID NO: 111294 - DNA, 795 bp, Heterodera glycines
  Promoter: Source sequence=SeqID_998; Location=2796..3590; Strand=-; Gene=SeqID_65664
tgcgtcgttgtttaatgtgttgcagaagaagaatagcgcaatagaataataaagtaagtgaatgattgccatcgactaaatttccttcttttatacaaaaaaattcctattaaactaagcaattttcttgaatgaattttcctgtttgtttgcgacgtataaaaatgatttttttttttactgttctttctttagttgaataaaagtcatggggactccagaccttacctcccatcggccgattttcttgaaattttacaaaggcccataatttgactcccttgaaccttgatcgaactctttttattttatgaaataattcgagatcgactcttgcacttttacaaggttaaataatatttcttttaattttggcgttctgataattgaaaaaactttttttgtttcgagacggaatcccgagggattaaccccgcagaatcctgcagattgcggcggctttggatcccacaaaattgcgcgcatgatcctatcctgcgcctgtttctacatagaacatagagtcaaaaataagtcgtgtgtaccactaaaaaatatatcttcataaatttggctgagaattcagtttactataggtatttttttagaaaaattcaaaaatgttgcccgttccgagccctaaatatagtcaaatttttgttgaaaaaaggaataaaattgtctcggcagtttactcagattgtcgcatttgtaataatagcctacattttgatattttttagtttcagtatttaaagatctttaatatcttcaaaatagctgaatacgaaaatg

SEQ ID NO: 111295 - DNA, 362 bp, Heterodera glycines
  Promoter: Source sequence=SeqID_22670; Location=1..362; Strand=+; Gene=SeqID_53354
cgtgttgggtcgaaggacaaaaagtgcaaatttggcgaagtacaaaaagtgcaaaatttgctgtttttgactaaatccactcataacttttctcagacgcaacctaattggacaataagagttctctattagcctgccaaatttcaaaaaattatattaagtttttcaaaagttatgacaattttttggctagaacttttgataaacttaataaaattttttgaaatttggcaagctaatagcgcattcaagggctatcgtatgacaccaagattgtgcaattaaattttttttctttatacattttttcactatctaattatcccccagtctctgaggaggttgaaaaataatcccccatg

SEQ ID NO: 111296 - DNA, 60 bp, Heterodera glycines
  Promoter: Source sequence=SeqID_45181; Location=999..1058; Strand=-; Gene=SeqID_72529
ttgctgaagaacgggctcggcacgttggtcaacgtgcagtggaagcaactggccttgatg

SEQ ID NO: 111297 - DNA, 549 bp, Heterodera glycines
  Promoter: Source sequence=SeqID_17178; Location=510..1058; Strand=-; Gene=SeqID_81619
aaggcccacagcatttttgcatacaaagaacaaaaaccttcctacctaaagcaacaccagcgctatttgctgctgaaaagcatagcatcattttacaaaattggcacatcggtgagtgatgattggcatattatgggttacggattttaaattagtcaaaatcttatcattgattagggattactcctaatcaaattcgaatgctcttcaaaaaatcgaggtcccggtcccggcttctcaggtcccggctagtcccggtcccggttttgcccaaaattcccggccccgctcaactctactaaaaatgctcgataagattcgtataatgggtcaaatttcgttcaaatcttgggttaagctttgttcttgattctcgatataaggcttcgttccagaatctctgggtcaattctatttccttgttcctgctgtaccacaaaattttcggagggcggaatccaaagagaccattttccctttggtacattacaagagtatcatgaaaagccctccttaaaagttaagcagttgtcactttgtttcctcatg

SEQ ID NO: 111298 - DNA, 543 bp, Heterodera glycines
  Promoter: Source sequence=SeqID_7856; Location=2520..3062; Strand=+; Gene=SeqID_66178
atttaattatacatttgtatgagattgaaaccttatttaaacatgctgaaatcggatggacattaaaagaaattcgaaattcataataattgttatttataataaaaataattttaaaatgcaatatacaaaaatatttttatgctttaaagcttccagcaaattaaaagtataaaatattaatctctcataaattaaggaaaatgagaatttctcacattaatttattattatttaccaacataatttttctttcaaacctttatttttcagcagcacaatgtaagccttttttttaatttcaatgattaataagaccaattatttgcctaattacccatttaccattgctaatgttgcttaatttggtgttgttcagcttcttcccccgccctttccgcctccctttcgcgcattggtctctacgaaatcccgccgttggggccgctgctgcgcacgcgcgacaatgcgacgaccgacgcgcggaaaagcgaacgctgtgacaatttttacgcgagtgtttgtgcgccggtccacgaaatg

SEQ ID NO: 111299 - DNA, 76 bp, Heterodera glycines
  Promoter: Source sequence=SeqID_7780; Location=4197..4272; Strand=-; Gene=SeqID_65940
tcattatgaaaaatatgaaaaattggtcaaatttaaaagaattaagctaaaataataatattttagataaatgatg

SEQ ID NO: 111300 - DNA, 385 bp, Heterodera glycines
  misc_feature (34)..(34): n is a, c, g, or t
  misc_feature (65)..(65): n is a, c, g, or t
  Promoter: Source sequence=SeqID_15470; Location=2608..2992; Strand=-; Gene=SeqID_79745
aaaaaatgaaaaaaagcaacaaaaaaaccgaaanaataaattaaaaatattaaaaaatataattntaatgagccaaaaaataaataaaaattaaatttttaaaataaaataaataaataaaaaataaaataaaataaaataaattaattaaataataattaaagtaaagaaaaaaagaaataattatttttaattaagcaaagcagcaaaaaaaaaaacagaaaaaaaattttaaaaaataaattaaataataaagaaaaaataaatggaaataataataattttattaaggattacaaatgcggataaattttgtttgttttatgctttggtggcgtcaaagctttatttggaagtgcatcgaaacatttttaatcgatttatg

SEQ ID NO: 111301 - DNA, 1003 bp, Heterodera glycines
  Promoter: Source sequence=SeqID_9324; Location=1334..2336; Strand=-; Gene=SeqID_70997
ttgatattatttgctgccaatatcaattaatttgcacttcttccaaattccgttatcgatttttttttcgcggcggcggcatcgcggcgcggggcgagcggggaggaaatgcaaaaaaaaacccgcactgttttggcacattttcaaaaatgaaatttcaggatccgaaaacccatcataaaaatctcaggatttgtgaaaataaaatgctaaaaggtttggggtcaaaattttaaattttcaaagaaaaattgaatttccttcacctgccactttggtgacaggtggatgattgatgaccttccgcggcgctgcgcggcgcggagagggggagtgaaaaaaaaatcgccagtgcggatttgaggaaattaaatctacaaggcggcagacttcaaagaaacaacccctcacatagggttcggttggcacgcacccctcctataggcttgggattgtgcgggaaaatgtccccgggcggtaatatcaaagggctgcgcccctcccataggcacgggtttgtgcggtaaacacccgtgcgcaaccgtgcgcttttgacgtcttatactactcccgatcatcttttcgttaacctcagcaccgatgacgtgccaattggggagccgggaattgagcgccgactttcacgtggacaaacattaactattcatggcccgatcaccttgcgtgtctaccctgcccttctcctcgtttgccttttgcattttttggcgacattcgtcgcatctaccaatcaactgccacacgacctttgcaaacgacaatttggttccctccaaccaattcacttcgactcaattttttcttattcacccactgcccttctacacaatccaatgttcctcgagttggtgtgattcatttgccgctgccttccgatctactacttaaatactgccagccagcacttatcaccatcatttgccaaattcctttttcccccaattctgtcatcgccctaacgccttgccttgccaacaacatg

SEQ ID NO: 111302 - DNA, 172 bp, Heterodera glycines
  Promoter: Source sequence=SeqID_10302; Location=1..172; Strand=+; Gene=SeqID_73467
tgaaaacaaaaagatggggtagaataattaaattcatagcttgtctcaaagtcaacctaattaatatttcgtggtatcattcaatagctataattgttgtctctcagaatataattttcataacttcataacttaagtatataagaagagataaagcattgaacaggctatg

SEQ ID NO: 111303 - DNA, 157 bp, Heterodera glycines
  misc_feature (15)..(15): n is a, c, g, or t
  Promoter: Source sequence=SeqID_30498; Location=1..157; Strand=+; Gene=SeqID_60900
ttgtttttagatttnagcgcaaaaaataaattctctttcttcttttgaccaatttgtctaacactgaaaggaattcaaaacttttcttaggcatagtttttccaatcattttattttttgaatattatttagaaaaagtaatcctttataaaaaatg

SEQ ID NO: 111304 - DNA, 313 bp, Heterodera glycines
  Promoter: Source sequence=SeqID_28636; Location=1..313; Strand=+; Gene=SeqID_59234
aataattttgaaatttgatgcaattaaagaaaagttgaaggaaaaaataaaatacaaaaagaaagattatgacaaaattgaaagaaaaattgcaaaattattaggagcaaatctgcaattaatacaaaaatggaaaaatgaattaaatttaaataaaaacaaaattaaaaaacaattatatgatgagaaaaagagtgaattcattgaacgatttgatgaatttaaaagtttatatgcccatggcaaacagaaagaatttgcgaaggaattgggcatttctgaagtgacattttggaaatggaaaaaacaaatg

SEQ ID NO: 111305 - DNA, 1003 bp, Heterodera glycines
  Promoter: Source sequence=SeqID_4665; Location=1411..2413; Strand=-; Gene=SeqID_55288
aaaaaactatttgattatccgctgatcaacagtgattactcatcacatcaactgggaaagtggtgggatgggatggaatgtgacggcaaaagcggcggatcggacggacggacatttgacgattaacaaaacataaacataattatgtaaattaggttagtaaatgaaattgtgtgaacagcaaaaaagtggttgaaaaataatcgtaaaactgggagccgggacaattgagtacgggctgactgagtttggagcaaaattgggtggtggtgcaggtggtggaaagtaatgtcctgctgctgtggaatgtccgtcattgaaccaagaaagtctcgggttcgcaatgttcgagaatctcggcgccgagtctttaagcgcgaaagtttcggattttcgcaaccctcgtaaacataaatgaatgatgcaatagcaatgtatgttttgtgccaatttgtgctgccgttgcttctacttctgctgcgtaaaaatttaaaataatgaaaaactcagaattatgaaaattttttgtgccttattaacgtgtacattttggtgcgattttatgaattatagaaagggataagttcgataaaacttgtaaaattaagcctaaaaataggcataattaaaaatttcataaaaattttctaaaataaaattcatgagccattttaatatatgtgcattagagtgccttaataacgtgtaaataaatctggtgcgattttataaataatagaaagagttaagttcaaaattaattaattaattaattaccaaaatttgatcatccacaactcatttaattaattgatcagaagctcaccaaactttgcaaaggaacagttcaaaatgtttacaaatttcttagaattttttactccaagaaaattttttgcattaacaacatatgcatttttttaattttttgaaaaaaccagggccccaaggggctctgtgaaagcgccggggccgctttcaatcattcgatttgcaatgtatg

SEQ ID NO: 111306 - DNA, 113 bp, Heterodera glycines
  Promoter: Source sequence=SeqID_3737; Location=1..113; Strand=+; Gene= SeqID_51684
caattaatgggacaattggcctaataattatttatttatttttatatcattttaaatatctcttccccctttttgatgagtgtgcccacagcctcggcttcgtccgtgccatg

SEQ ID NO: 111307 - DNA, 365 bp, Heterodera glycines
  Promoter: Source sequence=SeqID_26949; Location=622..986; Strand=-; Gene=SeqID_57692
tcattaatatcaaataagatattacattgtgattgaatcagttcttttgtaaaatttatgtgggctaattagtcttccgccagattagggatcattttgatcaaaaagggttactcattaaaaaataataattagaaagaaatgacgcaatataactttaggactattatttgataggttggttatataagggtttgaatatcatattagttgtagtttaagattaatttgcgacatcaataaggaaaagatcaatttaatgaaatgaattgaattaattaaaatcagagttagttttaatccctgatcactgataagtacagtaattacttcatttcgtccatcacaacagattcggtaaaatg

SEQ ID NO: 111308 - DNA, 357 bp, Heterodera glycines
  Promoter: Source sequence=SeqID_37478; Location=1..357; Strand=+; Gene=SeqID_66542
aagaggaagaggcggcggaaggctcggaaagctggaaaggaagggaaaatgagaaaaaatattgccattttgtaggcaaaaaaaaaatgtcggggaaacggacggtcatccggggaaataggagaaatccgtcggaaaagatttacaccaaattctcaacaaaaaaatagcatggacaaatgtcactgggaatcggaaccaaaaaaaacttggaaaaataggggaattttgctcgggcggtgtctgtcacccgaacccttcaatttcttcaaaaaaaggattcagaaacaacgaattccgttgtttcaaagataatctgtaacaaatcctctcaaattacccaatcccaccataatg

SEQ ID NO: 111309 - DNA, 371 bp, Heterodera glycines
  Promoter: Source sequence=SeqID_5609; Location=1..371; Strand=+; Gene= SeqID_58640
tcggattttttgtaatccgaggcgtctttttccttgctcatttggcccctcgggtttttcgtaacccgaggcgtgttcctttctccagtgaccgacccctcgggttttttgtaacccaaggcgtcccccattgtgagcaggtcgctcctagggtttttcgtgacccaaggcgccacccgcttacacggtcggacccatcgagtttttcgtaactcgtagcgtccttcttcatacactgtaagactcttggtgggtctgaagtcaaactcactttgtccactgtttgttcaacttactgctattttgtgaccccgaaccccacacaatttgttcggaagtcgggtagcagaacctaaaagtgagcaaaaatg

SEQ ID NO: 111310 - DNA, 237 bp, Heterodera glycines
  Promoter: Source sequence=SeqID_43176; Location=1372..1608; Strand=-; Gene=SeqID_70910
tagtaaaaaaaattattaaaaatttgtaaaaaaaatttatttgtttagccctctgaatatgtaattggaaaaaagcttaaattttattttcgggaaggcgggggaagctttgacgggtttttaccggattttaagcccatgagccaatcttttgagtgtttttttgcgatggcattccatcaaaagtaacaaatcaaacaattagaatttgttttgcagaggcgcaaagtgacgatg

SEQ ID NO: 111311 - DNA, 282 bp, Heterodera glycines
  Promoter: Source sequence=SeqID_23912; Location=1..282; Strand=+; Gene=SeqID_54604
acaaaaaaaatagggagccaggctcgaataatatttataatgtttaattggttgataaaaaaaagttataggccaaaacaatttgggaccgaccgctaatggtcgatccgctaattttctctaccaaaaaaatcacctttttctggtccgggaatatttgggaaattgtataaattaataaaacagtttttttcacaataggaagccgaattcgcttcgctattgttagtgaacaggccagcaatactcctcaattcgctcgtagtcgtcctcccaaaaatg

SEQ ID NO: 111312 - DNA, 720 bp, Heterodera glycines
  Promoter: Source sequence=SeqID_22707; Location=1744..2463; Strand=-; Gene=SeqID_53394
taatattcccaatcaaattatcgattgattttcgatcccttatgagagtgtgtcgactttttttctctgacatccccttccacaaacccaaacctattggatggggtcgagagagagaaaatacagcatttgctctaattatcccccagtctccaattatccccagtctatgaggaggctaaaaaataatcccccatgggttgataattagatcaaatacggtagttagataaagagagaaaatagtgagggaggagagtgtgcgatatgaaaaatagaaaagtgagagagagagagagagaaaaaatgaaaagaattgtgttagagaaatagagaaaaatcggtagccattaaaaataaattaattgtgctattttttgcccggctaaaaaatatcaatactatgattaataaatttgtagaattgtttttatttttaaatgtttataccatattttaaaatatgtttaatttatttatattttcaggtattaaccataatttttggaaaaaaaatttaagcgcataaacaagcgcaactttgccaattcgtttgtggcgcgaggcgccgtgtttgccaacgcgttggtttataaggtttgcaataattatcattaatttatgtcacaataattttcctgaattaattgtcaggaggttttttgcgcactaaacaattgtgaagcgggggcgaagccaagtgaagtgagacagcaaatg

SEQ ID NO: 111313 - DNA, 759 bp, Heterodera glycines
  Promoter: Source sequence=SeqID_5544; Location=1..759; Strand=+; Gene= SeqID_58400
ccccccccccccccccgaagccaagggtctggctaagcccttgaataagagataatttaaggtcgttttttaactaaaattgctaaatttgaaagcttggacttttgagttttttgttcaagttagggttccgagcttcggaattgcctaaatggatgccggattcgtgatcagcgacctcgaaacccccagggaacttaatattttttcactgacgcattttccgggagctaaaagtttacatgtcatcaaagaaaacaagtttcctccaaacttcttgacactggccagctttaaattgattttttgggaaatagttgcaaaaactttcaaattttggggtgttaaatcgttaaattttatccaaaaaggttacaacaaacttaagccaaatcaacattgagataaaataatttttaaaatgaaaattgtcaagaaaataaattaattaattttaaaggataatgaaaactaatctttacaatacttgtattataaatttttaatttgttatttgagaaggaaaaattatatttaaatgtaatgattattttatttattttttccaatatttgttcagtagaataaaatttaataaaatcttaaacattaattatttccgattaagtaggtttttatgatttctatgaaatcaatagagttgcgtttttgttatgtaaaaaaaaaacatattaattttaaaattattattatttttaaataaatacaatttttttatgagaatttttaaataaaatg

SEQ ID NO: 111314 - DNA, 576 bp, Heterodera glycines
  misc_feature (77)..(77): n is a, c, g, or t
  Promoter: Source sequence=SeqID_885; Location=1..576; Strand=+; Gene =SeqID_63280
aaatggtacgcctttcaatgtttttgggaattagaaacgaaaattgctcagaaagtcgctgacaaaatgttgaaatntagtgattttccatttaatttgaataaaccgagcaaatcttctgcaaccttaaatttttaaaatttgctcttcaaaattagaatagttcattttaacataaaatttctccttttttcatttttacgtactctgcaaaaatttcgggggagaaacaaaaattaaatccgttagaaagaggtgtgattttccacaaaattgtcttgtgaatggtctgtcgatctatggcttttctttaagaagtcaaaattggtaacattttggtgataaattagtgtaaatatctttggcatggaaattatgagggcattctgtgcattggttgatgctcaaatagtgcttctcgtggcattttcaataagaaaatttgttttgtttggccaaatttggtggtcgccagtcagattaatacatttaaaaacaatttggggtcacattggttaatatttgttgccttaaaagtgtccaacattatttactcattgtcagatcaaagacatg

SEQ ID NO: 111315 - DNA, 301 bp, Heterodera glycines
  Promoter: Source sequence=SeqID_10579; Location=2486..2786; Strand=-; Gene=SeqID_46885
agtgccaacaaatgaggaaaaattcaaaaaaaaatcgaatcatgattaactagtaaaggaaattcacggggaatttttgatcagaaacagagggcgagcgtcgcctggtaagattttatgacgtaaatggacaactcttgtataaaaaaaaaataataatacctttacaatatatatatttttttttttttttttttttacatggcttgccaattcctcaattaaggcctgaccgacaggttttctcatgccccatttgaatcacatttgttttagaatttaattcgccacttttcagatg

SEQ ID NO: 111316 - DNA, 482 bp, Heterodera glycines
  Promoter: Source sequence=SeqID_15212; Location=2140..2621; Strand=-; Gene=SeqID_79413
tttttaaaaaccgaggacgaacaaaagtcgtgggaacagtcccagcattttggcttactttgggtaaactgcaggaccggcggaatctcattttcataaatcgggcaggggtctggagaccggacaaaattaactgtgggatttccctgtcgaaataccgacccgtggcactgacaaatgagcgtggatttaacagaatttaccattttcggttgtctacgaatgttccaccaatcacattaacactgtcgacgtgtccaccggggcaaagtcaatttgatcattttggcactgtttttgtgagttttgccgctctttagggctcttccgaccgttttgtgttgggctccgaattcgtccgttttactcgtcggggacaacaaaggcaatttcattctgctcaattaccgactttcacggtgccatttaaaaaagcattaattttgaagcaagatctctttaaaaggaaagtgccagtgatg

SEQ ID NO: 111317 - DNA, 209 bp, Heterodera glycines
  Promoter: Source sequence=SeqID_6423; Location=981..1189; Strand=-; Gene=SeqID_61514
tattgtccaacccctcgggcccatttgcaacaatttaaggcaaacaaaattcaaaagttgtttggataaaatgtgattttcgttagaatttttggttttacgcttttctcattatataaaaataaagtttccaacgcaattaattcttctgctatttgtgtgacatcattcggaactcgtccaaattgtgctaattgctgccaaaaatg

SEQ ID NO: 111318 - DNA, 448 bp, Heterodera glycines
  Promoter: Source sequence=SeqID_21793; Location=1762..2209; Strand=-; Gene=SeqID_52407
tggcgcgaatattcggagaaatgaccagcggaatatggcccgatcgctaaaccccccccccttccccatccactttagttctccaaaaatttgtttcttttgtcaatttgtcgtcttttcattgtcagaatggccatacaacagatgttatcttcctttgtttggctcggggcgatcagcaaagattagtgctaggaatattgtgcacaaaagaataagcaactttaggcgccccactgacatgatttggtggcggaaaaaatttgaatttaatgtgcgttataaaaactggtgaaattatgattaaacgaggggacgatcggggaaattttatgtattaagagtcattctaaaagtaatttataattctgcaacataggtaaaaccgataatctgaatccaaatattccgataattttgcgtgaaaaatgggacagatcaattcatg

SEQ ID NO: 111319 - DNA, 313 bp, Heterodera glycines
  Promoter: Source sequence=SeqID_24902; Location=1342..1654; Strand=-; Gene=SeqID_55650
cactgttatctgatcattgccattgttgtaacgtttgtgtgcctgctgaatgtgcaagcggaatacaagaagggcaaaaggggtgattagctttataacactgggattaatttggtgccaaaaatctgtcaaaaataataaattggatgaatgaattttatttattatttaaattttagagcggtataaaaagcattgtttctgagatttatacccgaggcagatgaacataggggttttttaaaattttttaggcgaattttggggcttttggcgtggcggacgtacccgacgctcaatccgtcgtctgatg

SEQ ID NO: 111320 - DNA, 1003 bp, Heterodera glycines
  Promoter: Source sequence=SeqID_100; Location=3169..4171; Strand=+; Gene=SeqID_67530
tcacactgagcccaatgttccacagctcaccccatttttgcaatcaattcgtaattaattaaaagttgattcataaacaaccatttttgcaataaaaaacatattttccgtatattgtaagcaccgccggcattaaaattacttacatatttttaaatttaaacaaaaaattccattgatcactgtataatttcaattcatttattgtcaaacaaataaattaagttttattttggttacagccctacgtatttaatattaattatggtttcataattattttaaaataaacttactacccatttctattcttggattttgttttatgctctaaataaaatcctgtgttttggcttgagctttccggataaatttcttttttgctgttagtttttccggaaacattttgctgtttttggttttgtataaacaaaaacaaaattcacatttctgatttatatttccaaagattgtttttaacatttttatttgtgctttacacaaaactcaaatgttttttttaaaaattttccgcaaaaaattcctgatttggttgagattttccggacaactatttatgttttggtttgtattatcaggaaaataatttctgaattggcttgtgtttttccggaaaactatttctatttttcgcatgattcttcttggttctggcaattttttttaaattttattagctttttttttaaaaattcgcccaaatgttttattgttagctgtcggaataccgatttcgattgcctattttttaacaagcatgcttttccaattgtattgatcgtgccctttctacattttgtattgatcgctatttacaattcacagatctattaaaaacgagatgccggaggacagcaaaaacaaataatctcaaaatttctgccgtcacaaaatagacaaatttgaacatcaaaaacaaaaaaatgacggttccaaatattggggagaggagcggcacgctgacgcggcttatgccgtcatg

SEQ ID NO: 111321 - DNA, 181 bp, Heterodera glycines
  Promoter: Source sequence=SeqID_9463; Location=1..181; Strand=+; Gene= SeqID_71510
atgtttttggatataacttttttctttggcatcccttaccaatattgttggtatcattcgagagcttaacatctttctaagctattactaagctatcgcttcgcgatcagacaattaccaaaaccaacaagtacccaaaaaacactagttcgtatttatttcagtagaattgtttattatg

SEQ ID NO: 111322 - DNA, 742 bp, Heterodera glycines
  Promoter: Source sequence=SeqID_28912; Location=256..997; Strand=-; Gene=SeqID_59481
tctttttaaaaaaacataagaaaccttctaaggctgtattttttacttttttaactttctcgaaccgagcaaattataatgtgacagaaaaaattcatttctttatcaatttttgttaataaatagaatttttatttttttgaaaaataatttctttttctatttaataaaaattaattaattctaaattgaaatccgtttaaatgttttaataaacatgaaaaaagaatatagaaaaatcgtttacttcccccggatccggaaataactctccccccccccccctcagaatgattcttcaattctatagccttaaaatacccctaaagacctattttagaagattttggtgaaaaaaattttccattcgaaaatatgtgcacctccctttgttcccgaatcgcaatgaatttcatttttaaactttcttcaaaaaagtgataaaaaaataaaataaaatacctcttgtaatcaaaatttcggattttctagtatttacattgtgaaaattccttttcaaaacggcgttctgaattttttctgaaaaatcgcaaattttcagaatttctggaaataaaattctcccaaatttatttatttaggctttattcggtaatactttagatggtagatttttcgagtttctcatttttggttctaaatcggcttaaaataaggaaacaatctaaaagtcatcaaagcttcaattaaaaaatgtttaaacaattttagactaaaaatg

SEQ ID NO: 111323 - DNA, 615 bp, Heterodera glycines
  Promoter: Source sequence=SeqID_16551; Location=176..790; Strand=+; Gene=SeqID_80959
tttctatttgggaataacgacaacaacaacaacaacaaggtgagaaagctgattatcagggcttcttttttatgtaagaaaaatcgcgaaatatgtacataaaatgcgtaaaaaaaatcccgaatatgtaagaaatatgtacaaaaaaccaaaatatgtaaataaaattttttaataatttttttttggaaaaaaattctttgtaaagcgttaaataggtacaaaaatggcataaaactgacctaaatagatttataattcatattttatattttaaaaagttttggaccattcccgtatttgccctcaaaatcacaaccctgctgtcctaaaaaatctccatttcagcagcaattccatgtggatgtcactgatgttatatggaaaagaaaatttgacccaatttaaaataatttttattaccacgactgttttctactgatttcgcaattcactcccaaaatccattcattctctcttttcattctgagtaacgtcatcatcattcattattccaaagtgttcatttgaacagttttacacaatttatacatttttgctaagctaatttaaaaaagaacgaaatctttcttatttaatttgcctcaacaaatg

SEQ ID NO: 111324 - DNA, 244 bp, Heterodera glycines
  Promoter: Source sequence=SeqID_20054; Location=720..963; Strand=-; Gene=SeqID_84832
atgtgcgaaaacgtgaaaagagctgaataaataaaaagagaaatcgacagaataaagaggtaaggtaagaggacaaaaatatgagaccaccaagctgctggccagcttaagctccctataaaagcaattgctcaggcagaaattttcaagaaaaatattgaagacttaaaaatatttaagaaattaagaacatttttaaaattcaacttttaaaggaaatataatgaaaaattttctagaaatg

SEQ ID NO: 111325 - DNA, 269 bp, Heterodera glycines
  Promoter: Source sequence=SeqID_21707; Location=105..373; Strand=+; Gene=SeqID_52319
aatactaaatttcattaatttgactaagtttatgctaagttatgattaattttagcaaattaaattaaaataattaaatttaattattacgaacattgatacttttgtcacttcggctcaccacgatttcgacagtaaaaatttttcaatcgtgagctgaacatttgaaaaaaaaaaaaatttcggcccgaagacaaaaaaaggaagatcttcggcgattctgccctccgccgaaacgtgatgattagagatcgacattttgaaaaatg

SEQ ID NO: 111326 - DNA, 392 bp, Heterodera glycines
  Promoter: Source sequence=SeqID_13695; Location=1143..1534; Strand=-; Gene=SeqID_77612
aataaacaaacattagcattttaatcattaatctaattgtaaatcatttaaacagtgtacaagccaaggataacaaaaatcgtagtcaaaagaaagtggacaaaaaacggccagatcaattgaagaacaaagaaaaagggaaattggcacaaaatgaggccgaaaattcatcacaaaagcaatttaagaaaagtcattctcaaaatttatcaaaaaatctgctaaacattttaaatgaagaaaatcaaaagcaaaatttaatgaaaaagcaacaaaacactttaataaatttggaacaaacgcaaaaagaaaagcggccaataaattcggcggggcagcaaaacgaatccgaaaatttgtcgacattaagccaagattttgccattactatg

SEQ ID NO: 111327 - DNA, 468 bp, Heterodera glycines
  Promoter: Source sequence=SeqID_30742; Location=331..798; Strand=+; Gene=SeqID_61142
agtaaagtgccaattgtcggtattgctttcacaaaaagggcattttgaggggcgagtgaatcaattgggcggagtgtttatcaatggacggccattgccacacgaaaagcgcgttcaaattgtggagatggcacgcaggggcataaagttggccaattgacggaatccattcttaattttgtgccttacagaccctgcaaaatcagtcgcgaactcaaagtttcccatggagcagtgtcgaaaattctcaatcggtgccaaaaaaacaacaattagtgattgtgaatgaatttctttttttaggtttcatgagacgggctcaatttctccaggacaggtaaaaggggagacaaagctatgagaacgagagacttaagactttgctattatttggaaaaagtgacagttattttttgaatatatacagtattcctttttgacacacacttacagtaccaccatgcgatg

SEQ ID NO: 111328 - DNA, 346 bp, Heterodera glycines
  Promoter: Source sequence=SeqID_14542; Location=1347..1692; Strand=-; Gene=SeqID_78593
attaaaaatactaaaaatttgcatataatattttgttttcttatatgatgatataaaaaagtaaataaatccatgactatgtttttaattttcaggaaatttaaaaaaataaataagtaaattgaaattttcataaaatttgttacaagaattttaattgaaatcatccatttctttaaaaattgaattgaaatagctgttttcacagattgacctgctcgaggagctcaaccgccggctgaaccgcggctttcgtctgggcttctccgacggtgtctatttgcaatatgtgaaccactacagtgccaacccggacctgtgccgaagcgctgcggcgcgcaaaatg

SEQ ID NO: 111329 - DNA, 317 bp, Heterodera glycines
  Promoter: Source sequence=SeqID_25636; Location=810..1126; Strand=-; Gene=SeqID_56385
gtctcaactttttttggcacttaataaatggcatgtcgatcccacacccttccaaccacaaattcttattgttttgactaatccccaattaacgggtctcattaacaaatcgaggacaatcagtaacccgaccccaaaattcgagtagacgtccccagtgacttccctaagccccactttattggtacttcgctgggttatggcatgccgtctcccgacattgccaacaattttcctctaagatcgagccgcttgtcacctaattatttttctttccctttagccgcttaatcttaatcaaatccgattaaaaaatg

SEQ ID NO: 111330 - DNA, 769 bp, Heterodera glycines
  Promoter: Source sequence=SeqID_18542; Location=353..1121; Strand=-; Gene=SeqID_83169
aatttaatgcaaataaatcgcttgagactgctcttgtcaaaaatcttatctccataatttgttgaatcgtttattttcgtcgtgctttctgtctaaatttgctactgcccattcactgcagttggcaagatgaacggagtccgttttctgcagcgtttcgtcaacaacaatccgcgcaatttggaaagagcgcgcctccagcggaagcccagcgggtgggaatttgagaagaatcgagcgcaacataacttcatttacaggtgaatttgatggcatactgtcgatgtgttttccgggttttttttttgcattacaacaaacgagtaacacagggtcgacttttgtccgacaaaaaatgcaattgctgcccgagtcgtccattacgaagatggaattgtgatcgaagcgtcaactcgtgagaagactgtccaaagtcaactatacaggtcattcattgtcaaggggtccgatgacacttgaaattggatggcacggaattgttccaaggacggtctcagaattttggcttggcttctatttgccttaaaatgcggaagagtgggcgaggggggaccttgggatcgttcctccgttgttttcccgtgtcatttcacaaagtaaccactcgaaaaccccttaacgagttacgatgccggttaaatacccaatttttgtttgttgtcaattaaaatgtgtgtcccctgtcagtcagacggatgtctccgccgcttataacattggtcggctgttggctcatcgatgcaaaatg

SEQ ID NO: 111331 - DNA, 132 bp, Heterodera glycines
  misc_feature (11)..(11): n is a, c, g, or t
  misc_feature (21)..(22): n is a, c, g, or t
  misc_feature (41)..(41): n is a, c, g, or t
  misc_feature (44)..(44): n is a, c, g, or t
  misc_feature (58)..(58): n is a, c, g, or t
  Promoter: Source sequence=SeqID_29055; Location=1..132; Strand=+; Gene=SeqID_59619
aaaatattatnaattttgaannttaattttgaaagaatttntantaaatttattttanaaaattataattaagtgactaaaaatttttaataaattaaaaaaaacttttaggttgccgcacagttcaaaatg

SEQ ID NO: 111332 - DNA, 440 bp, Heterodera glycines
  Promoter: Source sequence=SeqID_39584; Location=1101..1540; Strand=-; Gene=SeqID_68119
atgcttttgttttttttttgggtaaactgtttaatgtgtctctcagtaaatttattgcagtttacaccgaccgtaaaataattttgcaaatttaactataatttcttctagaagcataaaattcaatatttttgataaaagaaaattccaaaaaattttattttttagaaaattaattttttgaagttttcttctcgtatttggcgttctgttttgttcattatcttggcggttttttaatttttaataacctattttttggttgtatacgcctttgacctacataaaatcgggtatagtacagttttacttgagcgcttgaacaaatcttgaaagtattggtatgaaatacttaatactgaattgcaacaaacattttcggtgtcactactcagtctttggttcttgacaggttattgccgacaaaacagccaaaaatg

SEQ ID NO: 111333 - DNA, 493 bp, Heterodera glycines
  Promoter: Source sequence=SeqID_3869; Location=2781..3273; Strand=+; Gene=SeqID_52232
ttgctatcaaataaaaaatatttaaaatttatttaaaaatattgagtgcctcaggggttggtcgcaaaaatgcgtccaccacacgctgaaccagctccgtgaaatagcgttgatgacgcacaattgtcgacgcgtcagagggcgggtcgaatagacgcacgacggcagggcaggcaccttaaaatcatcgagaaaagatgtttaattacattttaaaaaagtaattaaatttgtgcacctatcatatgttcgaagacggctttgccgaaagccgccttcggtattttgagccacgattttctggaaatgaaaaaaaaattgtgaaacgcgatttcttttgtaaaactggacgatggcaaactgggcgacagcccggtttttggagtataactcctttcatattgtccgaatttaaccaatttgttatcgttcggtaaacctaaaaattctctctgcaaattttaaaaattcgttatatttcaaagaaattatg

SEQ ID NO: 111334 - DNA, 200 bp, Heterodera glycines
  Promoter: Source sequence=SeqID_13998; Location=2525..2724; Strand=-; Gene=SeqID_77966
aaattttttttattgcatttggagccgaaataactcccgacccgccaaaatgttgcctaaaatgatcaaaaaattagcattttattatctgaaacaactcaacttcctcttttgtttagaaccgtcagtgcgaagctgtaagcatatttgggaatcaattttgaatggataattttcaaaatttcttactgtaaggtatg

SEQ ID NO: 111335 - DNA, 802 bp, Heterodera glycines
  Promoter: Source sequence=SeqID_8279; Location=1..802; Strand=+; Gene= SeqID_67549
attttgcaaaatcattgattttgtctgtgatttttcatcaggtacttgatttttttttgaaaattgtttttttctatattttttctttatttctttttaaataaaagtttgccacaccgttttgtctcggcggcgtttcagcagagacgttttgtcctgctcccttccaaactaacaaatgagtgccatcccctccgggaaaaataaagagaaaaaattgacaaattccagaaaatggccccaaaatttgctaccgcctgactccaaattgcttgggttttttaattaacccagaaccctaaaaatgctctttttttgagttaataaattccactcaaatttttaaaaatttctctgcttcgcctttcggtgccgcccgactccttctttccaagaaactgtgcttcatttaggaccaactaattatttggttgtttttacaaatcagtggcaaaacgtggagtgtgtccatgtgattttgtaatgcctcattaagtgacttaccccaatcaattatcgaccacttagcttttcgtagtgagttgggttggttttgataaaaattttcatttattcggtggcattggctataattgcatgaaattgtgccatttcttagggctgattttttccttaactaaattgttccctttccttaattctaattacaatcaattaagacatttggtttattaagctcattattatgcatctttttttggcattttctcctttctttttgccgctgctcggccaaaattgggtccacagtaatgagaacgaattgacgctgaaaataatg

SEQ ID NO: 111336 - DNA, 251 bp, Heterodera glycines
  Promoter: Source sequence=SeqID_2286; Location=2360..2610; Strand=-; Gene=SeqID_78909
aataaagtgcgaaatttttcggtatatcaacgactacattttatactacacactgaggcaactgagtgaacaactcccacacacgggcaagaatattttattgtttaaatgcgaattttgattaatttctaaaaattgtcgtccgattgccaaccttccatcggtataaattcaaattttaaattggacaagaaaatgccgagaacgacacaatcaccatacaattaacggcctctgttgtttcagacatg

SEQ ID NO: 111337 - DNA, 60 bp, Heterodera glycines
  Promoter: Source sequence=SeqID_20908; Location=688..747; Strand=+; Gene=SeqID_51489
cgtaagttgaatttacaaatcgatatttaaattgtgcgcgagtttttttttagcccgatg

SEQ ID NO: 111338 - DNA, 283 bp, Heterodera glycines
  Promoter: Source sequence=SeqID_17315; Location=888..1170; Strand=-; Gene=SeqID_81789
tctgataaaaattaatacaaataataaaaaattattaatttagatattttggtacacattttagggtttgtatattcttatatatttcgaatttaatttttttatgtatttcgcatacctatatttacgaattaatgtttttctatattgaacttcaaataaaatattcctgtttagaatttattttcaaacaaataataaaatataaaagaaaaaatgcgtttaaacaattataaataaatttctagtaagtattaagataatttttatagaattgaccatg

SEQ ID NO: 111339 - DNA, 423 bp, Heterodera glycines
  Promoter: Source sequence=SeqID_12985; Location=1953..2375; Strand=-; Gene=SeqID_76748
tcatcaataagggacaattccaattggcatagtgatccctatgtgtgaccaattaagactaattaaccaatcgtaacgggataattagctcaccgtaattatatatttaggagtaattagccaacatcggaaaaccgtttgattagctgacaaattggaaataatcaaatattttcaatttagcaacgacagaggaggaaagtgctcatcaaaacggggataacagcagccgggcgccctccgttgcgcaaccgccgtcacaatttgccggtgtggcggcgatgccattccaatttttgcttcaaaatggggaggagaatcagcggcaacaattcgactcaatatttccaaagtccatccatttgatccaaatttccattcaaattttccaattttcacttttcagaattgaacttgccaatg

SEQ ID NO: 111340 - DNA, 146 bp, Heterodera glycines
  Promoter: Source sequence=SeqID_20226; Location=1..146; Strand=+; Gene=SeqID_85026
cagaagaaggggatattgatgttgactataatgtgttttcttttggatatcattaaaataattttgtgtttgtgtttattctttagtttgtttatttcattcaatatttacgaaaacttttttatgctaattattttttaagaatg

SEQ ID NO: 111341 - DNA, 923 bp, Heterodera glycines
  Promoter: Source sequence=SeqID_28231; Location=1..923; Strand=+; Gene=SeqID_58872
ttagcttctaaacatgttacgctttcgaatgttcctttgatttaacatgtttttttcggaaaatgcccaaattggtcaaccaagatttcgaatatgtaagcactgtttttgataatcaaatgcagaattggcgcaattgaatgacattaaattttgaattttagcccagcataatttttcgggtttcccggtttcgctcccggaaaattttggactctcgcgcttccgccaattttctcactaaaagcggaagtaaaaaattcaatgctaattgtaagaatgttggtaaagaaattgacctcagaacgcaaaatttacctatttttatgacaaaattcatttaaaaaaaggccactcaattttctatttccccgccgcgacgccctataaaaggaggcattttccaccgaccgacccacaaatttctctcatttgtcacaagtacatttattgtgcctaattttatttgtgtcgtcggcatttgtacatattacgacagttcgtcgtcattatttgtgtcttcaccacacactcgtcaagctgctggttgagcgcaatgtccaagagacggcttcgacaggtgtcactcatttggggatgacgttgtttttcaatttgaaaaagtcattcttggcggcatctcatgaatccaatcaaaatttgcgaatccgatcaaatccaatcaaaatttatgagtctgatcgcattttgagtcaaaaattaatgaacagttccgaattcattgaacatttctttccaaatgcaaattttttcggagtttaggcaactgccaaaaagcgaaatttttcggaaattgtaattccgatgtccaaaaattccctggaaatctgttcttccagggcaggactgtttgtcatcaaatgctgatttcttttttccttttccaggaactcaaggacatg

SEQ ID NO: 111342 - DNA, 572 bp, Heterodera glycines
  Promoter: Source sequence=SeqID_36612; Location=802..1373; Strand=-; Gene=SeqID_65882
ctgccaaatcattaattaagtttttttatatttaaaaaataataaatttttcaacatttttcgttttttcatcgcttttagccagacagacagacgacagaagacacctgttgtgctttttcttttgaattttttttttttcaaatttaattccattttcattgtattttgtgcagtacaatatttttgttacaacaatgttttcatcctattttgatttgatttttcaaactatagaaaaccttagaaaatgacggcggagaaagagcatttataaagaaaaaactaccatttaattaaatagcttttttaaattttattaaaaaaataatctattgcctctacgggttttgattttcagtcaatttaaaccattttttttttttttttgcttagagcgtttaataattcggcaccaaaataattaaccgagaatagaagaccgcaaaatctcgagatttttttcgagtcgaacaaattcatgctaattaattatcaaattgtattttttcgtttaaatatttctaaggccaacagtacaatactactgtatcatccatcccctcgacatg

SEQ ID NO: 111343 - DNA, 884 bp, Heterodera glycines
  misc_feature (509)..(509): n is a, c, g, or t
  misc_feature (527)..(527): n is a, c, g, or t
  misc_feature (552)..(552): n is a, c, g, or t
  misc_feature (556)..(556): n is a, c, g, or t
  misc_feature (560)..(560): n is a, c, g, or t
  Promoter: Source sequence=SeqID_27127; Location=521..1404; Strand=-; Gene=SeqID_57834
tttgaattcactgtttttgggttttcataaataggaaaaaacaaaattttttacagcatttttttttcaaactttttcatgtttttctatattttgctttcgaaatattgtaacaataaatttcaataaatttgaaaacttaattcaattaaatctcttaaaatttattaattcaatttagttttttatcaatgcattttttgttgattttttgattaaagtacataattgaactctctgaatgctttttcttttaaatttataaaaattgtgaaattagttctaagtttttagaattaacataaatttcgaaaaaattttccataaataaatttgttggatatttaaattcaatgcatattattttgtttttcccgaaattcatcactcaatcagcagaaaacgtcatagactgcatttcgtaaaaaccgcctcccatgcgcgtttcgtaaatccgccaatgggttcaaaaaattcttagggctattgaaaatataaattaattttgnctcaattacattttatanactttaaataataaatgtttatatncatnaccnttgcaaaaaacatagccatgttcaaagctttataactttatttatacttaaggaaaaaactttagaaaattatattctgaaagagaacaattaaagctattgaattatcaagaagtattaatttggtttaattttagccaattttaacggttttattaataagcatttaatttttttcttggtattttggttttttctgtttttaaaagtaattgattttctattcttttatttaatgaaaaaaattaataacaaaataaatgttatgaatcatcaattatttattcccataaaatattaattaatattattcaatcaaaaatg

SEQ ID NO: 111344 - DNA, 309 bp, Heterodera glycines
  Promoter: Source sequence=SeqID_10422; Location=146..454; Strand=+; Gene=SeqID_73618
tatttttcatttcctttcgatttgccttccgccgatcaattcattccccgtcgtatgaattacgttttctctttctcagtttcattttctgcccgcccgaccaatcatttccccccttttcccaaccatcggcaggggatcttacagatctttccatctcatcctaaattatgctacaaaagtgttatttctttcattccgttgattgagtgagcctttcttccgactcatttgcggtttctcctcctttttcttcttcatttgctgctttttcttcgtcaccgccgtattttcatcttcatcaaaatg

SEQ ID NO: 111345 - DNA, 147 bp, Heterodera glycines
  Promoter: Source sequence=SeqID_25223; Location=1..147; Strand=+; Gene=SeqID_55966
actagagttgagcgggaccgggaccggcgggaaatcccggttttttcaggtcccggtccctatcccggtttttggaaaaacagaaatcccggtcccggtttagccagtcccggtcccggtgggactaaataagcactggtaagaatg

SEQ ID NO: 111346 - DNA, 119 bp, Heterodera glycines
  Promoter: Source sequence=SeqID_14299; Location=473..591; Strand=+; Gene=SeqID_78326
attaacagaacagacactgtgtaatatttagcaacgaagcagcaccatccattccatcccccaaaacggcggaagaacgtttttacgcgccggccctccccccgaaacgcaacgaaatg

SEQ ID NO: 111347 - DNA, 869 bp, Heterodera glycines
  misc_feature (26)..(26): n is a, c, g, or t
  Promoter: Source sequence=SeqID_30957; Location=1..869; Strand=+; Gene=SeqID_61318
aatgttgaatgacaattcaaaatatnttttgagaaaccatcggaaagaaattggaaatttatttggaaaatgaggaggaattaaattatgaaattaatgaggacaaaaattggatcaacgaaaatactgaaaaagtaaaacaaaaaattgaaattgaagcttttcgaagagaattagagcaaaaaatggaaaaaatgagtgaaaatgaaatgcaaaaatggccaagcttaaaatttacaatgcgtatttagtgctgctcgaaacagaaatttcccgagaccgagacttgatcccgagactcgagaccgagacccaaaaaatccgagacttttctcgagtcgagaccgaaactctcgagcagcactagtatttaattgtcaacatttttatttaaaaaacgcattttccatggtaatccatcggcttctgtaagtgttttttcttattcttttttcattgatattccttctgtctcccctactgatgaatgatcaatccctattttttaaatattgcctcattatttaatataataaataaattatattaagtaaaatatagattttaataatcctactgatgattattacttaaaagctttttaatataatagacaaattagattaaataaataagatttgttggttttgctccctttataaggcttttgtgcttttccattttttcattttcataattactttaaggtattgaaaaatagaaataaattattttatttatttatttattttagttacatagatattagctaatttcttaataaaaaattttaatttattttgaaataaattttaataatattaatgagcatttaatttattttaagaaaaaataatgaaaaaataatg

SEQ ID NO: 111348 - DNA, 173 bp, Heterodera glycines
  Promoter: Source sequence=SeqID_10903; Location=1602..1774; Strand=-; Gene=SeqID_74183
ttttttgttcaacgtttgaagagggaaccggaaattacaaaatacttatttaatttacaacagggtaaaggaaagaagagaagaactaaaagaaaactagtccttgtccaggttaaccctataaaaacccaaggattaaatagagaaaaaccgctatttaaaccagtgttatg

SEQ ID NO: 111349 - DNA, 95 bp, Heterodera glycines
  Promoter: Source sequence=SeqID_22057; Location=621..715; Strand=-; Gene=SeqID_52693
ctcagctgtctctcgtccatccgaaggaagaacaagccgaagtcatcgacccagccaaaatccgcaaatcacaagctgattatgcgcgaaaaatg

SEQ ID NO: 111350 - DNA, 499 bp, Heterodera glycines
  Promoter: Source sequence=SeqID_820; Location=2607..3105; Strand=-; Gene=SeqID_62027
ttttattgatttttttactaaaatattaaacaaaacattttttgattataataaaattgacaaaaacctattttaaaaagagtaaattggaaaaataattctttatttttatttttaagtaaaatatattttattgaatttacttaaaacataaaaaacaaaatttttcatttttcttccctcaatgatcagcagtttttcaatttaccagccaatttttatgaattgcagcaataaaaacaacaaaaaaacaatgcaacaaacaatacataaaaatggcattttatcaggcccataatcaggggggggggggtagaaaaattcgcacatttcgttggcgcccaaacttttttggaaatttgcaccggaaaaaacattttaaagcatcttttttcagttttcccactttgaaacttttttttctggtaatatgggcctgagactaaataaatactgcgagcagcagagctaatatgttcataacttttgcttaatgatg

SEQ ID NO: 111351 - DNA, 1003 bp, Heterodera glycines
  Promoter: Source sequence=SeqID_13281; Location=2024..3026; Strand=+; Gene=SeqID_77114
tgaatttttggaccatttcttttttctttctcaaccaaattaaacattcttgctgttattcgaaagaatttgaaaaacgctattaaattgcaaattttcaaaaattttattcatacgggtaaaatttgattgacaatgaacaaagtattggttcaataagtctgcaccgttcacggggtgggggtgagaccaaaaatcctgtcctgcccacgttcccctggacgggggcgggggagatttcgaaccctagtcctaacaactacgaaattattgacaattttcaagaaagaatttattgaacgaagattattatgcttccgtgaaagatgatgctgaggctatttaatatctgagtgtaatctgtttttatcaattattttatttattgcttttgtttgatattttttatgttttaagcttctcattactcaaaaccaaaacacttgcgaaatcaaatgatttcttttgtattcgtatttagttttctttattggagctccagttaactgtttcggtcctccggtttaaatttgtttataagtttaataattaaaaataaatgtttttatatgtataatatagaattatttttaataatttttctgccatcattcatttatttaaattaacttattttcatgtgcggattaaagcattgccaattccgataaattaattacatggtgattaatttcgaagccattattattttagggatttttttcagaaaaagtgttttcttttaaatatcatattcattaaacaatgaattaagttaagatttatatttatatcaatttgtcttataattacttttaagcatttcttttttcttgtcaatttcatttcattagttgttttgtttcaattttcgattttaccatttaataaattttgaatattttaaaacactattttatttttacaatttttatattataaattttatatgcctttttgaattatttataaacatctttttaatttcagtatcgtgaggatg

SEQ ID NO: 111352 - DNA, 144 bp, Heterodera glycines
  Promoter: Source sequence=SeqID_29775; Location=127..270; Strand=-; Gene=SeqID_60238
tagtaaaaaaaagtgctaaaaatgccttttcgtcttttgcacatttcgcttgcctttttcctgtattttacattggcgtttcttttaattttcagcgaacaaacgaccaacgtcctaatttctgaaaccaccattctccacatg

SEQ ID NO: 111353 - DNA, 286 bp, Heterodera glycines
  Promoter: Source sequence=SeqID_32816; Location=442..727; Strand=-; Gene=SeqID_63052
tactttggagtgtcgggcaaggtgttattattgcaacagagtgggcggagtaccgtgtggaaaggagagtggagtgaagattgaatgcccgaagtgtcgccgttacttttacaattgggagtgttataactatcatcaaggacatcaaacttgtaaattatggaaacgttgtgtgatttgtgataagacttatttatttaatccgaagaaggaccatgaatgtggtgagacttattgccaactttgtagtgtgagccacgaccccaagcggggttgttatattatg

SEQ ID NO: 111354 - DNA, 250 bp, Heterodera glycines
  Promoter: Source sequence=SeqID_2905; Location=173..422; Strand=+; Gene=SeqID_82285
aacattttatgtgtttgtgattgcactttctttagggtttctcagaattttgactcgtttaaatttttttcgagttttttgataaaaaaaattttctaaatttttttttttgtaattttcttatatggaaaattttctaagattttttcttgaaaaattttctgtttaaaaattttaaaaaatcctgtcggggtccacctttctctctcccaatttgtaatattttccccccgtttagcccgcagcaatg

SEQ ID NO: 111355 - DNA, 1003 bp, Heterodera glycines
  Promoter: Source sequence=SeqID_11255; Location=2277..3279; Strand=+; Gene=SeqID_74621
tttaaatgcgcctacaacaaaaaatcaaattatcaattttcataattggatgatgtgtagtttttgctcgctattaacggggtttttacttattttttctgcggctttaactcgacgagaaatgcacaaaaaagatatttttgttcgaaattttgcgttttatcgcccttatagaattcaatcggaaaatttaaaataagttttgaaagtatttataataattaaattgcatgaaaaaaattgaaaaaatttttcaaaaactgccactttttcacaagcgccaaaaatattatgtcctattttttgctaacaactgaaaaactttttgaaatttacaggcgattggagaaattttgagtcatagaatttaatcaaaaagtgaagcgttgaattttgtcgtgtcattttattgtcgtataaaattaacaaaaatatcaaatggagaaaaaaataatagtagaaaattaagtggaatgagggaagggaggaggaacgatcaattggattgggggcaatgccaagccaaatgatgtgctgagagcagtgccaaaggtgtgacggaacagcgtcaatttgtattggttttataacaaggcatacagagaaaaaaaagatgaatgagagagacagagagataacaaaggttatgactttttatttaaataattttctttgtattttacatagaatgtgcttttaagaatttatcgaaatttagtatattttaaatgaaatttatttgaaaaatgaactctaaaagacgattccttcggaaaagggaaacaaagaattaatttttaaaatttataaattatattctaagcctaatgaagtaactttgtggtagttttgtttttcaaccccggcctgaaaagccgagtctacactttctaatttgttgtttctttctttaaattactaaaccatttattcgtaaacttaaaaatattttttagttaatttttaaaagtaaaatttttatctttattttacttgtgatatg

SEQ ID NO: 111356 - DNA, 100 bp, Heterodera glycines
  Promoter: Source sequence=SeqID_26214; Location=1..100; Strand=+; Gene=SeqID_56966
gtttccatcctcaaattccccaattttttttagcgcgggatgcaaattcacggcactgctcaaattcccggcttcgtacccgcattatccgccaacaatg

SEQ ID NO: 111357 - DNA, 263 bp, Heterodera glycines
  Promoter: Source sequence=SeqID_36755; Location=888..1150; Strand=-; Gene=SeqID_65997
aacaacatatccatcctgtgtttttgtttcttcttaatacttaatacccttttttattttgcgtattaattgccaaagaaatttgagtcatttccctaattaataaatatatagtttattttacagtaaaccatcagtccagtaaatgtgaaatgtacaaacgctcatttataagtcccatttgttagtgcacattctttaaccctttaattaacacactttgtcactttaaacgacgactaaaaacggcaaattgaaaaatg

SEQ ID NO: 111358 - DNA, 444 bp, Heterodera glycines
  misc_feature (82)..(82): n is a, c, g, or t
  Promoter: Source sequence=SeqID_31924; Location=1..444; Strand=+; Gene=SeqID_62238
tgttttgaaacgtgctgttaccaaaggcggttgctcaacctactgagctccgttatcctggcagcaattttaattgcctttnagagctgagggtagtgcgttaaacatttctaaattttccgtgtcgtttaggtgccctgtcgtcttgtgcttcatgggtggcagtgcgctgctcttcgggtcatagttggttacgaattttacaaattttatgctaatttgtttgataatgcatgtccatgtccatgcgtgtgctataaaaatgaatattttcggctcacctaatcattcacaacgtcatttccctcccatttaagatttttgaaaaaaatgcaaaatcagcctcccaaacgtccctccaatttttctattgaatacctgctgtctatccctaataaaaagccgcggcgcggcttcctcatcaaccaattgttgggagaaatg

SEQ ID NO: 111359 - DNA, 1003 bp, Heterodera glycines
  Promoter: Source sequence=SeqID_12725; Location=1129..2131; Strand=+; Gene=SeqID_76423
gaaaaattttgtaattttaatgcgatttataaaatttctaagagcatcgaatgatatcaagataacttacttttgttggttctaagaaagtcttgaccagaatttttgatgatcaatcttattttatgtcgaatgaaaattgtttaggttttttattttcttgataacaatcaatagcaatagtgtttcggattagtttgcaaaatttcaaaaatttttgttaaggtttcaaaaaagttatgactatagtatgtcagtcgaatcgttctacaaaattgaatgtttagcgaaaacggaacaataaaataatttttgtttatcaattttgagaaaatttttcaatacttagtggagtgtattttttgaaattttttcaagtgattttttagggagtgtattttcccgattttattgcattttaaatctttcgaaaaaaatgctaaaaaaggaaccaaaacggcaaaatgccaaaaagaattaaacgcttaaattatttttgtgtttaaaaaataaattaaatagttgattaattacaaaatcaaaaatcaacaacaaaatttctgtaccaacacagtttttcatatgggataattttgaaatgtttaagaaatgcaccaaacatcgtgaaggcattaaaattaagatttttaaaaatcatttaatttttatcaaatttgaacaaattaacaaatttatggccaaaacagctatttaatgatactaacaatgttggatttggatgacaaagaaaaaaagttatagccaaaaacttgccgggcccaaacgttggggcccaattgagctgctccgtattaattaaatggaaaattcgaataaaattatggtcgccatttagagaacaggaaaacacaaattcaataaaacagaaaattttttaaattaaaattaggaaaaattaaataaaatattttgattccttttaaatgtgctattcatccgaaagttcttcactgaactggtcaaatttattccaaaagcgatg

SEQ ID NO: 111360 - DNA, 722 bp, Heterodera glycines
  Promoter: Source sequence=SeqID_10791; Location=1048..1769; Strand=-; Gene=SeqID_74055
ttgctgtcctccttcgtcgctcgtcggttgtgcgccggccgttcccatctgtcaaatgaagtaaacactccgtcatgctttaccttctgttaaatataaatccctatttttcggcatttcccacttttcctttcgttggcacttttttctccgtccattaagttacggctacggaagttacggcggaggcggaagttatgcggcaccgctaattgtgaattacccacgcccattcggctatcaacaacagacgcagttttatgactgcggggggagcgaatgcggcggagaatgccaacagagcggggagacagggggaggcggcagagaatgctttagcggtgcggaattttgtgcctgcagttgtaggggcgggggaggagcagttcaagcggacgcgggagggtgccaaggaggagaatgccagcagggaagtgggtgtcaacagcagcaggtggccacacattgccaaggatgcgtatgccaagggggaggatgccagcaggatcgaggtgctggaggagggtgccagggaggaggagggtgccaaggaaggatatgccaaggatgtggagggtgcaacgggtgcctgagaagcggaggatgccagggaggaggaaataagcagggcggagaatgccaaggagcagggtgccaacgagaaggagcaacccaggaaatagggggattacaaggaagcggatgccaaggaagcaaaaatg

SEQ ID NO: 111361 - DNA, 1003 bp, Heterodera glycines
  Promoter: Source sequence=SeqID_8036; Location=1309..2311; Strand=+; Gene=SeqID_46530
ggacgaattgctcgccatcgattggacacattgatgatggagtcgaaatgagaattttatcgaaatgagaatttaaatgttaaaaaatgcttttataaaattttaatgctttattgtataataataaattatcggcttcaacattttaatataaaaataaattcattttttaaatttgttaagaaaaatgcaatgaaacagaaaatttatctgcgacggactaaccccaaaattacataaatttcaaaaattctaaccaaaattgaaaaaaatagtaattttaaaaagactgattaaaatattggcacaagacggatcagagagataatctctggactgaaatagtttcaaaacacgaagaaatcaagacaaaaatagaattaatattttcattataaattgaaaattaaataaaaaatttaatagatttaaaaaatttcttccatttacctttgctttttcgttaaaaatttacatatttaaaataatcacttaaatatttcatcaaaaaagctcattagtgacccaattcaaagctttaaccaactaaaataggcaaaaaatatatattacaacgttgagacagacaaaaacatatgtttttatactttacaaacaacaattggatttaaattggacaacggaaatcctgtgtattactcagaacaaaaagaatgaattaaaaacggaaatgtgcctgccctttggcagtcacagttactaattgctgcagttgtctgagaattgaaaaatgaaaaataaagccacgggggctctattttgggaaacacagtatgttatttaatttagaattttgtgccaataatcattttttattttctgaatttaaatatatattttttctgtcttggaattctaaaaaatgtgtagtaattcaggtttttgccaataaattagtatgagtatttttgggcttgaaattggcgtggagccggtcggcctactgatgggcgtgttcgagccgcaaaagtacacccaaatg

SEQ ID NO: 111362 - DNA, 235 bp, Heterodera glycines
  Promoter: Source sequence=SeqID_5355; Location=686..920; Strand=-; Gene=SeqID_57775
aaaatttggtctttttagagcaaagttataagcaaaaaaattttattttgatggttttttaaataacgcacataataatggtttttaaataatgacatagcaccaaccgccgtccgacgtttaataaggcacgaaaactgggcttaaattattgtaaaaaagaaagaagcatcttttctaatcgcattttaccatttacaggactttaaaaatagtttttatttaatctcaaatg

SEQ ID NO: 111363 - DNA, 120 bp, Heterodera glycines
  Promoter: Source sequence=SeqID_13840; Location=94..213; Strand=+; Gene=SeqID_77780
ggtcagtatctcatcacaattaacccgttaattaccccctttgatttttaattacactttcctctcattagcgctttaattactcctccctttgagttttaattattaattaactaaatg

SEQ ID NO: 111364 - DNA, 393 bp, Heterodera glycines
  Promoter: Source sequence=SeqID_41629; Location=480..872; Strand=-; Gene=SeqID_69713
accattcatgcgtttttacctgttggacggttcagtcccaagggtatttgccacttcagtctcgggtctgcaacttagcagcaggacttttaggcattaaaaaatcgaaaaataagcacctaatgaaactaaaaaaagttaaaaataattgtgcgattaaaaatttttgcatttctcttctcaataattacaaaaaaaaattttaatgtgagcagataaagccaaaaatgctaataataagtaataatattatgttttgcactaaatccatttccttctgcttctgccgttccaaccgatttatttgatgaattgtgtgtcaacaaattttggttcccgtccaccagcatggagaagcggcacaaaaaaatgccatcgaaaagcaccaaaatg

SEQ ID NO: 111365 - DNA, 114 bp, Heterodera glycines
  Promoter: Source sequence=SeqID_1949; Location=681..794; Strand=+; Gene=SeqID_76975
ggtggcgaaatgacaactctctgatcagccaatgcttaaaacgttttgatcaacttgcaggaactggcggagctggagcaggaaccgatcacgggttgcaccgcgacaccgatg

SEQ ID NO: 111366 - DNA, 399 bp, Heterodera glycines
  Promoter: Source sequence=SeqID_7293; Location=2384..2782; Strand=-; Gene=SeqID_64374
atcaataattaattagttaatttaattgaaataatttttaaatgcctcgagtttatgtgcattaaataaagctaaaatatttacgaattaatgatcagaaaattgaaaacttcgttctttttaaagagaaaataagagaataagggctttattgctaaaaatatttttaaaaaattctaaaaaattgaaaattttgaataataaagttgtgaaaaagtcattcataaattgatctattttaaaatccactaattttttcatccctataatattattggcctaaatttactaataattttaaaataataattaatttttttatttaattgccaaaattattgtcattagcatccgaaagtcacctttctgaacaaaactccgcgcgcttacattccgatg

SEQ ID NO: 111367 - DNA, 561 bp, Heterodera glycines
  Promoter: Source sequence=SeqID_11533; Location=3075..3635; Strand=-; Gene=SeqID_74963
gccgttaaaagaagaaattgaaattaacacacaacatagggaggacttgaacctgggaccccccttttggtgactaactcacagaccactaagacgaaaaaaccaacttaccgtatttgctctttttatataccatggtatattatttttcaaccttctcagaagggggtatataattggagactggcagactaatggagactggcatataaaaagagcaaatacggtaattgtacttggagcccaaaattgaatcgccgtgtggaacaaagtcaccaatttgcgcttgactgttccgtttgcaacagcagatgagcagccagtttggggtgttattatgcgtgaaatttggccaattttttcggcaaacattcgccacttgggcgtttgcaatggcatcctttttgacaaattgcgtcgtctcacttcgccttcaattctcaccgatctcgaccaattgaattcaatctattccggtgatttgttgcccgatgcgactgttgatgatgattttgatgggccaaatgcaacaatttctgctggccaaatgttgtcaaaatg

SEQ ID NO: 111368 - DNA, 1003 bp, Heterodera glycines
  Promoter: Source sequence=SeqID_12385; Location=1773..2775; Strand=-; Gene=SeqID_75991
caaaaatgctctcaccaacgtctaaaaagctttatttgtataaaatggtatttattattttggtgttaaaaaattagatgtaaccttttagttttttaattcctttttggaacttttagttttttaattcctttttggcaatcttttatttcggtatatatctttttttgtttgttttttcgcttatttaattaattttttaaacattgtgttttttaagcgtgaaattttctttgtgctaaaatggttcgacataaacagaatttaaaagttgatgattcttcgccaaccacatcatcatacctgaatacagggttcaaagctcccgtaaaaaaagcagtaaagtgaacggttccaagctccgttcaaaagcggattgaatttttacaagaaagtgatgaaaattttatccaaaaacatgcgataaaaagaaaggcatatataaaagaagttattgatttagacaatctccctgatgagttcttatctattaatatgaacaaagaaaaaaatgaaagaaaccgagagtatgataaaaatagaaaaataccgcgcatccaaatgagtgaggaacagagaaatgaactaagagcgatggatgctaaggttgttaaagcacgtagagatagaattaaagaaggtgacttatatttaaaagcagccgaatccgatgtcctacatataggtgtttatggtcttggagaattgaatataaagtgtaatcattgtccggccattcattttccagaagaacaaaacaaaaccaaaggtttaaacgaattttttgaatgttgcaattatggaaaattaagtaatttggaggatttgctgcaagaatatcctatagatttaagggtattatttcaacctgaaatcgacgaaaataattacacaaaaataaaggatttacacaaaagttttataaaaaatataagaactttaaattcttctttttcatgtgcttcgttgggttgtatgaggtttaaatttcctgataaaaatg

SEQ ID NO: 111369 - DNA, 157 bp, Heterodera glycines; identical to SEQ ID NO: 103018
  Promoter: Source sequence=SeqID_18032; Location=1073..1229; Strand=+; Gene=SeqID_82611

SEQ ID NO: 111370 - DNA, 381 bp, Heterodera glycines
  misc_feature (29)..(29): n is a, c, g, or t
  Promoter: Source sequence=SeqID_43910; Location=721..1101; Strand=-; Gene=SeqID_71473
agagaatacggaatgccatggaaagagcnaatcagcggataaagagagaatgaaagagagagtgtgggtgaggaaaggacgagagagaggcgagagagaggggagggagagagagagagaaagagaggaaaagtcatgatcagaaaatgattgataaatttgaaaatgacaaataagtaaagaagtgtccctttattcaactctgccattgttttctttgctgatcactctcccaaatcactgattgatcaaaacccgttcattttgcctttctcatctcccaatttgtcttcgttcagttccgatctgtccgtcctttactctctgctcactttgggcgactatctttgtgatcagctgcagctgaccagcgacgaaatg

SEQ ID NO: 111371 - DNA, 447 bp, Heterodera glycines
  Promoter: Source sequence=SeqID_30337; Location=370..816; Strand=+; Gene=SeqID_60756
ggtgaacctatattttttacaaaatgaaaaatttttttatagtagttttcttatagttcatacagaagttattttttatataattgctatagataatttttttatttgtattttaaagagatttttttgccaaatatacatgtatattgtataatattattcaacttttattcccgtacaatctcccatatatttttctgcgtactgttttttacatacaaatatatttttgttttaatttagcataggtctaaaatatatattacatttataaaaatttttttaaaccattatgatagaatttgtttttaattgctttaatattatcttactgtaaaaatttgtgctgaaaatttatcgtactccaacgtttaaattagcaatttgttaattaaacatcttttttcatttttaatatagaaatttataggaataaaattaaaaatg

SEQ ID NO: 111372 - DNA, 98 bp, Heterodera glycines
  Promoter: Source sequence=SeqID_24420; Location=2329..2426; Strand=-; Gene=SeqID_55151
cccaatcggggattaagaccagttttatggcgtcatgctctggaatatatttcagtttcgtattcgtattgatggaaatagcaatgggaagggaaatg

SEQ ID NO: 111373 - DNA, 1003 bp, Heterodera glycines
  Promoter: Source sequence=SeqID_949; Location=3360..4362; Strand=+; Gene=SeqID_64820
atttattaatgaatttttatgccgtgaggaaaacgaaatcggaaaaaatttttcaaaattgggaaaaaaatattttatatgaaaaatcagaaaaaatgcgaaaagatttttgtgaggaattgaagaagggaaaaagcattgaaaaagcaacgcaaaaagtgggaaaaacggcaaaattctcctattatatttcattgcctttgtgttatttggcaatgaattcatcaaagaatgcaccggctgccttcgcaacaataataaccaaattcactcaatcgaattggcagagaatggtcccgctgctgctggtgctaatgggcaataaattggtgtcaattagggaaagaaaactgacgatgtgtgatactgtgttccttatatatcatagctctgtggtgaagtcaatattagtgatatttttttcaaaccttttcttattctattaaatgtttgttgactttttgtttgtttgggaattaattattattccatcaaatttaaaatgcgaaattttaagttttactcaatgtatttttttattctattaaatgttacttgacctttttttgttcggaagttattattatttcaacaatattaaaatacgaaactaaacaatatcaattaccgaatcccgacaataaaggaaatcgagttcctaatgctgctggagaacattcactgagtcaccaacatcattaatacgggcgtacgccgattaaagtgttcaattgatgtatgtgttttttgcatcaatcaattatattttaattacgaagctaacaagagaacatatctaactgtcagtatccaaatcttatggatatttctctcttacatgttagcccattgtcatgagttcggatccgcctgacagatggtgaattattttgatttttttctaagtatcattccacctagcatttttccccattatacaattttattttttgatactattggatagaggaattcttgttgaatattataaaagaaaattatg

SEQ ID NO: 111374 - DNA, 348 bp, Heterodera glycines
  Promoter: Source sequence=SeqID_35788; Location=931..1278; Strand=-; Gene=SeqID_65255
tatacgcttcatcatcgtcgtagatcaagcttctttaaaggaacaagtggtgcatacagtatgccgcaaagaatgacagtacgtctattacagtacgattaccttctggccctatgccttagcaaactgtaacgccgactgtacacccttttgagcagtgatccgcttctcacaacttcgccatttctaatttgatcgtcattttgtgaattattgttaagtgttgtggtagggagagcgagagaatttcgcggtttggagcttaaaaatgaaattttaaaattccaaaaaagggaaatgccttgtcgaatgtttgtgcggattgcgtcggcttagcctttcccgatg

SEQ ID NO: 111375 - DNA, 301 bp, Heterodera glycines
  Promoter: Source sequence=SeqID_14083; Location=1865..2165; Strand=-; Gene=SeqID_78057
ctcataatacggattcagaaagaaattacggtaaattttgtgattataattttgatacaatttatttaggtaaattactcccgacccttccccctatggatgattattgtcctgaaagcatgaaagatgacgaatttgaaaaattcaaagaatggtaccaaaaaaacaaaaaaaaaaccctttttgttaggtactataaaaatgagcgaccttttaaaaaaattttaatttagaggaggaacaattacaaatttattgtggacaggatacagaaattttattaaaatcgatactgagtatg

SEQ ID NO: 111376 - DNA, 213 bp, Heterodera glycines
  Promoter: Source sequence=SeqID_19350; Location=750..962; Strand=+; Gene=SeqID_84086
aattaattaggccttgttttcattttaaggtgtggtggcagagagatataagcgtcagtctctttcacagacactttccaactcggaccaattgttctttgttagcgatttaatttcgttttcataattctgtttgggttccagaaaccattggtaaagctgcggacgttcgatcgcacttaccaaagcagcaatagcgaagtacaaaaaatg

SEQ ID NO: 111377 - DNA, 1003 bp, Heterodera glycines
  misc_feature (150)..(150): n is a, c, g, or t
  misc_feature (173)..(173): n is a, c, g, or t
  misc_feature (203)..(204): n is a, c, g, or t
  misc_feature (270)..(270): n is a, c, g, or t
  misc_feature (294)..(294): n is a, c, g, or t
  Promoter: Source sequence=SeqID_16717; Location=2166..3168; Strand=-; Gene=SeqID_81119
atttatttggctggcttttaaggggtccccttttttccgtttccctcctccctcattttcaatcgttctccctaaattttttctctcattttgttgctgcacttttctgctgttggtcgattgtgacatcattcttttgttattttttgnccatgtcaaaaaacgacgacgcnccaccaaaaaagaaatgtaaattcacaaannaattttaaatattcttcaaatttttcagctttatctgcgccgattgttggcttttggtgttgattnttcttacgccttcccaatttggcnccgaaattgcattgatcaaccgctgctttgacatttacgtggacgaacatttcaagacacgcaaatggaaattgggcgaaattcgaatttgctacaaaattttcttaaaattgataaatttatgtcaaaaataagcaaaaaagcgaaaatttcgcttttcgggttgatttttcggtaaaaattttgagaaagtatacccttaattttgaaaaatttatgtccatatttttgccattttatgtccatattttgccattttatgtccatattttgcgatttgttgtccatattttatggccatatttcgtgattttatatccatataattttacgccctactaatcattatccgtctccaaatcgtcaatttgctttttatcattttttaaaatcacgaagctttaaaatgctgattttcttcttcagatcgtggttgtcagaagagtgactttgaaattttgcaggaaaatacctctttagcacagagggaggggctatctgcttgaaaaattaaaaaaatttcatgcattcacaaaaattctgtacaaacatttgttcgtgttttgttttattaaatttgaactattgatggcattttcgtgattttggccccgagttggcagaatttttagtataaaacggcccaatgtttcttccattctctcattcaatctccttataatttccggtcactttgttgctacaaatg

SEQ ID NO: 111378 - DNA, 317 bp, Heterodera glycines
  Promoter: Source sequence=SeqID_1873; Location=1424..1740; Strand=-; Gene=SeqID_76484
tgacgacgacaagcgctcgtaggtgaccgcctacacgcacgtcgagctcaacaaagcgctccagcttggctatgtggtcaccgatctgtttgaggtaaagtcactcattaaaaaattttgtgtacgaaaacacaaattaggtctgggactacgaagagtgggacggtacgctgttcagcagctacgtcaacaccttcgtcgggctcaaagtgcaggcgacgggctggccagaaggatgtgtgacggatgagctgcaaaaggcatttgtagacgattttgagcggacggaaggcatccgattggactccaccaaaatg

SEQ ID NO: 111379 - DNA, 89 bp, Heterodera glycines
  Promoter: Source sequence=SeqID_30509; Location=1407..1495; Strand=-; Gene=SeqID_60911
agaaagatgagaaggacaacaaccatttttctgtgttcggaatttgctgtctttttctggcacaatatttacaaaaagcgaatgcgatg

SEQ ID NO: 111380 - DNA, 529 bp, Heterodera glycines
  Promoter: Source sequence=SeqID_32239; Location=1223..1751; Strand=-; Gene=SeqID_62564
ctttttgaattttttctgcaaaaaatactttaatacaatatttagcaaaaagggttttttaattaaccaaattgagtaagttttgagaaatttatcatcctcggaaaattatgcacaattttggaactttatattatatttcgaagtttttccacatttttacaattttcgatttttacacatattttaccgataaacgtgactttattaaaatccagttttcagctgaatagtgcgatcgtccgtttttgttttttggcttgttagcatatcgtcagtttttgctgatttggctggctaatctgtgaatcacaaaattttatattataaattttgtgatcagcaaaatatttttctccgtaaagagaggcactgtttttgatgattcatgttttatgtggacaaaaacagatttattcagtcaaatcatttttcatttatatttgtttattaattatattttctgaatctaatatttttcttcatttcgaaatattattattattatttggtgtatcttccaaatatg

SEQ ID NO: 111381 - DNA, 462 bp, Heterodera glycines
  Promoter: Source sequence=SeqID_15002; Location=722..1183; Strand=+; Gene=SeqID_79158
atttaccaattgtgcccctccttccctttcgagaaatttttctcaaaaaattctttaggatagattatgtatatattggggtgttcggaaagttctttcatagcggtcgttttatgtaaattagaatttttttcgcacccaaccgcaacctttggccaaattctttctgttctatgggaaggagcacattttgctgcatatgttacgagccatttcattttcctttctttgtaaattgattttttaaaattatcccaatggagcacccaaaatcccaaatccgatcacttttattgtacgggtcaaaactttgctttgatcagttggaaatttattaaaagcagtttttgtggccaaatcaagtccggagaatccaaatctggcctcagatttgatctctgaattgtctctggcattgtactgctccatgtcgttgacaatttgtttttcctctttaggatg

SEQ ID NO: 111382 - DNA, 302 bp, Heterodera glycines
  Promoter: Source sequence=SeqID_42768; Location=676..977; Strand=-; Gene=SeqID_70583
cctaaaaagaaattatgtataatggacagtataattgcgattctttttggaaaattagtattttatggtgctagggcttattgtcggatagaaatccgggcttttcgaaaaatgaaaaatagacaaatttttaaaatttgctaaaaatccaagtaaagtgctagtgcccggcgtcggaccggaccctgtacggaatttttaagggtacggaatcaggtttagtttttagtagtttaatacataggtaatttaattttaatatttgcttgaaaattaaaaaaaaatatttttttttagaaatg

SEQ ID NO: 111383 - DNA, 265 bp, Heterodera glycines
  misc_feature (159)..(159): n is a, c, g, or t
  Promoter: Source sequence=SeqID_23486; Location=1293..1557; Strand=-; Gene=SeqID_54181
caaaaattggggagttggttcattttttcaccaccttagattattataaataaaaaagattcattatgattctgatcatgtctaggtccgatctctttcaattgaactgaacccccttttaccaactaaaaaatatgcataaatttcattgattttatngtacgtatagtttggtatatcaatgatttaaatttttgatgatgattatttgataacaaataaaattgatttgaatatataaattataatttgaatttcatcaatg

SEQ ID NO: 111384 - DNA, 79 bp, Heterodera glycines
  Promoter: Source sequence=SeqID_3004; Location=1516..1594; Strand=-; Gene=SeqID_82724
tgttgagaaaacaatctttggcattccataatattacaaaaacctattccaaatgcttaccatttttatccagacaatg

SEQ ID NO: 111385 - DNA, 127 bp, Heterodera glycines
  Promoter: Source sequence=SeqID_3775; Location=3370..3496; Strand=-; Gene=SeqID_51828
tctggaaatttctcggtttaacaaaatgaatttttaaaaataagtttttgcctgcgtccaattgttttttcctttcctgaagttgagacgccatattttggaatttgcagagtaaaaattgaaaatg

SEQ ID NO: 111386 - DNA, 413 bp, Heterodera glycines
  Promoter: Source sequence=SeqID_40146; Location=1..413; Strand=+; Gene=SeqID_68569
cgaaaaattataaacgtaaacttataaaacaaatcggcaaaaaatgccgaagaaagagataattgaattttgctgacaaatgaggtaagcgaaaaaagcaatgtaaaacaatgaattttgttgcatatatttctttgttactcgctaaaaataaaatttctttcattgtattaaacaataaattttttgtcattctttattccactgcacattttagttggaaaaattaaaagaacataaaaaaaaatttcttttgcaaatttattaaaatttaaataataaattaaagttttaatttttgcacaatcaataaaatattggataatgaatgattattaataattatccataaaaccattgaggtagaattattttagctattttcctataattctcttctttttcacgcaatg

SEQ ID NO: 111387 - DNA, 1003 bp, Heterodera glycines
  Promoter: Source sequence=SeqID_10075; Location=2118..3120; Strand=+; Gene=SeqID_73139
gcaaaacgcatgattttgattatatggtctggttgccgactaaaaactgacaaaaagtgccaaattttggcaagaaattgtaaaaatttgggcataatttcaatttggacaaaatttattaaaattaaaaactctaaatatattatattacattttagaaggaaagactcaaaattaagctaacattttttattttgaaattcggtatttagctttttttcaacataaatttaccaatttttagaaatgtagaatttttttattcccgagaaaattcctcttaaaatagattttttttttttttagaaaatgcccaaatatagaaataagaactggaaaatatggatgaacagtcctaattagaaaaaactgaaactaaagctaacttttttgtgcgtccaaatacaaatgccaattttatctgtttcgttaaaatttcaaattgtgccctcacctgcacacatccgggcgcaatgccaatggcatggcttggcatttgtgccgcacctctgcccccgccgccttcgcccatcgccactgctgaacgggcgtacacttagcaaaacgggggaaggggggggggggtaattaaaatttaaaaatatctgaaattttttacgaggcccatgactctgcgaagcttttgacggattggcggaggtataaaatgcggcatttgaggcggaaattgtccgattttcgcaccctttgctcacatatttgccagccactaaaaaatgtcgatgatcgcacagaaaattatgaagtcgcaaaatgatcagttcggagcctaattccccgaaagtctttagagtccggacatgattgatcaatatatcctgttaagattttccctggcttctgaaatacggcaaggacaggatcccgactaaatcgggatttgagtcccggatatttaccgatattttttagaaaagtcaagtctttttgtatatgtttatttttcataaatcagtgattttgagtcatttttcagaaaatg

SEQ ID NO: 111388 - DNA, 92 bp, Heterodera glycines
  Promoter: Source sequence=SeqID_18128; Location=2536..2627; Strand=-; Gene=SeqID_82710
ggaagaagaattgttgaccaaatcagaaacaaatgtttctaatgcaaaagatataacgcaaaaccatatcagcaaccaaaaatgccgcaatg

SEQ ID NO: 111389 - DNA, 65 bp, Heterodera glycines
  Promoter: Source sequence=SeqID_7545; Location=954..1018; Strand=+; Gene=SeqID_65171
tcttaattcgattttaatgatattttcaaattatcatttttattatttaaaattcaccgaaaatg

SEQ ID NO: 111390 - DNA, 571 bp, Heterodera glycines
  Promoter: Source sequence=SeqID_1838; Location=3702..4272; Strand=+; Gene=SeqID_76281
aagaagacaactgccgtcgatgtgtctgtctgtcgtcgttcgcctttgtttctcttgcgtctctgctcaacatttctcactctttcgctagtgcctttgccttctctctcatttcctctccatcttttctcatccacatttactgcactcttttcacacaatgtttcctttctctatctctgctcccccattttgttgcattaggctcaaccaaaccaaagataaagcattcgaaagtgcttaaaagcgcaaaggctgatttggcgaatccaatttgagtgattgttaatatttcacatatttgactcatttttgatgttttgcccagtagatgatattgacctctcaaaataaacaaaaattgaatttatattgacaaatatggttggattgtgttcacaacagttggagggaccttcaaattgagaaaggagtggaaagaaatccgtttttgccccaattcttttatgatttttatattgtgagctgtcttacctatcttctcgctgtctgcactctcacataaatataaacgcttttttaagaattaaagcattttaattgttcaatg

SEQ ID NO: 111391 - DNA, 646 bp, Heterodera glycines
  misc_feature (69)..(69): n is a, c, g, or t
  Promoter: Source sequence=SeqID_13461; Location=1..646; Strand=+; Gene=SeqID_77352
aaaaagaatgttataaaaaatattttcacccattaaagcttctgtgagatttgcttaaaaaaatacagnctctaatcaaccttttaccatacctaagacttgtcttcagggcaaagagaaaaaaacataaaaaattaattgctaattattaaatgatatttagtcgttgaatctcaatagagaaaaaccaaaaagtagaataattttatattataaacaccagataaaaaaccagaaaataataattgtcttttgtttaactttcactaataattttccaaaagtttattatgaaaaataaatctttcaaagacgaaaataacgaaactttgcatataaattatgggattataaatataaacatgagctttagaaaaataaataattaaaaaactagaaaacgaaatcatagacataaattaacagtaataaatatgggacaaaacaaataaaaataaactaataaaagtttatatatggaatacacatttttcccagattttattgagtaataaagtatgaatattgaaaaaacaacaaatttaaaataatattgtaaaactaaaataaacaaagagaaaaaccattattacacgcataatctaaaggttgcaagtttttttctaataaaaccttaataaacatg

SEQ ID NO: 111392 - DNA, 51 bp, Heterodera glycines
  Promoter: Source sequence=SeqID_1201; Location=2078..2128; Strand=-; Gene=SeqID_46682
ggtgaggaaaaccagcggtctcacaatttttattctttttctttcagtatg

SEQ ID NO: 111393 - DNA, 1003 bp, Heterodera glycines
  Promoter: Source sequence=SeqID_195; Location=1302..2304; Strand=-; Gene=SeqID_77171
tttatatttcggtataaaaaaatttattatcaaaatggatggcaaaatgagtaaaacataaaaaagcgtgaggttttaattaatttaacctatacaaaaataaatgaatttacctaattggaaaaattttatgtgtgattaagacaaatttagaaatgaaaattttctatgatgcaaaagaatgacaatttacacacagtgagtgattggttggccaacaaatccctgttcaaaaatccgaattttcccggtactttttttgtcgcttttcctcgctgtctgtcaccgcgcactgtacaaagtttttagaggagtactgtaggcgagacagtactccatgtacctccgccgctcataaaaataccttaaaatataatttctttccttgtgtatcttataggaatttatttaaaaggtgttgcgagaattccataaaaatttttcctcgaaaaaatttttaataaaaaatgttattcttaaaaagttcgttagaattcccaaaaattttcgccggaggtgcaaattggcttaaattttttaaacttggcctgaaaaatgtacaaatgatgatttcttggtgagctatgaatttaaaaattttcctatcaaaactatcccttcatgttgtgaaaaagcgccagaaaaactaagtgaaaccaaagagcaaaaaaatccatcgaagctaagaatctggcgacgtctttggtttttttgcgcggcgccaaaataaaaaaagaggtgccaaccagggctgcacgcaattgcggattgcggattgcggattacggaaattgcggggtttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatg

SEQ ID NO: 111394 - DNA, 186 bp, Heterodera glycines; identical to SEQ ID NO: 109872
  Promoter: Source sequence=SeqID_44493; Location=642..827; Strand=-; Gene=SeqID_71977

SEQ ID NO: 111395 - DNA, 351 bp, Heterodera glycines
  Promoter: Source sequence=SeqID_11979; Location=675..1025; Strand=-; Gene=SeqID_75495
tatttgtcaaactaaaaatgtgtcgtgtgttataaaatgagtattaaaaaaacatttggtattaaacagccgttattgatttctccaaagtttgtgacacatttcattttaaaattgattttgttcgtgacatatttctcgcaattaaaatgatggattctgtcaagcgcaaattttaaattgtctaccaatcattgtatcaataattattagttcattaaacgatgattacttttcgtgcgtcatgaaaagaaatgcgggagtttcaaaagcgttaacttcggtattaaaaacagttgttgattttaaaacttaaaataaaataacgattctttttgacccttaattatg

SEQ ID NO: 111396 - DNA, 1003 bp, Heterodera glycines
  Promoter: Source sequence=SeqID_2552; Location=512..1514; Strand=-; Gene=SeqID_80375
cggaacgttcgctgcttgcggagtgtttgagcctttgtttaagacggtttcttaagcggcggttaaatctgacaaacagccgcgggcggaagtttggaaagagcaggtgatgccaaaggcatcgaggaacctgctgtgtcaaatgctgggctaactcatgggctaagaggcgaatggcaagggaaggacaacggtacaatacttgaaaaaatcgaatttttatttcatgcttaccccgcggcacccggcacggtccaccaaaaaaataaatgcccaaaataatgttaaatccataaaatgtacgcctctctaatcgggcgattatgcttaattagcgaaattgaagagacactaattaaccaatgacaaatggacattagtgtatgacaaggctcccttccattgaccatactgaatttcaaagtacgggtaagccgttttgcaagtaaatatcttaattttcaattccaagtacacatcggagtttttattttatacaaataaattatcggcatggaatttattcgacattttctttttttggtgcgaataaggtgggcggggggggggagagcggcaatgtcatcattcgctgccgagaattttgagttttttgatgattttttttgacagataatagcccaaaaataccgaattttatttctgaaggcacacgcggactctgtaattaaggccgaatttggcactcaattaattccacccttcccctgccccaacatttcgttatcattccagaaaatgcagtgaaagtaacaaatttaaatttataaaagaaataaactcgaaacggaaattccaagaaattatgccctgtattaagcttaaagcaattttacaggaaactgtggcaaaactcaaaagcttagtaaaatattgcaaatattgcatcatttcaaatatataataaaagcttcaaaaaaaattattatttataaaaaaaaattcccattaaaaattctgaacataaataaacttttaaatg

SEQ ID NO: 111397 - DNA, 242 bp, Heterodera glycines
  Promoter: Source sequence=SeqID_440; Location=291..532; Strand=-; Gene=SeqID_52868
ttttggtattaaaaaattggctaaaaaccctaaaatttggtcattttttgaataaaatctgtgaacaaattgcattaaaaactacaaaattttcccaacagcgcctatcggcgccgtctgaccctcactgtcctccaaaagttttttttggaagaaagagccgaaaaagcggttggaaaataaaaaaatggtcgttgccaattggctcaaaatcccaaaaatcggcctttgggttcaaaatg

SEQ ID NO: 111398 - DNA, 137 bp, Heterodera glycines
  Promoter: Source sequence=SeqID_1809; Location=1..137; Strand=+; Gene= SeqID_76101
acaaagcatttgatcgtgcctatcaaatccggatttgtcttgtcccttgaaatggcacgccgaccgggggatgtgcttcgatgagtttgtcgcattggctgcccgtgcggagtcaattcaaaaggcaacaaacaatg

SEQ ID NO: 111399 - DNA, 729 bp, Heterodera glycines
  Promoter: Source sequence=SeqID_24663; Location=819..1547; Strand=-; Gene=SeqID_55401
ttttacaatgcgttttaatatgacaagtttggaaaattgtaatcgaaattaatagtttttgcaaatgctattctataattgtttcaataatggtattcttttttacattttcctaatttttcacgacttttttacatttttttcgagatttttgatgttttttatgactttttcgtgattggcgatttttattcccagccctactaataaataaaaatttacaaatttaaaaagtttttcggaaaaataaatttattatttttattattttttttaattgcttaacattacctttacattattgccatgtaaaatgccctttttggccaaaaaataaaatcgaaaatttgctatatttatcatttttaaaaaataatttcattcccacctgctattaacatttgctttacatcattgccatgaaaatgcccttttattaaaaaaaaatcgaaattcactatattttattttttctgcatttatttctagcaatagaaatagtaataattcacagaaatagtaataattcatctttattttatggaaataatgcttaaataatattttccaatcaatgaatgatcagctaattacgtcaataagaggatttcttcacatcattaagtagaaaattctgcataaaaggctatcactgctcaattaattcactcagaaattttcttttatcataatttaaaataataattttgtttttacctttagaaaatg

SEQ ID NO: 111400 - DNA, 1003 bp, Heterodera glycines
  Promoter: Source sequence=SeqID_15488; Location=1116..2118; Strand=+; Gene=SeqID_79761
ctatcggcaccgtcgtactctctactcaacaaaattgttgtaaaaaatgtgccaggaaatagaactcatcaaaagtaaggaatttaattgaaataaaattttcaattattttaattttatttcattaacacccaaaaaatcattaaagataaagacgcaataatttaatttaaaagatacacacctttctgttaaagatataattttatctaatatttttattgaatatcttatatgttaaaatggtaaaaaaatttagttcataaaaaacatatttgattatttacttttgcataaaaaggcaaaaataaaattaaaaaatgagtttgcatgtcagggatccgaacctgtgggcttaaaaaacgaggactagctcactaccgctgcgccattagagacctgatgaaggcgcaaataaattttaatttatttattcactaaaaaactttggcacgtcataactcggcactcgagttcattccgcaaaaaataaaatcacttttcttaagaacctgtgggtgctctatccacccaccaaattttattcggaaatcaaacggacacctggggaccttcctttttttagccgagcttcgcccagccctggtgccgataggtgcagccgggatatgcaataatactgattgcaaattacaattttggaaaaaattacctaatatgtactttttattgggatttttgttttaatagaaaataaaaattatccttttggtcgttgcctttttttggatttttgaggttttttgaaattttctatcaaaatttctaaaaactaataagattagtcaaaacttattaaacatttttgttttaaacaatttatatccgagccataaattttaacttctttaaaatgttttattgttgaacatgaaaaaacaacgcgagggtttttctctaatcaataaattcttaaaaatttatattaatttcaaataaatattttattctctattttagctttacatttattttcgtaatg

SEQ ID NO: 111401 - DNA, 1003 bp, Heterodera glycines
  Promoter: Source sequence=SeqID_17383; Location=220..1222; Strand=+; Gene=SeqID_81869
tacaatttaaatatgacccgtcctaacaatagacaacaaacaccacactaattcaaacacggacatatacaaacacaaaactttaatatgtgatgacaaaaataaaattcaattgttattttatcaattttatcagagtttgattcttttctataaaatttgacttatgcagcttatttttaattttaaatttgtgttttttctattttattattttaaactattcctttttatttttttaattcttatgctaaatattttatatagaatcacataattctttaaaacttgtttacccatgttttctagcttccataatcggtggatgtaattgtgtacgcagattattatttttaaatttgttaagttaatctttgaacttaattaacttcagataataaacaattaattgttttctatttcaccaaattccaaattctattaggatttatataagttctgagagaattttaatagatttttacaaagggtgtgtttctggcatttagcatatttccaattgtcttaatattttttataatttaacccaattaatttaccaaatttaatctgaacttttagaatttcttaaaatttttttgtaatttgcattttggtctcaattaaaatatttaaatgaaaatgttgcgttttattatttttgatcaaataaggcgaaattattgttcagcatatttcttcatttttatatctttatatcttatattatttttgacctaacattgaggattatttttattcattttaaaacaaaaatatatatgtgacgataaaaattgaattcgtaaatgttttttttatttaacattatgagacggtccaatcctcttttattaactaaaaaaaattttttttatgcatattgaaaaatttatattattcgcaaaattgtcaaaaaacttctagaggaattacaaggtttcatgaaagattactgatcctcaaaataaataaagctaaggaaacaataaagaaaataatg

SEQ ID NO: 111402 - DNA, 232 bp, Heterodera glycines
  Promoter: Source sequence=SeqID_13661; Location=2740..2971; Strand=-; Gene=SeqID_77570
tggtggtgatctggaaatttgattctccgcacttcgccgacaattctctccgatctcaacattatttcaatccattccgctgatttgttgcccgatttgattgctgatgatgagccaaattcaactgctggccaagcgctgtcaaaatggttgcaaattccggcaaaagatggacagccaaagcaattgagttgttgtgctgctacgtcaagaaccactaaatttgtcaatg

SEQ ID NO: 111403 - DNA, 1003 bp, Heterodera glycines
  Promoter: Source sequence=SeqID_3114; Location=2139..3141; Strand=+; Gene=SeqID_83266
ctttttgagaaataaaaagtcaacatattatgctgaaatgactaaataataatgggtaataaaatatatttttactattaatcgaaaataaataaataaatatttatatttaaatataaataattatattaatataatgcatgatatatgaatattttattactacgtgtaaaataatttggcatattttaaaagacattaaataagaattttattttaattatttacctgtaagaaaaaaaacaaatttgtggatgtctttgaggaatagaaaaaattttaaacaatttttaaattaccgttaccgatatagacatttattaatttattgaaaaaaacctattattataaattctataaaattttcatcacagtcgtaatttcattaattttttaaattaaatatcaggcgagaaactgacagtcaaagcagcaacgaatcgccaagccggccttcgtcgagtagaaaaatgtttgtttttgagatgcccaattattatacgctattttttttaaatgcacaggtccaaattgccgtaccgttcttcgacacgccaaaaaaagtatgtttgttgtttccccagcaaaatattaataaggctgtgcaccgggtcttagtttggctaaaacaatatggaaaaattcaatctaatattttttccttcattcacctaaattaaatattcttggcatctttgacagctataaaaatgctttattagtcacaaagtttaacaaaattcacttattcccaaaaaggtttgaaaaagcgaatttaattttggttaataatttgcatgtggttttttttaattcgtgggttttgaataagaatccatcgctagagatgtggcctaaaattttcggattttatttattttttcattttatgtttcttttgttccattccactttctaaatttttgaagaacagcttaaaattttaattaaaaacaaaaatttccattgaaacattagcaaagtgccgagcaatgccaacatg

SEQ ID NO: 111404 - DNA, 728 bp, Heterodera glycines
  Promoter: Source sequence=SeqID_19684; Location=1..728; Strand=+; Gene=SeqID_84424
tcttacacacaccatcccagaaatgagctcctgtgccagaaaagatttgcatgtgtggctcagtggttttttaagatagtaaagggacaaagggtggtggttcgagtccgttgtgcaacatgaatattttcatttatttatgtccaaaatattaaaaaatgacgatttttgggaattgtttttgaagctttttcccaaccaaattggacaatcttggtatcattcgaaagctcttgatggggagaagctttttctaagcaaatgctaagcaatttgatgagttagaaaaaagatatgatgctttgaaattttgttttttgaataaattctcgaatcgacctattttcaaattaacctgacctatcattagatgcagaatatttttctctatcgatatgcaaaattaaaagaaattctgcctgaggaaaaaaaagttatgctgttcgaagtaaatgttgcttttcctaataataaaaatattagatagtacgccaaaaggagacaaaaaattagagaaaaaaagataatgtttttctctggcattctctatttattggtacacatctcgttttttgggatggtgtgtacagaggtcccagtggcctaaaacgcacgaaaaattgttttttggtggttgttaagctactttttgatagagatcggctacgggtcggacccgtatacggacttttacgggtccgtagtccgtattttttcggaccaatatg

SEQ ID NO: 111405 - DNA, 293 bp, Heterodera glycines
  Promoter: Source sequence=SeqID_28647; Location=688..980; Strand=-; Gene=SeqID_59241
tcttttttttgttcttggatttttttaaacttacctcccccccctccccgccccctccaataattttccttaatttcctcaatttaaagtaacattttatagtaaaaatggcattatataatttcatttttgcttttcttgcacattgtgagaattttgcacaaatttttcaactaaaaactggaaacccagtgcacttaaatttgttttgtaaatcggaaatgagaaaatctatgacttttttctttttagtttacatatacctccgaatagtcaaaaaaatttcaaggatg

SEQ ID NO: 111406 - DNA, 64 bp, Heterodera glycines
  Promoter: Source sequence=SeqID_34345; Location=1394..1457; Strand=-; Gene=SeqID_64172
ataatcaatgtgcatttatgtttcattaaatcattcaatttatttaatttaagaaaacataatg

SEQ ID NO: 111407 - DNA, 317 bp, Heterodera glycines
  misc_feature (48)..(48): n is a, c, g, or t
  Promoter: Source sequence=SeqID_38313; Location=699..1015; Strand=-; Gene=SeqID_67166
agcaggatacgtagaaataataagtattattgtatgagagtaggagancctgtgtaggcagtcagtatcgtatcgtaaatctcgtctactgtattcaaaagtcaaccagtggcacagttaaatgaaagtcattcattacgtatgagaccataaaatttaaatgccacatcacagatacgcacgctgttttgcaacttcgaaatgccggaggataaagtatactattattactgtaacatgcattcattacagtaccactcactatttgtccccagattcttaagtggatgatcatccaatttgccgggtaaattatg

SEQ ID NO: 111408 - DNA, 106 bp, Heterodera glycines
  Promoter: Source sequence=SeqID_103; Location=5765..5870; Strand=-; Gene=SeqID_69066
aggtggtcgtggagcgttcaacacatacgcaagtcgtcaataccaacatgggactcaggccgttcatttgcttacaagagccggtgtttctgttgacaaacacatg

SEQ ID NO: 111409 - DNA, 224 bp, Heterodera glycines
  Promoter: Source sequence=SeqID_29405; Location=1023..1246; Strand=+; Gene=SeqID_59909
ttttaagagttggattccgattccccaaaattgaggcttcgaaactttctgactctgatatgtgccatcttcgttattgtccgtttgtccgcctttcccccctcctctttttgtccgttctcacattctccgtccgttcacttcgaattctgcaaattgtgcccggtttcaccaattcccatgtgctgttcaattatcggttggcccaaacgctggcggacatg

SEQ ID NO: 111410 - DNA, 1001 bp, Heterodera glycines
  Promoter: Source sequence=SeqID_1120; Location=1..1001; Strand=+; Gene=SeqID_68144
ggtcttgaataatccctaaaacttgtaataaatagaccaaattaatactgccaaatatttgaggctttattgaaaataatttataattggggttatgcatgcaattttgatggcacaatgtttaagaaatgctgagaaatgcaaaagaactgtatgttctacttataaaaaggttggcatctgtccatttacttttgaaattataattataattttaaaaataaattaaaatgtgaaattattttaagaaattcttattttctttccttttttttgattggaaaacaaatatgttaatcctaaattgtgtatctttttacggatgaaatgcgtgttttttgggcaattaaatgctagaattgcgaatgatcatttttttagggtaagctgacaattaatccgccatttcatctctcgtcaccaaaaagcgtgagttttttttgctgaaaaacagacatataatccgtcaaattgcgattttacttaaaaaaaatattttaaaaataaattaaaagtgaaagcattttaagatattcttattttctttacactcataaaaaactaaacttttttggctggaaaacaaatatcttaatcctaaattgtgtatcttttagcggaagaaatgtggtttttttttgggggcaatcaaatgttagaattgcgaatgatcattttttagggtaagctgacaattaatccaccatttcatcgctccccacaaaaaaagcgggagttttttttgctgaaaaaacagacatataatccgtcaaattgcgattttccttaaattcaactgaaaaaacgtctggcttttttgggcagatttggcgaccaggcacataaatggggctatttaaaggtatccaattcaagttgaaatcatttaacaaatgagggctaatcgacctgaaaaaaaagcggaaattcgtcgctgcgcctcctcaccccaaattggcgcagcaattcctgaaagggctgaacgtctttttaacagaatg

SEQ ID NO: 111411 - DNA, 451 bp, Heterodera glycines
  misc_feature (53)..(53): n is a, c, g, or t
  Promoter: Source sequence=SeqID_25647; Location=576..1026; Strand=-; Gene=SeqID_56398
atgttatcaatatgattaactcgtttttaagacacgcttgttgtattttggcncagttcgttccgctcaaatgggccgagtaccgtagtgtcgtggtgtgtgcgtttccacaatgtccatggcctggttactgtatgcaatggtgcactttgactcgctctttgccgattacattctttacattgtgctttatatgttttacaatacgctcaatgccatttccaggtcactatggcgccaaaaattttcggcaatttgaaattcgatgattcaaaaaatttcggaaattctacccccaaaaatgccgggcaatcctataaataaaaaacccgcatcttttattgactatattttaggttattttgaacaaaattaaaaaaatcttaggtggattattaccaaattctaaaagaattaagccgggagattgagttttaaacaattaaaaatg

SEQ ID NO: 111412 - DNA, 902 bp, Heterodera glycines
  Promoter: Source sequence=SeqID_5555; Location=2117..3018; Strand=+; Gene=SeqID_58447
atggaaatgatgtcattttgtccgcaattttctttttattcatttgtttccatttattacgtatttatcaataatggttttctactcgcttctccacccccataagcataagtgtgcctcggcattttacgtaattccgacatgcttcttcttttttacatattggtcaaaccgttaatttcaatttcttgttttgtgatgtgtttttgtctgaatttgtccgtaatatttgcgaattcaatgcgtgtgttagacacggtgtgtcatcgctctctgtcatttttagtgcgcctttaaggcaacaacaaataatcgatagtcttctgtttctcttctgtgctttgtgttggttctattaggtcattttctgtctgctctgctctgacccctcctcctttgttcagaatctgtccgccctcactcattcattcacttcatttgttagtcattcattcatttatccgtccaatttttctcatttcttttctgcaaatttctttcgaactgttgaagcaaaaaccacatcaagcaatgatttgagaattcgttctaaatccgaaaatatattgttttttcgaatcactcactttcaatgatcccttcatattaaatatctaacgaatactttttgcgactgttttacgattgtgtcatgccaactcgtacaattgcttaggccgaatctttggctacgtctaggcttggtcttgcttcggcctaggcttaagcttaggctttgttttgtaaaaatacgagttgacttttgacccgaatagtaataacattcattgttctaaatcaacatttttttgttaactttgttctgctggtcgatctgattttttcactttagccatcactatttttaatacactttaaacatcaccaatttgttccaaatg

SEQ ID NO: 111413 - DNA, 55 bp, Heterodera glycines
  Promoter: Source sequence=SeqID_22115; Location=187..241; Strand=+; Gene=SeqID_52766
ggttgggcaaaggccctttcgtccgccacccttttgatcatttccccaaggaatg

SEQ ID NO: 111414 - DNA, 589 bp, Heterodera glycines
  Promoter: Source sequence=SeqID_11349; Location=1223..1811; Strand=-; Gene=SeqID_74735
tctaatcaaaaaaaaaaatttcaaaaaatgtattacgcatttttcaaattaattttaaatgataaaaaggcgttacgaaattaaaaatttaatttttttttgttacttaattacaatttttaattttttggaacaaaaagatgaaaaaatcatttaacaaccttagtggtaaacaaaaatttttttattagttttttagactgtaacattcatagttaatttcaaaaaattccaacattgatcaaatcttgatgacaatgaaaataattctgaaaaatacgctttttttattttttgagcaaaagtcttttttttgtaaaatttcagctcaattagacaattattttaaatggctttaaaatgtacacctcgtattttttatttttaattcaatgtttttttttataaaaaaaaacatttttaattgaaaacgaacttttattaaatttcgtaaattattttttgaaaaaaaatattaaagaaatttgcctgcagacggccttgcctgacggtgggaccgtcaattagccgtaattctggcaatttgctatcgtacaccagctgctcttggtacggtagcatttgaatg

SEQ ID NO: 111415 - DNA, 452 bp, Heterodera glycines
  Promoter: Source sequence=SeqID_21329; Location=315..766; Strand=+; Gene=SeqID_51925
ttacacttaaaaataaatgtttaaatgtgactctcaaaaaaaaaaaattgttccccgggatttttcgggctcactgatcagtgatcacgaatttagggaaaggaatcaattgatgttagagaaaatccagaaaaataggtaagtcaatcttaaagagtggcaccgaaatttcctataccatcgggactgaaatggcagactgaaaaataataataataaaaatctggtggcgaattactgaaatgtgactttagaggttttttacgaatttttttgttgacttttcaactccaaacaaatttgaataattttccgatggaccaatgtctaaccctaggctttttagccatattatatgggaaattgttgggcttttttacgacatcgttctgataatgacgacttcactcgacttgagaacttagccaacgaactggggagggcgccgaatg

SEQ ID NO: 111416 - DNA, 517 bp, Heterodera glycines
  Promoter: Source sequence=SeqID_32411; Location=1..517; Strand=+; Gene=SeqID_62715
gtctctcccccttcattctctcccctcctctctagccatctctcccccccttttccccccaattccccgcccccggggggttaagatgaaatggtcgagaatgactgagcaaattgtgcatgcattttttggccgtttgattgtttatttttgtttgttattttctgttgtcgttgcgttgccctttccctttttgggagagaaaacgcgcaaagggaccaaacaccgaagaaaaggccccccagggcagaaaagttaattgccaaatcgctctcccatgcccccccccctccccccattttcgcattccctgcgcattttccaattttatttggtctcgtcccaatcgatttgattccccaacattttgccatgacaaataaataaataaaataatcaaacaataatttggcattggacacaaaaatattaggctaataggattatcataaaataatataataattttcattagtccaatagattaaacacaaaactctctcttccgttttcaatg

SEQ ID NO: 111417 - DNA, 111 bp, Heterodera glycines
  Promoter: Source sequence=SeqID_582; Location=4393..4503; Strand=+; Gene=SeqID_56670
ttggccgacgcgccggtgcgaaatgaatttgccctcgctgttcgaggtgttcggcaacaacatttggatgcgccgcaaaattttcttccgaaaagaaatgctgttgaaatg

SEQ ID NO: 111418 - DNA, 401 bp, Heterodera glycines
  Promoter: Source sequence=SeqID_26640; Location=1..401; Strand=+; Gene=SeqID_57394
attttcaaacctagaaatttttataaaaaaaattcttaggaactttcttagtacgaaaattccaagaaaaaaatttttgagaaatttttcaaggattttttagaaaattttgaaaaaacttagtagttcattataaaatttctaaaaaatcgctgaaaaatatctcaaaaaatttttttccttgattcgaactaagtaagttcctacgaattttttttataaaaaatttctaggtttgaaaattttttttttaaaaaatgtttcggggggggggggaaatgaagtccacccatgatagggatatcattcaattttgttttaaaatatttatatttgcccctcttcagaaggccgctgccgtactttggcgtcgttttgccgacgacgacggcaccggaatg

SEQ ID NO: 111419 - DNA, 622 bp, Heterodera glycines
  Promoter: Source sequence=SeqID_27927; Location=1257..1878; Strand=-; Gene=SeqID_58591
ttatttcattttctactgatttggtgatgatttgttttattctttggcattctgttttgtattttattctatgatttgtgaagaatatttcagagtatcaaaaactgtattatttagaaaaatttttattttcaaaaatagttttattattatttttttcttataatattttcttatctcttttttctttcttttatttctatcacagagaatacaatgattggaaattctttgtggtaaaataaattttgaatttaatgcaattgaaaataaaaaagttttcagatcacaaaatcatcgttaatttgatcatttgacaaaattacccaataaaatatgtacatagtttgttttttttctgtccttgttttgtattttatatttttctgcctttttaaggcgagttaacggagaatgattttgccattaattttattcattcaccattttcgtaaaatgaatttcaataaaaataaattttatttaaaaaaaaataattattttattctttttcataaaaatggttttaataaaatttattttattttcaattaactaattattttttttaatttaggaaattactttattttaccacagaaaaaaagcaaacaaagaaatg

SEQ ID NO: 111420 - DNA, 316 bp, Heterodera glycines
  Promoter: Source sequence=SeqID_6086; Location=4536..4851; Strand=-; Gene=SeqID_60268
taataaaagtcaacgtagaagcttcaaaccaagtggaaaatgtgttatttatatttataatatgtcgaaactagtgcgcaaaaaaggcatatgccgcaaaatccggtcttctctagttatcagggaatgaaaaaatgtaagtttaaatccgattttggacttaggtgcaaatgtccgaggcgtatacactttggagggcatctgtctgctgcatggcgttagtgtcagataactccctttttattttacagaaaatttccactttttatgtgcattgtcaaaattttcaccaacactgtttgaagtgttcaaaatg

SEQ ID NO: 111421 - DNA, 78 bp, Heterodera glycines
  Promoter: Source sequence=SeqID_44154; Location=1333..1410; Strand=-; Gene=SeqID_71681
ccattaattcagtcatcccgctcaccgctgctcggcgaggcgctcgtggtcggcttccaatttttgcgtgaccaaatg

SEQ ID NO: 111422 - DNA, 96 bp, Heterodera glycines; identical to SEQ ID NO: 100709
  Promoter: Source sequence=SeqID_24913; Location=1032..1127; Strand=+; Gene=SeqID_55659

SEQ ID NO: 111423 - DNA, 173 bp, Heterodera glycines
  Promoter: Source sequence=SeqID_10283; Location=869..1041; Strand=-; Gene=SeqID_73449
aagaataattatgtttaatttgctttttatgtgtaacatacagagaaagctaaaacaacaagcaaatagcgttttctttatttgctcatttgtcagcaaaacatcccacaatatatatcaaattgtttattgcttttcgattctttttagaataaatttttcgtttgaaaatg

SEQ ID NO: 111424 - DNA, 105 bp, Heterodera glycines
  Promoter: Source sequence=SeqID_5241; Location=1407..1511; Strand=-; Gene=SeqID_57413
ttttttatgatggacggaacccacccttgcgtatgttcagttcgtaaatttcaatcttatccacatattacagtaacaggcagtatattatcaccctcaaaaatg

SEQ ID NO: 111425 - DNA, 396 bp, Heterodera glycines
  Promoter: Source sequence=SeqID_3569; Location=1113..1508; Strand=-; Gene=SeqID_50902
aaccgagatggcacaccacgatataaggacgatctcattttgaagaatttatacttgttgatcaaatgacaaactctttctttgtaattttgccgagcaatacgccaggctttgttggaaataaaacaaacaaattcaaagtgcacttgccaaagaagttggtgtttgatggggccgggtggatggttggactgtcaggcataatttacccaaacaggtgggcaaaaatcatggctattgggtccgatttttggcttaagttgggcaaagctgggtacatcagaccgacaatatgtgattgttcacctgcacgacggccgaaaataccgtttccgtgtgccaaagggaagttttctctcgccacagcagcttgagaggggcattcatcatggcatg

SEQ ID NO: 111426 - DNA, 1003 bp, Heterodera glycines
  Promoter: Source sequence=SeqID_24068; Location=912..1914; Strand=-; Gene=SeqID_54766
ttaacgcagaaatgcgttttttgagctcctttcttcaaaacaattgagcaaaaaaaaaagttttttcactagaaatcggttccctagttataagttacatattttttctgcgcacatgcaaagaatttttgtgtttttagtccatattttggccatttttggcaaattatcacaagaaactgcaaaaaaagtgaaaaatacatccctaaaactgggtatttttggaaatttttttaaaatacacctctaaaaaagaatttttccgaaatttctgaatttttttttatgtattttgtccatccgaaaattttcgcggagatattatttattataaacatttttagatgcatttgttttgcaattgtgaagctaaatttaataaaaattggcattttttaaatgttaatccattttttggcagtttttcgcgtattttaagtctattttagcaaatattgaatataaatatatttttggaattttatggtttaaaatatttattttgtcagtttttagtccatatttgaccatttttagctttttagcatttggctaagtgttttgtatttaaatttgaatttgaagagaaaaaaagcaaatgaaaactaccaaaactttttcaacgatatatgtatactaggaattaatcattcatcgaatgtagctcaatttttataatgctgaaaagtttcaaggatctaatttttctgggtttgggatttactggccaaacggcctctcaaatgccaaccattttaaatttaaataaaattcagtttccataaaacaatggaaggaggctttttgaggtttttttccaaaaaagcagttggtatcactgggttttttatgcaaaattttcatactcctaagaaaattgcagactcaaaggagtcccctacagaaatttttctaatgttaaggtataattgaaaatttataaccattacaacaaaatgtgttctttttaattaattgcattcgattttttaagttgagaatg

SEQ ID NO: 111427 - DNA, 135 bp, Heterodera glycines
  Promoter: Source sequence=SeqID_1331; Location=2377..2511; Strand=+; Gene=SeqID_72723
agtgaaccaaaaccttttactctgctttcgattttggaaaaacaaccaaaaaaaaagtctgacgataaattggaaaaagaaaaaggcaaaaacctcattattataaattataaaattaggtttccttcagaaatg

SEQ ID NO: 111428 - DNA, 702 bp, Heterodera glycines
  Promoter: Source sequence=SeqID_349; Location=8735..9436; Strand=-; Gene=SeqID_83727
attatgactcatcttttcttttctccatattttcgctatgagtcatcatttttgagggaattttttccctttgcttgtgtgcatttcttcacgtgcctggccccgcccccatcgattgtgagggtataaaagcccggcccattctccattttcttcactctgatcaatttttgattaagtcacccggacagttttctgtccaagcaatttgcattaaattgtaattgtgtaaattgaataaagattaagaaagagtcttagtcttttctctatctgtaaaagggacgctcaggagccctttcatacagatcattaagccattgacccccgttgggtcaaagaaaaggcttacaaaaggaaaggagaagcattttcctcctttcaaattgtcccttcagtaaaggagaggaatttcctcctttaatttgtccctttggacattcagtgaatttctgtcttttggacagaaattcgctttgcttaaaagactccccccttctgccgggagagtctgcttccccttctgccgggaagtgcaaatttttgtggccttttgcccacaaaattggagccccgtaggggtcggcttccagtcgtaagcctaccctccaaccaaaccaatccaaagcgcggccttagcgcttggatcaaacgcacaacccaaaggggtttattgcgttttcatcaagcgtaagagcaatg

SEQ ID NO: 111429 - DNA, 714 bp, Heterodera glycines
  Promoter: Source sequence=SeqID_8431; Location=875..1588; Strand=-; Gene=SeqID_68046
gtttcaattgcatgattttgaattaagacgtgggattgaatttctcaaaacatattaaattcattttcccacggtgataactagggatgcgatttttaggcacaaaaaatcgcgaaataggcacctaaaaaggcagaaaaaaatcgcaaaataggcactaaataggcacaaaaaagcccgaataggcacaaaaataggcaaataaaattttttataacgctttttaggtaacaaaacacgttaaaactttaaatatttcaattgtaaatgaaattattaaatgttttaaagtttttttcgaatatgaacaaattaaaccaaaaaatttttattaagaaaaaaatattaaatttagggaaaatttttttgaaaaattttacaattcttagcggtgtattttctgaaattttttttgggtcatttcttaggggtgtattttttgtttttattgcatttttgttaaggattttttcaaaaaccctaaaataggcactttaggcacaaaaaccccgaaataggcaaaaataggcattataaatgtcatcgtagacaccccaaaccatgcggaaagggcttttttcgtgcttatctgtgcgtattaagtgcgcaaaaattttaggcatttgcctaaaaatcgcatccctaataataacatcaattatttaataatttttgaaattttcttatacataaatatgatttatttcagggatg

SEQ ID NO: 111430 - DNA, 839 bp, Heterodera glycines
  Promoter: Source sequence=SeqID_20702; Location=1..839; Strand=+; Gene=SeqID_51260
ccccgagaaattttttttttgaaaatttctgtttgcaatttttttttttaattttggagatggggcgaaacggggcaactgattggaactgatacggggagatctaccgtctgtaaaacttttatgtgacgggctttttccgcctttgttgaatttccactttcaaccccccccccccgccagcttatccattcattaaaaatccggtttcaatttacaaacacatccctccttcattccctcccccattcaattaatccgccgtcatccgcctcaatcctggaaaatcaatccgcaaatgatttctctctgtgtctatgccctcttctagcgccggaggcggcacgaattagtcatcaccggtcggatcggcgccggacggcgccgctggatttgtgaaaattttcatttctaaaatagggttagaccccaatttcccccgggttttttttggcatttttcggggaattccccgacccgacatgtccccgacagtagcttccctaaaaatttccatccccccgatttcgggatgtgtaaatttttaaattactcataatttagggaggcccatgggtttaaattctctcccaccattaaaaaaaatcaaattttcaaaaattaaataaaaattttcttcgtctcttctaattggcacattcagcctgtattttgtacaagaaattttgagaaaaatacgctgaaaattgactttgattagcatttttttcttgaaaataaaaatcacaaaaaaactaaaccaaaaaatcaataaaaaaatttttaacatttaattaaaaattcaggctatttattatcaggcatttgtctaaataatg

SEQ ID NO: 111431 - DNA, 125 bp, Heterodera glycines
  Promoter: Source sequence=SeqID_31688; Location=628..752; Strand=+; Gene=SeqID_61996
ttttggcattttgatttcaaatttggaaaaagaaaaattttaaaaagcaattttatttcgactttgctccattattcccttaaaatcaaaaaagcatttaatgccaaacaacaacaggagaaatg

SEQ ID NO: 111432 - DNA, 552 bp, Heterodera glycines
  Promoter: Source sequence=SeqID_30753; Location=1..552; Strand=+; Gene=SeqID_61148
aaaatttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaaataatttaaagaaattatttaaaaaattctgtaccgttggggaattgaacccacgagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatccttaggggtgtattatcaactctcgcctctcgtcccaaaaaacgagaggcgagagacgagaggcgagagtaccaaaaatggcgagagttggcgagaggcgagagacgagaggcgagagttgtcccacccctggtgcgcagctgcattacttgccaattgcgtcattccccaacacctgcatattgagctgaaatg

SEQ ID NO: 111433 - DNA, 475 bp, Heterodera glycines
  Promoter: Source sequence=SeqID_7700; Location=3368..3842; Strand=-; Gene=SeqID_46464
cttagaaaaagcttctaagcatattaaactttcgaatgatttaactatattggatttggttggcaaagaaaaaagttatagtcaaaaaatcggctggggccgaaccatacggggccgaactgaggtagaccggtaattttggttctaatacacaacgtccatttcaaattgtaaaagaaaaacaggaaattccggttttcaactctgtataatcctatcactatgtagaccatttaacaaaaatttttatttggtccattttctctaaacttaccattcataaaaaagtagaatctcttaattgcaattaaaaagttcaattttcagaaaatatacctattttgctttttatctattcattgcattatgtattcgatgccaaaaaagcgtcgggatccgggtgacgaaactatgatggatggtatttatcctaaataaattccatcaaaattcccataaattttgcatagaaatg

SEQ ID NO: 111434 - DNA, 1003 bp, Heterodera glycines
  Promoter: Source sequence=SeqID_5088; Location=37..1039; Strand=+; Gene=SeqID_56858
ggcaattcatttcatgacaccaaaagtccttttcctctattctttcattcgcaatttcgaattctcttcgttttcctttttgctgtttaaaaatgttaccattttggtgtttttgcccaatttatgattttacattatttattttccctttttggccatttcaattaaaatcctttcacacttttgccatttcaatttgaggacacgacaatgccaataaatgtgtacaaattgacccgacttattatacgattaaatattgtttattctgataattattaatttttaccatttgatatttcccttttcattttctaaatttggcaccgattgaattcctttattttaatttattgaatttaatgttttttattataaaaatcggtatcatttcacttttttaatattgaatctgctaccaattgtgccccccccccccggggatgcacggaatttcgttttcgttttgtcctacattttcggcactttttgagtttcgttttcgttcgtcaaaaaattttcgttttcgagtttaaaattttatttttcgttttcgtatcgaaatgccctttttcgttttcgtatacgaaattttttttaaagttttcgtgcagtcctgccccccacccctctcttccctttttggccctaaatgcttttcccgttttattccattttaaaaataaaattaattttcttccttgattgtccaataaaattatttgaaagtgttcaaagaatgcatttccttcccctaaacttaccttaatttccgattccttttttggggtgccaattctccgccgtctttgagttgttttttggttttgtttgttttttgttcctccccaaatcaggccgaaacgagtgcaatattacaaattgtgccgcttttcaaatatggcaaacgtcacagcctgactgagaggaggaagcactttggaggagtgaataaagagaataaaataataataacaataaatatgattaaaaggaaataatg

SEQ ID NO: 111435 - DNA, 80 bp, Heterodera glycines
  Promoter: Source sequence=SeqID_5640; Location=968..1047; Strand=-; Gene=SeqID_58746
aacaataccttacttaacaaaattattattatttataatataaaaggataaataaaatatttatttgctaagggaaaatg

SEQ ID NO: 111436 - DNA, 52 bp, Heterodera glycines
  Promoter: Source sequence=SeqID_13005; Location=1786..1837; Strand=-; Gene=SeqID_76776
tatggaaaactcaacgagggcaaaattggatttgaacgctttgaaaaaaatg

SEQ ID NO: 111437 - DNA, 488 bp, Heterodera glycines
  Promoter: Source sequence=SeqID_20240; Location=1..488; Strand=+; Gene=SeqID_85040
actgcttttgttagccttttgtcgctttctcgccctttttcctttctctctctcttcttctctctctcgctctcttctctctgttttccctctctctctttctccgtctctcactccttcgcttttctctttcttctttttacaacttttttctattctcttttttatttttcgtatatttctttaacatacaaattcaagtgcattaaaagaagaaaaaaagataacatcacaacccaaccacaatcacagcactaacacacgaagaaagtgagtgaattggtggtgcaaatttttcaaccgtttccttcaaattattaattcaatgaagtcattaccctaaaaagtaaattggaggaaaccacctttgagcgtgttccttcagctgacccaaacaatttataaataaagatgcgttttcttgtatttaatttttccatttattttgtccatccttaccatagcatataaaccgttaaaaccaaatg

SEQ ID NO: 111438 - DNA, 600 bp, Heterodera glycines
  Promoter: Source sequence=SeqID_11801; Location=1..600; Strand=+; Gene=SeqID_75302
tgttggctgccgctgccttttctgctcatttggtccatttcgtgacgctaacgcccaacccatccaatgaaccaaacgattgcaagtgcggcatcagcgacggcggacgattgcaggttggcacttttaacggtctcgagcactcattcccgaagtgtgctggtcaataaagtgtccacttaccatgattaaattggacttgcaaaaacagggttccaagaaaaaaaataatactaccaatctgcaaaatttcataaaatttcatacatccaggtttttttaaatccgtctgtttttaaaactagaaaaaacaattcacgacaatcatgaatttttcaagttttgaaaatacaaaaatttccgaaaaaattcttgaatccatgaaattttatgaaatttttgcagacaagtagcccttttgccaaaatattttcctgcaaaattccaaatcattccgaccataatgaacaatggttaacaacaaatcacctttttcaaactccgtgaggttcttcgtcactaaattgccagtcctaaataatcatagctttttcttactgtattttctgtccatcttacagtattcccctttttaagatg

SEQ ID NO: 111439 - DNA, 197 bp, Heterodera glycines
  Promoter: Source sequence=SeqID_33940; Location=1..197; Strand=+; Gene=SeqID_63857
aatggacatgggtgaaagttggcattcattgaaataaaataaattcaaattttagattaaagatgcactattttttgaatttgtcaaaggattagcgacaaattttgagaaattttttaagatggctaacgaatattcaaattatttacgtcagaaagggaattttgatttttggtgatattgataatataatcatg

SEQ ID NO: 111440 - DNA, 698 bp, Heterodera glycines
  misc_feature (50)..(50): n is a, c, g, or t
  Promoter: Source sequence=SeqID_44469; Location=1..698; Strand=+; Gene=SeqID_71953
ccggacccgaattcgaacaaaaagtcgaaaattttctcatctctcacttntggttccaaaattgaccaaaaaatctaaatttggtcataaaccattggaatatcaaagaatgatcattctatacagctacgaacataaaagtgaatttcctgggaatgcaaagaaaatggtcaataaatgaattgtttcattctttcaggatttctctaatatggggtgggcgataacaatttacattttaaaaagtaaatttttaaattttgctttgaattggcatgtcgattcttttttttgcttctcttcccactctcatagctatggtcatgaccatggtcatttttgtcaaaatctttataaaagaaattttcgatccgtcatttgttgattctatcttttcacacacaatatttcatttttatatttacaaaccgatttttttttttgccttttttttcgtttgcctcagtgaaacaataaatttttgtttcgaaattccaagttcatacataaaaatataccaaattttatcgaccctcgacccttataaattatggccaacgtgcgcaagacgggaatcatttgcaccataagtattgaagaaaatgaatattcactaaggctggccaagaactgttttcccttttcagggccgcccgtttgtcgttctgtggaaatgcttgtccaaatgatcgaaaatg

SEQ ID NO: 111441 - DNA, 720 bp, Heterodera glycines
  Promoter: Source sequence=SeqID_37908; Location=1..720; Strand=+; Gene=SeqID_66879
ttattttttattttagtatcaaaatattcaatttcccatttgtttaaaattgtccaacataaaattccgtcgtttagtgaatcattggaataatttttaaacatcacaaaacatttgcaattttccatttatccgattttgtaaaaataaaatgcctttctccatatattttttgctgctcatttattatattatctccaatgaaaaagtttttgctgaaaatggagaaaagaagtttctttgcaaaattaatcacatttaaattattattattttaagaaaattgtttttggatttaaatggcactgatcggaccattcggctgaaaaactgcggcaattgcaaagggttttaaggcttaaaaagccaataaataagtaattgaggtgttaattaagtctgccatgtgctacaaaagtgtgttgtccggcgaagagaatttcccgtggaaagtgtcgcgtcggtttcgcttcttttcctatttgttggataaaagcggaaaatgtggcaaaaaagttcgtattgcaatgaatggcacgcaattttcaatgggaagagcatgcttcaatatttgactttcaatttttaaaataaatatttttaaattctaaaattatgaaattggctattttttgattttgaaattcaatttccaatttcaaaattggccctacaattaaagaattcattttaaatcgctctccctcatattttcagatg

SEQ ID NO: 111442 - DNA, 1003 bp, Heterodera glycines
  Promoter: Source sequence=SeqID_4301; Location=3264..4266; Strand=+; Gene=SeqID_53955
atttaaataaagatgaaaaagagcgggggaagcaaatccataaaaccattgaatgaatgaatgtgtgtattttaatatatggatgaatgaatgcatatgaaatagagaactctgactgaaagaaaaaagccacaaaaatttgcgacgtggaataaatgggaaagggggagggaagataatgtcgcagtaattgaatgtttaggggctggaaagcaattagttattttattaatgatggctggcgattgctgggtgtgtgactgattttctctttatctctcttctctctctacatatttgtgcagcaccgcacgacaagcagcaaaaattaaaaaaacaacgactaattaagccccagtcagtcagtaattagctaattagtgatcaattagaagcaataagtgatcaaagaaggcaaacgggaaaccttcactctttaatgcttgtaacaccctcttctgctgttgtgtgtacacagcaacaaataaaacaccaaagttccaacacagcagtgcgacgacagcagacaattcaaaattgtcgttagcaaaatgtttcttggcgaaatgcttttgaatttaaaattcttgaagttttcaaattgaaaatttcttttcctctagatttcattctcaattaaagttttcttatgtcaaattgttaaaacactaaaaacttttttgtattcagttcaaattaaaagttcctttttttatgtataaattttgaaaaataagccactttccataaaaagggaattaaatggttttacatacctagattagagtgttcgaacccgtacgttcaaacacgaaaattaaaccaacgagacattttcagccctgcctgatagattaaaaattattcttcactccatttgtaaaagtgctaaaaaagaaattaccacacaatttatacattttcaagcaccactgttttttaaagataaatttcaaatttaagtgttgtccccgaacaaatgttgaatcccattccgtcaatg

SEQ ID NO: 111443 - DNA, 1003 bp, Heterodera glycines
  Promoter: Source sequence=SeqID_6712; Location=623..1625; Strand=-; Gene=SeqID_62591
tttgcattgatatatgtcagtcacagtgccgccatgagaaaattggcgccattaaccacagtgaacggtgtcggtgtgaaaataaatcacagactgatcaggccagctgatcagctttagcaaagccgttcactaattttaaaatgttaattttttgaaggaatttgatgcgcggccccgctgtgtgtgtcggctaggctttttccgagcgcccggcttgtccacctgtgtgccaaccgaagcgttccctcattttgacgcctccaacgcttttcggcttgcggatgcgctccggcgtggtgaacaaccaacaacaaattcgagctgttcacgccttttcaccgatttggcacggctttacccggcactgtttctgttcaacggtcgcgaggatgccaaaaacagcagcggtggcaccataaaacaacgggacgaactgatggaaacggatcgccaactgaccatccgagtggtatcacccgcccgtggggcgaggtaagcgagagcagttgaaaattatcgaatttcgtgaaccatggatcagaatgccgggattggcagactttcccccccccccccccaaaatgtttttgtaaaaaatttaggccggcgtttattgcactaaatttaccgattagcgattgaacccttcatttatctagtaaaaatcggttttcaatttttttaaaatgcctttccttgtttcatgctttcacttaaaaatttaaaattatatttctattcagtttatagcccatttttaagctttcaaattttttaatttgttcattttttaagaatatctggctaatatcttcggcttacataaaaaatcctttcccgattagcagcacgagggcacggtcaccgcccgacgctcgggcggcaaactcgatttggatcggcacaaaaagggtggtgccgataacggagccggacgaatgtgacgcggaagaacggacaagcggatcgcggaggggacggaagaatacgtgccgcgatg

SEQ ID NO: 111444 - DNA, 194 bp, Heterodera glycines
  Promoter: Source sequence=SeqID_25234; Location=1..194; Strand=+; Gene=SeqID_55980
ttttcggggcagtccccccgaaccgatgcgcccagacttttggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 111445 - DNA, 363 bp, Heterodera glycines
  Promoter: Source sequence=SeqID_30033; Location=1..363; Strand=+; Gene=SeqID_60483
gggtggggggggggggagagggggtaccaactaaacctagcaattaagaaatctcttattttggtgatagatttctagacaaataaaaatcaaatgaacaaatgttgttgttgttaacaaaagcatctgcggtacagtacgatcctaacaaattgtcgtgtcctcgtgtcggaaaagcctatttttaaaaaaacaaaacgccaaaaaatttattttaattctttcgtcatcttcccatcaattttaattaagaaaatgaaaacaaaagtacaatgaaaagctgaatttatcctttttcattaaagaatagcaaattttatgaattccttttaaagatctgttgatactatttcaatttttatg

SEQ ID NO: 111446 - DNA, 88 bp, Heterodera glycines
  Promoter: Source sequence=SeqID_10182; Location=1..88; Strand=+; Gene= SeqID_46843
cacgcgtttttatcggatacttcaaaggtgggcaccacaatttttctctgagtccattttcctctttcaagcattcgataaacacatg

SEQ ID NO: 111447 - DNA, 94 bp, Heterodera glycines
  Promoter: Source sequence=SeqID_14932; Location=253..346; Strand=+; Gene=SeqID_79096
tcgtttttccctttcccctgcaaaagagaatttttctaatcgcttttttaaaaatcttgtgtaatctgttggtcggctttttttccatcaaatg

SEQ ID NO: 111448 - DNA, 516 bp, Heterodera glycines
  Promoter: Source sequence=SeqID_11441; Location=1..516; Strand=+; Gene=SeqID_74834
ttcgggtccgggattcgcaatggtcaaaatgaacgtacagattcgtactcaccgaccctgaaaactcttagaaacatattttcagtgacttttaaaaagttaaatgtttatttcaaaaaagaggtcctaccatccgtagtataccttttgattttccaaagcctaaaacatttttactttttgataaaattcaaaattgaccacttttcatatagcgcaggaaattgttataaatttcgccatttttaattctgtaaaatcttaagaaaatgaaaaattttgggtgaaatatcggattcggaattcggagaaatcaggccgggataggattacagggattgaaatcacggttttatagggatactgaattatatttttaagccgtcattcatcctaaaattttcaatctcgaatagctttactaagaactttttcatttgcggaattcattaaaaaattttcagaaaaagtattaattgacaacaattgcaattgccaaccaactttctcaaaatg

SEQ ID NO: 111449 - DNA, 543 bp, Heterodera glycines
  Promoter: Source sequence=SeqID_35484; Location=1..543; Strand=+; Gene=SeqID_65024
aaaaaaaataaaaaagcaaaaaacaaaggaatcttcctaccaaataacgacagggacaagcgcccaaagtacgatttcgagaacagagaaacgagaaagccacaaaagtagaatttctagaattgagagaccagcagaaccgtgctccgttttctttgcttcaatttcaatttggtttgtagaatgagaagatacattctgagaatcgtttgagcagaagcagtgttggaaaaaaacaatagcaccacaattacaccggcaatattgaacagcggcgaaaaggtttggcgattcggtgacccacgaggaaaatctgaattttggattgaagtaaaaagcgcatctcaaaaaggcgggttctagtcggttttacgcgtcccatggcattttacgcgtcccatgacattttacgcgtcccatgacattttacgcgtcccatcacattttacgagtcccaacaacactttacgcgtcccatcacattttacgcgtcccaacaacactttacgcgtcccatgacattttgtgtccatggcggggatg

SEQ ID NO: 111450 - DNA, 1003 bp, Heterodera glycines
  Promoter: Source sequence=SeqID_28682; Location=249..1251; Strand=+; Gene=SeqID_59271
aagcaaatacttaaattcatcttcgtttttgagtatggatcatttgaaagcattgaattttaatggtttttgacattaaatctcaaaaattgccttatttcagacaaaatctagtttgcaaacaggtcggcatccgctaatttgttaaagtttaaagttgaaaaaatttggactgaaaactttggcttgtcagaggattttttccaccaataattttgtgtcaattacttagtgtttttcactttaaattttgttacctatatgtatgaactttcggaaaaagggcctttgggtttggggtcgtccaacgctaaaagtgctcatatgtactgtatataatgcgatgatttgattgatggttagcattttgtacaaaactcgcacaacgtcggtgattccgttcccaaacgacctttttgtttgtttttttgctttccgcatgacttttattcggcgcgcttttttcaaaatttttttgacaacacaggctgagagatccagcgctgtgcataactccctaattacagaaatccgtgatcctaatcagtagagacaaacaaatcagcaatatatatattatatatcttttttctgctaacttcctacatatgtacgaataaaaatgcaataactacgaaaaagcacccttaagaatcgacctaaattaaaaaaaacaccccttaaattggaaatttcacaaatcgaaaaaaccagtaaccccattcgtaattacccgggcctaaaaaggccgtaaaccttgatatagatacacattcattcggattagtacttttccttccatcgcaatataccggggtttttctactaaatcataccgggccgaaccggctaaaattgaaaaagcatgatattgtgttgcagagattttttttgttccacgcttttaattttggtgtcacattaatcactgcatttcttttttttagcgctcaaatactttcttttgtcgtagcacttttaaccgttgaaatatcgacaaatg

SEQ ID NO: 111451 - DNA, 217 bp, Heterodera glycines
  Promoter: Source sequence=SeqID_12366; Location=1216..1432; Strand=-; Gene=SeqID_47031
ttatattggcaaaatgatcttaagtatatttgaaaaaaaaaaatttttttttggctacgtttttatccaaaaatctcaaacaaacaaaaaaactcaaaaaatcctcattttctatcaaaaaaaccataaaatcgggatataaatcctcacatatctgaactctctattattttatttaattgaaatggtatagattaccaaataatttaattaaatg

SEQ ID NO: 111452 - DNA, 274 bp, Heterodera glycines
  Promoter: Source sequence=SeqID_972; Location=11078..11351; Strand=+; Gene=SeqID_65206
tttttcaattctgaactaaaggagaaggaaggcaaaactgcaactaataaatcgaaacaataaagaattgacacaatttgaaatcagaatcactaacattagaagaacatttaaaaaaagtttttttaaaagaaagtaattagcaaatgacaatgaaaaagaatcacttatccttatcatcatacatatgtcaattaaagttcagtaattaaagcttgttgttagagtctatccacactttcatcccttcaaatcaaaagcagaaattggaatg

SEQ ID NO: 111453 - DNA, 101 bp, Heterodera glycines
  Promoter: Source sequence=SeqID_26225; Location=1..101; Strand=+; Gene=SeqID_56978
tgatcatatacggccccgtctgcttctaatctctgatcacttttattctgatccttttttgtcttttgattacatgcgctttcccatatgcagatgacatg

SEQ ID NO: 111454 - DNA, 388 bp, Heterodera glycines
  Promoter: Source sequence=SeqID_3463; Location=97..484; Strand=+; Gene=SeqID_84771
tgacgatgcgactgaaaaaaggaaagcgtaattaattaaggtgtcagaagaatgatgatgaaaaaagcaactcactattctctgatgagcattgttgctgaagtgcagtcaaaaggggaacaaagtgaagaaggagacagacgcttattatgtcagtaaaggacaaatgaagaatgattgtttctgcgcttaaatcgtcccttttatacaaacattttcctacccgtcaattccgtgtaaaaattctctataaaaagggatgaaatttgcgagatccactcattcttcgcatttgcgacttttactctctgctgaacaatttcttctctcgacgacactttgcgcattcaatccgagcacacttcttcacccatttgctagtcccatg

SEQ ID NO: 111455 - DNA, 192 bp, Heterodera glycines
  Promoter: Source sequence=SeqID_36766; Location=1145..1336; Strand=-; Gene=SeqID_66008
gaaaaattttgggcatcggatttcggatttcgggaatttttgggaccttcggattccatttacaatttatgggaaaatttgtggcatcggttttcgattttcggaaatttcggggcctcgggattccaatgatcaaattatggaaaatttttggctcaggatacggaaatttgggggcctcggattccaatg

SEQ ID NO: 111456 - DNA, 254 bp, Heterodera glycines
  Promoter: Source sequence=SeqID_12073; Location=1685..1938; Strand=-; Gene=SeqID_75621
acaccatcgacggagagttccgctgatacgttcgaccttatccgaaaaggcacaaccgcgatacgaatttctttcaacacaccagtgcctgcacgaggaatagtgctaatagcaatggcagaaatcgattcacttcttatgctggacaagaatcgttcggtcgctacagatgttcaagtataaaaagacacttctttgcttagattgttcattttacattcgctttattgaaaaactttttgcttaataaaatg

SEQ ID NO: 111457 - DNA, 53 bp, Heterodera glycines
  Promoter: Source sequence=SeqID_14966; Location=3812..3864; Strand=-; Gene=SeqID_79123
gtgttggcactggttctgaaaatgccaatttttagttcaatccgaagaaaatg

SEQ ID NO: 111458 - DNA, 190 bp, Heterodera glycines
  Promoter: Source sequence=SeqID_23146; Location=1558..1747; Strand=-; Gene=SeqID_53851
aatcaaaaattttggtcaagaaaaaaataaatttagtagaaaatttttaaaaatctttccattcttagtcgggatgtgatttttgatttttagcatttttgtgatgaagttctcgaaaaatgcgaaaaatatttatgtaaataaaaaatcgaaatatatttttttaactttcagatagtaaagcgacatg

SEQ ID NO: 111459 - DNA, 83 bp, Heterodera glycines
  Promoter: Source sequence=SeqID_29381; Location=1080..1162; Strand=-; Gene=SeqID_59880
tttcttcagatggtgttcattctccacagaactgtgccctttaccagccgaatgaggggggaggaaggaccgaatttgcaatg

SEQ ID NO: 111460 - DNA, 188 bp, Heterodera glycines
  misc_feature (30)..(30): n is a, c, g, or t
  misc_feature (42)..(42): n is a, c, g, or t
  Promoter: Source sequence=SeqID_1989; Location=1..188; Strand=+; Gene= SeqID_77223
taaaatacattaattttttaaaaacgactnggatacgaattnaatagacttatttgaatgctttttttattagctacttgccaaaaagggggtcatttttatgaaacgacttagtaaatgatactaattttgaaaaatataaattgttaaattattacctaatttaaattgttatttttactcagatg

SEQ ID NO: 111461 - DNA, 309 bp, Heterodera glycines
  Promoter: Source sequence=SeqID_9404; Location=831..1139; Strand=-; Gene=SeqID_71292
aagaaaatggaatacacccaaatgaccaacaagagagaaatgattcaaaaatttgaagcaattaaagaaaagttgagagaaaaaggaaaattcaaaacaaatacagaacaaaattgaattcaaaattggcagagttttaggtgcaagtcgccataaaatatacaaatggaaaaaagaattaaatttatataaatttaaaataaacaaaagaaaaagagtttttatgagcagaaaaagcgggaattcattgaacgaattgatgaatttaaaagtttatatggccacggaaaacagaaagaatttgtaatg

SEQ ID NO: 111462 - DNA, 92 bp, Heterodera glycines
  Promoter: Source sequence=SeqID_22226; Location=2364..2455; Strand=-; Gene=SeqID_52895
aaaaatacggcactcaaaattggtggaccttagaaaatggaaatttacttttggcaaatttttaaatttttttttcgttttcagtggaaatg

SEQ ID NO: 111463 - DNA, 70 bp, Heterodera glycines
  Promoter: Source sequence=SeqID_6994; Location=1038..1107; Strand=-; Gene=SeqID_63524
agtaagatatacatatcacacatttaaatggtctttaccttttgcattttttcagggggacattgtgatg

SEQ ID NO: 111464 - DNA, 94 bp, Heterodera glycines
  Promoter: Source sequence=SeqID_26402; Location=153..246; Strand=+; Gene=SeqID_57134
ttgtcagattatcaaccaaaagtcctgttgggctgttcaatttcgtgcgctttacgagcggagtttgttggaacggcaaaatcggcgcagaatg

SEQ ID NO: 111465 - DNA, 640 bp, Heterodera glycines
  Promoter: Source sequence=SeqID_43921; Location=520..1159; Strand=-; Gene=SeqID_71482
gtcccagttgatgctggcaaatattttttataattttaatacctatttaacgggtaaaagagttatttgacattcaaaaatttgcccatttttcttgtttcaagggcgttgataaaacggcgaaaaattgggataaattagtggatggctttttgaaaaaattgaattttaggaaaataaaagcctcctagaagaggggtcagagtaaaaaaagattgggaatttcgggaaaattttttgaaaattttaagcaaaaatttcgaattttccccttttaagaggggaagagtaaaggggtgaaagaccttcgacaagaattttttgttaaaaaaacagagagttaatcaatgccaaaaacttgccgggaaattccctcaaattcggggtgttgcccaacaattttgtgcaacaacaccaaaaatgcaaaatttgagcatttttttgatgctggcaactattttttataattttaatacctattgtaacggtaaaagaattatttgacattcaaaaatttgcccatttttcgggtttcaagggcgttgatagttaattaattagtgaataattaatgggatttcttaaaaaataaaaactgtgcctgcaaattgacgagcccgtcaatgtcctgaggcagatg

SEQ ID NO: 111466 - DNA, 92 bp, Heterodera glycines
  Promoter: Source sequence=SeqID_21876; Location=1306..1397; Strand=-; Gene=SeqID_52514
tttttaaccctgaaaaaaatcaaatcagaatctgatcaaatttgtggatgatgtcagagaatttgtgtctgaaaatgtttttgttcgagatg

SEQ ID NO: 111467 - DNA, 71 bp, Heterodera glycines
  Promoter: Source sequence=SeqID_24174; Location=1..71; Strand=+; Gene= SeqID_45844
tcaaactttcatccgcaacattaaaatgagcatcaacgcttcatgaaatttttaatgccaatgcactgatg

SEQ ID NO: 111468 - DNA, 654 bp, Heterodera glycines
  Promoter: Source sequence=SeqID_30348; Location=683..1336; Strand=-; Gene=SeqID_60770
attaatcagcagaataattattgtattactttcccattttcccagtccatcggagcaaattaaaaatgcataaattatgtaaaaaacaatttgtggaatttgctatggcttttcgattagagtcattcattagtcactaccctttcgctaattcgcccgtccccacccataatttctatacattttgtggacattattcattccattagtgtgggcattggctgatcaaaaatgtacttttattaaatttatcttcaaaatcatataattatttctgggaagatggtgggcgatatctcctattctttcagatccccaattataatacgtagtgattgctcgagaccaataaatttgaaaccaaaatcaaaaactctagacatttctcgagacccgagactcttgtgcatccctgtaatttaaccctttttaaaaaacccaaaaacccgaagaatttctcaactcaaaagtcaaggccaaggatctttttcttaaatttttgttatttaaaaagaaattctttcaaaaaattaatttaaaaatatttctgtttttatttatttttgctttgttggtaaaaatgattttatttttaattattccaattaagagattaaagattttgcatcctaaaattacaattttctaaaaatg

SEQ ID NO: 111469 - DNA, 261 bp, Heterodera glycines
  Promoter: Source sequence=SeqID_11400; Location=1..261; Strand=+; Gene=SeqID_74793
cgaatgcgtttttcaccccaaaattggaaatatatctcatatgcaatttcaaccaataaatttgaataaatttagagaaattatacccccaaattggaaaaatttatatgcatatttttcagtttttatgtgcatattttgccatttttgatgcatattttatgcgcatattttgcgattttatgtgcatatttttgccaaccctagtgatttctatgcccggattgaccggctcacacaaacaatgaaaaagcatcaatg

SEQ ID NO: 111470 - DNA, 801 bp, Heterodera glycines
  Promoter: Source sequence=SeqID_2383; Location=6962..7762; Strand=-; Gene=SeqID_79461
taaaaataaatacatatatgtataaaataattgttttgaaaaataaaattgcgcatgaaaatcgcagcaccacggccaacaacaaaaaattagaaatattaatttaaatatttgttttcaaaataaaattgctaaaatacgcaaaaatctcacccgcccccccccagccggaaaaaatgcgtctcttcaacaacaaaaatgaaaatattaattttaaataaaatatttgttttaaatatcgtaaaaaaatagctctccaattgttgttaaaataaaatttggcataaaaatcttagccccccccctcgcaaaacagcgttccccattccttattcttcaacaacaaaattaaaaatataatcataaatacctaataataaaattcccccccccccccgcttctcccacggaaaaaagcgttcttcattcttcaacaacaacaatttaaaatatttaaaaaaataaaataaaattgcgcataaaaaagggaaaaaaaatttgtgtactcgaaaatgggaaataataataaattaaacactcctcatcatcatcatcactaacattcattcatattcattcacaaatatgcatcaaatatttatttttaggggtccgactgagtttaaatttagccggtcggtcggcggatgatgagagaataaacaaacagtccaacagagcagcagagagggggaagaagcggggggaaaagcgccaaacaattggggaaaatctacaaaattttacttttaaacatcacaattcttggccgaaaaatttttggttaagaaaaaaaatatg

SEQ ID NO: 111471 - DNA, 368 bp, Heterodera glycines
  Promoter: Source sequence=SeqID_22576; Location=821..1188; Strand=-; Gene=SeqID_53242
cgatttgttaacagattttgttcgaccaataaatttaagaattttgactatatttttagcagatttcattgaaaaaaattcttaattttgtgattttcggaaaagaattgattattttctagtttttatgaagaatttaacaaaaaaccacaaaaaacctcaaaatttctcaaaaaaccacaaaaaacctcaaagcctcatttgaaaaaaaacctcattgacctatcaaaaaaccacaaaatgagactaaagcctcacatctgggagccctgactgtaaatccgcttactattcatgatcggagttctcaatgaaaattttcaaaaatcaccagttggccgacgcaaaacgaagatacaattgaaatg

SEQ ID NO: 111472 - DNA, 1003 bp, Heterodera glycines
  Promoter: Source sequence=SeqID_4380; Location=533..1535; Strand=+; Gene=SeqID_54230
cttcgcgcccgttttttagcttgttaggcgcttcgcgcccgtttttcaatttttgttggccttggacgggcgcttcgcgcccgttttttaaatctgttgaacttatacgggcgcttagcgcccgttttttagcttgttaggcgcttcgcgcccgtttttcaatttttgttggccttggacgggcgcttcgcgcccgtttttcaaattttgttggccttggacgggcgcttcgcgcccgtttttaaactttgttgggctttgacggccgcttcgcggccgttattaaattttagaacagatacaaaagtgattagaagaggtacaacattggtcagaagaggtacaacagtgattaaaagaggtacaaaagtgattaaaagaggtacaacagtgattaaaagatgtacaaaagtgattaaaagacgtacaaaagtgaattaaaagaggtacaatagtgatcagaagaggttcaacagtgattaaaagatgtacaaaagtgattaaaagacgtacaaaagtgaattaaaagaggtacaatagtgatcagaagaggttcaacagtgattaaaattgtatgaattataaatttattaaattaaaaataaatcctccatttattaattgaaaataacgttgaaaattaataattgaatatttaataaatttaagatgaaatttacaaattcaaaaaataaataattaaattctttaatgtaaaaaatttttttttaaataatctacaacaaatcttaagattagttaaaaacattgaaaatgacgtaaaaaggcatataaaataatttacaccggccggattcgaacctgccgccccccccccccccccagaagatgactcagaatccccaatcacacagggattctgaggtcttgacgatgtcaaaagtaaaatctgatcacgtattcgtgatcagcggcccaaataacccttatttggtagagcaaaaaattgcggatttttgttgtatattatttttacaaaatg

SEQ ID NO: 111473 - DNA, 189 bp, Heterodera glycines
  Promoter: Source sequence=SeqID_17856; Location=1095..1283; Strand=+; Gene=SeqID_82399
atttaacagtttcacttgtcgatttggcacacaaatttttgttaaaataaccattaataaaggtttgaaaataaactccgttcgaattaggttaagcaaacattaaatggtataaaaaactcaaaattagatataaaaatcattttctttcatttaatcaaaaaataaaataattttatctttgaaatg

SEQ ID NO: 111474 - DNA, 650 bp, Heterodera glycines
  misc_feature (12)..(12): n is a, c, g, or t
  Promoter: Source sequence=SeqID_24352; Location=1020..1669; Strand=-; Gene=SeqID_55073
aatggggagacnccttcgcaagtgggaggagggtcaattgtatgctcgagactctcggggaaaagtttcttattttttatgtcggtcttgggcttttggtcacggtgttcgatactgttcgagacttatttacacaatctcagactaagtggaaaatgctttttggtacaatctgttttcactcaaaaatcctatttttcggagtcgctgatccatctttttctaatttttgagaaattgggccaaacaaagcgccccaaatggtaaaattttgctatttttgatgaaatcaagtgcttccaagtaggcggattcttcagatttgtgctgtatttgagatttgaaaaaccatgaatttgttcatttttttctcaaaaatttttcaaaaatatttccaggagccgcatctcggcaccgcctaatttttccttaaaaattaagcccgcgcggcgaaaaaatgtgaatttaagcctattatttttgtctgcatttagaaattgcatgctgaacactgcgttgtcaaagtatatagtagaaaaccaataaatcttcaattgcgaaagacgcagcagcagcagcagcggccttcaggacctgaactcctccgggagtcgggcctcccgttggagcagcagcagcatcacctgatg

SEQ ID NO: 111475 - DNA, 78 bp, Heterodera glycines
  Promoter: Source sequence=SeqID_8216; Location=1446..1523; Strand=+; Gene=SeqID_67332
agtctgaattatttctgtactaaaacaattttggtttcaattttcaattttaattatatatttttttaattttagatg

SEQ ID NO: 111476 - DNA, 58 bp, Heterodera glycines
  Promoter: Source sequence=SeqID_3373; Location=6867..6924; Strand=+; Gene=SeqID_84441
tattttttttcatcagcattaaaaatctaaaaaattcaggtaagcataactttggatg

SEQ ID NO: 111477 - DNA, 689 bp, Heterodera glycines
  Promoter: Source sequence=SeqID_9007; Location=3702..4390; Strand=-; Gene=SeqID_69983
aaatgatttcttcttaagcacttcttttggcaacaattcctccatcacacgtcggcctgacttggtccgatacgagctgctcttcatcgatttgctgctaagactcctcacaaattcttttttttcacttttactcgctgattgtttttttgcacttttacttagttttttttcactttttccacggcgccaacgccgacggtgttgatgaggttcaatttctgggtttggcgacaatggagatgatgacgacgacgacagaatgccaactaataattttaaatagattaatgagcattttagtgcccaaaaagggaattcaaaaatttgtacattttagccgggccaggccgatttcgtacgaacacatgttttctgaatacaacttcttacgttatatgccaaatcatacactgttgttgtctttaatgacttattacatgatatacaaaataagcaaatttcacatcttggtctgcatttcaatcacaggtgaaaaacatgaaaatacctatgttttcatttatcgatttcagctctatttcaaggtcgacaacgttttggctgacaaatattggaataaatactaacaacttttggtccgaaaaaactttaactgcggcagcaataacaacagttgcttaatcagtcgaagcattctcaaaatttgcaaattgttctttcagatg

SEQ ID NO: 111478 - DNA, 265 bp, Heterodera glycines
  Promoter: Source sequence=SeqID_31146; Location=1051..1315; Strand=-; Gene=SeqID_61523
atttatctgctcgctgtgcgctttgtatgcagcgtgcaatccgctatttgactgacagttacggactgagcaacattgacgagctctacgcttaccttaaggaggagataaaaaatagtccaacaggagacggccagtcattgtttccgaatccgttgcgtgcagtcgactgtgtgcatattgcaaacactgagcacagaaaccaaccagtgtacgtggaagggtcacttgatcttgtcgagggactcgagctttacacaacatg

SEQ ID NO: 111479 - DNA, 123 bp, Heterodera glycines
  Promoter: Source sequence=SeqID_766; Location=1..123; Strand=+; Gene =SeqID_60742
aaatggggatgagagggaagaggaagagaatggcagcggaaaaaaggagcgggtgatagtggaagagagggaagagaagaaaagaggagagatgagaaagaaggaggaacaacaacaataatg

SEQ ID NO: 111480 - DNA, 1003 bp, Heterodera glycines
  Promoter: Source sequence=SeqID_6210; Location=1681..2683; Strand=-; Gene=SeqID_60724
ctctctcttgataattagagataatacggtaaacgtttttaattaatcgcgcaaattgtggttgggtgtcataaaattgattggagactaaaattgtagcagaactgcaaataaatcctaacaaatgaaaaaaggttttttaaaatgggagtaaaaattttaaaaaaatttaaaactattaaaaaaatcattaaaattacttttataatattttcgatcaattggaaatcattacaataattgaaaaaacaaaccgataataaaaaaatcggcagcaaacccaacgaactaatcaataaatgaattacttcagagattttaacatttaagtctgattttttgttaaaatgatactaaatcgacaaaagcctttgattgatcgcgaaaattatgattggtcatgtaaaagttgattgaaaataaaacaccaggagaaacgcaaccgcagcctaatataaaatcaattaatgaaaaaaggttttttaaatacataggggattatacatatttcaaaaaatcattttagtgtacacaaataatttttaaaaaattattgtacacattcaagaccattaaaaatttgctattaaaatgattttgttcaaggaacggaatgaaacgtttgatttgacttctttatttttaacattcggaatattggaataataattcaataataagaaaagagaaatcgaatttaagtgtgttgatttcgtaaatgttattgacttttgttgtttcactcataacaataataattctcttttccctctttcattctctctttgtttttgcaaatgctttcgcttcgaaaaataatccattcaaagtgtgacatacatagtcacacatcaaattagtatggttaattaggtagcaattacggctctaatgcagtttacgcgtccaatcgacttttacgcgtccaatcaatgaccatcctcagtttcttaagccataacttttttcttacttttgtcaatctaattaagagtattaaatg

SEQ ID NO: 111481 - DNA, 740 bp, Heterodera glycines
  misc_feature (390)..(390): n is a, c, g, or t
  Promoter: Source sequence=SeqID_3815; Location=677..1416; Strand=+; Gene=SeqID_45645
tttttggagtaaaatgggaaattttttggggatttagattttgtgaattttccttgacattcattcgacttttataatgatagcacacgcacgccaaagcgcatagcagcatatgccaacaatgcaatacgtatgcttaagccagatttcatcttgcgccagaattccagcaaagaaataaaaatctgcaaaagagaattaaccgatttcaaaaatttttctggtttagaaaataaaataaatataaaaattattgaaaaggcatttatatttttccaactgctgaaacgcagtatttgaaagaattttggcaaggaaataacagaatttttgaataaaaataatttcttttcgaaagagcagtttgggttcttaaaaaacagatccacngacaaccctaactattaattacagacattaaatgatttttacgaagctatacaaaatcaaaaagaggttgatgtcatttatattgatttttccaaagcattcgattctgtttctattgatttgttacttgcaaaaattaaaaatgctggaatagttgggaaaattttgatgtttttacgtaatttcttgttacaaagaagttttagggtaaaaattgaagaccgattactctgaaagctataatacttttacgggggtaccacgagggagcgttttgggtccgattattattcctaatatttatcaacgatttaccggtaaatatacctaaaaatgtaaaaattaaaatg

SEQ ID NO: 111482 - DNA, 482 bp, Heterodera glycines
  Promoter: Source sequence=SeqID_6979; Location=4110..4591; Strand=-; Gene=SeqID_63474
attagtgggagtaattagaggggggggggggacattgagtgaccataagcaaatgcgtttgttctgccgtttttcattgtgtgctttcctttggcaaaatgccacaagactttcacccagattagatttacccttttgcattaaaaatcaatttgtttttaatttttcgtgctgacccgggcctaatgcccttttatcccccctccctctggccatgctcttggcactatcccactccgttccgctttgacttatccgtttaaatggcattcaacatgttttgcttctgtgcgatggattgtcgagactgactctcgaacatccctttccctccccctctcattgctaacttttggctgtcgatccgtaggactttggtcgccccttttcatcatcccgcgccattggcttcgtcttctgtcataccttcctctgtatcaccggtgcatttcccgcgcagcgacgccgccggctgcgcaatg

SEQ ID NO: 111483 - DNA, 102 bp, Heterodera glycines
  Promoter: Source sequence=SeqID_18144; Location=389..490; Strand=-; Gene=SeqID_82731
ttttcccccaaaaggttgtcttcctttccttggcgagttcatggtaaaacaataatacgacgggatacggtaattaacatacggtactctttcaagaaaatg

SEQ ID NO: 111484 - DNA, 536 bp, Heterodera glycines
  Promoter: Source sequence=SeqID_3624; Location=3403..3938; Strand=+; Gene=SeqID_51166
aagattaactcatttttccttgatttattttgttacattgcttacacatgcaaatgattgattattctatggcatttttccactttccttaggtaccacgacccggaaaatgagccgtgcgggacgaaagcgattggatttgatgcggaagcaatcgaacgattggaggcggaacagctgaaggaggcgctaatggccgaagcggaacaatttgggaacaaagacaacaaacaaaacgccaatcagatggaaatttgaatggaaattgaataaaatattttagcaacagaaatatttggtaaaaaggaagaaataggctttggcttctttgaaaaatcagaagaaatggatattaaaattaactttgataacaaacaacccgaattattaatattagcatttataaataacttttatgggttaaataattcctatttatttttatcctaatttcttctttgagcaattagtgaaattaatctcattaaacaataatatttaaaaaggaatagccgatcagaaaccaagtcaaaatg

SEQ ID NO: 111485 - DNA, 1003 bp, Heterodera glycines
  Promoter: Source sequence=SeqID_1722; Location=1374..2376; Strand=-; Gene=SeqID_75503
aaaacggtcgacttccttcttttcatttgtcaagaattgataattttattttagtgtgcatttctagtaacaaatgttataataacataaagtgtgaagcaataagccgtgtctcaccttttttttgtcgtaacttttttcaaatgcaaccaaaaatgatcaaaatatatattcaaaatgtgcacaacagataagggaatattaatagatttatcctatctttataaagtcggaggataaagaataaaatgtgccaaaaaaaattgcagatggctgcaactcccggatcaatagtttggcaattttccggagaaaagcttaatgaaaataaacaaattttaatgagaattaacaaagaccacttttcactaaaaaggattatataagataattattgggtagtgtttaatgggattaaaaggttaaaagacagtttaatattaattccataattttaataacaaaataaccaccgatggacgatgaatcaatgtaatccaaaacaagaccaatatttttatctcttgttgtaatgctccgtagattagttttaaaatggaaaaacgtgcaaaattgaggcggttgggtaaacaatcgttatacaaaaccttataaacatataaaaatgctttattattttattttattccaatccgaaaatttttaccgaatttaaaatttctcgaggattttgtgtaaacaaacaaattaaacaatccgtttttaattaccaatacataaagcgcatttaaatctaacaaaatatttgctcataagacgtggaatttttttatttagaaaattattataaaacacttttctattttcataaatttttatgtgagtttttcaattatatttaaatataattttttttgtaatgataatttatttatttaatacattaaataaagaataattgataaaggttctttataaatttttttttaatttctaatttttattataaatgtttttaatttttatttttaggttaataatg

SEQ ID NO: 111486 - DNA, 1003 bp, Heterodera glycines
  Promoter: Source sequence=SeqID_5212; Location=1929..2931; Strand=-; Gene=SeqID_45997
ttaaaattttgtaattattaattaattaatcataattacttttgtcctccttcccttcccttcccttctcttttctgtgtttatcctttgcgtcatttccgtttgggtttctttcttttctcagttcctttggttttcatttttccttctcctcctcctacacaataattcagtttctcgacaagtcttcagtttatttcaagaattttcaagtcaattttaagtgcgggaaaacttatttaaaaaagaatttgtgcagaaataaattctcaaaccgatgatttggaaattataacaaattgaagaaatgagtttttaataatttaattttaaataggtatacatataaataattttaatgtgaaataattaaataaattcccttttattttatttaatgataatcaactcatttttaatcatcataaatcaaatccaatccattaacattaaaccaggccaagtcatgtcatagtgacaatgtccgtcccatttcctttcctcaattcataatcataacgttcaatttgatttgttttttgcttttgtatttttacattgacgtgtcattttgtccttcttatttttgaaacgactttctgcttctttctttctcttgcctttggcattgtttaattgtctttgccaattgattggcagaccctcgaaaatgtgattttttggttttccctgaaacttccatttggcctccttaattgccggtgcctatctcacaatcaacatgagttaattaatcgtaattcgttgataatgataagcgctgtgcaattcgttatgatgcatataattcctaaattggccacagacaaattccgacgttttttttacgtcattttcatttttcttttgtacatcctttggaaatttgatagaaatattgaaccaaatgtcatattcctttttgttttcctcgccttttatttaattttccctttccttccatgttcttcaggttgttcatactcgcacaaacagcgagatg

SEQ ID NO: 111487 - DNA, 208 bp, Heterodera glycines
  Promoter: Source sequence=SeqID_13066; Location=1045..1252; Strand=-; Gene=SeqID_76853
gcaattatgttttattatcagtaagcgttagttcttaaattttaaattttttttttctgcgcctttacttccatcagaaatgcacgcgaaaccttaacaaatatattttaagagggtatttaaacctataaataatgacaacttataatttatgcttatagaaaacaaattttcaattttatttgctgaaatatcttttgtttagatg

SEQ ID NO: 111488 - DNA, 274 bp, Heterodera glycines
  Promoter: Source sequence=SeqID_20131; Location=935..1208; Strand=-; Gene=SeqID_84917
attacgccataatgacatccaaaattcagcggatattctccaagtaaattttttaaataaaaattgtttaattaataaaataaaaatcgtaatttttaaattaattggcaaaagcattttcagtcgctttgtgctttttggggggttcgtgagctgtcgagtcgcgcgcatttccatcaaattttgggcgctgcccaaaatgtggtggaaaatgtaaaattatttaaattaaacattaatttaaatattaattattatgcaattttaacagatg

SEQ ID NO: 111489 - DNA, 563 bp, Heterodera glycines
  Promoter: Source sequence=SeqID_4795; Location=376..938; Strand=+; Gene=SeqID_55747
aattattgttgggaatgttcatttgctcatattttaaatttcccgcgcttttaatgctgaacatcactattattgatttcagccattttccctttttgacccgtccttaaaatatcagtccttcctctcagttgtcgcctcctccacacatcattatattttgctccttgactccgccattttcattctgactttcattttcatatttatttcttgtttgtcttttattttatttcttcaataaatttgtatttaaaagtaaaagacacaacaattggcgacgcctgatcgctttccagcattgctgtgaactcacccaagtgtgatctcaaggccaccttcccctaacccataacacaaactgtgaacctcccttaaactcgccaagagatttctcagtttcaagactgattaaaaccgagtgggggttcagttttgttggttaagtgagaaggagtttctcagtattttggctgagtaaagcctcgttgtgcccaatttttctcatttaaattttcatttcattatttcatttgtctcaatcattcatcattctctaaatg

SEQ ID NO: 111490 - DNA, 279 bp, Heterodera glycines
  Promoter: Source sequence=SeqID_42883; Location=1..279; Strand=+; Gene=SeqID_70691
tttttaattggataaataaaaaaattgtttaaaatgaaaataaaaatgataatcactaaaaaaattttccccaaaaccacctttccggttatatttatcatgaaaaatacgcattttaagaatgtgtttttatttggaataaattatcacaaaaccttcatttcctgttattttagcttgaaaaatacgcattttaagaatgtgtttttatttggaataaattatcacaaaagcacatttgcggttatatttatcatgaaaaatacacatttcagaatg

SEQ ID NO: 111491 - DNA, 1003 bp, Heterodera glycines
  Promoter: Source sequence=SeqID_24499; Location=536..1538; Strand=-; Gene=SeqID_55229
ttgtgactgttcatttgttgccgacaaagttgaagatgacgaagatggaaaaaggcgcaagaaatccataattaattttaattttaactgtggaacagaaaaaagtatttaaatttattcgggattcggcaaaaaaacttgggcttcttaggagaggaatgtatcttttttgttattttgcatttttattaataaattttggacataacgccaaataggcaaaaataggtttttcaaaatgtgtttaaggccttgggagctcagaaaaaataggcaaaaacctaaatgctgaaatctgttaataaactatgggctcgaatttccaaaaatcataaagatatacctagacatgtaaaaattataaataaaaatctgcaaaaattctgattcaatgccctaaacttggctcagacgcaactgcccctaccgtccctgcgggattcccgaaataatggaattttaaggcaaatcggaaaaaaggaatatcgtactgtttttttttgttttccccttccacgaagcaattttttaaccggcatagttaacattatcccaccttggactccttcccaacctttgttcttttagtaccctttttaattttgactaactgacattttgctgctgtaaaggctgctatttgaaatgtaaatgttcatccggttaggcaatgaatcatttatacaccaaaattttgcctttttttctcggtttttagtcattgcattaaataatatttaaacgattttacacacaataattcaatttaaaaaaatattagttaaagctaaaattttgtttaaagcttttgagtatcataacaggttttatgccgttagcttaatatatttgtataacgtcaatcccggcctgtttgttatcgtcatccccaacggccatcaaagcgaaaaaatttctcaaaatgtacaagacattagcataattatatttaactaatctttatcatttaactcagttgcacacgccgcctccagtcagcatg

SEQ ID NO: 111492 - DNA, 99 bp, Heterodera glycines; identical to SEQ ID NO: 101586
  Promoter: Source sequence=SeqID_1248; Location=246..344; Strand=+; Gene=SeqID_70713

SEQ ID NO: 111493 - DNA, 398 bp, Heterodera glycines
  misc_feature (28)..(28): n is a, c, g, or t
  misc_feature (58)..(58): n is a, c, g, or t
  Promoter: Source sequence=SeqID_8535; Location=1448..1845; Strand=-; Gene=SeqID_68426
tgaattgtgtcatttttcatagcaaatntagttaagattgggcaaagttttaacaaancaactcaaaaattatgcatttggtttttttttggtgaaaaattgctataacatgaactatttttttgcccatttgggccaatggtcttgaaaaagtagaccatattcttcaaattacaaatacaaatttgaaagcgcttaattgtgtcctattagatgtggatatgaaaattttgagaatttggatgaaattgttagaggattttgctccgtaaactaaaatttcaaacttcctcggaaggagggtgcattacgtttctccccacccccctccccgaaatttttttcaatttttaaacttgaaaattttagggaaaaaaatcagatataaattcaagatg

SEQ ID NO: 111494 - DNA, 144 bp, Heterodera glycines
  Promoter: Source sequence=SeqID_3278; Location=1303..1446; Strand=+; Gene=SeqID_84035
attaaataaacgattgtcaatacgctaaataatgtgtgtcgtgtcgtccgttccaattccgtaaattcggacaattttacttttcatttccttttttttctttccaatttcaaaattcaaattccgccatttattcattaaatg

SEQ ID NO: 111495 - DNA, 997 bp, Heterodera glycines
  Promoter: Source sequence=SeqID_5875; Location=393..1389; Strand=+; Gene=SeqID_59518
ttttccaaatttctccagccagtccgacaatatcgtcgagaatttccttcccaatcccgaactttctcttcccgagaatcggggatcaaccctctttcaccctctgttgacggcttattttattctgcgaataaataaaataaaatgagacaatttggaaaatgcttaaatattcaaaatgtaaaatgtattttaattgaattttattaatcacctatttatttgtttgtctgataattctgacaaacttacagatttaaaataagaaatttgataatgcaaattataccaaattttgtgaattattttctaaattaattaaattcactttgagtcttccccctttaattcgaaaactgattttctttattttttcattcattttcagtgaaatagatgaaattttgaaaatgaatgaataagttttacaacgcctcctcactaactatatgcatattcattaatattaaattattttgcagtttttttccgtttcttttttcgtttatccaattttttggctttgaattaattaatttttttttattactattgctattaagcaacaatgccatcattgctgtcataattgacgtggttaagtggtgaataatcgatggtggctttcattcattcattcgtttaatgctaatgaaagttaaattacacatgattaaataattatgaatttgctggcatttgctatggctaataatacgtgcgtaaatgtaatgctcacaatcaggcaaatttaacataaaaattattatacaagggctggcattagggttgggggaggggaggggaggcaattaaaaagccatcgcccctcctcaataatattttaaaaaagcagctaattataagcattaaatgatatttcaaatttttcaaaatacaaaattaattcctctttttaaattttacatttattttccttcttaaaaattccctttcccaaatccctcagctttttcagaccaattaattgactatg

SEQ ID NO: 111496 - DNA, 234 bp, Heterodera glycines
  Promoter: Source sequence=SeqID_17512; Location=2076..2309; Strand=-; Gene=SeqID_82018
aagcaaagaaaaagtgaaaccatggtaagaattgcaataggacactatgacgaacaaaataaaaaaagaattattaaaataaatgtagaaattacggagttatgaattttttaattttaaaataattaaggccgacagaacttatgttacaccctaagtatatgaaaaaaatttttacatggtgccaagaagaaaacaaacaaataaaattgatcaattaaaaattacaaaatg

SEQ ID NO: 111497 - DNA, 168 bp, Heterodera glycines
  Promoter: Source sequence=SeqID_27691; Location=608..775; Strand=-; Gene=SeqID_58362
cggcatcagtcggtaatcagtcaagccctgctggcaatttcaatcaaagcttcttcctctccgcttgcttcttcattcatactcatcaggtgggtgatcacctgatcactcactgatcagttcctttttcgtttagctgtttctcttctctctctgctcttaaaaatg

SEQ ID NO: 111498 - DNA, 373 bp, Heterodera glycines
  Promoter: Source sequence=SeqID_21702; Location=312..684; Strand=+; Gene=SeqID_52313
agaagttcggatggaagtctatttgcttgttgctatgcaattgtttccattgtataatatgtaatgtggttaacgggtattcattcatttaacacatacattggcatatgtcaaccatactatttgtttcaataaaatatatcgcaatattggatgacatcattttgtaaaaatgttaatttacatgctttactttgtttgccttaatatttacaaaaattgcggttttggcgggctaaaaattattcttttattttcaaaaatatcctaaaaataaatgagttttagaaattgcccgaatattttttttaattaaaaattttaaatactatttgtgttcgcttgtatgccaaattctgcttcaacaccaatg

SEQ ID NO: 111499 - DNA, 583 bp, Heterodera glycines
  Promoter: Source sequence=SeqID_22693; Location=1505..2087; Strand=-; Gene=SeqID_53376
tcgctattatgcatccaaaaagtcttttcgacctctatatatctaccaaaataaaagtgagagatttgaaaacggatgaacggatggggggagattaaaatgatttgttggccaaaataatggccataacgcattaatttatgcgtatataaagagagagtaatggggaagggtgttttgctgattttgttcaatacatacataatttacacggcttccttatttttgtaaatgcatatattttttcctggattctccgtatcctaattcaaaattgattgagctgataccgtccgtatatctctaattatccccccggatgattattgttcaacctccttagatagggagggggggggggggggggggctaattagagataataggtaaagtgaattagagtgaaaaaacaatatttttacaaatctccgtctgttttattctgtttcaaaattgttttttgttctttttgctttatcatttttcctaattgtctctgttttaagttaacaacagatttttgccttttgtgacaaaaaacaatcgaaaaagggaaaagtgtgctaattgagccaccaaaatg

SEQ ID NO: 111500 - DNA, 101 bp, Heterodera glycines
  Promoter: Source sequence=SeqID_33389; Location=1524..1624; Strand=-; Gene=SeqID_63463
ttcaaggggtctattttaatttattttattttattaatatttttttcatgtgtttctcaggtgcccatgttaaccatgtccaagtgctgatcagcggaatg

SEQ ID NO: 111501 - DNA, 777 bp, Heterodera glycines
  Promoter: Source sequence=SeqID_4226; Location=1..777; Strand=+; Gene= SeqID_53676
ctatctctttttctgctcaacagtaataggaattccaaccgcattctcagaacaattacgccgatactaattgttctggaatttgtttctcggcgcgtttgtttgggagaaatttggaaaattggctatctctttttctgctcaacagtaataggaattccaaccgcattctcagaataattacgccgatactaattgttctggaatttgtttctcggcgcgtttttttgggaaaaatttggaaaattggctatctctttttctgctcaacagtaataggaattccaaccgcattctcagaataattacgccgttctggaatttgtttctcggcgcgtttgtttgggaaaaatttggaaaattggctatctctttttctgctcaacagtaattgttagagaaggaagtaattattgattaggtgtatgaccccacgccacttcgccatcttccccctcccattcccctcattcagttgttattgtgcccaccaatttgacctctccaatttatttctgcatttttatttatttatttcttcggcaaataaacttatttaattttttatcttcggacataacaaattttggcgcagtcagcaattaactgcacatcaccggcaaagcaacaaatccgagctttatctcgtgttgatattgctcgagagggaaaattagaaagctcgtgttgatttctaattttcgcagatcatcaaaaacttttctctccgtgtgagattaaagtctgccgtgtgcagtttttcttcaattggccatg

SEQ ID NO: 111502 - DNA, 87 bp, Heterodera glycines
  misc_feature (21)..(21): n is a, c, g, or t
  Promoter: Source sequence=SeqID_5275; Location=1928..2014; Strand=-; Gene=SeqID_57529
aataaaaaaatgtttttatantcgggtattcacttttttacttctgtaaccctaactaaatacatcaaatatatttggtcaaaaatg

SEQ ID NO: 111503 - DNA, 435 bp, Heterodera glycines
  Promoter: Source sequence=SeqID_24674; Location=549..983; Strand=-; Gene=SeqID_55411
gcaaaaaggagcgcaaccagcgaattctcgcacagcgctgtggaccgattgttggtttggctccggtatacaaacttttttatatttaattcaaattatgtccatctttataggtcaaagaaaagaatttagtgaatgagtgtgctaaaaaaatgccgttgaaatgtgaaaaaaagaaaaatcaatggatgaccgtgaaaatggaaaagtaatattaattaattctctgttaacttacaatttttacgaattttagccggttcctgctaaggcattgtaaattgtggcgcaaaagctttccacaccaattggatattctccagtaaaacatatttcttaattttctaattttatataaaatattagatcaaaactgttttcaagccagttttgcgatctgcgcaaccacaattatcggagtctatcaaaaaaatg

SEQ ID NO: 111504 - DNA, 838 bp, Heterodera glycines
  Promoter: Source sequence=SeqID_9292; Location=765..1602; Strand=-; Gene=SeqID_70881
agaatggcgcatttaatatcccataaaaagaatcattgactgaacccattaatgactcattgacacttttaccccatttttacgcctccatttcttaaatcgaattttaatttatattttcaaaaggcaatttatattatatattattattattattcatttcattttcttttatatttcatctcaattcttttcctcattttaacacattccatcacaaaattctttatttttcatttttatcaaagtaaaaattggacggaatgaatcatttctttgccaatatttagttaaacttaaatgggacgggacggagtgatcggaaactaagtaaatgatcggacaatgagagatgatgactcatcggcggatttaatgaatcattgggagcaaaaacaaagtttgatcagtcgatcgatcacctttaattttgtttacaaatgaattcacttcgtttggctttgacttttcaaatgaaaatattcgataaaagggaaaaaagcaataaatcgcaagagaaaaatgcgaacaaaaaaaaagtgagggggcaaacggcgggggggggggagccccaggggaccaacaaatggccaagcttatgctgctgatgagagagagagagagaagtgatgggatgagccgtcagcagcagccgttcactctgccgctgtttataaatacccaattagacaaacacttcaattgccccccaagggcattaattaatgaatgtttccctttcccaatttactcagctgttaatttggcattaattcgccttttaatcttccccaattattctttcattttatttagattgctcagtctccaaaatatg

SEQ ID NO: 111505 - DNA, 72 bp, Heterodera glycines
  Promoter: Source sequence=SeqID_8791; Location=1522..1593; Strand=-; Gene=SeqID_69233
aaaagatacgattgtcgtccaccgccgccgtcgtttgcccctctcccccttgcccaaatttattgctaaatg

SEQ ID NO: 111506 - DNA, 97 bp, Heterodera glycines
  Promoter: Source sequence=SeqID_13740; Location=3917..4013; Strand=-; Gene=SeqID_77659
attataataataatcagtttgtgtcaaataaaagtatgtgtcaaataaaagtacttttgttcaataattttttagagacaaaacagcaatatcaatg

SEQ ID NO: 111507 - DNA, 124 bp, Heterodera glycines
  Promoter: Source sequence=SeqID_44888; Location=1..124; Strand=+; Gene=SeqID_72296
ccatttataccgagggttaggtaaaaaattattggattatgaagaattattgacttatcttatccaaatagaaaggatagtcaatgaaaggccaattacatacattgagaatgatgaaattatg

SEQ ID NO: 111508 - DNA, 226 bp, Heterodera glycines
  Promoter: Source sequence=SeqID_4357; Location=3326..3551; Strand=+; Gene=SeqID_54164
aatgggctttacatttcttgaaatgtccatcgttattattattattattgttttattattattgtcatttaattgcttgcaattttgttatttttgatcaatattgcattgtcactgaaaatagttccttcgtttatttcatgcatttgtttgtttctgtcaatatttatttttgcattaattgccccattaagaaacgttgttttatttagaattttagaaaatg

SEQ ID NO: 111509 - DNA, 411 bp, Heterodera glycines
  Promoter: Source sequence=SeqID_142; Location=17273..17683; Strand=-; Gene=SeqID_74441
tttggccaaagcccgcccggaaataaaaagattggcgacaaactggtgccgttagcaggggctttctgcaaacgtcggcaaagcatcagtcgagagttttggtcgccgaggaccaacagcacaacgaagagaagctaacggcaaactggtgccgttagcaggggcatctgcaacgacaaatcgatcggtcaggcaaagaccagagacttcaaattcgagaagctaacggcaaactggtgccgttagcagggggcaactgcagccaccaacaatcggtctacgagcgaccaatcggtctacgagcgaccaacgagcacgaattcgagaagctaacggcaaactggtgccgttagcagggggctccagcgaaacatctcggtcgacgaacggaacaggcggaaacgaaaaatg

SEQ ID NO: 111510 - DNA, 1003 bp, Heterodera glycines
  Promoter: Source sequence=SeqID_7724; Location=1579..2581; Strand=-; Gene=SeqID_65751
atggagggacggacgcgcgtacagttattgcggaccggcaacgccaagtggggacccattgttggggagaagtgcgacgccatcgccgctggaaaaaaagtcagacgaacggacgacgacaaattaataaccctttcaaatttagcacacttttcgaacatcaaacaatgaaaaacgaaaatggcttcgaattcccattgaaacaaacgaaagaaaggcggcaaagataatatgaaaaagtcgtttaattaattatttattatttgtttttattttgcttattttttatttttatacgattttgtccaaatacagaaaatccttcgcaataaatggacggtaaacttcattcgtatttgcaacaggaggggatgctaccaggattaagcttttcagcggaatcaaaaattattaaaaatgctttaaaattgaagtaaaaatacttagcaatttgcacttaaatcttataaaagtggttttgtgagttgttggctccgggccgtcaagtacatatctacacacatattagtacataatatacagattaatacataatatagacaatttcggacaagtaaatgagtttcttctgacatctttgccctaatttgacgtttcctctcgcccattcttcagctctgttggggcccatccgattcgttatccctgcgcatcgcggtatttccacgcatctgtcggcgccccggacccatctctgacaaagtggcgcggtctccacgctggacggtcccgtcgttcgcgctccgtctcctcctcccgctggcgttgttggaagtgctgtttaactaagcgggggaaaatcttaattactccatccatgcaatttgacccttttttcaaaacgcactttgagtcgccagctgtgtgttgttagtgtacagtgcggcagtgagatgacgccacagttttcggctcttattgtcctcctgctgcatcaccggaacacactcctgccaaaaaaataataaattcagctggaatg

SEQ ID NO: 111511 - DNA, 560 bp, Heterodera glycines
  Promoter: Source sequence=SeqID_10108; Location=542..1101; Strand=+; Gene=SeqID_73191
aaaaggcagttacaagccattacggcgctaataaccttatcgttcccatttttaaaaatatgcattatttatttatttaatttcgttgtaaaattgataaaattaattttgaatattgaaatgctgtttaaaggaggtcatgtgaaaagggtacagattattcagaagttttatgcgccgcaaaaaaattgttaaaaatctgatttgttcatcctaaatggcactcacaaaaaattggaaagggtaaaaaaaaattttttttcccgaatattgtcccaaatttgctgtaacaaaactataagttcaaaaattgaagacaggtaactttttttatagagcacgaaaaatgtgaaaaaaattcagctcaatgtgactttttgtgctgatcaaaaaagtcaattgtaccacaatgatcagatcactccttcagggtggtctgaaaccctaaaatggcttgaaaccgtgaaaattttgtaaaaaaaatcctagtgggttggataaaatttttcgtataagatgaatataacagacagaaagagcgcaaattttgctacaaaatg

SEQ ID NO: 111512 - DNA, 823 bp, Heterodera glycines
  Promoter: Source sequence=SeqID_5668; Location=1909..2731; Strand=-; Gene=SeqID_58844
gggcccgcccacattttcgccggccattttggcgccaaacgttataacattttgattttgtgatcaaaattaaagaagcgtggtatgaagtgaccgtcccctcacccttgaaaaagaaaataattatattgtaattaagagaaaccgacttttgttcgtgaaaattttaattttcggggggagtttgcacgtgccccactcccctccctggataaatggcctgcagcgttgctttccgtgtcagcgacaaatttggtcaagcttgtcgtacatcggttccgccgctaaacaaattgttttgaagctttctagcgttatttgaaattttatggtattttttcaaaattttttttgtcaagaattgctttttaatgtggaggggtggttcgacaggggaaatgaagtgcacccccagcaaaccaactacggctagtgatttctgccaaccacagagagacggcaagttgggattacatcatatgaacaatttaaaattgtatcaagttgcttccgcccctttagaaggggatcgagccatttccctgtggccgtttccctatggccatttccctgtggccgtttccctataggccatttccctatggccgtttccctatcaaaaaatttacgaaaatttcaggcaaaaattgcaatatacacaggggaatttaagcggttggatgcttatcatgattacaagtaaatctagataagaagacaaaatttaagaaaaaattcataattttttctggcaattttataaaacaaaatttttaaaatgaaaattgaattttataaaaaaactgtagtctgtgcaaaaatg

SEQ ID NO: 111513 - DNA, 168 bp, Heterodera glycines
  misc_feature (15)..(15): n is a, c, g, or t
  Promoter: Source sequence=SeqID_32428; Location=1889..2056; Strand=-; Gene=SeqID_62736
atttggatttttttntggcttaccaaaacttcatcgaacctgtgttctttctattctctttcaaatcgccccaaatttttttcacagcttaactaggccctattaagcttatttccagaaaatctcgcatgaattctcatttttaaattttttatagatttttaaatg

SEQ ID NO: 111514 - DNA, 71 bp, Heterodera glycines
  Promoter: Source sequence=SeqID_15341; Location=888..958; Strand=-; Gene=SeqID_79599
tttccaacggaattggaattcttcgatgttgcgcaacgcaaaacggcgtgagaagaaggaggaggacaatg

SEQ ID NO: 111515 - DNA, 667 bp, Heterodera glycines
  misc_feature (54)..(54): n is a, c, g, or t
  Promoter: Source sequence=SeqID_2357; Location=1820..2486; Strand=-; Gene=SeqID_79311
agtggaaaatacctgagtatagaatttattttcagaaagtgtcaacagactttntggaaaaatatatttgcaatttatcaacaattttgagaagtgagttagaaatgataaacttcacgattcaaaccagttttcggtgctctaattaaccgcgataaaaacatccgaatcaattaaaaagcttctgagataataaggtttatcataaaatttcatttaaaaataaaccctcaattattggtatgaacgatactttccaaacatgcacgcgttttgcgctcgagctatttatcatcgggcttgtcaatccaaagcgaaataacaaagattgtgttttgaacgaataaagggcataggttattttgaagaagtgtcaaagaacatgcagcaataagcctgcaaaatctaataagtggaaaatacatgagtatagaatttattttcagaaagtgtcaacagacttttggaatatatatttgcaatttatcaacaattttgagaagtgagttagaaacttcacgattcaaaccaattttcgttgctctaattaaccgcgataaaaacatccgaatcaattaaatagcttctgagataataaggtttatcataaaatttcatttaaaaataaaccctcaattattggtatgaacgatactttccaaacatg

SEQ ID NO: 111516 - DNA, 846 bp, Heterodera glycines
  Promoter: Source sequence=SeqID_11373; Location=2384..3229; Strand=-; Gene=SeqID_74762
ttgatcagggccattttctacatatccgttgggtttcagtcggtttctgacaacaaatttccctctcctataatcacaaaacatggattttgtttcccctaatgcagcacgggctccctcccctattttgatctaataaatttgctatttttatgtattacataccaattcaacattgtattatttaaatattttttatcatgatattaaaaaatggcgctgctgattaatgagaattgataatataaacacacgaatttatgttgtatatttaaatatctattcaattttttttactaaatttaattttgtagagttcttacccaataaaaatgaatgatgaatacataaattggattttcaatatttcattcattcatttctattcttgaaactcttacaccacagagaaaatctttttttgattttaatttaaaatcctttttttgagtgtcatggaggaggaagcaacttttgttccgtctccgcccacccaattgtcagccggaccaaccttcttcagtcgggctaaggtcctccctccattttgggaaaacaaaaagcaatggcctaaacacgctttcgatttagtttatttcccaaattcggagttaaatcggccattttcgaattcccgaacccaaaactccttaaaaaagaaagttcattaaaattcgtaaacatcattatttgaaatttcccatgtgtagttttgttaatttctcgaatttgcgtaattttgtctcgtattcctacaattttttgtgtttggaatgagggaggggttctaaatgcaacaattagaaatatcaaaaaattgcttacttttctttcccatccctcatg

SEQ ID NO: 111517 - DNA, 295 bp, Heterodera glycines
  Promoter: Source sequence=SeqID_9463; Location=2698..2992; Strand=-; Gene=SeqID_46760
tagtctggccggtttagtctggccggtttagtctgaggggacgttttagtctggcagtcgtaatatttgccgcctatcctttgccatgacacctaacaattctcattcgtaatcccaaattccctgtttattttggcctctttccataacttatccccataatgtcttctctgatatccaatttcctcaaaaattgctgccccctatgagtccgattcacccaattttatgagttagtcctaacaataaccgtttttaaagattaataaacgtattatttttctgtctcaacatg

SEQ ID NO: 111518 - DNA, 73 bp, Heterodera glycines
  Promoter: Source sequence=SeqID_7258; Location=2619..2691; Strand=-; Gene=SeqID_64274
atttttcaaattaacaaattttcagcgaacaaacgaccaacgtccaatttctgaaacgaccattccccaaatg

SEQ ID NO: 111519 - DNA, 195 bp, Heterodera glycines
  Promoter: Source sequence=SeqID_26651; Location=979..1173; Strand=-; Gene=SeqID_57406
tcggagcgaaagtcgagaacgcgatgacgggtttcgaattttattgtttttaaataaacggagtgaggggacacaatcttggcaagacttggtgtatcagtccaataagtggcatgaatttttgccaaaagaagggctggcaaccggccgaattttacaagattgcccaaacttttgtaatagtcctcaaatatg

SEQ ID NO: 111520 - DNA, 83 bp, Heterodera glycines
  misc_feature (38)..(38): n is a, c, g, or t
  Promoter: Source sequence=SeqID_21539; Location=1..83; Strand=+; Gene= SeqID_45660
cgatgccgttcaactacgttgtgtgagagtcttgttcnaatctaatatcgggattcactttcatatgtttccatttcagcatg

SEQ ID NO: 111521 - DNA, 61 bp, Heterodera glycines
  Promoter: Source sequence=SeqID_22310; Location=678..738; Strand=-; Gene=SeqID_52983
ttagtcccccccgaaaaaataattccattcgcttttttgccggtcattccgttggccaatg

SEQ ID NO: 111522 - DNA, 298 bp, Heterodera glycines
  Promoter: Source sequence=SeqID_44165; Location=1..298; Strand=+; Gene=SeqID_71696
aaattattgcgcgtaattgtcagggtttccgcgcgaatcccgaaaaactgaatctcgagtcgcaaaagccgacatttttctcgccctgaatcccacccgaccatttttctcgattcgcggcacaaccaatgcccaataatgccaaagaaaatttaaaaatgcattctgtttgtttgtgtgaggataaatagtgccgaaaaggcgatggtggcgattagctaatttatttttgatttttattatatcttacggatgtctctatttttatttatcatttatttaattttccagcaggatg

SEQ ID NO: 111523 - DNA, 485 bp, Heterodera glycines
  misc_feature (57)..(57): n is a, c, g, or t
  Promoter: Source sequence=SeqID_11998; Location=1521..2005; Strand=-; Gene=SeqID_75520
ggaaatgtgcaagtgacacattttgggagggtaaaatgccattaaagtgtggggggnggggggggataaattgggtgggggggggcgacaagcacaggttaaggctaacaattaagcgacattctgatgagtgggggaaatccgttatcacatggattccatttttggcattcttttttcttggaagattggtttggatatcctttttggactaatgcctttctttgccaattctatgcaaacatttttaggatttctgaaatttttttttcagaaaattcaattaaaaaccgaaaatgctcaacaaagaatttaacttaaaaagcatttcctgaatgtgatttcgattgaaccaaaataaaattttatttttattgcctattttggtttttttattattttttaatcgtcgtttttttgatttaatgcccaataaaaacaaaaaaccaaataaatattttttttatttttcatagcaaattatg

SEQ ID NO: 111524 - DNA, 86 bp, Heterodera glycines
  Promoter: Source sequence=SeqID_21241; Location=136..221; Strand=+; Gene=SeqID_51834
ggtaaagccaaacaacaaaaaagcataagccgtgtcccccgttcatttgtgtctttccatttcatacgggtgttctgctggtgatg

SEQ ID NO: 111525 - DNA, 190 bp, Heterodera glycines
  Promoter: Source sequence=SeqID_13151; Location=1753..1942; Strand=-; Gene=SeqID_76964
ttttttatcaacagagatatttggggctttttttaaaaaaatcatttaattaataaatttgttttactgaactaataaaaataacttatattttacatttgcattataaaaacttctacttataagaagacattggatcgcccacactgagtttttttttggatcgcccacaattgttagctcaatcatg

SEQ ID NO: 111526 - DNA, 166 bp, Heterodera glycines
  misc_feature (159)..(159): n is a, c, g, or t
  Promoter: Source sequence=SeqID_31527; Location=1..166; Strand=+; Gene=SeqID_61856
gccgtgtcggctctgcacaaacggccggtcgccagcgaacacagagcgcacagcactgtgccggacccggaactgccctcaatccgccgtccatttggcctccattggacggtcacattgttctcgtcgaagaaattatggccggcgacggacaccaancgttatg

SEQ ID NO: 111527 - DNA, 69 bp, Heterodera glycines
  Promoter: Source sequence=SeqID_3600; Location=2027..2095; Strand=-; Gene=SeqID_51046
agatggggaagacaaggtcagcccggagaagacgggttggacgtacaactccaaccggaggccgacatg

SEQ ID NO: 111528 - DNA, 200 bp, Heterodera glycines
  Promoter: Source sequence=SeqID_28110; Location=390..589; Strand=-; Gene=SeqID_46088
aaatattaaattaggtaatgacataaggccataaaaatttcatgaataattttacaaattctggggttcgaatccgcttggctgcggattattttttatgaatctaagttcatatttttttcgggaccacaattctacataattgcctttttatcctttttatgttatttgaataacttccttttaaaacacttataatg

SEQ ID NO: 111529 - DNA, 304 bp, Heterodera glycines
  Promoter: Source sequence=SeqID_24858; Location=304..607; Strand=+; Gene=SeqID_55603
attaaggcaaaattgaataacaaaatccccaaataagcatatttacataaaaaacattttcaggtgctcgtggtcacttcagtggcggaagaaggttattaattagcaatcgtttttgagcgattttattttgaataattttacctttgttaggtgtgaacatccccgcttgtaatttgatcatccggtgagttttaaatgctcatacattaaatgggggggagggctggtcaacacccctgacttcgttcgtatgaggggccgaaaaagggggggggggacttcaattggttgggataaaatg

SEQ ID NO: 111530 - DNA, 668 bp, Heterodera glycines
  Promoter: Source sequence=SeqID_5977; Location=1..668; Strand=+; Gene= SeqID_59884
agaaatggggagaaccagcgcgaaaaacgacaatacgacccataccaaaaatggaccgaatccccgatcaaaatcgcattcaacaaaacagctcgtaataatcttgccacatcatacagtatttgaacaaatgttttaagtgcctgaaaattatgacctctggggcaatgccatcagagctggagcaaaattaattatgtatgaaatgatgggttgaattttttgtatttgagaatgatctttttaagtttggttgatttcggagcgtttgtcggggtttcagcagagttttttatacaaaaaatggggggggggaatggaaagccgggagttatgaggaccagtgatgccgcgggttgagaaaaatttcaggttcgggtttcgggtcgggcactcgaaaaatttcgagttcgggtttcgggttgagaaaaacttcgggtctcgggtttcgggttcgggttggcatcactgatgaggacgcaaacccgaaagctcaattaagcaaaagcgacaaaaagtgccagaataaagtggacagacagtgaatgctgcgaatttttaaaattttcattttccaaaaaagcaaaaaatgcatatttttaaaattcatttctctttctataaacagggaagtcacctgtgttcggtttgaaattgttgatgaaatg

SEQ ID NO: 111531 - DNA, 156 bp, Heterodera glycines
  Promoter: Source sequence=SeqID_20718; Location=1865..2020; Strand=-; Gene=SeqID_51274
attttttggacaaatcggaacaaaaaagccatagttttgttggtacaaaagttaacaattaaaattggcatttttccggatgttggcacttttctcccccactcactttgtctccgtcaatggcacgcagtgggcccacctccgtgttgttgaatg

SEQ ID NO: 111532 - DNA, 1003 bp, Heterodera glycines
  Promoter: Source sequence=SeqID_2747; Location=1463..2465; Strand=+; Gene=SeqID_81386
ggatgcgcgagtgggtcaacagtgggcttcactgccgaaaaccttaagaaatttttgatttacaattacaaaaacaaccgataaaatttatggggaataaaattttttaattgatttgcatatttggtgcatattttgcgatttttgcgcatatttggtgcgtatttcacgactttatttgcatatttatgcgcatattttggacattttttgtgaatatttttgacagccctggttataatataaaatccgccgccacctttggcgtttcgtctaaaattcgccaccacgtaaaattactttcctgcaaaacattgttgaatttattgttgctacttaacaatattggtttcttgattgtgtgcttttattgttaaataacttaccagggctgccaagtgtccttatttgtaagatttgtccttatttggaggggccagctcttagaaattaaaaatgtccttttttctaagatttgtccttattttggcacgacctccttgaatttgccctttgtgtcgtctgcaacgatgatattaatctcctttccattgggaaagctgccatttctcatcatcaaaaaactgaaaaaatcagaaaacggcaaaagcagcaaaccgatcgattccgttgcaggaatttttgccaaatacttcggccccatcaactgaagatcgaaaaattcttgccgcggagggtaaggcattcaaaatcaacaaaaaaaaaaaattcctctctcacaatgagcctgggcttatcacaccgcgcagcactcccattctttcaattccgttgattgtgtgtcttcttctggactgttccgaacaatttttccggattcggcaattgcgaaaaaattcagttgtgctcgtataaaaacagcaaaaattttgacaggtagaagaattaaaatagatttctttcaggttaaacaaccaaattagattttattttattaatttcagcaggaaaaaacattttaccggaacttttgtcagaaatg

SEQ ID NO: 111533 - DNA, 244 bp, Heterodera glycines
  Promoter: Source sequence=SeqID_31699; Location=968..1211; Strand=-; Gene=SeqID_62004
atatttaaaaagcaattaaaaatttttagatttttattcttctccctttttgatagtgaaagcatctgagtgcctaaaataacttgtaaataaaatttggtgcgtttcagagcagtttgtgaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 111534 - DNA, 982 bp, Heterodera glycines
  Promoter: Source sequence=SeqID_29077; Location=387..1368; Strand=-; Gene=SeqID_59638
ttgttgaatttttctttttttaaaattaatttatgacataaatttatttttctactttgattcggtttcccctctgctgctcttttgaagaatcaattttgctgctggtagcaaattgtcgcgcagcagtgccaaaaatgggccgcactaattgcaatgctccgctgataagctcatcaaatggggcttaatttggcaatttaataattcgtaatgattaaatttaattgataataataataattattattgtataccttgtcttttttgcggttttccttcatcattagccgttgtgcaaggaattgtaaaataaattgtaaaaaaaaattttaataattttaacttcatccggaaaacctgaaaagggaatttcatacaatttatatatgggtttttcccttgttttttgagagattgtaaaagcaccaaaatttcttaggatctgccaggtaaattttgaaatttagttattttaacagatcttcataaatggccaactttttgggccgaaaatttgcttttattggtggggtgaatggcggtgcgataggcgtttccgtgtaaaatttttggaatttttaaggaattggttaagataattagcaaatgaaaaagtaaattgtatttgaatgtgcaagatcttaattagaaaatggtgtattcgaaaaatgtaatgactcaaatcacgcgggatcccatgggattggcaaaatggtagggaaggataggcgactcgggatctcattgaatttaaaagggttcgggatggatcccgagggcgggatcccgatacaatcccgcgggataccgatcccgtccggcagaattggttctttcctgacgcaaattaaaattatcaaaatttgaatggttccaagaaaatcaattaatggaaaattcgtcaatggacaatcaatcaaaataattattttctttagtttgatttttgcgaaaaaagtatttgacgaattgtccaatg

SEQ ID NO: 111535 - DNA, 557 bp, Heterodera glycines
  misc_feature (8)..(8): n is a, c, g, or t
  misc_feature (21)..(21): n is a, c, g, or t
  misc_feature (71)..(72): n is a, c, g, or t
  misc_feature (87)..(87): n is a, c, g, or t
  Promoter: Source sequence=SeqID_39606; Location=699..1255; Strand=-; Gene=SeqID_68133
actgtttnttgcttggcgtgntgctaatgcaaatttgttcattgatccacaaatacaacaaaaatgcatcnncaattcataagaatntaaaggtgaaagtttcttttatttctatggattatacggtaaaaacgaactcgtactgttattcgacaaaaaaatcgtcaattttctcatgtttcaaaaaaaagatgacaaaaattgttaaaaaaaatttcgtctttatcttttttgaaacaagatcaaatttttttgaaaaagcaatgaaagattaacattaatggctatcgaaagatgcaaaaaaaaatgtttgaaatttttcatgaaaaattgtttttaacccaaatttttgaatatttaaatacataattattttttaagcttctacttgtcaacaccatcattctttacattattaattcactggtttggattgtcttctttttacgatatcgggtaatcccaaagcttttttaaaaatttaaatgaatgcaaattaaaaatgcagggattttaaaaataattttaatttttaaatgcttattcagattcaaatg

SEQ ID NO: 111536 - DNA, 539 bp, Heterodera glycines
  Promoter: Source sequence=SeqID_9198; Location=1..539; Strand=+; Gene= SeqID_70566
tgtttaaattctaattttgtaggtttattgaagccaataacaggggaaaataggcaaataacgctcataggacttccacttaacgtgattacgaaaccaaaaacgctgatgaaatgaatcgccggacgaaacgggtcagttgcgtctggccagttgcgtctggccaattgcgtctggccagttgcgtctggggccagttgcgtcttggccagttgcgtctggccaatttcgtctggccaattgcgtctggccggttgcgtcttagtacttatggggccggttgcgtctcaaacatttggtttggaaaaataattttttttgatttatccgaaggcgcaaatattaataattttttttcttaaaactcatacgtatgaaaaagttacaagcattttttgagaaataaaaaaaaatacggggttaactaattcggagtgaaattgtgcggggtggaaacatagtgcacccatatcagaaaattgtttttgcatttttatacatttcatttgttttaaatcttttaatatagcccgaaaatg

SEQ ID NO: 111537 - DNA, 624 bp, Heterodera glycines
  Promoter: Source sequence=SeqID_1792; Location=2008..2631; Strand=+; Gene=SeqID_75996
aacttctaatatatatatatatatatatatttatatacataatcatatgagttggcggttttaagaaacgcccaaagtggcggttttaagaaacgcccaatgtggcggttttaagaaacgcccaaagtggcggttttaagaaacgtcccagcaccatatttaatataattttattctattttattttcagaataataaatcataaaatagctctaatttaatctatttaatttatcttggtattgagcgatagcccaagttatactctgccatttatgaaattttaaaaaatttacgaaacatttacaaaaacctataatcaaaaaatttagataaaataatttgtcactaccttttttcaaacttcaaaaaaaaaattttgaaatttaattgaataatagaaaaatcttttctccgtttaattatataaagaaacttaaatttggttgcacaaggtatgatttattattaagtaaattaaatttaaatattaattaatttaatattattatcattgatacgtttttaagttcgacctagcacccttaaaaactaaaaattttggaggaattttaattttacttaataaaagtgtaaattggatagtttcagaatcacgatatg

SEQ ID NO: 111538 - DNA, 401 bp, Heterodera glycines
  Promoter: Source sequence=SeqID_13025; Location=395..795; Strand=+; Gene=SeqID_76802
aaagacataacgaatcgtcataaatatcgccaccgtattttaacactgaatttgtgttctagatttccatttaattttcttagaaaatgtttgtgttcttttatcaatttcctgagttttcataagaaatacacagtacgctctctcctaagtattttgcgttgttttgtttacattcaaaagacatatcttcattttttgattcttttttattatggtgttactcggagtcgttatgaatgttctttgttttctcgtttggcttttcctttttttggagttttctttggcgcttgaggcgcctttgtgggttattcaggtcgttgttctcttactttttgcaaaatttccgacaattttagcggaagcgggatttgtatgagcgcaattccgtatgcatg

SEQ ID NO: 111539 - DNA, 568 bp, Heterodera glycines
  Promoter: Source sequence=SeqID_11128; Location=1..568; Strand=+; Gene=SeqID_74468
acagacttgaaaaattagaaaataaatcggataatttttgttactgtacagggagttctcctcgtggattcgtacgtttgttccccattttcctttccatcgcttcgttttcagctcttctctcgcggattctcccctccgacactttcaaaatttacaaaaaagggcatcgccttcgctttgacttttcgcttgtcgattttaacaacaatggcccattgccaaaatggtatgtcggaaaaatgattacttttaccacttttttatatattttttgtttgttttctaagggaacgtggcgatgtgtctttgcttttggacattttgtcaaccgatggacgaaaggcggtgctaatggacaatcggaagagggtcagcagttggatagtgattttcagcataaccaaatgggactttgaatgattacaggtttaccaagtgttgcgggaaaagaaccaaaatctgagcgatgaattggacttgctgatgacgtcggacatcaccaagttggccatggccaaacgacgccctaaaatattggctaattttgtatttcagcactcacatg

SEQ ID NO: 111540 - DNA, 598 bp, Heterodera glycines
  misc_feature (23)..(23): n is a, c, g, or t
  Promoter: Source sequence=SeqID_19130; Location=167..764; Strand=+; Gene=SeqID_83872
acttggttaagaattaaaaaatntagcctattaaaatatttagaaatttttttattatattgtatattttttgaaaaatttccgatttctcagccccttttaatgcatcccgccagcccctaaaaatttatttttcagcattttttgatttttggaaattttttgaatttaattgaaattttttcgaattttccaaaatcccgcaatcccgcacgggatcccgcaaattttaaatgcgggatttgcgggattaatcccgcgggatcccgtcccgcaaagaattttgagttccagtcccgcagcgggatccgcaaatttgaaatttccggtctctagtttatatggttgccaagtgaggaaaataattgtgtaaattagtagtaatctgtgaattttgttaaaaattgcattttcgatttattgttcgggtccgtggtcagaatgattgtgtcataattggattatccaatcgcgaacagcccaaaagtcaacttcaactcgaaaataattttaattttttttctaaaaacagggaccgaccaccaccttaactattacccagatttttaattatatttttagaaacaggaggccaatg

SEQ ID NO: 111541 - DNA, 563 bp, Heterodera glycines
  Promoter: Source sequence=SeqID_26093; Location=250..812; Strand=-; Gene=SeqID_56838
tttttacattatcaactctaactccttaaatacttttctaatgggatttatcccttgcccgataaatagcaaactcattctcaataataatgtcagatatttcggatcatgattgtggttttttaaatttatattcataaaaaaattctttaaaaaaagttgtgcagaaacttatgttacaccctaagtaatagaggtaatggcgtagccaaacttttggctttaatgggaggggaaggaggaaactcaactcaaaaggacgagccaaaataagaaaacccaccgggaaaaataaataaaaaaagaattgaaaaaattaacaaactcccggaaaggaaaaaaaatttgtaaaacaattgacagaagtcaattaacgcattgactaacccgaaaaggggacaaacaaatcatatgtactccatttttaaaaattatctgtattgtcgaaatcacctggcatggcgtcttctgttttttacgcctttattgctcaaatgaatttttcatgctgaatttattctgaattacttattgttaaccatatatttttttcaggaaaaatg

SEQ ID NO: 111542 - DNA, 222 bp, Heterodera glycines
  Promoter: Source sequence=SeqID_6738; Location=1..222; Strand=+; Gene= SeqID_46303
ttcttttgattctagaggctcctttgtgctttttactaccaccgattttaagcatacctatgcttttaacttgcattttatcttcttttcttaaaaaaaatttttgtcacaaaaatgcttctttttttgtttttaatttgtgtgttttcccctttttattttcgaaaatttcttggttaattaactaaatctcgaaattttatattaactgtctctaatatg

SEQ ID NO: 111543 - DNA, 550 bp, Heterodera glycines
  Promoter: Source sequence=SeqID_3956; Location=1577..2126; Strand=-; Gene=SeqID_52577
cctaaaaaattggcagtgatgagaaaaatcggcttttatatggtttgtcgcccataattttttcgaaaaaattacaattttgaagaattggatagaatacctttttttaggtttttgggtgtcgctaatcacgaatccagcctacatttcagagattcaattcgaattcggggctcgaacttcccaggactcaaactgactttatatttttaaaatattttatggttttgacggtttttaaaaaaattttcgcctaaaatttattgatttcttcgttgaaaattcttttcgcccttttttgttttattttatgttcatatttttcatttaagcattccaaaaaccgtcattttatctgcgtatttatatacttattgattgtggttttgtttctcatacaaattttacttctcatacatacgagtatcaatcatttccaagcgataaatgatgaatagggttgtaaattatatggattaaaaaacgctaaatatggacataaaatatggactaaaaaagcccgaaatatggactaaaaagctcgaaaatg

SEQ ID NO: 111544 - DNA, 568 bp, Heterodera glycines
  misc_feature (19)..(19): n is a, c, g, or t
  Promoter: Source sequence=SeqID_25245; Location=724..1291; Strand=-; Gene=SeqID_55988
ttagaatttgcgaatttantggtttttcatggtgttagctcccaccaaagatagtacgccaaaacgagagaaaaagaaatgcatcttgtatgttttattttgttacttttgaactaacagatagaatcaaaaaataacagatgaatcgatgcagaatttttttctctatcgatatgcaaaatttggggtggatttaacgtgtagaaaaaaagttaaacgtagcgaagtgaatgttgttttttacataattaaaaagaagagatagtacgccaaagtgagagaaattacaaagaaaaagagaaacgacgagatagtactaggcttttctctgcacagtggggcgtacccatagtgtataaaagttatcgtagaagtttcaaaccaagtcaagccccaataatcgtaaagtttggtttaattgcaattatggttattatacgaaattcctaaattaaattgtataattcgaaagcactatttgacccccaccgcattttccaattaaaacaacgactactttaatagtgtataatttttagcaaacattcaaatacttttatgaattatg

SEQ ID NO: 111545 - DNA, 97 bp, Heterodera glycines
  Promoter: Source sequence=SeqID_35810; Location=324..420; Strand=+; Gene=SeqID_65279
tcagcgcctctgcagtcctcactcccgaaaggacagagaagggcacggggcaccgactacgagcagcagcacaaacaacagcgaaaggaccacaatg

SEQ ID NO: 111546 - DNA, 274 bp, Heterodera glycines
  misc_feature (27)..(27): n is a, c, g, or t
  Promoter: Source sequence=SeqID_30979; Location=1..274; Strand=+; Gene=SeqID_61333
attttgcacgaatatttgtgcagaganatacgttgggattcacacaaagaagccaaaatttgtgcttaaaaataaaattgaaattgaaggaccaataatttatgcgctgagttgtttggccaatattttatatttttttcacagaggagaaattaatgcatataaattaaataatttgttctatttttctcataatttaatattgttgaatgatgagaaattgaattatgaagtgaaattggtaaatgaatcaaaattgccaattaatgaaatg

SEQ ID NO: 111547 - DNA, 169 bp, Heterodera glycines
  misc_feature (19)..(19): n is a, c, g, or t
  misc_feature (34)..(35): n is a, c, g, or t
  misc_feature (42)..(42): n is a, c, g, or t
  Promoter: Source sequence=SeqID_13571; Location=1..169; Strand=+; Gene=SeqID_77472
aggggcaggaaactcgaancaacagacgcgtgtnngatgacnagaggacaatcccaccgtagccacccttctgttggaaaaagggaacttcgaacaattagcactgctaattaatcaaaggacaatcctcttttacaaacagttagctgggatacaaggccagaaaatg

SEQ ID NO: 111548 - DNA, 225 bp, Heterodera glycines
  Promoter: Source sequence=SeqID_14278; Location=1775..1999; Strand=-; Gene=SeqID_78293
tgtgagtttgtccctgtcggcaatattagatcaatttgccttcattttgccattttaccgtgccaatttcccctctaagtgttaatctgtgtcattctgctggtgccggtgatcgccaatcgcttcttttggttcgacacccatccctcctattctgatcgccttcgggtccgtcatcgcttttgcatggaaccatcggacaaagcgccgacggcggaagcgatg

SEQ ID NO: 111549 - DNA, 305 bp, Heterodera glycines
  Promoter: Source sequence=SeqID_38886; Location=1..305; Strand=+; Gene=SeqID_67583
cttggaaaagtagagaaaaatagacatagtcgaaatagtggagtagtttgtgcgaccagtgcagaaggcggagatgctagggcagcgaaaaaagacgatctctgagggaggggggggggggagtgatcagagaaaggaaggacaaaatcagcctctgatcacattgagaagagtgaatcactcactaatgagccaaagatattttggtggataagcgaatattaattagtcaattaattattaattttgctttggataattgacccatagattggtgattttgtgacctgagctgaggccaaatg

SEQ ID NO: 111550 - DNA, 623 bp, Heterodera glycines
  Promoter: Source sequence=SeqID_9032; Location=1..623; Strand=+; Gene= SeqID_70056
tccccaaatgtcgggatccccaaatgtcggaatgcctaagtgtcggatccccaaaagtcgggattgtcgggtccccaaatgtcgggatccccaaaagtcgggtccccaaatgtcgcgtccccaagctacaaatccccaaaagacgcaccacgcttccataaaggaataggaaaaagtgcaatgcgatttcttaaatgagagcactcaccattatttaccaattctatactacccttattcaatgaaatttacaataaatcacctaaattcaatgcctcgatacgatcccgtatccaggcatctgcgcgccctcccatgttttctccattttgatcaatgatcggctcttcttcttcaacaattcgtcggggccaatccaagtgtttacaaaatatatgacgagttctttaaagtttttcatataggacgcattaatttaatcccaaattcccagctttttcatattgatttaccttgcaattcagcagttggttccaaagttgacatcaatgcacaaaaataattgtacacatagtgatctggcacaaatggccttgatttaaaaaaaaaataaaaattatagtctcattaaaacggaaaagggccttttttccacaaaaatg

SEQ ID NO: 111551 - DNA, 123 bp, Heterodera glycines
  Promoter: Source sequence=SeqID_6603; Location=1..123; Strand=+; Gene= SeqID_62162
aagggctatcgtagataccaagattgtgcaatttggttgcgtctgagaaaagttatgagttgatttagtcaaaaatttagcaaattttgcactttttgtccatcggccaaccacgaaaaaatg

SEQ ID NO: 111552 - DNA, 179 bp, Heterodera glycines
  Promoter: Source sequence=SeqID_6393; Location=2219..2397; Strand=+; Gene=SeqID_61386
tctcgtcgagcagttcaagtcgtttctaagcacttattatatttatgtgtttttcgtttttgaaataaaaattcatttaaattgatttgcaaatcaatgaaatccttacaaaaatttctaaaattttattgaagttttaaaagcactaattactgattaatttacagtttttgccaatg

SEQ ID NO: 111553 - DNA, 51 bp, Heterodera glycines
  Promoter: Source sequence=SeqID_42475; Location=1401..1451; Strand=-; Gene=SeqID_70358
cgcgtccgttcctcttgcgtgatcagtcaccgacgccgcgacgcgtcaatg

SEQ ID NO: 111554 - DNA, 115 bp, Heterodera glycines
  Promoter: Source sequence=SeqID_12761; Location=1306..1420; Strand=-; Gene=SeqID_76469
attcaaaatccaaagaattgttaagtgataaatgattacttttctgatacattgaccattccgtcatcgaatttcttcgttcaacaagcaaatttttgacaaaggcatcaatatg

SEQ ID NO: 111555 - DNA, 336 bp, Heterodera glycines
  Promoter: Source sequence=SeqID_41651; Location=1..336; Strand=+; Gene=SeqID_69735
gttaacaaaaatgcaataacttcctaaaatacacccctaagaatcgaccgaaaatttttaaaatcacaccactaagaattggaaattttcttaaaatatttgaatatttatgtgcatattttggtcatttttcgtgcatatttttgcagccctgcctatgacaaatacttcgcacagtttagcagttacaaattttcctaattttatccaacgattcttttgaaaattaatgaaaatataaacatgagttttggtgacaaactctaattttggtattaaaaaagtttgttgattaaaagtgaaaataaaaacaattgggtttattgcttaattatg

SEQ ID NO: 111556 - DNA, 170 bp, Heterodera glycines
  Promoter: Source sequence=SeqID_35090; Location=1..170; Strand=+; Gene=SeqID_64729
ctgtttttctcgacagttaaaaattggggcaaaagcacaataatgacaaatttcttgccattttggtgccgcgtgcaatactttttttttggcactgagtgaaattttttgtgatttttgacagctaaatacagtgcatgtaatagtgattaaaaaacaaaataaatatg

SEQ ID NO: 111557 - DNA, 1003 bp, Heterodera glycines
  Promoter: Source sequence=SeqID_9427; Location=1468..2470; Strand=+; Gene=SeqID_71373
accaaaacctattggaccactttgaagctgccgcctgccaaatccgatttcccaaattgttgcgggtgtttttttcccgcgccgcgcagcgccgcgggaaggtcatcaatcatccacctgtcaccaaaagtgacaggtgaaggaaattcttttgccaattaattcctttttgatcccaaaccttttggggtattttctcaaatcctgagattttttatatgattttttatcctgaaattaaaactcattttgaaaatttgccaatgtgcgtttttttttttttttgcatttcctcaacgccctccctccccgcgcacgatgccgccgccgcgcaaattaatcaataatggaattgtagaagtgtaaatttaattaataattgcagcaaaataattcagataaataaattaatgaattgggcaataaaattaactatttaaatataaattgaaaatgaataataaaataggatgggaaaaaaactttcaaaagtaggtcatctgccaataaatttgattgatggtttttccattatttagcaatctgaactgactttttttttttgtttttttttcatccaaatatttcgcaatatgagaccaatatttttgaaaacctgtcaccaaaaaatgattgatggttttcttatttaaatttaaccattatttttagttttttggtcaaagtatttcgcaatagggcccctaattttgcacttgtcaccaaaaaatgattgattggtctcttatttcacaatttccccgttcatttcgccatatgcacgtgacttttttgtttttttttgttcccaatatttcgcaatctggaccaaaattaggtaacctgtcaatcaaaatattgacaggtccaattttgcacatcactcgtctcgtataaaagccgccccaaattcacccccaatcagttcaaccaaaaagttggatttttgctaaaataaaattgtgcgtaaatatttagaaattattaaatattattaaaaatg

SEQ ID NO: 111558 - DNA, 772 bp, Heterodera glycines
  Promoter: Source sequence=SeqID_26414; Location=1..772; Strand=+; Gene=SeqID_57146
tcaaggcgatacactcattgtaccatcaggtgtgattatacacccaaattaaattccattaaataacataaaataatctaaatttataaaaattaatgttttaattgctttttaaatgatgtagaaattccttcatttttattaaatgtaataaataacggatttattccacagcaaaaatctatttccattaaatatctaaatgaataaaaaaaaaaaaattaaaatttataaaattaaaccattttaaattatttttttgaataatattcaattttcccgatttttagaaaaattatctataacactaattattttacaccaaaattaatttcatttaaataacctaaaaaataatcaaaatttacagtaattttttcacacctaaatttatttcgattaaataacaaaaattaaatatacaaaatttataaattttattgcatttgcattttacttttacataaacgaataatcaaatttcaaattcataaaaatatagccattttaattatttttgattaatgctgaatttacttgattttataaaagctcacagataaagggaattatcccaaaattgattttgcttttaataatatttgttaaacgtttaataatgaattgcatatatcatcagcacgtttaattattaataattacaattaaatgacttaataaaattaatttttaattttttacaaaatttaggcctaatattttttgtaaaaatgtaaaaaaaaaaaaaatttttttttgtgaattcaggatg

SEQ ID NO: 111559 - DNA, 1003 bp, Heterodera glycines
  Promoter: Source sequence=SeqID_16818; Location=588..1590; Strand=+; Gene=SeqID_81232
aagcaaattttatttataaaaataaaatgtagagtactaatgcattcttacaatggcgtagaaagacaattaaataaagacaaataaaagtcaaaatcacaaaaaaggaaagcttgcggcagcatattttgtggcccaacacaaatcagacatttaccgctcagttaattagacccataaaatggttaatggcattttcatacttctatcaaaacatcaattagtctttccatccaaaaaacattgaacattttaccgatttaagcacatcaaatgagccatgtgagagcatttacagcttcattagttaatttatgtacacatatatgaagaggaatgaggttttttaggtacttttttcgtgaattttttatacctatttaaataccaattttagcgttttttcttacctccttacttatgaacattttttattttctgatcgatatttaatttcccatttgaaattaatttttaaaattataattttttaatttcataaattatgttttattacagaattggagagaaatgataaaaattaacaaattgcaaattccttatttttatcagtttcttttcattcttttaatttctccttttgaacattcattccaaaaaaactattaaatattttacgaagtaataaaatggtaaaataatttttaatttataaaatatatttttaaatttccttaagaattccgctggctttgttctactgctgtggaacattgtcaatttgcttattgtttgtgaaggaaatgtgctaaaagaggtaataaattaaaaagtaacaaaaattcatcaattagcattagttacactaattaacgaatcggtgaataattcagaaagttgacaagtcttttgcaagtgccgatcttttggttgcgcatgtgaatggacagcagagttcgtggaaggtgtgcttattttgtgtattgaaagacattttaattgtttgctaaaggccaaattaaatgccaaatttgccaaaatg

SEQ ID NO: 111560 - DNA, 111 bp, Heterodera glycines
  Promoter: Source sequence=SeqID_8332; Location=1..111; Strand=+; Gene= SeqID_67715
aaatagtaagttaatctaattattatgtacattgatattttttcacttcgtcctagcactttttgttctttttcttcaaattctaaaaacatgcttcacactcatcagatg

SEQ ID NO: 111561 - DNA, 280 bp, Heterodera glycines
  Promoter: Source sequence=SeqID_19130; Location=2877..3156; Strand=-; Gene=SeqID_83873
tttaaatatctaaaaaagtcaaaagttgaataagcgtcagttcattttttctttccattccatttttgttattttcccataatttagaaaccggtttttaaattacattttgtattcactggtgtttgtacgtcgtcgtttgctcccaaaaaacatttttgataatgaaaagctttcgcaattggaggaatattttgtatttggtttaaatccattaacattgaatttactttaatttatacttacttatttgtttttttttgttcccatcttttccatg

SEQ ID NO: 111562 - DNA, 114 bp, Heterodera glycines; identical to SEQ ID NO: 103745
  Promoter: Source sequence=SeqID_4637; Location=915..1028; Strand=+; Gene=SeqID_55186

SEQ ID NO: 111563 - DNA, 203 bp, Heterodera glycines
  misc_feature (51)..(51): n is a, c, g, or t
  Promoter: Source sequence=SeqID_34772; Location=1..203; Strand=+; Gene=SeqID_64483
attctcatttttaaattttttatagatttttaaatatttcggatttttttntggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 111564 - DNA, 236 bp, Heterodera glycines
  Promoter: Source sequence=SeqID_36057; Location=612..847; Strand=-; Gene=SeqID_65493
gggaagcatgaaaataaaaaaatattaaacattttttttatacaaagttggacagtattcatgccaaatgagtgttagtcatgaatttaaaaaatctcaaaattttcttcagcctttacaacacatgcttattgagggtctgcgccggtcaggcactaaaaagcaagttttttattgttttaaaaaatatttggaaatgaatttaatttaaaaaacaactacaaaaatttagaatg

SEQ ID NO: 111565 - DNA, 694 bp, Heterodera glycines
  Promoter: Source sequence=SeqID_4462; Location=6005..6698; Strand=-; Gene=SeqID_45816
taggatgtttgacgtcatccgaaaaatagtcccgtttaaaaatgtctatctttcacgtacacatatatatttttcccagattggaaaccaatgattccgttcgggtttatgtctcagcaacgcgctcataggatgtttgacgacgtccgaaaaatactcccgtttaaaatgtctatctttcacgtacacatatatatttttcccagattggaaaccaatgattccgttcgggtttatgtctcagcaacgcgctcataggatgtttgacgtcatccgaaaaatagtcccgtttaaaaatgtctatctttcacgtacacatatatatttttcccagattggaaaccaatgattccgttcgggtttatgtctcagcaacgcgctcataggatatttgacgacgtccgaaaaatactcccgtttaaaatgtctatctttcacgtacacatatatatttttcctggatttgtacctgtacctgtattccaaaaattgcctgtacctgtattttctgtacaaaagtacaggaaaatacaggttgccgaaaaatggcctgtatctgtacctggatccaggaaaaatacaggcctggatccaggtacaggccgatctctactttaaagtgtttgtttcaacatttttaattctttttaatttgctattatttatttttatttatttttaagttttcgacatg

SEQ ID NO: 111566 - DNA, 706 bp, Heterodera glycines
  Promoter: Source sequence=SeqID_17606; Location=1239..1944; Strand=-; Gene=SeqID_82117
taattattattattttaaataataataataattaaatttaattatttacggttggaaaataattaattttaaatatttcggcattttttaaccatttttgaatttaaatttggctgcctgtttcagcgatgtcagccgcaacatcccgtgctggttggtggccaacattttgcgcgaggtgtacacgggccgcatgagttgggcgatggccgcccaccattggggccgtgagcttacggtagttgttttcgtcccgcaattacgggttacggttgatcggtatacgtatactgtatatatttgcctgtttactgtacaaaaacaagtcttattatcattttcaattaaagatttattaagtttttgagtcctgctcattttttccccataaatttttaggattttacgatttttaatttttgtagttggcgggggagtggtttaaattacgattaccgtaaccgccggtggaattttttcactcaaattttgatacaaaattctcccattttttcacagagttttgagtaccgcccaaattcggaccaaattgaccctgagcagttgcccttttcgcaagagctgtacatggaaaagcggaagctgcgcgcccaaatgctggaggcacattaattatttaatttatttaaatgtaaatttaattattttttccatttttaagaaattggaacacttttcggacatg

SEQ ID NO: 111567 - DNA, 632 bp, Heterodera glycines
  misc_feature (47)..(47): n is a, c, g, or t
  misc_feature (75)..(76): n is a, c, g, or t
  misc_feature (105)..(106): n is a, c, g, or t
  misc_feature (121)..(121): n is a, c, g, or t
  misc_feature (148)..(148): n is a, c, g, or t
  misc_feature (157)..(157): n is a, c, g, or t
  Promoter: Source sequence=SeqID_43614; Location=1..632; Strand=+; Gene=SeqID_71236
cccaatcaaaaaagggaaaaaaatttgcagtcaaaaaattatcgaantttctccaatttgttttccatattccgnnaaagtatcggggtatcataatgccaaacnnaaaacgaaatcgttntaaaatattcctttctggactgacttnggtttctgnatatcgaagctgttttctacgctatttctaaaacggttataccaaacccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 111568 - DNA, 95 bp, Heterodera glycines
  Promoter: Source sequence=SeqID_44899; Location=1..95; Strand=+; Gene= SeqID_72301
aggtcaaatcgggcgagcgcaatttgcgtcgtgcggtcgcttcaaacagtgccaagtacccagtggccgccgctgcagttggcggtgcggtgatg

SEQ ID NO: 111569 - DNA, 69 bp, Heterodera glycines
  Promoter: Source sequence=SeqID_17913; Location=1369..1437; Strand=-; Gene=SeqID_82471
atcatttttcagaaaattcgagggcgctggcaagaagacgtgtcagccagcaccaccagcgggggaatg

SEQ ID NO: 111570 - DNA, 1003 bp, Heterodera glycines
  Promoter: Source sequence=SeqID_7168; Location=1623..2625; Strand=+; Gene=SeqID_64033
caaatgtcgagtagccgttaataatcatcagggctgtaaaaatatgcacaaaaatggccaaaataataaaactaccgtacaccagtaagaaataacggaacgcattcacaaaaacgcacagtgctgtaggggcaaattggccataaactaccgaaaaaatttgcacaaatgcattcagaaatgcataaatggactgggcgataagtagggctgggatttttagttttttaactattttttctgcggcaagttggccactaaaataattttttgccactattttggcgtttcgtcattatttttgccactatttcgcgatttttcaaattttgtaaaggaaaattcactaattttcttcaaatataccaaataataccatatttttaaaggaaatatcgaaccaaaatgcccgcccaattcaatctaaatctgcatttattcgtgactggatcaaaaaaattgacggcgaagaaatttattccattaatggaaaaataatcttttgtcaagtttgcgaacagcaactaaagacaacgacgacttgaaagaaacaacagcagcaacatgataattttccacagattccatgctctttttgccactattttggcatttttggaaaacttcccaaaattgcaataaaacgaaaaatacacccctaagaatcgacctaaaaaatttttttctaaaagctcttccaagaagcatctcgtaaataactctaattgttaaggaacaaaatgacggacgggaaaatcgccaaaatccgtaatccgtaattacggggtccaataattccgtaatccttaattgcttgaagccctgcttattaccgtattattccaaaattatgttttttttattctctcctacataatataattcaaaatttggttaaatcgaataataaatgccggtatatttcaattttttcgtttttttaaatttcctatttatttggctatttccatctgaaatttcttaatcattcgtaccaaggatg

SEQ ID NO: 111571 - DNA, 1003 bp, Heterodera glycines
  Promoter: Source sequence=SeqID_11051; Location=321..1323; Strand=+; Gene=SeqID_74382
gcattttatttacataatgccataatataatcaaaatatcgttgaaaattacaaagatttctcaaatttctttgaatttttttaaaacttttctaaatgttcattttcaaggacgtccttggcatccaaggacattttttattttcaagaaagagggcccaatttcaaggacgtccttgccattcaaggacggatgggaaccctgttctaatttattaacggactgtacaaatctccaattctcactcgagcatttaagtttaagctttttgtttcttttcttatttctactgcttttgcatgcgttcgtttttccctgttttttagagtgcctatatttttttcttttgaaatttccattaaatgtaatgcattgctcgccgattgggtacattaaacaccaacagcaagaacaacaacaacagcgtcttgctctttgtgttggcattacaagcaatgaatgccatttgctatttgttgatgatttgtccgccttgacaattcgtccccgttttgccaattgtcgttccggtcgatggtttcgcgttttgccatcgtcaaatcatcacagcatcaacaagcattcatcaaaccaattttctttgctcgacaatgaaaatgaatggccatttccgacccgttttgtggacaattccttcgcaaaatatgtccaggtttttgctaccgaaacgaatacaaagcattggcttagggggacagaaattttttggcactatttacaaagagcactattttgaaaattttttcaacttttttttggtcaaatttttttttgtttaaaaagtcctgaaaccaagtacccgggtgttttaaaggtcgctgatcacgaatatgacaattatttgggcctattaagcaaacttggcgctagttataaagtgatagattttgaattttatcaaaaaccataggggggacccttttgttttgtaaattttttttggataaaaatcgtgaatatacattttattcaccataaatg

SEQ ID NO: 111572 - DNA, 254 bp, Heterodera glycines
  Promoter: Source sequence=SeqID_13195; Location=637..890; Strand=+; Gene=SeqID_77023
ggtgatcaaggaaaagaattactgcgtataggccagtcaaactttgttggatgtattcttaatttatgtttaccggaacaaaatagtcttctccaacggattaacaaccgagccgatcatcatgatcaccaccaaaatctctaggtgtgccacggcaatggtttaccattctgcaagcaaatgatcagaacccggagggcttaacagtaaaacagggaatttaaatttaaaaaaattgattttaagtggcgatg

SEQ ID NO: 111573 - DNA, 126 bp, Heterodera glycines
  Promoter: Source sequence=SeqID_1552; Location=6298..6423; Strand=+; Gene=SeqID_74422
cctacggtaaaaggggtcatttaacatatgaaaagccttcccatgttaagtcaatcgactaacagacttcaaaaacgccaattttgttattgttgcccaatttgttggagaaagaagcggacgatg

SEQ ID NO: 111574 - DNA, 464 bp, Heterodera glycines
  Promoter: Source sequence=SeqID_3847; Location=2817..3280; Strand=-; Gene=SeqID_52117
actcctttttaagttggccacgctggacgaccgcgacaatgggcacgcaaaatggggcaagaaaaagaggcaccggcagcctttgttggacgcgtcccctccgcctggcgaaagtgcggcggacgaattacgtcgccagcggcgctaccggagtgttcggcgtggacagaacgaatgtgacgcggaggggcaatatccgccgccaccgccgcgcgggcgaccgccgccgcgtccacgccatcacatcgagtgggcggtggaaagcggcggcgccatgggggcggatgatgtagcggcattccggcacgacgtgccctttccgcctcctccgccaccgcgagtgccgccaccgccaccaccgctgccggcacgatgcgagttcaggggaatagccaaagacaaaccaacaattgtatttcagatgagcgacgccgctcgcgcgcgtccgccgcgtctgaccaatg

SEQ ID NO: 111575 - DNA, 258 bp, Heterodera glycines
  Promoter: Source sequence=SeqID_11696; Location=1097..1354; Strand=-; Gene=SeqID_75176
ttttctacgtcccgacccgaatcccgacacatcattcctttaccgaatttttttttggaagtctcgactaaacttttttttgtaattttctcgacccgtggcaaccttgttatttgctcaattcattttttacccttctctaccagcccaatggaatttagggaatattttctattatacattccgtaaaaccaaacttttcagattatatttttaatattgaacgtccaatttaatttttttttattttaaagaatg

SEQ ID NO: 111576 - DNA, 1003 bp, Heterodera glycines
  Promoter: Source sequence=SeqID_18161; Location=1012..2014; Strand=-; Gene=SeqID_82744
atcccccaacgcacccacaaaactgatgaatcaccactgtgacttcaaagcgatcaaaaacggaaggaatggggggggggaatgaatggaagttggaacagcaccaccaccaccaccaagtcatttttgtaaatttgcatgtttttatgcaaaacagaaaaccgacccgtccacttgttggcattctttagttcgccgggctttaaatgaaaaaaaaatcgatcgagcaaaaaatttgagtttttcgtattcgaattgtcctagccattttgggttcagtctaattgatagagacaaaacagttcagtgctgtcgaatgataccaaggagcatatattagaggtaagcagcagaagagagtaaagatggggcccaattggtcctggggcccaccgcacctgtgactgcaaagcgatcaaaaacggaaggaatgggaggggagggggggggaatgaatggaagttggaacagcaccaccaccaccaccacaaaatcaacacagcaaccaaccaacttgtttgtttgctgattgatgatgataaaaatgcatttaaggcatactaaatatgtataattatggctcggttggtgaatgatgctgatttgctgatgatgataatggttggtggtatgtataatgatgatgattcattctcagcaaatttgtacggaaatgaaaaaatggggatcggattatttataaagataatgcgatttttaataccataacttcgattgcttgaaaattttttttactaatttctaatgacttacattttaccatgaatacctcttattgttaggcatgaattttcacaaattttcaaaaattttgcggttacaatttcaaaaggatttaaatgtttgccttttggcattttgtttgaaatggccggaggcacaaaaaatttgttcttttaaattgttttacacatcagaatttttttaaaacttaaaaattatttcctttttcaatttttttagatgttaagcaccaaagatg

SEQ ID NO: 111577 - DNA, 77 bp, Heterodera glycines
  misc_feature (12)..(12): n is a, c, g, or t
  misc_feature (17)..(17): n is a, c, g, or t
  Promoter: Source sequence=SeqID_25348; Location=1..77; Strand=+; Gene= SeqID_56100
aattattcttgnccttntaggaacgctttggctctgacgcgggcggcctaattttggactatcattgtgccgaaatg

SEQ ID NO: 111578 - DNA, 68 bp, Heterodera glycines; identical to SEQ ID NO: 109495
  Promoter: Source sequence=SeqID_44515; Location=322..389; Strand=+; Gene=SeqID_71996

SEQ ID NO: 111579 - DNA, 968 bp, Heterodera glycines
  misc_feature (24)..(24): n is a, c, g, or t
  Promoter: Source sequence=SeqID_8559; Location=362..1329; Strand=-; Gene=SeqID_68524
ggtaattttattaatgaaaaaatntaatttaaaagtcaaaatttaaaaatattttaaatatttaaaattagatgaaataaaagtttctttttttatcaacagccaatgaagtgaaatattgtgtggaaaacattgaaagggacgaaaatgttttaatggagcgaattcgcgacgcaaaagattgggcactgactaatgggctgacttttccggtgccaagaagtaaactgaaatgtgacgcatgtggcaaaatcaatgaagtataatgtttaaaattaaaattaaacaaaatttaagtaaaactattgaccaacatttcgagaaaagaatgagaaaaagatatttgaaaatacagacagatccctaaaaacttggcaaatgccataggctttaattgtaatgtcatcgtggggctcgaattattttaaaaattaaatgcaattttgaatttaaataaagccaaaaggctcaattcctttacttaggccaatggtttggaaaatattgccaaaatatgacattttaaagcatacaaagttgaacaaaatcaagtaaaactgtttgtatattcttctatttttcagctgtttttagcttttgagcaattaggcacaacaattttactggggtaggccccgggtccagactcaatacagcggcctttgcaagacgactttttgaaaatgcaatccaggtgccctacccggctagaaggatccaactggatcctaaaatacactgtaagaattgggggaagaattttttaatcaacgttgagggaaacaaaaaaaattcttagaaaaagttaatgaaaatagtttcaaaattgctttaaatccgttctaactttataaatttatgaatttattaattttttaatatttattcagaacttaaaaaaattttgcctaaatttttcaaaaagaagccttcggcacagaccccccaaaagacttggcaaaaaaatg

SEQ ID NO: 111580 - DNA, 283 bp, Heterodera glycines
  misc_feature (34)..(34): n is a, c, g, or t
  Promoter: Source sequence=SeqID_32118; Location=1..283; Strand=+; Gene=SeqID_62442
gaaatgttattaataatcaatttcctacgcccgnttgtcctctttatgttcgtgtggtctcaaattggcatcgaatgtggtctaattcagtcattgtcagcacattcaaagggaaagagagaatattcatttgccactgaaataaagcgtaaatttattaaataattaaaaggttattaattatgcatttaatggcaatttaatttcaagagagcgaaattagtgataaaatactcaaaaaattgaaaaagcaatgcgcaaaggtgaaaaagatgaataaatg

SEQ ID NO: 111581 - DNA, 1003 bp, Heterodera glycines
  Promoter: Source sequence=SeqID_15262; Location=401..1403; Strand=+; Gene=SeqID_79473
aaattcatttgagagagatcattttgtgttgcaaaagcataattaatgtccattcatttacttatataacaattttaatgcgaataaaatattcggcattcaataaattcaattctaaaaaaaacagcaaatcaggcataaatttttcagaacctcattaaggtaaaaaatcgaacaaaatttctcaatttttttttctcgttagcacatgagggaggcactgtcggaaaaatgatcaaattttacagggtcataggccaaatttgtcaaagaattttactaaaaattcaacaacccttaaaaattattgacattttgcacaaaatttcctcttcgcccgacaaaaattggggtcgtccggcgaggcatttgagaggaaaagataattaatttaattggacgatgatttgtacattattggttggtcttcactctccaaaaatggtggtcctccccgtccgtcttcgtcccctcccccattttcacatttctccgattgtgtcaattcttcatccccccgtccttcgccgtggtggtggtggtggtggtggtgcacctttccatccatctcacggcggacggaccaacaaaaatttttcgatcgattgtccttcagtattaaaattaaaattactaagaaaatatatttatttcattttaattttaaataacagatgagggcactttgaatatcaatacatagtatgagaattgtccttggatgtacttaaaatattctttaattaaattaatttttcatttttataccgaaaatttttggtttccatagcccctggatgacgcaatggatatgttgtccttgaaaaaactattcaaaaaatttaatgcataatgtatccctgtcgaattattggaaaaaaaaatttaatttaccaaattttgccccaaaatttttaatcaatttcggccaatttaatgccaatgatgtcatgttttgtctttgtttaaatgtttaatttcaaaaatttcatggattaacatg

SEQ ID NO: 111582 - DNA, 166 bp, Heterodera glycines
  Promoter: Source sequence=SeqID_6499; Location=1243..1408; Strand=-; Gene=SeqID_61804
aaaattaacttttttgggggagtagcaaaatcggtgctgttagttttcgacagcggtgattcgacagtaaacttttgcttttaaaaaacttgtcctatatggtacgtctagtaaaattttgaaaattaaaattaattcatttgaacagtaaattcgtagaaaaatg

SEQ ID NO: 111583 - DNA, 470 bp, Heterodera glycines
  Promoter: Source sequence=SeqID_42070; Location=1..470; Strand=+; Gene=SeqID_70064
taaacaattatgtttcgttgttaatttagtaaaaattatcgttttatttaacaaaaaatgaattaaacaattaagaaatatccctttattcaaaatttgttttatatttatattatttatttaatgcttttccaaaataaataaaattatttgactttattaaataaataaccaaagaatctcatgattaattaaaaaaagaatacgttaatttttaaaaatttttcccaatttctttaattttttttaaatgttaattacccctattttacctttttgtgttagcaagcagtccacccattccaaaacataaaaatgtaattgaatacctgtaataattatgatgtcatcccaaaatcatttttccattaaacgaaattttagattcaaaaacgcaaaaaaaaatttttttaatttttttgttggatgttttattaattcaacaccacacacacacccagcaaataatg

SEQ ID NO: 111584 - DNA, 381 bp, Heterodera glycines
  Promoter: Source sequence=SeqID_12021; Location=1055..1435; Strand=-; Gene=SeqID_75547
tgagaatattgtttgatctagggaattaaggaaagcattccccccccccccccgcaagaagcgaacaatgaaacattttaagtaaaattggaagcctttttaaaaaaaagttatttaaaaattaaatttaattttacaaattttctgatagcatttatcgccgtaattggttgcctaaattcacttgaatttttaaaaattgacaaaaatacttttgttctaaattttcaaaagtttgatcataaaattgctttcattttacctggcatcgtatcaccaatcaaacttttataaaatgaatttataaatttaagtgctaaaaagacacgaaattcaatcaataaaaacaccacaaattcagatataattggcacttcgatg

SEQ ID NO: 111585 - DNA, 294 bp, Heterodera glycines
  misc_feature (38)..(38): n is a, c, g, or t
  Promoter: Source sequence=SeqID_21254; Location=1..294; Strand=+; Gene=SeqID_51847
cgttttcgccaacttttcgcctcttctccaattaattntggtcatcaacacggacaatgaccgcactttggagtcaattttgtgcaacatttggctaatgatcgcgaaaaacatttgtgccatgcaattgcccgatcccgaatatgcttccagccatttgcgacaatttgtcccgtcaattctcaatgattgtccatcgcttcgtgttatcaattcccattctgatggtttcatcgccgaatttccatactatgagagtgccaaggcttcgaatggacaagcgttggccaaatg

SEQ ID NO: 111586 - DNA, 94 bp, Heterodera glycines
  Promoter: Source sequence=SeqID_22705; Location=1..94; Strand=+; Gene= SeqID_53389
acaacagcaacaacagcaacaactgatcagtgctggcggcactgatcagcaggttgccgccgccgctgccgctgcggccgctaccacactgatg

SEQ ID NO: 111587 - DNA, 64 bp, Heterodera glycines
  Promoter: Source sequence=SeqID_14550; Location=1..64; Strand=+; Gene= SeqID_78617
tttgagcccgggcaatttaggctaatttttgaaaattcataactcgcttcagggttggacaatg

SEQ ID NO: 111588 - DNA, 1003 bp, Heterodera glycines
  Promoter: Source sequence=SeqID_44724; Location=41..1043; Strand=+; Gene=SeqID_72169
cagtcccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcggcagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagtctgtactttaattctgcgttggatttttgctccccataaatgtttgagtaccccaaacggacacttgaaaaaatcgattttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataaatgtttgagtaccccaaacggacacttgaaaaaatcgattttttttgttttcggggcagtccccccgaaccgatgcgcccagatttatggggagaccgatccttcgggaatagcttccctatagcctgtactttattctgcgtggatttttgctccccataaatgtttgagtaccccaaacggacacttgaaaaaatcgatttttttgtttcataaatatttttttcagaaagtcatg

SEQ ID NO: 111589 - DNA, 252 bp, Heterodera glycines
  Promoter: Source sequence=SeqID_7343; Location=118..369; Strand=-; Gene=SeqID_64529
ttttaaactgatgcatttaccggccatgcaatgaaatatatttacaaccaaaaaaaggcccgaggctgaacatatcttcgatttttaaattctgatattcttcatttctttacttaactatctagcgctttataaaaccgaaatcacagctccgctaatttgggaatttttccaaaattaattgaatagcctttttcaaaaatttgggtttttaattttacttttgttgaaatttgcagagagctggcaatg

SEQ ID NO: 111590 - DNA, 106 bp, Heterodera glycines
  Promoter: Source sequence=SeqID_25495; Location=370..475; Strand=-; Gene=SeqID_56233
ttaatttatgcagaagaccgacggtaccaatcgcatgggaaatccgcggaacaaacgcaaaaaataatttggcacccccggcaaaaaatgtaaaggaagcggaatg

SEQ ID NO: 111591 - DNA, 166 bp, Heterodera glycines
  Promoter: Source sequence=SeqID_18362; Location=304..469; Strand=-; Gene=SeqID_82960
acttttgtttcaactttttcttttctgatccaatttgatcaattaaattgatcaaaagtaaaaataataaaatacataatttcatttttccaattggcaatagatattaataattatacaaatgaaattaggaaaaattttttagcaataaattatttatgaaatg

SEQ ID NO: 111592 - DNA, 98 bp, Heterodera glycines
  misc_feature (25)..(25): n is a, c, g, or t
  Promoter: Source sequence=SeqID_31223; Location=1..98; Strand=+; Gene= SeqID_61597
cattggaattcttttataaaataanaataatataataaataaaataaattaattttatttgtttacagtttagaacaacaacaatcgtgttcattatg

SEQ ID NO: 111593 - DNA, 175 bp, Heterodera glycines
  Promoter: Source sequence=SeqID_13330; Location=2041..2215; Strand=-; Gene=SeqID_77194
ggtaaaaggcctgtaaagtatgcgttggcatttccattccacgcttagttttgccgaattggctgccaatgttttcgtgctgaacggactgtccgcctttctcttttccgccgtcgtccccacccctgtcgtttcgtttgccgtcgtttctttgggttgtgctgcgggcatcatg

SEQ ID NO: 111594 - DNA, 745 bp, Heterodera glycines
  Promoter: Source sequence=SeqID_5128; Location=3628..4372; Strand=-; Gene=SeqID_57017
aaaaatgaaaatgttacacaaataaacaagaatattcatttctaaatataattttatttaaaattttgctcaattttcactcaatgccgcttaaataatattttccaactaatttgttatcaaaaatatcaaaaagatatgaccacaatttaggtggaaacctgttcattgaacagacaattctttgagccaacatagttgttttttgcttaaatgaatgcgactgtgttgtgcacatttgcagccaaaaataaaaaaagcaaaacccattaacagatgattaatgggatatgcaataacattgactataaaaatgagctgaatcctaggattttttgtttttaacagaattcactggaaaaattttcaaaaaatgtgctttccttgaaaatgttttttatataattatataaatataaaattaacctcataatgctgttcgtagttataaaatccatcaaatagtaaaagacattaaaattaatttaattcccagtaaaaaacaagaaattaaaaaatgttttaaatccaattttctctgtttgagaacgagctgaccatcttaatacaaagtacactttccgacatttaaaatttattgttagcaaagattaatcaggtaaatgaatattctctgctcgcgattttaccactctgcaatgtttcattttttttagaactaaagaaaaattatgcaattatcaaatttttatcgacttccagtattttcattatctttctaatg

SEQ ID NO: 111595 - DNA, 101 bp, Heterodera glycines
  Promoter: Source sequence=SeqID_41752; Location=1..101; Strand=+; Gene=SeqID_69814
tttgtttcctttgcagtgaatctccgctcgtcgttcacttcgattactccgaagacaaaggccgcgtgttcggcgcttctcacgtccctttgccgacaatg

SEQ ID NO: 111596 - DNA, 166 bp, Heterodera glycines
  Promoter: Source sequence=SeqID_6331; Location=2877..3042; Strand=-; Gene=SeqID_61165
tcgaactcgtattcggcaagtagtttataaaaaaataaatatttattacgcatgcagtaatttattttaatttttagtctttatgtaatgctttaccaggcgaattgtaggcgcatttgacattgcatcaatttcaattttgtttttcaattttagcaaatcaatg

SEQ ID NO: 111597 - DNA, 170 bp, Heterodera glycines
  Promoter: Source sequence=SeqID_28669; Location=1..170; Strand=+; Gene=SeqID_59258
gaaggaaaagtgggagggacgggggtataaaagggaaaggaaaggggggaaggagggcatttgtgagacggaaaagcgacggatacggcacaatgggcgaaccaaattcaaaaactaatatttttcacatttcaagcaattaataataaattagtgcaattaaagaaatg

SEQ ID NO: 111598 - DNA, 182 bp, Heterodera glycines
  Promoter: Source sequence=SeqID_18585; Location=1868..2049; Strand=-; Gene=SeqID_83216
cgaaaattgccaattttcaaaaaagttcccataaatattgtagtttcgttttgggggacgaattggaagaaaatttttaaaaaattttcatttcgggggggggggaatcttgagtcccaaaattctggatttttataacattaattaaaaaattttgcaaaaatggccctcacgcgaaaatg

SEQ ID NO: 111599 - DNA, 145 bp, Heterodera glycines
  Promoter: Source sequence=SeqID_12922; Location=3481..3625; Strand=-; Gene=SeqID_47089
aaatgaatttaataaatgatattattttctaataaattacctcctttaatattacaacagataaatttatggaaaaaaaattttttttttatataaattgaaatgaacacccaattttttataggtgctgactaagccgggaatg

SEQ ID NO: 111600 - DNA, 836 bp, Heterodera glycines
  Promoter: Source sequence=SeqID_1552; Location=5194..6029; Strand=-; Gene=SeqID_74423
agtttatcgggggcaaagtgccaaattaaaatatgctaattgtttggcataatcccaaagtgccaaattaaaatatgctaattgtttggcataattccaaagtgccaaattaaaatatgctaattgtttggcataattccaaagtgcctaattaaaatatgctaattgtttggcataattccaaagtgccaaattaaaatatgctaattgtttggcataatcccaaagtgcctaattaaaatatgctaattgtttggcataattccaaagtgcctaattaaaatatgctaattgtttgtcataatccgaaagtgccaaattaaaatatgctaattgtttggcataattccaaagtgccaaattaaaatatgctaattgtttgtcataatccgaaagtgcttaattgaaatatgctaattgtttggcataattccaaagtgccaaattaaaatatgctaattgtttggcataatcccaaagtgcctaattaaaatatgctaattgtttggcataattccaaagtgcctaattaaaatatgctaattgtttggcataatccgaaagtgccaaattaaaatatgctaattgtttggcataatccgaaagtgcttaattcaaatatgctaattgtttggcataattccagaatgcctaattaaaatatgctaattgtttggcataatccgaaagtgcttaattcaaatatgctaattgttggcataattctaaagtgcctaattaaaatatgctaattgttggcataatccctttaaaggcatcccatcgccgccgcttttctgtgggtctccacttcgctgacatttcccgcaataatg

SEQ ID NO: 111601 - DNA, 65 bp, Heterodera glycines
  Promoter: Source sequence=SeqID_17031; Location=3394..3458; Strand=-; Gene=SeqID_81455
tttggtaaaaaagtaaaatttgaatgtaagtttttttaaaaaaatcattaagccttacttccatg

SEQ ID NO: 111602 - DNA, 336 bp, Heterodera glycines
  Promoter: Source sequence=SeqID_37511; Location=1..336; Strand=+; Gene=SeqID_66563
tggtaagttttattttccgttttaagcggtgacattcgtgatgccaatttggctttggtgaagagtattcgcaaccgtgcctcatatttcgctgagcttctccacaattcgatgaaggcacttattaattttcaattgttactttatttttcattgttagggcattggcacccgcgacaccgatttggtaaggaaatggacgaacggataagcgaatgctccaaatttatacaaattatataaaatgctggctttttgcacctttcacagattcgtctcgtcgtcacccgctccgaagtcgacttggccgacattcgccaggcatatcaaaatatg

SEQ ID NO: 111603 - DNA, 592 bp, Heterodera glycines
  Promoter: Source sequence=SeqID_5694; Location=663..1254; Strand=-; Gene=SeqID_58935
tttttgtattatttttaaatttaaatatccttttttctattgaagtgatttttaaaattttttttacaatttaattaaaaaattgcatcccttaaatgtgatttaaaacattgattgattttatggttgtcaaaaacgagcaaacagaaaattttcccacggtaacatttttttatttttttaaaacctttccacttcatgcaaaaaaaaaattctttttcggaatttctatgatacattaggatgaataagttcgacccaatattcacgaaaaacacacttaatttttctggttggtcataacaaaagtaaaaatgaaaaaaaataattaaaaatttgagtttttgtgatcagttggatgggaatttattaatcgtgaaaatattttttttaatattattaaataataatattactaattgcgaccaatcagtagagagaaatctgtcaatatttcactttaaaatgtgtaggttttagaagagaaaaatataagaattcgtttttgagaaataataatatcattcattatttattgcttttcatttctgtctattaaataaaatacaaattgaaatttttagaaaatatg

SEQ ID NO: 111604 - DNA, 943 bp, Heterodera glycines
  Promoter: Source sequence=SeqID_2396; Location=1554..2496; Strand=-; Gene=SeqID_79524
tgtttggcaatgcgagacattccctgtttttctctcacctccaataaatcggtgcactttgttccgccacagactctccaaaaaattaacgctatttcgttccactgctcacccatccctggaattggtgcgtctcattgcattttcgcattttcttccaccgctgactcattcatctctcgcactttctgtcgttgtcaatgtttaacggtcccttgcccactttcaaaatgggcttctttgtgcgttgctcgtgtctatccccggaattcgtgcgttatccactatttatttctgcctttttctctttcactacaaatttcctttttctctttttcccctgtctcttttcctagcacaaaatgcattgaaaatcggtccctcgatttaagcatcgccccacccatcggtccatccctcggaattggtgcgtttctcatattcgcccttcatgcgtaacaaatgctgagcgttttttccatcgcgagacgggccctccactttcttccccttattttcccactgtctctcttttcctttctctctctctctatctctctttctctctatttggaggtgggaaagcaaagaaagagaaaactcttcggccgcctctgcccctcattttatttccccccccgcccccactcttccttctgctctcccccatcgttcactttcctcaaactgaatgaaaaggaacgaaaaaacatgtagcacgttgtgacaaatctcgcgcaactttaggcccactttctcacgaccctcgtcaagactcagggctatttcccaataaaaattcccattgctcgctgtgtgcttaaatatataaattagattgttacgtttgcatttaaaggagtcaatcagatttgaactttcaggagaattgaaattttatcttttgaaaatcgtctagacctatttaatttttcgaaaaatg

SEQ ID NO: 111605 - DNA, 78 bp, Heterodera glycines
  Promoter: Source sequence=SeqID_23946; Location=177..254; Strand=+; Gene=SeqID_54634
tatgtcattcaggaatacatatgggcgcacattccatctttgcctgataaagatgacgacacccccattgcaaaaatg

SEQ ID NO: 111606 - DNA, 343 bp, Heterodera glycines
  Promoter: Source sequence=SeqID_7287; Location=1..343; Strand=+; Gene= SeqID_64354
ttttactttacttattttcctttatataataattatgcataaattcttcctaaatatttttatgatgatgattcaatgtgaaagtggataaaattgtccgttttgtccacataaaatgaaaaaaaggcattcgtcatcgcttctctcccaaacactgcactgatttgtgaatatggaatggacaaaattccgatcagcagaaagataaagccaataaacgatgagtcaccgtttctattggcttttttggctttttaagcgattgcaaagccaataaacccactaatttactaatcattttacccattttcagcaaatttattcctttcccaaaatcaaaatg

SEQ ID NO: 111607 - DNA, 1003 bp, Heterodera glycines
  Promoter: Source sequence=SeqID_1284; Location=1524..2526; Strand=-; Gene=SeqID_71573
ttgttttggcgatctgtgcaacgaaacagactatccgggccaaaactgctccaatctgatcgcagctgggccattgtgctttttcatcattttaagtgaggaaaaccaattaaagaagtggagcattaactcaaagatttttttaatcagtaaatatttttatcatttaatagaatattttatttaaatgtttttaaaataatcattaatagacaaatttacaattaattctaaacataccataattagtgaatttaaaattgaatttattctttttagtgctccttttcttctccataattttggcgattattagcagctcataaacaacaaaaatcatcacagcaattcacggaaaaggcgctgtgttactgatttttttaatatgttttttggttgcgcgggaccggaatattctcggaatccccggtcttcagagaacaaacttttcggaatgtgttttatttttataaaattaatgaaaatggcaaaaaaaggtttatgtatttcctaacttttaagcaggaaaatattattttaaaaattgggaaaacaattaattaaaatttttgcaattttcccaaaagtctgtcccgtgtaactctgttgaaatcaaatgagttggattacttttgctgaataatttactaatgtctttgttgacatataataatatgtaatttttttcttacactatgtaaatataataaatattttactttaaaaattgtttgacaattcttttgtgtgtcacttttaaatttacgctaattatccttaatttcatggcgccagccaaacaaagtgaatgaatggccgccaacactttcatttaattgttgttttattgttacttaatttcttcgatatttaatgtgtcttaaaagataataaaattataaaataattaaattttttaaattaacaatatatcaacgggaaagttgctaagcataacgtttaacataatcttaaggaaattttaaatttgtatgtgacaatg

SEQ ID NO: 111608 - DNA, 73 bp, Heterodera glycines
  Promoter: Source sequence=SeqID_19891; Location=1..73; Strand=+; Gene= SeqID_84649
gactgtccatctgtgccgaaaattggaacagaaactgtgcggcgaatcaggcgaaaaaaaagtgcaggaaatg

SEQ ID NO: 111609 - DNA, 176 bp, Heterodera glycines
  Promoter: Source sequence=SeqID_32362; Location=431..606; Strand=-; Gene=SeqID_62677
agaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatg

SEQ ID NO: 111610 - DNA, 67 bp, Heterodera glycines
  Promoter: Source sequence=SeqID_27949; Location=1552..1618; Strand=-; Gene=SeqID_58609
tgtaatataatgcaattatatatttagttttatcttcagattatgtaaaattacagaaaaaggcatg

SEQ ID NO: 111611 - DNA, 430 bp, Heterodera glycines
  Promoter: Source sequence=SeqID_2711; Location=1621..2050; Strand=-; Gene=SeqID_81207
acactgtagcaaacactaattaactaaagattcattaattgttggtattgattgaccaattagaccagtgaactattattattctgaggcctatgaccctcagctactgatcggacaagatcgatttaaatgggagcagttcgttccagccaacgatttttttttaagttttcaaacttggaatgttaaaaattataagaattaaaaaaaataattttgttgattcagcaatttttgaaaagattttttagaaaagacttagtatttcatcacaaatcttgaaataattcctaaaaaaaattataaatattttctatgattaaatttagttagaaaattttaaaaagaattctttggggggggggggggggatataagcacccgattaaataggcacctattttactaatcaccttaaatttgtcagatg

SEQ ID NO: 111612 - DNA, 129 bp, Heterodera glycines
  Promoter: Source sequence=SeqID_44176; Location=1..129; Strand=+; Gene=SeqID_71707
cgaattaaaatataaccatagttgaaattaaatttagttaaatttgtatttgactacaatgagagcttgaccataatcattttaaaaataaaaaaaataaaatgttaagggttcgaacctacgagtatg

SEQ ID NO: 111613 - DNA, 1003 bp, Heterodera glycines
  Promoter: Source sequence=SeqID_2099; Location=3364..4366; Strand=-; Gene=SeqID_77841
tcaaatatttttttaggttatacatcccattttttcatgagacaactatgaaaatttgaaaatctcacaactcgtttctgggatgtcaaattgcttaacttttgcttagaaaaagcttctcctcatcaagggctttcgaatgataccaagattatccaatttggttggcaaaaaccttcaaaaataattcccaaatatcgtgattttttaatattttggacaaaaataaataaaaatattcatgttgcacaacggactcgaaccaccaccctttgtccctttactatcttacaaaaaccactgagccacacatgcaaatcttttctggtacaggagctcatttctgggatggtgtgttaagaaaagaaatatgtctttttgaaacagtgaagtttatgaaattcacattgaaaattgaagaagaatcagaaaaacagagtaaatcatgcataaaagaaaaatgagtgaatgaaagggaggaaaagagggcgcaatttttatagttcgacgaaacagcgaagggcaaaaaattaggtaaaattgaagattaccgccaattttgattttgtatacaaatgatatatcattcgattccttatgctgagagaagtcgaatggtatgtatcatttttagagcgcggcgagaactctgagccgagctacagacccgggactgaagtgtccatttaccactgggactgaatcgtctaatgtctaaaatacgggtccactgcgtttcggcgccatcatgtttttccactataactttctgtaacttttttctttggcatccaaatcaaacattgttgatatcattcgaaagcttaatgtgtttagaagctttttctaagctattgcttcgcgatttgacattaccaaaaaatttatacatgaaaatttcaaaaagtcgaaaattccaagttttttttaataaaattttttctaggcttgaaaatcttttcgttttggcaaggctaacagagcatgctacgagcattcgatg

SEQ ID NO: 111614 - DNA, 101 bp, Heterodera glycines
  Promoter: Source sequence=SeqID_15629; Location=915..1015; Strand=-; Gene=SeqID_79921
aataaaaatagatttaaaactcttccatgatataattttggaaaagatccatattcagcataatgattccttttcaaaaacatattcagaactgaaaaatg

SEQ ID NO: 111615 - DNA, 923 bp, Heterodera glycines
  Promoter: Source sequence=SeqID_5323; Location=1569..2491; Strand=-; Gene=SeqID_57680
aattttgtggtaatattaagaaaatttttttgtccaaaagtgtaaattttgctgcctttttcctttttgtgcctttttttgtcgtttttgtacatttttatgccttttttcacctttttcgtgcctattttcggtaactatttgaaaaatgttcgtgcctaaaaatccggtctcatgttataaattcgagcccaaaacttgtgggttttcgggagcattgaacacgaatcagacacccatttcgaccaaatccagaacccggaattgtaacaatttctttttgttttgcgcaaaatagcgtcaacgcaccttattttatggctttctcgcagcttgagagtttgaagtccatcgggaattacaattgtttgggttcgattcccgaatttttattctgtctcattctttccttccttttcaaattttttcaagattttgataaaattttaatcattagatttttatttgttttgtcgctaattttgtttgatactgtattttaactccgacataagtattcgatagtttatttattaattatttgatattctgtcaccggtcccttctcacctcgggggacaaaataacattttcttcaataatgagaaaataaaaaataatatccaaatatttcttctaattttcgagaatagaaatattaaaataatattcactattatttatattgataattttatgcttgctaaattgaagactttcttcagaaatagcttaacagaatccaacaattgtccatgcccatgtgtttgattttcttggcatttgcccttttcttcattttttttttgattcccatttgatcaagagtttcactcgttggctttttttagctttttattcatttttataatataacttcattttctatttttactgtaaagtaacaaattttagaagcaatg

SEQ ID NO: 111616 - DNA, 514 bp, Heterodera glycines
  Promoter: Source sequence=SeqID_33400; Location=436..949; Strand=-; Gene=SeqID_63472
tgaaaaaactggtcaaaatcctagttaattttttaaaaaatctcatttttatcaattcgctagcttaaatgcaagcaaaatcatttcaatgctttttggtttaaactttttttagctctctaagattgacttatttttctgaaatagttcgcgaaaattcaaatgttttgccttatgaaaaaagtcaagaaaaggtcaaaaaaaatacaaataaattaattttgagcatttggccaagaatttgagtgccaaataagattttgtcaaaaaattccaatattttccaaaaaatctccaaaatatgtgctaaagactaccaaaaccccaaaatatgttttgagcttctcatgcgatagcacatgcgcaaaaaatatctaaaaacatataaatccgttccctgtttatgaggaaccgattattccaaaataaagacgcataattatgcacagacatggcagtgatgtgtaaagcagccaaaatttttgagaaagaaaataatgagcgcgaaaatatg

SEQ ID NO: 111617 - DNA, 384 bp, Heterodera glycines
  Promoter: Source sequence=SeqID_4077; Location=6100..6483; Strand=-; Gene=SeqID_53079
atttcttcatttgaataacccatttttgtgagttgtggaaatgtttagtcctcaaatccaaaagatttctcttgccattcctcggatgttcgctctccttaaattgttggcattttcgaccctaaaacacattctccttccgttttacgtatttctctcttccttcgtctattccgtcccccccccccccctctccggctgaaaaatatcggaaaattgatttaagcataagctgcccctgtccacttcttctgcatatgttcgtctgtgtctgttcctttcttttgactttcactctcattttcttgcgctgttctccatttttaatatacactcaaatacccaatttagtttttcgtttatcactttaattgacttccaatg

SEQ ID NO: 111618 - DNA, 1003 bp, Heterodera glycines
  Promoter: Source sequence=SeqID_3630; Location=718..1720; Strand=-; Gene=SeqID_51200
gtggaaaatttcaattttatcggttgacgaccccttacttttgttttttctttttctttttgaattccgaagcccagaaattttttaaatttttaataaatccaaatcggctatatgcataaagatgccaaaggtatttttggaataatatctaaaatagaataaataaataaaataataaaattgaaaatgacatgaaaaaaatattgtttttgcacacgctcaaagcgaccaatgggtgattgagagttaacgaataaaatggaatggcaataatattgtatattacacatttggcaatttggatgaatgataaattcacaaaattgcccccattcgtttccaaaatcagttatcggatgccaaaataaaaaaaattcaataatcttggtgtcattcgatagctctaagtgtcctctattagcctccaaaattttgaaaaatttcgttaaggttcaaaaagttatgggcagaagaatgaaaaaaaaaccagattttccaacctttttgggcataaatcaatgaggtgtaccggctcaggaactaacagtcccaatgccagtcaaaataaaaacatttgaaaatttaagcattcattcgatcagccaaaaaacaccaaaatgaaatgcttaagcatttcaaatacgggagccatgaataaaaatatataaaataataaattttccagaaaaaaaagctttactaaatctcttttttagtttttctaaaaaaaaccacactttttttttgcttattgattcttgcgccgtgtcattattttatttgcatattttttgcccgttctgttggggtcatccatttatgaggtcattcatattaattggtcctcattagtgcaactaaactaatgaatgaataattttattggatttgaattggctgaattcctttaattgtattttatttattaataattaaatttattattcaatttaaaaaaagttgacaattaattggacattaaaatattttggcaaaaatg

SEQ ID NO: 111619 - DNA, 251 bp, Heterodera glycines
  Promoter: Source sequence=SeqID_28121; Location=1115..1365; Strand=-; Gene=SeqID_58770
gcaggtccaaaattaggacatatttgtgtggaatttatccgcttattcctctcctttatgttgttattttttttcatttcatcatttttccatttggtgacgatcttcaaaaaaatattttggattttctcgtcattttggtgatttttttgcaaaaattacttagttggttttctttttaccagtttatctcggattaatttccgttatatgtatatattgtatgtcaatcttatagaaagcaacaaatg

SEQ ID NO: 111620 - DNA, 955 bp, Heterodera glycines
  Promoter: Source sequence=SeqID_5794; Location=2006..2960; Strand=+; Gene=SeqID_59251
atagaataattccaatcgtataatgaaattcgatccgtaaatgaataaatatttttgaaacaaaacatagagatattaacaaaaacaatggattaaactcaaaattttattaagaaattcaatgtggagataaaagattttatacatatttttataaaaaataaaagttttatatgtctattttgagggtaacatttttacttatacggtatgaacactttttgatacattttgtcggaataggacaaaacgtcgccggaaagttttttggtcaataactcattttttctttctcaattaaattcaatgttttggtatttatccaaagtctgaaccttttatcgccattttggcaatttttaatatttttagctactaagtattatcgaacaataccaagatgcttaattggtttacaatgaaaaaagttatgatttaaaaaaatcgtccggcaatgtttcggatgttttgaggtgcacagaaatgttattattattaaaaaaacgtggctttacgtcgctgcttatttctttaaatgtcatttgtcttctgtttgtgtcccctccccggcggaaagcggggagggggtgaaaatattttttgttttattcaaaatggcattaaataaatgccaaacattcactcagacacattgaaactccaaagtactcagaatttgccacattggttctgtttgtgttagctcaacattgccatttaaaattcatttctttaatttaatgtcgacaatttttcttcccttttctcagcccccgaggggacgatgaataataataattagtgacaaattaattggggcagcacaatttgttggcaaaatcaccggccaaatgtgcgtataaaagtggtgatcaaatggctgtcaaatcaccaaaacattcattcattttattattttattggcccttttcctaaaattcaatttacaaaaatg

SEQ ID NO: 111621 - DNA, 149 bp, Heterodera glycines
  Promoter: Source sequence=SeqID_12598; Location=2170..2318; Strand=-; Gene=SeqID_76260
tggatttttgtccaggaaatccaggtccaggtcaaatccgctcaaaaaatccaggtccaggcaaaacaggcttttttcaaaataccgatctctagaatttattgttttttttcaaaaatttttagagaaaaattgctgaaagtaaaatg

SEQ ID NO: 111622 - DNA, 63 bp, Heterodera glycines
  Promoter: Source sequence=SeqID_25922; Location=1055..1117; Strand=-; Gene=SeqID_56692
tcttaaattaggtgttctatggcgtcgctttggaaagtgacgccaattaaccgatgagaaatg

SEQ ID NO: 111623 - DNA, 243 bp, Heterodera glycines
  Promoter: Source sequence=SeqID_27803; Location=534..776; Strand=+; Gene=SeqID_58469
ttgcggcattacagactcggcaccgtcaccacagctcatcgagtatcaccaaattggcttttaaataccgcgccggtctgtggacaaacttttgcccggttcatcggagaaggccatcacaaaaacgtaaataaacaaaaacatttttaattatggacttaacatttaaacacttaattatggacttaacatttaataattgattttatttataaattgtgacgataagctagcacaaagatg

SEQ ID NO: 111624 - DNA, 635 bp, Heterodera glycines
  Promoter: Source sequence=SeqID_4556; Location=2675..3309; Strand=-; Gene=SeqID_54885
tttgtggaaaagtataaatgcgtcgcttttgcccaaaaatcgaccttttgtttttcattttccaaatgttttttagcttatgtcaccgtttttgaacactcattgactaattcgttgctaattgtcgccttcggcgcattgggtaaaacgattttaatattttgctgaacataaatttctcccatttgaaaggcttttcggtgctcgtcgcttttctgtctgactttcttcgcgtgcttaccgtgcacattttctgcttccacatttacacgcacaggtcaaatttttctgtgagcacattccgccgggaaattcttggccaatgttttggcctacaattagtggacataaaactggaaattttgtcgccaaattttttcttggcatcgattgggttcgtttttccaccccaaatggcagggctcagccaaacaacagcttaactttttgttttatgccactgtcacaatttaggacccacccccctttttccaatccatgttcatccttttaatctggtatccccattttccattccaattatctcttcccaattttttctcaattgtcaggttggccaaagtctcctgcaccgcctttgtgggcctcggccgcgcctttcgcagcaaaaaatg

SEQ ID NO: 111625 - DNA, 309 bp, Heterodera glycines
  Promoter: Source sequence=SeqID_1834; Location=8684..8992; Strand=-; Gene=SeqID_76240
ggttcttttttttttgttgcagatttgtcgtttatttggccgcccatttcactttcagtttggcctacacacttaccgtactgtgcaacattcagtacagtaactttgagagagctcaccgctattttggcacggcactgaaacattttgaagggataaaggcattgatgagaaagagcaattggccaatggtcggggccaatgggtggggggggggagacggaatccaacccaattgtaccaattaaggcgggccttcgtctcggagagtttgtcgctcggatggaattggttcttcacgaagcgatg

SEQ ID NO: 111626 - DNA, 130 bp, Heterodera glycines
  Promoter: Source sequence=SeqID_8162; Location=3160..3289; Strand=-; Gene=SeqID_67179
aaaagtaaacacagcgaaggacaaacggggaaaaaataaataaattagcaaataattatttaatttttaggaattgcttctttatttaattgacgaaggaacggacggcggcacttcggccgggaaaatg

SEQ ID NO: 111627 - DNA, 208 bp, Heterodera glycines
  Promoter: Source sequence=SeqID_10991; Location=4632..4839; Strand=+; Gene=SeqID_74300
attgggccgccctcaataatacccattctcaccattattataaaaacatatatttaaattttaaaatattgcttataatagtttgcaacgcgcacacacacacacacacacacatgaatatatctgacagatgatgtcgttttgtgtgtaaattttataattcgttttgaaagtaatattctgcgtccttctgatctaaatcatcatg

SEQ ID NO: 111628 - DNA, 112 bp, Heterodera glycines
  Promoter: Source sequence=SeqID_41032; Location=159..270; Strand=+; Gene=SeqID_69255
ggtgattttttaaaagctccatatatattttgggtctttaagtttaattgtcatttttcttttttagcaccagttcttttgcgatcaaaccgacattctcttgcgggaaatg

SEQ ID NO: 111629 - DNA, 166 bp, Heterodera glycines
  misc_feature (47)..(47): n is a, c, g, or t
  misc_feature (80)..(80): n is a, c, g, or t
  misc_feature (130)..(130): n is a, c, g, or t
  Promoter: Source sequence=SeqID_44491; Location=1..166; Strand=+; Gene=SeqID_71972
aaaatgggaaagaaaaagagaaagaaaatttggaagaaaaaagaganataattcaaaaatattataaaataaaagaaaanataaagggaaaaggaagaaaatattcacaaaaagaatggagtaaaatacntcaaaaatagcgaaaaaattggggacaaatcgaatg

SEQ ID NO: 111630 - DNA, 161 bp, Heterodera glycines
  Promoter: Source sequence=SeqID_6763; Location=603..763; Strand=-; Gene=SeqID_62805
tttcttatcttcgatttcagttggcttttttatgtgcgcattggcaaagggtggcgatgcattccaacgaaaatcaggtaaaattttgtgtttgcaaacaatttcaaccccattttcataaatcaaacaaagtcccatccctttaacatttctcacagatg

SEQ ID NO: 111631 - DNA, 766 bp, Heterodera glycines
  Promoter: Source sequence=SeqID_3986; Location=1..766; Strand=+; Gene= SeqID_52703
agcctggactcacctgaccacacaataaaaagtgcttaaaggtcatttaaataattttttatgtttttttactgctttttgttaggacatatgtaaaatcatagtcatatttgtaatatgcttttaggtaaaagttaaattttaatataataacgttttttattttattattttagcgtttttcgtagaatttttgggctttccaattgaaacatttaaccatcgcaaaaaggagcatgcgaaaacggagcaagtaacccttggctccggggggggggggggcggctgaagtcaaaaattcgatttttaggggtgtatttcatttttttaaaatttattttaaattgcctttgttttcaatgctttacaaaccattacaaaatgcaaattgttcaaaaatgttaaggcaacgtcaaactcataaattcaagcaaatgccgttacgccttcaatttgtatgccgaaaaaaggaaccccggcagcggcaatttgagctgttatgacggtgtaaaaaaccaatattatcaatgcccatgtaaagttggtaatgaaaaatgccgcactgaagaaaaatgggcacacgaagaatttctttgcccaataataaaggtaattaattaatcaattaatgtcaaaaggcaccgccacaaaaaaatatttgagttaaatttttaggcactaaaaaaatttgaatttgaaaaacaaaaaaaaataaggccgaaataagtgcaaattttagaaataaggacaaattagaagataaatg

SEQ ID NO: 111632 - DNA, 64 bp, Heterodera glycines
  Promoter: Source sequence=SeqID_12476; Location=1082..1145; Strand=+; Gene=SeqID_47041
ggttggcaaatatacaaaaaacatttttgaaaattattaaatgttttagaaattgttgagaatg

SEQ ID NO: 111633 - DNA, 663 bp, Heterodera glycines
  Promoter: Source sequence=SeqID_14722; Location=1..663; Strand=+; Gene=SeqID_78849
tgggaaacaagttgaatacctatttcttaatatatagccaccatgggtttcatttttcaaccccccccccccctcagaaactcagaagggggaggctttaattcaggggggggctgtattagaggaaatacggtaattagtttcccattaaaatattaagacgcaaataattaaatttttttttttgtaattttttgggctcatttttggtggaatccagttggtttggttggtgctgggacgttagtcaaaaaccatcaaaatgggcgttagtcaaaaaaccatcaaatgaaaaatttttgtcagaaatttatttataacttagcctaatatgtacgaaattttaaactcttgatatttttcgatagctctaagtgttttctattatcatgcaaaattttagaaaaattaattaagtttgaaaaaagttatgacttgagaagctcagaaaaccaagtttttttcaacatttttggccataacttttttgagacttaatgaatttttttgaaattttgtaggctaatagaaatacttagggctatcgaatgatatcaagattttaaaatttggttgcatctgagcaaagttatatcaaaaaatcttttcatttgatggttttttgactaacgcccattttgatggtttttgactaacgtcatg

SEQ ID NO: 111634 - DNA, 536 bp, Heterodera glycines
  Promoter: Source sequence=SeqID_33644; Location=517..1052; Strand=-; Gene=SeqID_63652
tttttttgagataatcagaaaagggcatacataaaaatataaatatatattcctaccttagatagattatggcaataaaaatattttggataacttcaatactgtaactttattatatgtattttaaatatcaactcaaagaatcaaaattatttttaaaatttaaagttggtgtcggattttccagagtcggattttccaagagccgcgttagccaagttcccatcaaaagatggtgtggcagatattttgactaatttcgaatcccggacccgaactaaaacaaaagagaggggggggggggaagagaggcttcctctcccactctttctccctcttctcctctccaatagcgtcgttttgtgttacgttgatcattggtcactaattgacctaattatgcagtttgtccctcccccatcatcaccaattgccttaacacgcatacacttattctttttcatttcttctaatttatccaatcaattttttcatttaacaattaaaaaagaaagctgtgtgctaattccctaatg

SEQ ID NO: 111635 - DNA, 689 bp, Heterodera glycines
  misc_feature (55)..(55): n is a, c, g, or t
  misc_feature (89)..(89): n is a, c, g, or t
  Promoter: Source sequence=SeqID_34929; Location=1..689; Strand=+; Gene=SeqID_64613
aaaaatttgataaatcatcccaaaaaattgtaaaaatgaggtattttttaactanaattgaaaaaagcaaaaaaattgcccgtttttgngaattgagttttaagaaattggaaaacttcgataattaaattcctttttttttggtgtattaatagcaaactaacaatgaaatttgaaaattgatcaaaaatcggacagtcccccgccttttccccccttaccaacctcaacattcataatcaaattgccgtccatttcgaccaacaaatttggtgcgcccgcattcgccacacacgcagcctttcgctggacagtgaaggagggcaaaatgagacggagcctgtgccagggaaaaaatatacgaaaaattcaaaaataaataaaaatctcaatttcataaagttagccttgcctttttcaattttgtttttctcacaaaaaatgatatcaatttgaaaagcaccaatcccattcaagataaaatttgaaacaaattgcaacaaaaattgaaacagttagggagtgtgggacatcctaaaagaatgtactattttttcaagtattttaaattttttacaatttttttagcaaaaaaatatttttctatgtaaaacagtaaaaaaaggctggtaagaattttccgttttctatgtattttttccttaaatcttttggtctgctcacaaatg

SEQ ID NO: 111636 - DNA, 79 bp, Heterodera glycines
  misc_feature (52)..(52): n is a, c, g, or t
  Promoter: Source sequence=SeqID_33825; Location=1439..1517; Strand=-; Gene=SeqID_63778
agtcctttgttgaatttttagaaatctatccgtcatatcggcttttggaatntaatgagtaaatcagtaaccgtaaatg

SEQ ID NO: 111637 - DNA, 277 bp, Heterodera glycines
  Promoter: Source sequence=SeqID_7533; Location=1..277; Strand=+; Gene= SeqID_65143
taattaaaatttagaaataaaaaaattttttgaatttattcctattcataaatttttaaaaatagaaaattttttatttgcaattaaaaagtttgaaatttttgttacaaatgtcgaaaaaaaaactcttcctcaagtattttggtgaaatttttgaacaatttaacaaaaattaatcagacggtccatttttgaaaaattgaggaaaatttgaaaattcaaaaaatttttttgtattatttgcaatggaaaaaatttgaaatttttagataaaatg

SEQ ID NO: 111638 - DNA, 1003 bp, Heterodera glycines
  Promoter: Source sequence=SeqID_14999; Location=563..1565; Strand=+; Gene=SeqID_79154
ttggcgtttcgtcactattttttaactatttcgggatttttcgtctctaaaagttctgccctattaataatagctttagtatttttcttcaaaatgatttttcaaactattttagctatttcatgatatttagcttaaattcgacgaatttgaataattttggagaattttcccctcaatttgggaaaatttatatgcatattttttactttttatgtgcatattttgcaatttttggtgcagaatattttgcaatttttggtgcagaatcattttgagtattgagcaatggagtcaaaatacaccccatggacggtaaaaaagaaaaaaaagcgacataaatctttttatggataattacagaaaaaaattggcgttctgtcacaattaatttttatctttacttatctcaattttatgtactatctcttcattcttaataatgtaaaaaacatttacttcatcctgtttaactttttttctgtttgttaaatccacaccaaattttgcatatcgatagagaaaaggaaaatgagcaaactttcagtgttttgagtaaaaattttggcctagaacattactaaaaatgggatgaaaaaaatttgcatttctttttctctccttttggcgtactattttcatgtctctaacacattaaaaaacaccaaattcgaaaattctaataattttggttataagggtacaaaatcactttgaacatttagaatcaatagaaaaaagaataaatttagcattttggttagaaagagctgcctaggacttgagttataacgtgatgaacatttgaaactcgcacaacttttcaaaaaaataacctttttttgcctttttttatgggaccaatgatgttaatgattaccaaattatttcactattcgtctctattttggaatttttactcactattttagttaactatttcaagattttccgtcactaaaaatcgctattttttattacatttttcaaataacgaaaaatg

SEQ ID NO: 111639 - DNA, 501 bp, Heterodera glycines
  Promoter: Source sequence=SeqID_5446; Location=1..501; Strand=+; Gene= SeqID_58075
ggatgttttgaggtgcacagaaatgttattattattaaaaaaacgtggctttacgtcgctgcttatttctttaaatgtcatttgtcttctgtttgtgtcccctccccggcggaaagcggggaggggggggggggtgaaaatattttttgttttattcaaaatggcattaaataaatgccaaacattcactcagacacattgaaactccaaagtactcagaatttgccacattggttctgtttgtgttagctcaacattgccatttaaaattcatttctttaatttaatgtcgacaatttttcttcccttttctcagcccccgaggggacgatgaataataataattagtgacaaattaattggggcagcacaatttgttggcaaaatcaccggccaaatgtgcgtacaaaagtggtgatcaaatggctgtcaaatcaccaaaacattcattcattttattattttattggcccttttcctaaaattcaatttacaaaaatg

SEQ ID NO: 111640 - DNA, 150 bp, Heterodera glycines
  Promoter: Source sequence=SeqID_10686; Location=3455..3604; Strand=+; Gene=SeqID_73936
ttggcgcttgggccgattgaaaatcggttcggaaaaaaggaaagtgcttggggaggagtcggagaagttggagcagttttgggatgatgatgatgataataataatgatgaagacgatgagggggaaggggaggaggaggcgggagaatg

SEQ ID NO: 111641 - DNA, 115 bp, Heterodera glycines
  Promoter: Source sequence=SeqID_4706; Location=334..448; Strand=+; Gene=SeqID_55457
ggtgagtcgtcactctctaaaatgcccatttaaacgcgtttctttggcatttgtgtctccttttggcattccccccatttagacacgtctcttctctttgcacactttgccaatg

SEQ ID NO: 111642 - DNA, 62 bp, Heterodera glycines
  Promoter: Source sequence=SeqID_11114; Location=2675..2736; Strand=-; Gene=SeqID_74455
ataaactcttttatactataaatcgtgatcgctgatctgagcagataaaccaataaatcatg

SEQ ID NO: 111643 - DNA, 730 bp, Heterodera glycines
  Promoter: Source sequence=SeqID_36892; Location=1..730; Strand=+; Gene=SeqID_66098
tctcactcactttttcgtgtcaattctctcctctctctctctctccccctcccccccctgtttccttctctcttcttaactcccctctctttctctcactcactttctcgtttctatctctctcccccctctttctctctctctcacttactttgatcattatttacgtgatcaaatatcccacatgaacaatttgtgccagatttgtctttttattttttgaagcaagagtcaaatgccaaatctcaccaatcacactgatccggagaccgacctattttttgccataactcctccttccaactaactctgagaacacatgtgacaaaaattaaaggcattataaattacggaaaaagcaataaaagttttattgaatttctaattggcttaaggtaaaacaaaattttagcaattaaattaattttttttttactttattgcgttgaattacacaataagaagcagtttttttgttataatataattttgttctctattctttcataatatttatttgttccataaaaaaattatttttcaatgctaaataatttctcgttacttaaagtgaaattaattttaacaaagttaaatttccttttagtttatcgaacaaaaataatttttcctttacattttattcatcccttgcggcatgcaaattttaaactaatttttaaattatttaaaataattttttaagcaaccgttttaaataaattaaatg

SEQ ID NO: 111644 - DNA, 724 bp, Heterodera glycines
  Promoter: Source sequence=SeqID_16499; Location=226..949; Strand=-; Gene=SeqID_80900
gtgtaataataatttgggcagacaatttttaatgactaacaataacaagttatccaaattaataattaattaagaattaagaaaaaaagccaaaataataattaaatgctcggtcaataagcagtcaaaaagatagatcagaacgaaaataaaaaaaaattgttaaccaaaaagtttttaacaaatctttttaattttgatgcaaatgtttgtaggtttgtctaaaataagctcgttttttaagcgtttttaaaatatactaaatatgaattatatatcccttcagtgaagacaggaccgcctgggaaatttttgggattttggtctgatttttttttaaaaaacccatagaaaataaaaaaaatatgaaaattttgttaataataaaaaaacgactaaaagtgcttaaaaatttgcagtatgccatctatgaagcctttgttaataataacaataataatgttgtgatgaattaattttcctttaaaatttttttatagcaaaaataagttttatttatttttaaaaattaaaaaataaataattattacttactctgaatttgcgcagatttgaggatgtctttttcacctagtgcccaatctgcccaagcgcctcatttccgaaggactccaaaatttaaatttctgtttttaaaagaaagaaattccatcccatttagcgctatcgaagtgaccccgctttcgcagaaactgctcgtatg

SEQ ID NO: 111645 - DNA, 563 bp, Heterodera glycines
  Promoter: Source sequence=SeqID_26104; Location=2163..2725; Strand=-; Gene=SeqID_56851
cacttaatgcgctaaattagcgattgttaaatcaataataaattatattataggtaaattatttattattgtacaataattacataaatttttattaattttttaaaattttttagtcaaaacgacgcactgaatatattttacgaaactaattttttttttttcattttaacatgaatttattgttataacataaatttggtagtggtccaattttaataaatattttttaaattcaaattatttttctcttaaggttttaaattatttttaaatttacattttatttatgtattagtcatcaacactttaaactgatattggttaatttatgcagaataatttggtgaaaatgtttttggaaaagaagaacattcattccatttgtacacaattattattagtgtttaacattaaatcattattttttcattactaaactgatttttttttgaaataataatgataaaataaaaagtcaaaaccaaagaaaaacttaaattaaattaagataaaaataaaattttaaattccatttaaaaaactgtttttcaatcatcatg

SEQ ID NO: 111646 - DNA, 1003 bp, Heterodera glycines
  Promoter: Source sequence=SeqID_24196; Location=844..1846; Strand=-; Gene=SeqID_54909
tgccaaaacattgtttaatggccacccgagtttgggagtgtgcagcattataattttcttctttttctgtgcgtgggtttcttaatgagtaaagagcccacctctttggctcaagtgcagtttatgagggtgctatgacgttagtcaaaaaccatcaaatgaaaatattttttgatataactttgctcaaaagcaactaaatttttaattcttgatatcattagataggcctaagtgttttctattagcctacaaaatttcaaaaagtttcgttaagtttcaagaaagttatgactgaaaatgttcaaaaaaatttttctttgagcttctcaggtcacaactttttttaaacttaaagaattttttaaaattttgcaggatagtagaaaacaattagggcatcgaaaaatatcaagattataaaatttgatcaatcttaaacggaattatgaataattttctgtcaaaaattttccatttgatgctttttgactaacgtcccagcaccattattataaaccggacccatttatggcaactttttttggaatatttttttttgagaggatacccaaatttcaacgagaaaattccaattttacgaagttttcatgcaacagaagatggtaacataaaattttatgtcctgaaaaatattttttatatacaatttgtcgatttggatattgcatttcaatgtggcctcgttagctcagttggtagagcgtgagacttttaatctcaaggtcaggggatcgagacccctacggggctttcaattttttttcatttttaagtttaattactaaataatactttaattgtccaattttaattcaaacgtggaattttttatattttttcgtattcttttttttggcgcattttttattaaacaaaacaaaaattttttttactattttcaaaaccaaaaaaaaaattcccccgcagagcaatggttccggcggtggtccgtacagtgtgggcggcggcggcacaaatg

SEQ ID NO: 111647 - DNA, 126 bp, Heterodera glycines
  Promoter: Source sequence=SeqID_10991; Location=2953..3078; Strand=+; Gene=SeqID_74301
aaagctatttgcagagccgaaaggaggacgaaaaaaatatcagtttttgatatcataagtctgtatccttttgtgaattatacgtgcgaatatccggttggcataccgaccatcatacggccaatg

SEQ ID NO: 111648 - DNA, 729 bp, Heterodera glycines
  Promoter: Source sequence=SeqID_14777; Location=2188..2916; Strand=+; Gene=SeqID_78917
gacattaatgttttatcagtgtaccgacttttgcgccgcgacatttgcgccgccctacaaaatccatttgcaccgttctaagcaatgcaaaaaaaatttttaaactaaaacttgtaaatataaatgtggcttaatatctgatgtacgcattaacaaaaacaaaaaataggtgtctaacgttggagtcggggtcgttttggcgcccacgttttggcgccgacgttttggcgcccacgttttggcgccagggtcgttttggcgccgacgttttggcgcccacgttttggcgcctgtaggaagaaggacatttgatttaaatattggcgttccattttgatgttcattccccatttattattgatttacaactttgactttttcacaatatttcccgcacttttcccacgttcagtcattatggttttatcattctgatttcgttccccatatttctccatccctctccaatccgtctcttctctaaatatattattttccttctccaaataagtaaatatatatattctccatccatcgccaattgacttagtgatccaaatccgaaccccggcattctctcccctcttcctttaatcgtacttggcgctcctggccgacattcgaactgcaccgccttttggaagacatcgaattgctcgccgattgccgacaagccagcaaagcacgtgaaaaagcagcgccgtccgcccactcaattcgccgaaaatg

SEQ ID NO: 111649 - DNA, 128 bp, Heterodera glycines
  misc_feature (35)..(35): n is a, c, g, or t
  misc_feature (90)..(90): n is a, c, g, or t
  misc_feature (113)..(113): n is a, c, g, or t
  Promoter: Source sequence=SeqID_42629; Location=1..128; Strand=+; Gene=SeqID_70479
cgatcatatcttttttaaaattaacattttttacntattttttaatttttgataattcttaaagtttctggattattaaaagtgaaattntgctaaaaaaataaaataaaatnttctgcaggcaaatg

SEQ ID NO: 111650 - DNA, 392 bp, Heterodera glycines
  Promoter: Source sequence=SeqID_13729; Location=309..700; Strand=+; Gene=SeqID_77646
tttcttgcaggtgttctgtgtgttgatgagttttagctaaatgatgtgctgttgccatttaggtaatctataaatgcttttcaaaatgttacgacatggttaatttgaatgagacaacacttactagcgtggtaaccaccagatttgtccttatttctaagacttgtcctggtttgaaggggaaattcacaaatccttttttcaaagattcgtccttttttggcctttcatcattatttttatttaatatttgactttgatatgtacagtaaaattacaaaaaatatttattttagtaaattcctctcataaatttgcatgtttttcatgcgatatgttcttattatcacttgttttagaataccacttcaaaactctgacttttcataatg

SEQ ID NO: 111651 - DNA, 1003 bp, Heterodera glycines
  misc_feature (489)..(489): n is a, c, g, or t
  misc_feature (494)..(494): n is a, c, g, or t
  Promoter: Source sequence=SeqID_11450; Location=559..1561; Strand=-; Gene=SeqID_74847
tctgatcaaatcactttttttctcctccataaggctctcccgttcctcctatttgtgctgtcctttttgtgcttcttcgccttctcaccacgttcggcggcaatttcctttcatctgttgcccgattctttcaactttggcggcggatcagtgtcagcatcggaacataatggtgataatattaaaaaaatattaaattaatttatctctccctattaattataaactagatttcgtttttacaaatgattatgtgcggccttaactattatttttttgaatatttgagttttttagtccttcctcatagcacgtattgaatttttgaattttcattatagctttggcattttattgtagcttttaacgatttagttgttaattattttttaatgttttaaacatttataaggttacgtgctttaattaacagatgccttaacatgctccaaaaaatgatacattttcttcacagtgaatgcaaaaatntaatntaatgaactcataaaagaaatctcaaattttttatgaatttatgtgcggcactaacgacgaattttttttttcaatatttgagctttttattcctacctcatacgtactgaattttgaatttttattcaaattttggcattttactgcagctttttacattttttgttaattattttttaaatattttatgggttacatcattaatttaatagatggtttaatatgctccaaaaaatgaaacaattcttcactagaacaccaatttttaggctctaaaaccgccaaaatagctaggctttaggctttaaaaaacccatttaggagtgtaaaatgacaaattttattcaaaaaagtaaaaaattaagccaaatcagattgagataaataattttttaaaagcaaaaattcttgtcaggaaaaaaacaaatgaatttaattttttttaattaaatattatttaaacttattcctgacaggtccttgcatttttgcgcgttccatcaatatg

SEQ ID NO: 111652 - DNA, 465 bp, Heterodera glycines
  Promoter: Source sequence=SeqID_23332; Location=939..1403; Strand=-; Gene=SeqID_54042
tccctgatttagtggaccattgtttttttccctatgttttgtgcattgtgtcattttgctaaaccattcaattcacccacccactcaccaacgaacacatcaaaatgctttgagttgacatttgatattttagcaattaaatttgatttcttttttttttctgatctcggcacaccacatcatcacatcacaaaaaaaattgttgttgcacaataaatttttctgccggagcacaaattttttttttcttggccacccaaaaatttaaccccccccccccaaaaaaacggcacaaaaacaacacaccacacgcataataaacacacacacacacaaattggtggttaaatacctacgtgtttggtgacaacaaaactgcaacagcaacaacgaatgacaaaaagtaacagcaccagcagcaatgatgactgttttttcaccaacggcaccacccaccaaacaatg

SEQ ID NO: 111653 - DNA, 223 bp, Heterodera glycines
  Promoter: Source sequence=SeqID_18711; Location=1185..1407; Strand=-; Gene=SeqID_47538
ttcgttctcattgacttgaaattttttcacgtgaagcaaaaaagaggagggttggccgacagatagattctcctttatcacaaaatgtttaacttttacttaacaatggaccctactttttgttaattgcagcgcatgaacttttttgaaattcatttttgaccattgcttttcattttccttttttcaggtagtgtaataaattcttattgtagtaaaaatg

SEQ ID NO: 111654 - DNA, 315 bp, Heterodera glycines
  Promoter: Source sequence=SeqID_17927; Location=1..315; Strand=+; Gene=SeqID_82484
ttggctccggcgccaaaaatgatcagaaaaaatattgccccccgttccgaaaaataaaaaaattgaaaaataatgatagcgtggatatttgaacactcacagttgggtatgttcccgtgttagaggctcatttatcccaacattttatagcgtcctttttccgaacgtttggatttattaactttacctcaacttttttctcacaataatttttaattttgtttttaattgtttataattgctttttcctgactggtttttacgtataaaatttctgagtttaacacacttacaggttgcacacattctgcaatg

SEQ ID NO: 111655 - DNA, 374 bp, Heterodera glycines
  Promoter: Source sequence=SeqID_8266; Location=1..374; Strand=+; Gene= SeqID_67494
aaaacatttgttattgcaaagtaacagatgaaaaaacacatgtttttgggcaaaacatttgttactgcaaaataacaaatgaaaaaacacatgtttggggccaaaacatttgttactgtaaagaaacaaatggttttgcatgtgttttttcattgcttttgtaaagaagtaaatagtttcgcttgtgaaaatgtgttttttcatttgtttatttgcgtaagaaatgaagaataacaaatatatacactaaaccattttttatatacaagcaattgaataaaacacaacgaatttctaaacatgttttcgaaagtaactaatgaataatatgtgagaaataatttgcttatattggcaaactaagagaagaaatg

SEQ ID NO: 111656 - DNA, 853 bp, Heterodera glycines
  Promoter: Source sequence=SeqID_42801; Location=1..853; Strand=+; Gene=SeqID_70601
tcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattcctttctggacttgacttggtttcttgatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatgccaaaacaaaacgaaatcgttttaaaatattgctttctggacttgacttggtttagagatatagcaactgtgagtatacagtagttctaacacgtttattgcaatccctcggattttcagaactggttttcagaaaaaatg

SEQ ID NO: 111657 - DNA, 217 bp, Heterodera glycines
  misc_feature (166)..(166): n is a, c, g, or t
  Promoter: Source sequence=SeqID_5959; Location=1..217; Strand=+; Gene= SeqID_59830
cgtttcgatccatcgcttttggtcctttcgttcagcccatccaagccaaggaccgtccatcaaatccgtttggcatgctcgcgaatgtttggccaattttggcactgaccaattccgcttttttgtccatgacgttgttttgggcggcgaattccgacggcacttngagagggaaaatgcgcaaaaattggagcaaattttacgcattgccgaaatg

SEQ ID NO: 111658 - DNA, 457 bp, Heterodera glycines
  Promoter: Source sequence=SeqID_2961; Location=3255..3711; Strand=-; Gene=SeqID_82515
tctgaattaataataataatttattaaatagatttttaatttaaattgcttaattagggtatataactgttcttgccaatgcaaattaatctcgactaacccctctccaattgggattgaaaatagtgaattaaatttgtgtcagcaaatcaaaggtcgattcttcgggagattccctgacgtttccgtgcttttgtaccccaattcaaatcaattagaataattttgttttaaaaacttgtgcatattttccccaattcagcccatttctgttgctcgggttcagtgctgtcaggtcgcaattcatggtattaattgcgcattttaattgcctaccgtttatccctaccgtatttatgttgtacagtatgattgcctcccacccggccgttacttcgcttctgcacctgcgggtccgcctcccttgccgcctccgcccccaccgcccgccataatg

SEQ ID NO: 111659 - DNA, 93 bp, Heterodera glycines
  Promoter: Source sequence=SeqID_28365; Location=1..93; Strand=+; Gene= SeqID_58997
aaattcgcattcttctaaaagtttattagatctcaaataaaaataattaaaatttaggttgaaggcggcgtaaaagttgaaaatggccaaatg

SEQ ID NO: 111660 - DNA, 972 bp, Heterodera glycines
  misc_feature (42)..(42): n is a, c, g, or t
  misc_feature (962)..(962): n is a, c, g, or t
  Promoter: Source sequence=SeqID_40179; Location=558..1529; Strand=-; Gene=SeqID_68591
gctgaaaaataattttatttattataatcattcagagtcagntatattcatatataattttttagataactttaaaaaattttataataggaaatataatttttaattaaaatccgttcttttaactaatttaataaattgatctttaaaaaaatcaagaaatgtatagagtcaactgaaccatcctgtcaggaagtagcgcacaagaataaaaatattcttggggtaaattaattcatcgatgtctaatattatttcaaatttaaaaataataaaaaatttcaactcaccaaatataaagttttttcacgggctatcaaacgcaacacattaattttatttttaaaattaaaactatttctaaaaaagtttttactaaacttccctgatcaatttattttaaataggttttctaactagttctttttacaaaaaattttattattaattttggataatatatattgaaaattttgtaattgtaatttcatttatagtaaattatcaaaaaattatttataaaaaaaaactttatttttaatttttcaatcattttgatacataagatactcaaaaaaaaaatcatacaaaaatatttttttataaacctacaggatatttatatttattgcatatttatgtttaatgtaattttttgattttaatggaaaaatatttaaaaagctcatttggcaaaaatggctaaaattttacaatagaaccttggggtgatctacacccacacaccaagcttcatttggaaattccacggtcacttgccgacccttcctttgtcagaattgaacttttaaaaaaatttcaaagattacatttattttaatatcttttttttatcaatatcttcttataattaattttaattaatataatttttgtttaaaaaagctcattttatttttaaaaaggagagaatcgaattttgtactttgaattcaaaaatntaatgaaatg

SEQ ID NO: 111661 - DNA, 1003 bp, Heterodera glycines
  misc_feature (948)..(948): n is a, c, g, or t
  Promoter: Source sequence=SeqID_12780; Location=547..1549; Strand=+; Gene=SeqID_76492
taggctattaaaaatgaaaaaaataataattttaaattaaaatattttttattaattaattcaattaaaataatgttaaagaaaatataaaaaaatgttctgttccatcagggaattgatccgaagagacaaataatgaaagtaaaaaggtttagccacttgaccacttatacatatgcacacttgctataaatgaaaataaataatttaatttatttttatcaaaaatttctgatccctcaccaattcccttctcttttctcacccagacccccattcttaccagtgcttatttagtcctgccgggaccgggactggcaaaaccgggaccgggatttctgtttttccaaaaaccgggatcgggaccgggacctgaaaaacccgggatttcccgccccggtcccggtcccgctcaaccttacattaaagtgattcttgagtatttaagagaggttaggggattttttgtgtttttagcacggtgttttttttaaataaggcgcaaaaaattacccaaatggcgttatgaatcattttatgagttgtattttctcgggatcatggtcaggataggattacgaggattcaagtcacaattttttacagggtcctagtcccaggtgtcatttatgataatgtgatctgtcacccacaaatgaagttgggaaaattttaaaacttgttgattgagatttcctgcttctaaaactgacataaaatcataattattccagaaaccagtttatttgaaaactccgagattgaagtccatattttgtggaattccgaccctgaccgtttttcaaaaaaaaaaaagaatgggaccgggatccagtgaaaatcccgacgggacctcgatcccatccttgctctattacattttaatatttgctaatattttatctataattttaaactgccttaaatgtttttaatttttaatgactntaaagagcctttctattaacattgaagtggtagaaaacgaaaatcgtcataaatg

SEQ ID NO: 111662 - DNA, 387 bp, Heterodera glycines
  Promoter: Source sequence=SeqID_13910; Location=1634..2020; Strand=-; Gene=SeqID_77861
ttcaagatgaccaaaaatagtaaacttagagtccgagagcgagaattgacccatgaaacaggaaatttttagacttgagaatggagaataaatattttataaaaaaattttcactcattaagtcttcctaaaaagaatgctttgtatttttttaaaagttcaggacgacatcatttatttatttctttgagctcgattgttaataactttttcaacaaaaaatgtagttagacccgggaaaacctatatatattggaaaatataagtaaaaaaaaatatttttcatataatctcgaattttattttatttatttgttagcaataatccattcagtttaagatttttactaacacttggacaacatcttcgatttggaagatgaaatg

SEQ ID NO: 111663 - DNA, 176 bp, Heterodera glycines
  Promoter: Source sequence=SeqID_18177; Location=1954..2129; Strand=-; Gene=SeqID_82761
agggcgcgcgccgccccgacacactgttggcccgctgcattgagcatctgctgcagcgtgtgctttccggccgtgcgccgccgctgcgcatcgggttgtcatgccaaccaccgcagttcgcgaccccctaccacattccgcatcgcgcgccggagcagaacacagcggccgcaatg

SEQ ID NO: 111664 - DNA, 330 bp, Heterodera glycines
  Promoter: Source sequence=SeqID_33239; Location=1..330; Strand=+; Gene=SeqID_63364
attctgatgaggaatttagattatgtagcaaaatttttccttatgagactctggaaatttatttaccttaatcgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttggtcccggtactgagtgttttagctcaacatttattagaaaaaataacatcatg

SEQ ID NO: 111665 - DNA, 282 bp, Heterodera glycines
  Promoter: Source sequence=SeqID_40727; Location=1..282; Strand=+; Gene=SeqID_68989
gtcctcgtaaaaaaaatttgggggcgatttgaatgagaatagctttagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacattttttataaaaaatttaaaaatg

SEQ ID NO: 111666 - DNA, 510 bp, Heterodera glycines
  misc_feature (12)..(12): n is a, c, g, or t
  Promoter: Source sequence=SeqID_43768; Location=866..1375; Strand=-; Gene=SeqID_71364
atgtcatctttntggattatgtccatatttttgtgcatattttggcatttttgcgaaaatcctctattagaacggaccccattagctaattgacctttttgacaactaaatacccgaaaaaaatttttcttatgattttgactaaattttaaaattccataaagttgctcaattgtgtcaaaaataaggaaaaggcaaaaatttcgcttttcaagatttagcaaatttgaggaatttttaaattatacaactcaatttttaaaaatttatgtttccatatttttgccatttttgcccataatccgcgatttttgtatccatattttatggccatatttcgcgtatttttatatccataattttttatatgtcttagaaataataccaaaaattgtgttgctgctgctgttataattaataataggggtgtattttccctgattttattgcatttttaatggaattttttgtaaaaaaaaacgccaaaagaggcaccaaaagggcaaaatg

SEQ ID NO: 111667 - DNA, 767 bp, Heterodera glycines
  Promoter: Source sequence=SeqID_4858; Location=1..767; Strand=+; Gene= SeqID_55981
ctgctgcacagcagcacgcgtctgttcactgtatgcccctcccacccgccgctgcccgcgtagaaagacagtcagacagtgcactatttcccacctttccctccctctactttttttcaaattcatttttaacgcaaaactcaaacaaaacgccacacaaattcaaacactggacacacacatacacacactcaactttattatataagactagcggggtcagcgccttcggcgcatcccccgctaggcagtacgattgtgttatagaattatgaatgataaaatcgactggctcggccgcttcgcgccctcgcatcattttcttggcttttctccaatctctgggactcaacccaccagcaattcaatctctgggactcaattctccggcattccaaacattgggacttaacccaccaactttcaattacattccaatcgctgggactcgacccatcagcattccaatctctgggactcaaatctgcggcattctaaacattgggactcaacccaccaactttcaatgacattccaatcgctgggactcaacccaccagcatttcaatctctgggactcaaatctccggcattacaaacactgggactcaacccaccaactttcaatgacattccaatcactgaaactcaacccaccaactttcaatgacattccaatcgctgggactcaacccaccagcatttcaatctctgggactcaaatctccggcattccaaacacggactcaacccactaactttcaatg

SEQ ID NO: 111668 - DNA, 80 bp, Heterodera glycines
  Promoter: Source sequence=SeqID_42905; Location=1..80; Strand=+; Gene= SeqID_70703
ctggcaacaaaccaagccctgctggcggtccgatggcctttattcttaacggagaattccatcgccgcataagcagcatg

SEQ ID NO: 111669 - DNA, 571 bp, Heterodera glycines
  Promoter: Source sequence=SeqID_1320; Location=1244..1814; Strand=-; Gene=SeqID_72487
tttggcttttgcctataccacaaaaataacttctccactttttggccgggcgatactcaatcctagggttaagccagggccccttgggcaagaaaattctcgtggatcaagcagctcaaaattgtccgggatcggcgaacgaaaaattgtcggggatcggtgacaccctttcggagaatttggagataataaacttaatttcatagatgaaattttgattatagttatgtgattttcaatttctcacaaatctcattaatttttgttaaagaatatattttttccgattaattccccaaagtaaatccgtttaacaaaagtgcgcgaaattttaaccgcactttgctgttctgtcgagaatttcgctatcaaacaggcgcccaaaaccagggcatttttgccaatcccgactaggcctggctaagtttctactaatgagatgtggttaactaattactagtaaacaattttcattaaactttgttcggcttacatatattcttcctaatttattttaagcattgccacatcgaaatatttttgatttaaaaaatcaacaaaaaaaacaatg

SEQ ID NO: 111670 - DNA, 348 bp, Heterodera glycines
  Promoter: Source sequence=SeqID_42081; Location=1..348; Strand=+; Gene=SeqID_70071
ggactcaacccaacagcattccaatcactcgggactcaacccaccagcatttcaatcactggggactcaacccaccagcattccaatcactgggactcaacccaccagcatttcaatcactgggactcaacccaccagcatttcaatcactgggactcaacccatcagcatttcaatcactgggactcaacccaccagcatttcaatcactgggactcaacccaacacagcatttcaatcactgggactcaacccaccagcatttcaatcactgggactcaaaccaccagcatttcaatcactgggactaaacccaacagcattccaatcactgggactcaacccatg

SEQ ID NO: 111671 - DNA, 517 bp, Heterodera glycines
  Promoter: Source sequence=SeqID_11743; Location=3211..3727; Strand=-; Gene=SeqID_75233
ttttgtgcactatttcgtttcaacattgtatcaattttttgttgtcttttgaaataaattgtgaaaaaatatacgaaaaattattttcgcttttaattatgatgtacaatgcttttaagccccgccgtgaggcggcttctttttgtgcactatttttcgtttttaaaatgggatccggattttttggcttttttaaataaattgtgaaaaattcaaaacaataatcttttttattgcgctacaaatgcttttaagccccgccgtgaggcgggacagttccaaaattggcaccacattttactgtggaaagtccaagtaccttaattggacaactacgtgtcaatgagcacagtcgccgttggccagttgtgaaacagaaaaatgggaatatcagatggggtgcgttcttttctaaaaattcctgagggcgtgggacggaccgcaaaacttcgccaaatttcctttcattgagattaaatttcctctgcctttcgacaactttttcttcctaacaatg

SEQ ID NO: 111672 - DNA, 313 bp, Heterodera glycines
  Promoter: Source sequence=SeqID_7869; Location=884..1196; Strand=-; Gene=SeqID_66230
tgtttaaccaagtgatcaacgaaatgaccctttcatcactgatcaaaatccggttttttctgatcattgctactttccgagactttaatccagatagatgatcaatgacttttggatcaatgtttttgcttgagattgaaattatgttccaaggtttctgatcactgatttaaaatcctctattgtaattccttctcgagtgatcaaactgtttaaattgaccaatgaacttaatcgagactgaatttttttgtcggatttgagacaaaaataatttgatttttcactcataaaattttcgttcaggaagatg

SEQ ID NO: 111673 - DNA, 299 bp, Heterodera glycines
  Promoter: Source sequence=SeqID_38174; Location=383..681; Strand=+; Gene=SeqID_67071
tgaacagtgtttcgacgagtttgaagcacagacgagagccggggtggaacagaaaacgaatgccgggctgacaaaatgagggaaaattaagtgacggaaagattgggtaggctatggcctggctattttttctttggttttaattaactaggccctattttttcaaattttgtcatgctctttttggaacttaaaacaaacagacgaacggtcattcatttacacatacaaatgcgcacctgacagttcaaacagttccttgtcgcccggatcgtctccagcaaacagctgacacaatg

SEQ ID NO: 111674 - DNA, 433 bp, Heterodera glycines
  Promoter: Source sequence=SeqID_1877; Location=2809..3241; Strand=-; Gene=SeqID_76523
ggtataaatttattgtattcaccaattagagaataacaggaggattttttgagtgacaaattctagcgaattgatctaggtcaaatgcaagagaaattttagaaatttatttaggttaaagaaaaaatattccggttacaatccgggatcaggaacttgatgcaggcagcattttcggtggatctgtaccaaaaaaatttcctcaatccagacccagccccttaacatttatattgatggggatatttacgatttaatacgaaataaattttgcaaattttaagatggcccgaaacagtttatttataaaacggataaaaatggctcaattaattggaactttcgaaaggattttgttgaaaacaaacggataaataaggtgcacaaaaatattgaatcgcatgaaaaaataaccattttgttggagaatatg

SEQ ID NO: 111675 - DNA, 161 bp, Heterodera glycines
  Promoter: Source sequence=SeqID_9713; Location=4871..5031; Strand=-; Gene=SeqID_72459
gggtccacaaatgccacatcgtgtattcccagtcccgcaccaccatgtccaacaccctcttctgcacgtccgaccacttcctatgccccgtcaggtcgaaatcgaaatcgttttttgctttgccacaaattgtcaaatttgggctttagggtccaccaatg

SEQ ID NO: 111676 - DNA, 739 bp, Heterodera glycines
  Promoter: Source sequence=SeqID_29504; Location=1..739; Strand=+; Gene=SeqID_59996
ataacagtgttcagcaacctcgaaaacccctaagaatgtgttttcctttaatttatgaatttcaaatttttgttcgaattgggttcaggatttgtatttgcaaaataaaggtcatattcgtgatcagcgccacaaattacaccatgaaaaattatttcaaatgtcttttgagtgctttttatagtgcggtcacttaagtcccagctgaatttggcactccaattccggcactttttcaacctgaaaaagggcaagcgcacctttaattctatttttcctaccctttctagcctttttacatcgattctgaccgttttaagcatttttgagtttggggactcatgagaatcccatattcctcacccttatttactagaaatgttccaaagattctaataaattttaatggaagcaataaatttaaattattaagacgaattattttacgtattgagccattttatttacaatatttataaaatattacttgttaaattttaaacggtacgcaaatgtctggtagccataaattgtttctatgtttttaaaatctgatgaagaataagcgattccataaatttagaaaaataatcaaaacataaataaattttaggatgtgacaattaaaaaaaggccgaaggtaaaatatttgtttttatgctggtgttatttttttttgtctaagttggttgtcgatctagcaagttcatcgtcatgtaaagagcatcacaaaaaaatg

SEQ ID NO: 111677 - DNA, 97 bp, Heterodera glycines
  Promoter: Source sequence=SeqID_8848; Location=1152..1248; Strand=-; Gene=SeqID_69418
tttggtactcattttccttttagaagcaattcaattttccttttttaaatacctcaaaatttcgtctgcaataatccgaaggcttttttcgtcgatg

SEQ ID NO: 111678 - DNA, 293 bp, Heterodera glycines
  Promoter: Source sequence=SeqID_43048; Location=625..917; Strand=-; Gene=SeqID_70813
tctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaattgcagtcaaaaaattattcgaatttctccaattttgtttccataatttccgaaagttattcggtatcataatg

SEQ ID NO: 111679 - DNA, 508 bp, Heterodera glycines
  Promoter: Source sequence=SeqID_13781; Location=579..1086; Strand=-; Gene=SeqID_77706
atcagtgccaatgtgccatggcttaggtcggtgaccctgaaacggcgaaagttgacattgtgttacaattgttcgttaggcatgtatacccacgaaaattaaaaaaaacctttcttaatccgtgaaacgatatggggaagttgatttggcgggagggggaagaaaacagtgggggtcaactgggcgactttatttatttttttccaaggattatgaataagaaagccttctttagatgtggcaaatgaaatgattttattccttgttttacctctaaaccgtctgccaatttatcaacgaatatttaccatgattatatttttgtatattttttctgtaactctcagcagtcggccctaatctgtgatcctttccatcagggaatgagaatgaaaaagggagaaattgttggtccctatcccagccgagccccttcttttcccaggtggtgttgcccaagttcaaattggaggccacgcacggattgaacaaaccgttgaccaacatg

SEQ ID NO: 111680 - DNA, 53 bp, Heterodera glycines
  Promoter: Source sequence=SeqID_7413; Location=1832..1884; Strand=-; Gene=SeqID_64748
attaaaaggcgatgaattcaaattattggcactttttttgctctatactaatg

SEQ ID NO: 111681 - DNA, 234 bp, Heterodera glycines
  Promoter: Source sequence=SeqID_34378; Location=429..662; Strand=-; Gene=SeqID_64188
gcggggtgagaaatttctcgcccccgtggacgggggcgggggcggggctcaaccctatgagagaaaaatatctaataaaaattagtaaagttatttagagaaaatatttatattacgagaattaaaaaaaaattttattaagcaattaataattcgttgtcatctgtttatgaaagaagtcagtaccgactgatcagaacaagtgccgaaagtttggagaaagacctcaaaatg

SEQ ID NO: 111682 - DNA, 148 bp, Heterodera glycines
  Promoter: Source sequence=SeqID_235; Location=13234..13381; Strand=-; Gene=SeqID_79198
aatccctttcttcatctcgccgaattcgctggatttgttgaaattgtaaaacgtggaaaacgaatcttgaaagcggaggaaaagctgacaactaagtcaaaagcattgaattgaaaacgggaaaacaaattctcatttgctaatgatg

SEQ ID NO: 111683 - DNA, 392 bp, Heterodera glycines
  Promoter: Source sequence=SeqID_21451; Location=1..392; Strand=+; Gene=SeqID_52057
gggctgtcattataatcctcaaggagtggtccaaacggcacggcttgttgcagataaatccatttaggcacgatagaatccgaccgttggatggacgaattatgcctgggtttcagcactgatcaccgagcggcacctttcccttgtacaaagccccactattttttctcattcaaattttctcactaaagattaagccgtaatgctcggaggattgtaaaaatgttaattgaacattagcagtggagcaaatgggacaaatttctcgagtatttaaagggggagacacaattcataaattcattttccaacttttcgtactccattttaactatgtctcaacagccccaatactctgttccccctcccgctccatactcatatgcataatg

SEQ ID NO: 111684 - DNA, 81 bp, Heterodera glycines
  Promoter: Source sequence=SeqID_25681; Location=573..653; Strand=-; Gene=SeqID_56428
cgtaaacaaatttaaaaattaacttttttggcattttgtcattattgaaaaaatgtttaggacatccttttcaaggagatg

SEQ ID NO: 111685 - DNA, 618 bp, Heterodera glycines
  Promoter: Source sequence=SeqID_1741; Location=1..618; Strand=+; Gene= SeqID_75631
gtgtgggaaaaattccacacacaaacgcatggagagaagtgttgatacaatctgataattattgagagagaaacggacaaatcccgtggacatttgaagaataaagatcaattaaaataactttaattttaaataatttattttttgtaaatttttcaagatttcaatatcttactctaatcttctccgttttattattttgcttaaaattttatttagttaacagtttgttttttatgcaatgcttaattcatacacacaaatttattttatttgagaaggccaaataaatgtaaatgcaaattaattctttataaaatacacgtatttgtattcatatttttcctgtttaatttaacgtttataaattgatttatatgctataataccaaatgattttcatttttacattttttatgaataaattttagtttcattaatatagttttaaattttttataatataatttttcgaatgattcaacaaataaattatggcaaaggacagcgaattttattaattctttttttatacttttatttaaaaataattttcgctgaatttagaggtataaataaattgttccattcataaattttgtttatttttagagaatg

SEQ ID NO: 111686 - DNA, 851 bp, Heterodera glycines
  Promoter: Source sequence=SeqID_7640; Location=4460..5310; Strand=-; Gene=SeqID_65498
gtcagttattttttcgtctaatggaccaaaaaaaaattatttactttatgatttttaattaaattgtatacgaattattttgattatgtattttttcatttatgtattttgtgaataatctcgggtaataatttcacataaattacaaattcatttatttgaaaattcgaaaactttttgtctaatcaatataataacaattagctaatcacaaaaaatgcaatattatctcagagattggcaataatttttcttggtaatttttcataaaagcattcaaaatttcttcattcatcatcagcttggtgttaaaattatcagctttaatatttctaattaattaaaaaatttaaacaatttttccatcagcgtcataaatctgccgctggcaaatagaaaaattaattaattttttggttcataaaaatttggaagtttacctacagctgtttcacacataggaatcgtttttaattaacatttcttattaatttctttccaattgttaagagtttttcattataattttctggcgtggaaattttaggacaaattcaaaaatttatatacgttcattcattttctcacgaaaattttttcaaaatgtgtgaaaatgtgtaacgcaaatgtctcaaacttagcgattttttatatcacaataataatttcatattaatgtgagatttggcaaagtcaattaatttattaaaattatacaaaattaacggatcgttaattttaaatttttggagttctcgattatatatataatcaaaataaagaaaaaatctaattcacaatatttaagttttagaatcatttattcattgcttactatatcaattaaaatg

SEQ ID NO: 111687 - DNA, 96 bp, Heterodera glycines
  Promoter: Source sequence=SeqID_25864; Location=580..675; Strand=+; Gene=SeqID_56635
tcagcaaatgtagaatgaaaaaatgaaatagtaatgaatgacccgtgttaaataaaaaaaaacctttaattatttaggtaattagtttcatttatg

SEQ ID NO: 111688 - DNA, 1003 bp, Heterodera glycines
  Promoter: Source sequence=SeqID_2437; Location=1418..2420; Strand=-; Gene=SeqID_79725
attcggtggcttcgaaatgaatcgatttgttcgctttggcaccccacggaaaaatggaaaaaaacgaagtgcccccgggcaagggccaataaaaattagccaacaaagagagggacggaagaaaggacaaatcctcaaatgaaagccaataataatgacgcacatatgagaaatgtgaagttgatatttgaggataatattcaatgatttgactttttccataattattaaatgtttgaattttgcctctgattccctcgcccattccctttttggcatttccccttccattggtgccatttgacaaattctgtcggaaaaggggggtccattgagaaggggaataatattccccccccccccgcattctccatttcctttcattaagcgaagaaaatccattccgagttccaagggccatgcattctccccttcccccccccttctgtgccaattctcgactctcgtccctcgtcgagattcatttcactgtcccaatttgaaaggaaatgagatgaaatgcaagaaaatggggtggggaaggcaatgacaaataggcgggggtataattcctataaaaggcaaattcctttgtccgttagttcaactaaatttaaaatttttttttaaattttccaacaaacaaatttttatttcattttcttatcgtataataaactaaaaaataattgaatatatcaattaaaaatattcagtgcatttaattgaatttatttgcttaaaatcatttaccttttctttcagaaaatatttgccttttattaattaaaaatatgtaaaaaatgtcaacaaattccaacaaaaataagaaaattaaaaaaacaaattcaaatgggcattttgcggatggaaatggaaaagcggcaaagaattttgatattcatgcgggcagaaacgcattcaggtcaaatggaggaaaagaagcaataaaagcaaattaacacaaacaaaatgaaaatcccttaattaatttaggcaaatg

SEQ ID NO: 111689 - DNA, 384 bp, Heterodera glycines
  Promoter: Source sequence=SeqID_29647; Location=1385..1768; Strand=-; Gene=SeqID_60124
acattgacatcattagcagcaaccgtcaattatcatcccaattatcatcatccaaaccgctaattgcttcaccctccaccccattaatccccattatcatcatcatccttttcattattgacccaatcaccgccgtcaattagctgccacacatcttccgcttcatcttctaaaccctattttcctctgtttgattatccaccaccatcatctttatcatcatcatccgttttagcatcttccaccactaaatccgtgcttcatcatccctccccctcctcatcatcggcatcgtttgccaagtgcgctgttttttccgtcgcccctctgctccattgcttctgctgctggtcttccgttgtgccacttctgctcttggccatg

SEQ ID NO: 111690 - DNA, 313 bp, Heterodera glycines
  Promoter: Source sequence=SeqID_12882; Location=2448..2760; Strand=-; Gene=SeqID_76615
tactgtaacaccggcggtattccgcgtccgtcttgtgttttaagagccgcgactccacaccaccaccaacaaaaatagttgagtgaaaaattcactatttttacctgcctaaaatctcgtatttatatgtatttgtacggtttactgaaccacgttaattagcatgtaatttaaatttaattaaccctaaaaatccaatttaaaaccaattttaaatttggataattttattggaaggcttaataatttgtttgtacttccgttcttcattgggacaacacgtttaggctaagaattctgcttcaaaaatatg

SEQ ID NO: 111691 - DNA, 293 bp, Heterodera glycines
  Promoter: Source sequence=SeqID_4396; Location=1401..1693; Strand=-; Gene=SeqID_54297
ggtgaattaacaggaaaagaggggaatatttgaaaagttttatccaaattaaattcgaaagtgttgccgcgtgataacgggtaattaacaattgaattcaatttccttggtaccctccacgagttccctcatccaaatttcgtcgtccggaggcggtactccatccaatccgagttcctgggacagtcccagacaatgagttataccggtcccggtttttcagtggtgtcactcaactttttaacgcagtggcggaacgtcaaacgctgttggagcaaaaagtcagccaaatg

SEQ ID NO: 111692 - DNA, 55 bp, Heterodera glycines
  Promoter: Source sequence=SeqID_9992; Location=836..890; Strand=-; Gene=SeqID_73041
ggtcggtccttttcattaatcttatcaataaacgtaaaaaattccagcaaatatg

SEQ ID NO: 111693 - DNA, 268 bp, Heterodera glycines
  Promoter: Source sequence=SeqID_15311; Location=1321..1588; Strand=-; Gene=SeqID_79545
tgtttaatttaatcgaattaattggccattttccccactcccccttggtttctaacgaattgccaattggcatttcctcataattcaatttgattttgcccctccctgtggtgccaattcccgcccccccccctataaatttgcctttgcattttgcgattggtttcccaaaacggcactttttcggtttattgcaaatgcttcttttagatacctcctcctcccattcgttcattcttctccaattcgtcctttcccttctcaaatg

SEQ ID NO: 111694 - DNA, 353 bp, Heterodera glycines
  Promoter: Source sequence=SeqID_8035; Location=1826..2178; Strand=-; Gene=SeqID_66774
gaaatatgtgctcgataaaattatatatttcaatttaaaaaattatttttctggcaagtcaacttagttaaatttgaaaaatatttaactatattgaaaacatcgatcgaatggagaagtgaacaaaagtaaaagcgccgaaagaaggtgttttgtagcgtgaggaggtgatgagattaagcaaactcaaccatcaatcaatcaatggccaaccaaaaactaatgggataaaacgagagaaacagcaataaaataattagtcgttaattagtaaaaaataaataaaaattaattagcaaagacattaaataaatgaacaatttgtaattgcagtaaaaattattctaaaaatg

SEQ ID NO: 111695 - DNA, 294 bp, Heterodera glycines
  Promoter: Source sequence=SeqID_2247; Location=1301..1594; Strand=-; Gene=SeqID_78690
tttcaggttttcaaaaaataaaaatcctcccttaaatgtgatttctttaaggggggggcattccatgggggcaaaaattgttttatcccctgggctgttggaccggatggtttagccatggaaaggaattacaaaaggccagagaatcggatggaagcattgagagaaatgtttaaaaacttctcggggggaggaagtttggggtttgccaatttccaacagttattgattattgattgaacaaattttaggaatgtggaggtgaaagcggaatgaaagcggaacagagcgatg

SEQ ID NO: 111696 - DNA, 340 bp, Heterodera glycines
  Promoter: Source sequence=SeqID_29819; Location=1..340; Strand=+; Gene=SeqID_60272
ccaatgtgattaattccatttatagacacaataaaaacgtattattattttatcatttatttattttatttttgacaattttattgctgccttttcactcctcttttttgtgcttcatgtgatgatgatatttgtattagttaatgtgtttatttggcccaacaaaattaacattctcatctatttatttcaacgctcgcaaaatattatattcaataaaataaaaacaatttttgttatttttattttgtcctcaatttcccaaaaattttgatttaattatttattttgattaagttaaacggaaactttaaattatttatttttagatttaaaaatg

SEQ ID NO: 111697 - DNA, 66 bp, Heterodera glycines
  Promoter: Source sequence=SeqID_24946; Location=1301..1366; Strand=-; Gene=SeqID_55681
ggagagggggagggggagtcggaagatctgaaagaaagttgtctgacggaagagtctgaaaccatg

SEQ ID NO: 111698 - DNA, 581 bp, Heterodera glycines
  Promoter: Source sequence=SeqID_21758; Location=412..992; Strand=+; Gene=SeqID_52355
ggtaatttgccttgccgtatgcatttatgccaaaaactggatacacggcaaggatattgccgtatataaggcgccccaaaaatctattcacacatcactccatccaagacaatcccaccctttccggtgcccctgctgaacattcgcatggcctacccctctctctctctttcccgtcataagccattaatttgtcctcatttaaatgttgaaataattatttcaaattttgattcattattaaaaaaataaattaaatttaaaatgtaggactcccctaacataaaatttttcaaatttccaccctaaactcaaacccccccccgtccaaccttcctctgttgcttctctctttctctctctatcctctctctctctcctctctctcccgtcgtaggcctattaccagacagcacaaaaaaggcattttttacttacagtaaaaaactttttttttttgaacgaaagccctaaccttccacttcaaaatgattattaatttcgtttctaggatattttttaaaatttgtaggcttattattagggcttgtaattatatggacataaaatcgcaaaatatg

SEQ ID NO: 111699 - DNA, 98 bp, Heterodera glycines
  Promoter: Source sequence=SeqID_16781; Location=2683..2780; Strand=+; Gene=SeqID_81198
acttctacgtggatgaacacttcgagacacgcaaatggaaattgaacaaacaatttcttattcaatgggacattcaagaaaatgggacgaagaaaatg

SEQ ID NO: 111700 - DNA, 173 bp, Heterodera glycines
  Promoter: Source sequence=SeqID_39456; Location=775..947; Strand=-; Gene=SeqID_68020
acgagaatgataagagatgccgagggaggaggggttaagatgatcagagaagcttgaggggggattgattgatgaaaggccgggggaggaggggatgagaatgataagagatgccgagggaggaggggttaagatgatcagagaagccggaggggggattgattgatcaaatg

SEQ ID NO: 111701 - DNA, 806 bp, Heterodera glycines
  Promoter: Source sequence=SeqID_10222; Location=2493..3298; Strand=+; Gene=SeqID_73368
tttaaaattaattaattttcgcctgcaaatatttaagaaaaatttttaattttaaagggctttttaaatgaaattaggtaagcacaaattttgaatagaacagagacaaaagtgtcatataattagcgcagcagaagcagcggcggtagcagttctactacaccgcggcggcgcttttcggttacaaaacttctgcatttgcgcccagaatttttaatcggcatagtacgcgccatattgactatggcaggagcaggagtaaaacttattaaaaaattaaattaataaattaatttttctgattaaataaggtttttatttattattttttaaatgaaaaaatgttttgatcgtgcgtatttagttaatcttgcgaactttttttgtcgtagtacatgttctgtgttttggttccttgtagatgtggaggaggaaacaaatatttaagtttccattgtgagttttattttttttattgggcatttaataactttaaattaaggttatgtggattcaccttatgatgtgaattggctgttgagggttgggcgacagctgttaagatattggcagggtttttctgaacaggaaaatttgttttgattttttgtatttaaatttaattttttgtttatttcttttgtccattatactgctatcttttcaataatatttataagtgatttggtatttttgaatctgtgctatggatattgcaatttttatttgatcgattctaacgtattgacgtaattgcatttaaaattatttttagttggtaaattaagtatatttgcgacattatg

SEQ ID NO: 111702 - DNA, 487 bp, Heterodera glycines
  Promoter: Source sequence=SeqID_8497; Location=980..1466; Strand=-; Gene=SeqID_68288
acagctttcagcagcagcaaattccgccgcagcacgtgagcggaacagtggccaacattatcgtccaacagcccgtccaccaccaaacgcggttgtccgccagtccgacgattagcgtggagcagcaacaacagcaacaggtgggacgaaccaaagacaaaatgggattaattagtgaacgcatttttatgatgttcagccggtgattcttcacccgtcccctccgcccacgcagcagcaaattcacattgtccagcagcaacggcttagccctgtcccgcgaatccaaccccggccccttctcgaccttatcgtatttgctttttttgggggggggggatttttccaaatttggctgtaaaactctgccattaatttaattaggatgaaattcctttgtttcttattgtatttttaattgtccctttttaaggttgaaaatccacaaaaagcagtgattgagcatcaacagcaacagcagcaaatg

SEQ ID NO: 111703 - DNA, 184 bp, Heterodera glycines
  Promoter: Source sequence=SeqID_38352; Location=405..588; Strand=+; Gene=SeqID_67192
aatgaatagaaatgaagaccttttatttcttttcgggtattcgttttgtttatcgttgctcttttttacggtgctcaataaatttatacatttaaatcgctgacaattttttaaaaattagtttcgaaattcgtttattccgttcgttttgttttcatttttgtcttttacacttaggaaaatg

SEQ ID NO: 111704 - DNA, 342 bp, Heterodera glycines
  Promoter: Source sequence=SeqID_13493; Location=838..1179; Strand=+; Gene=SeqID_77381
aaaataagtcaaaacataaaattactaattaaaaaaaataaaaataaaaaataaatgccctttaagagaaaaaattaatttccaatgaagaaaggttaaaaataattaatacttttgacaaaattgagtcaaaattggtcctccgctggactatttgccgagatgttaaagaattaattgccaaaaaattgggaattgaactcagaacaattaatcattggagattaaaattcggcttaaagagtaaggcaaaagcaattgaatttaaaaaaattaattaattaagaaaaaataaaaacaaaaaaagaaaaaatcgaaattttggaacgttttaataagatg

SEQ ID NO: 111705 - DNA, 422 bp, Heterodera glycines
  Promoter: Source sequence=SeqID_2551; Location=1648..2069; Strand=-; Gene=SeqID_80373
atggttttttatataacgcccatattgatggtttttatataatgactcagcaacctcaccgatatcagtttaaattcaatcattcggggccaatgttcttcaaagggggggggggggataattggagactgcggtattaatagagactgggccataattagagcatatacggtacataattggacgcataaaaatgattgagcggataaattgaaaaaaataatattttttacaaatactccgtctgttttttgccaaaaaatgtgatgaatttatttctgtttcaaaattgtttttgcgttctttttgctctctcatttttcccaactctctctttttaagttacataacaacagagttttgccttgccttttttgacacaccaatcaattggaaaaagggaaaattgagccacaaaaatg

SEQ ID NO: 111706 - DNA, 109 bp, Heterodera glycines
  Promoter: Source sequence=SeqID_36484; Location=835..943; Strand=-; Gene=SeqID_65782
atttttaccccacagatttccctgaagatcagattttccttaaaaatatttttggttcccgcccccctttttttaaatttgggcaaaggcagagaacattacattaatg

SEQ ID NO: 111707 - DNA, 1003 bp, Heterodera glycines
  Promoter: Source sequence=SeqID_15882; Location=410..1412; Strand=-; Gene=SeqID_80215
ggtccaattagtgaatgtgctaatgtgtcagcccattaatggtcaaaaggaaagagggaaaagaaagagtcaaaggcccggagggttcaggtttttgattcactgatcagatcagcaccttcgaaaagccaccggaaactgattttgagctcaaaataaaaaaaaaatttaattaggaaaagcaattctttaccattcccatcagcagatggatttgatcagcagatgtgtaacgcattcatttggtcattggtcatgtttcccattcattcgttttaagtgcattttttggtctgttattccccctcgcccctctccattcccttccttcttccctccctcatttttcttttcgacttttcccttttcttcttcttcccctctctcctcttccctaccccatttttcttttctcttttttcgtctcctcctcccccctctctttttagtctctccaccaccctccctctcccctctccctctcccattttttctttttagacttcccacccctatttcccctctctcggatgtttttaaaaaccttttgcttttttttgaaaaataatagatatgtgtcctttattctgtccatttggtcctctgctgcttttcccgtccacaccattggccggctttgtgcctttttgctgtctttcattggcaccgtttttattatcgtgccgtctgccactctcttcccttcgctttgtgtgtctctttactctcttccctccgtatgtcttcagttctcttctgtttctttctctcgcttggaagttaatccattggcaaagaaaggcacccaaacagaaaatgcctgcctttggcttgccgttgtttcattttgtttcgtctctttcgtttcgtttgacctctcttttttgccttttctctctctcaaatgccaatttctttttctttttcctcatttgctcttttgtcttaaatttgcttttttttaattagctccttttgctgttcttttttgcgtccacagatg

SEQ ID NO: 111708 - DNA, 703 bp, Heterodera glycines
  Promoter: Source sequence=SeqID_6362; Location=1..703; Strand=+; Gene= SeqID_61267
tatgccagacattagtgtggtttatgtcagtcaaccacattagtgtgttctgtgactttgtgtgacacaataatgcgtgtcaatttttttgataaaacaatagtgtcacacagaagtgaaattagtcaaagttttttaaaatgtattgttatgtgatgacactattgtgcctttcatccataagacacaaaagtgaaatttgtcaaagctttttaaattgtattgctttgagatgacactattgtgcatctcatgttttagagataacgcatgagttgaatatgtcaaaagaatcgtttgtattgtattgttatgagatgacactattgtgcctctccgcgaagcggccgagccctccccaacggttcaacatccaaaggcacacaaaaagaaaaatactgaataaatttgctgaagttgaatcccagtgattggaatgccgtaaggttgagtcttgagtcccggtcattggaatgtcatataattgagtcccagtgattgggatgcctggggttgagtccaggtgatggaaatgcagaagaattggttagataagtccaagtaaatggaatgccggagaattgagttacggcgataataccagagaattgggtctgtaatggtaatgaattaagtgtccctgtgatgcagaattgttgaaataagtcccagtgattggaatgccgagcgtgtttaacaaatg

SEQ ID NO: 111709 - DNA, 90 bp, Heterodera glycines
  Promoter: Source sequence=SeqID_14082; Location=2080..2169; Strand=-; Gene=SeqID_78056
agagggcttcatgggggtttttcaaagcaatgaattaaaattaggttagtaaatgtatgtaattgtaataatttttattttcaagctatg

SEQ ID NO: 111710 - DNA, 551 bp, Heterodera glycines
  Promoter: Source sequence=SeqID_33512; Location=399..949; Strand=-; Gene=SeqID_63555
tagtcataaaatatggcccaaaaaatcgcaaatctagaaacatggacataaaattgcaaagtatggacataaatttccaaataaaatggtaaaattttcagaaatttcttcaaaatctctaaatgtaaagtaaaactttcaaaaatggcgctagatatggttaaaatcattttattcgaaaaattttttagcgaaaaatcaacccaaaaagcgaaatttcgcttttttgcttatttttgtaaatttgtatatttttaagaaaattttattcaacattctcaaataaattacgaaaaaaattttttttttttttggaaatttcccggtctttagggggtcaaaaaggccaatttagctgagtgtggtgccgtactaatagaggtttttttttggaaaaatgtaaaactatagaaaaacattaaaaatggacataatgacaaaatatgaaacaaatcgcgaaatatagaactatgaatatagtggcttttttgttttgccccttttttgtttatttaatttaaaattaatttttttttaatttttagacaatg

SEQ ID NO: 111711 - DNA, 1003 bp, Heterodera glycines
  Promoter: Source sequence=SeqID_4591; Location=1068..2070; Strand=+; Gene=SeqID_55008
caaaatatctatttaagcaaaaatcagaatgaaagaatctctggttttcaaaattggtattaaaaagcaaaaattttcgctgctatcggattagtccctaaatgagacctttgccagaaaaatgattaaaaaaattttagtttggatcaggcccttagccagcagaggaggaagtaacgaagaatcccccccccccccccgccccccgccctcccggaaatgaaaaattaaaaattttcatgaaaaagatgggcaaattttaaaaattcttactaattctaacaataaaaaattttctatatcccattataccatttttttttgaaaatttgaccccaaaaatcgccaaaatttttgcgccgaaatgcataaaaaaaatcttcggcttccccgccccctccttatttttttttctggcacaggcgttagtggaaattgcagttatattactgttattcaatctgtcgtataattaattttataaattcgatatattttatggccagactcttcattgggcccacaacacaacagcgggtgccggcaacattgccgacggcaattggcacgcggcaaaagtgcgtcgccgggggcgaactgtcagcctttccattgacggcaattggagtcactgtagggctgcttaattacgtaattaggaaggcttttaccctgtttatgatatttcgcggattttatcaatttgtcaattgaaatttttcaacaacgtacaattttctgtttaaaattgaaaaaaaaagttcataattttggctgacaagaaatttaagtttttaaagagaggcagatttttctaaaaaaaatttttgaggtaacaaaatgctttgaaattttattcgctgattgataatctttattccaatgtattttcctggaaaatttcaaatcattctgacaacaatagaaaaattttactaaacaaattgtttaaactctgtaaaatatttatgcccaaaaatccaggccctatttaattattatg

SEQ ID NO: 111712 - DNA, 427 bp, Heterodera glycines
  Promoter: Source sequence=SeqID_16148; Location=872..1298; Strand=+; Gene=SeqID_80509
ttttctgaagggaaggaaaatgttcacactgaaagattaacggaatccaaatccccctccttcgtctccgcttgagcctgcaaatcacagacgcaaaagtccgttccgtgaatttgtcgtccgtgaaaaaaagacacacaaatgcgtaaaaagaatgagctgtttcgcacctgcacattgcattatataggtagttgttcccttctcgttggtaattagttagaaatttttaagaaaaattcgttctttgaacacttgaaaagtttataaaaagggtcgaattttggatccatcatcactttgcctaactattccctattactgtcctatggaaataatcaaatcgctagcagaacgcactctacaggtgtaaaaattttttttcctttgtaaatttttttaaacaaactttttttgttcaggcatg

SEQ ID NO: 111713 - DNA, 841 bp, Heterodera glycines
  Promoter: Source sequence=SeqID_41358; Location=565..1405; Strand=-; Gene=SeqID_69505
tggtgccaacgcgacgccaaactctcaccaattgatcgccaacattcaattctctctcgcttccagcggaaatgcatgactttcctcctcatccctcagtttttttatattttagatgaatttttcatgttaaaaatcttaaattatttcttaataaacagccaaaaatagggtaggaaaattaaatttaatttagaaaaacctgtttatttaaaacaaggctaaatctctaaattttgtaaaacgcatccgagcattaaaaaattcataatgaaatggttttttcggtattttactcattttttatgaaaattaaggagttggaaaaaattggaatttttccttatctttaacagattttcacaaaaatggccaatttttggatagaattttgactataggaattttgaaattgaattatctataactaaagttacaaagaaaattgaaatcgagattatgccgaagcattaaaatcattcaaaaaaaaattaaattttgtaattttttttgaaaaacccacaaaaactcaaactcatttctcttcgaccaattaaaaaagatcacagaatgagtttaaaaactcaaattggcagacagatttaaaattaaaacagcataacatcataatttcaaaaaaaagcgaacaaaagatttatttcttttaattatttttcaaatttttgtcggattttcaatttctatgcaaccactactgcctgaaaattgttctacgacattatatgaaagcttaaaaatggcaaaaattcttggcgaaatgcaaaacgccaaaatttttgtgcgcccatcggaccccaaaattttactttcagttttaatg

SEQ ID NO: 111714 - DNA, 74 bp, Heterodera glycines
  Promoter: Source sequence=SeqID_10639; Location=1964..2037; Strand=-; Gene=SeqID_73876
ggtgaaaaaaaaactaattaattcaattaaagtaaatttgcctaaagggccgcatactttacgggccaagcatg

SEQ ID NO: 111715 - DNA, 344 bp, Heterodera glycines
  misc_feature (46)..(46): n is a, c, g, or t
  misc_feature (49)..(50): n is a, c, g, or t
  misc_feature (134)..(134): n is a, c, g, or t
  Promoter: Source sequence=SeqID_27995; Location=1295..1638; Strand=-; Gene=SeqID_58659
gcaaaaataaaaaaattttgtaatccaaagggggggggtatctacntanncctgtaagttcattcggaagtcaccgtcacttgtgtactctccctttgttaggggtgtatttaataaggagaatctaactgctngggtttcccactagattttttttgctagtatatatgtattttctatctttgaacataggttattagcttttacttttataccattatgagtaagagtttaaaactccaaaattcatatatatttaattctcacattttccacatgccgcatcaggcaaaaaaacgtcatggatatcgaaatcctacaaattgttccctttgataagaatg

SEQ ID NO: 111716 - DNA, 538 bp, Heterodera glycines
  Promoter: Source sequence=SeqID_15375; Location=1611..2148; Strand=-; Gene=SeqID_47294
tttgttcatggagtttttttaatgttttaatttcgatagcttttgacaagttctatagctttgtgattttttataaattcttcaaaaccggaattggtagaggtcgaatactcaaatcgaaataacaaaaaaataaaaataaaagtcttattcattttctaaattataattttattaaacatataaaaatttattgtattaattttacattttcagtggtagcccaaaattatatgtattgatggttattgatttcaacgtggatgttaccaatacaataattaaatttattattttaaatttattattttattttatcaatcactgagctttttgtggaacgcccacactgagcattttttgtggaacgcccacactgagctttttgtggaacgcccacactgagctttttttgtggaacgcccacactgagctttttgtggaacgcccacactgagcttttttgtggatcgacctagcacccttttatcccaaatttaaataatataattttttatgtttttaaataattgaaatg

SEQ ID NO: 111717 - DNA, 403 bp, Heterodera glycines
  Promoter: Source sequence=SeqID_24; Location=12774..13176; Strand=+; Gene=SeqID_80482
ttttttacaatttaatgaattggagttttttgctaatttacttaaagcttcggatatgatatatgcaataggcttgggtttattgattatttgtgtacagtccttacaataggttttgccttttttttttttgggggggggggggattattttttaacctcctcatagactggggataattggagactgggggataattagagcaaatactgtattttctctctctcgaccccatccaataggtttgggtttgtggaaggggatgtcagagaaaaaaagtagacacactcaaattatcgatcgaaaatcaatcgataatttgattgggaatattatctactgatgtgaaattaaataaattttttaaatccaagatttaattataatttttttgaagtgaatg

SEQ ID NO: 111718 - DNA, 309 bp, Heterodera glycines
  Promoter: Source sequence=SeqID_26922; Location=1..309; Strand=+; Gene=SeqID_57662
tttattgtttattgaggcgatgaatctttttcatgtcttttaattggtctttttccacaaaaaaacataaaataagtatggcgaagttgaaaaaatatctatccattcttgaaaaatgctataataattgtcattctcctcaaaataattattctccaatcaattttaatttgcataattatggaattagtcaaaatcattcgatgccaaaataaaaattctaaaaaaatcaaataaactttagcgaaattcattaaaatccccgtgacacacggagagtggctaaaatttccttctcaaagtgtgatg

SEQ ID NO: 111719 - DNA, 116 bp, Heterodera glycines; identical to SEQ ID NO: 105272
  Promoter: Source sequence=SeqID_39313; Location=427..542; Strand=-; Gene=SeqID_67907

SEQ ID NO: 111720 - DNA, 123 bp, Heterodera glycines
  Promoter: Source sequence=SeqID_6787; Location=2561..2683; Strand=-; Gene=SeqID_62911
tttcaagtttgttttgtttggtttttgaatttcttctagaaaaatttcagaaaaggaaaatggactttcccaatcgccacatgtcttctgacaggaaagtcgcgactggtctacgaaaaaatg

SEQ ID NO: 111721 - DNA, 97 bp, Heterodera glycines
  Promoter: Source sequence=SeqID_3273; Location=1..97; Strand=+; Gene =SeqID_84006
gggcaaagatttctattgtatgattctcgtgcaaccgaacccgacgaggttgtttattaccaggcggttattgataatttatgtagaacaaacaatg

SEQ ID NO: 111722 - DNA, 99 bp, Heterodera glycines
  Promoter: Source sequence=SeqID_26673; Location=915..1013; Strand=-; Gene=SeqID_57430
tgttccgccggctcagagaactgcttgcctggcttcaaacggtttgctgagataaatttggacaattcaatgtttgccaaaaggtactccgacccaatg

SEQ ID NO: 111723 - DNA, 249 bp, Heterodera glycines
  Promoter: Source sequence=SeqID_6183; Location=557..805; Strand=+; Gene=SeqID_60636
gatcgacaggtatgagtgccttcgggcttccaagagcgaggatgagaacttcctctcttttgtcaaccggcacaagcgcctcctaagggattttgagttcaagaaactcaacgaagagcaattctattgcttaagttaacagctttaaaatctccaaaggatggcgaacttcgaaagagaattttgggcaaattggcggcagatggcgatagggcaaaatacgataaggtcgcggaggacctgcaaatg

SEQ ID NO: 111724 - DNA, 484 bp, Heterodera glycines
  Promoter: Source sequence=SeqID_3774; Location=1950..2433; Strand=+; Gene=SeqID_51827
ttgggtgcgcgtggacgagcggctgctgcgcgcgcacccgggcagcggcgcaatgctcgcctaccgggacagggaggcgagcactgtgtcagtgggggatttgaaattcggaaatttatttgaattttccaataaatttttcatttttcaatgccctcggggctctctgaggtttttgcagttaacaataaattaaagtataagtatttaactctctctctctctcccccccaatttgatcacatttttaatgcgccgaaaatggacgtgtttttcttaattcgcttcacaaaatatttatatatcccgagcagaattgaaccttggccccaaaaacacagggtttaattaaccaacatcggcggggccaagtaatttttacagaaaatttaaccaattttttctcagaaaaagccaatttaatgaattttgctgaaaaaactgagaataaaaatttttaggctgttgattatagtcaaaaatg

SEQ ID NO: 111725 - DNA, 765 bp, Heterodera glycines
  Promoter: Source sequence=SeqID_12496; Location=1223..1987; Strand=-; Gene=SeqID_76133
gacaaaataaaaatttgggcgacaaaatttggcaatttttgcaggtggaaaaataaaaaataaacaaaatttaataaaaaaaatttggaaataaattttatgattggtctccccaaatctgtggaagatgtttggcaagattttgttcatgaacgaattaaatggcttggtcatcgcattgattcgggtgaatgtattcagccagaaactgtaatacttatttttaaaaatattactaaaataaaattatattaaaaatatgttcgatttaattaaaaatgtcatgtttttagcggcaaacgtaaatgcctactttcttgaaagttttttcgatttttgagcttgtattctttaaaaaaaataagtagacaaattcttcaaccggaaagtttttttttataaatttttactttttaaaaatttattcctgtattaaaaacattaaatatgatttgaaattagatttaatttaagcgcggcatgtttgcgcagtaaccataaaaggcctattttctcgaaaacttataatttttaaccataaaagaatctggacttttttctcgaaaatttatagttttttgaactaaaattcttttacaaattaagctgacataattttttaaccaaagagtatttttttcataaattttttttttgccctgttaaaggagagaattttaaatataaactcctatatatccaaaacaaaaacaaaaaatcataatcaaatttttagtttttaggcgggcccacctcaggcacatg

SEQ ID NO: 111726 - DNA, 492 bp, Heterodera glycines
  Promoter: Source sequence=SeqID_39771; Location=1..492; Strand=+; Gene=SeqID_68265
gcgcaaagcaagcgccaattttgaatgttggccaagagctctaattaaatgtttggaattatgaaaaaaacaattaaattttttaaatttcaattttggtcgatcagactgaaaaattaagaaaaatttaatattttaacataaatgaagcattattatacataggaatatgtcctctgctgggaaaattttaaaattccgccacattgggtttgggtattttttttaaatttggaatcattcgattgcccaaaatgttttctttattagcttgcaaaatttcaaaaatttcgtataacaaactagctaaggccttgttctcctctttttgtcaggaatttgtccaaaaatgacaaatttggtgggttttacccgccgaaaaaacaaaaaatcaattttccgattggcaatttttgaaaaataaattcgaatttgacttgagacatagcaatctctttttacataattttgcttcgttcaggccaaggaatg

SEQ ID NO: 111727 - DNA, 638 bp, Heterodera glycines
  Promoter: Source sequence=SeqID_5986; Location=1580..2217; Strand=-; Gene=SeqID_59934
tttggaatgagattaattgccaaaaataggggcccttctaattaataatcttcgaccctttccataatcactgttcgtttttgataattactttcttaataaattattttgctgatatttctcttcatatcactttaattgaagtttctcctatttatttcttttcttttaattttatttttgcttattattctctaagcaattccccaaaatttccaatttcattttccaattttccgtttatttatttatttattggttgtgttatttgcccattaaaaacggctgaaattttacaatctcagcataattttcccgcatttattccttccgtcgtttttctttcacattttgtttatttatttataattttaaaattttcttttcttttttattaattaccttttttacagaaatgtatcgttttctttcaactttttccaaatatttcattttgctgttttttcttttgatctgctcatttttgacgaccaatggcaagtcaaatctcttcccctttaattaccctttttaatatttttaagtgtttgaccaattagcgattgattagcgatcatcgcccgcaaagactgattaaattgttaattttgttctgcttcattttcagctctcaaatg

SEQ ID NO: 111728 - DNA, 219 bp, Heterodera glycines
  misc_feature (100)..(100): n is a, c, g, or t
  misc_feature (139)..(139): n is a, c, g, or t
  Promoter: Source sequence=SeqID_34940; Location=1..219; Strand=+; Gene=SeqID_64623
gattttgacgccatttttcgtacaatatgtttcccgatgtttggtgttgttactggtataaatccatttctcaatccctagctctaaccctatcaattcncaacttatacccaaattcgagaaaggttcaaaccccacnggttttcgagtcgattatgtattttcacatcattcaaacacttttttaggtcgaattgcgttctttgattcctcggaatg

SEQ ID NO: 111729 - DNA, 496 bp, Heterodera glycines
  Promoter: Source sequence=SeqID_9088; Location=658..1153; Strand=-; Gene=SeqID_70209
tgcgcgagctgaaaatgatgcaaattttgcagccgatgaaaccgatcatggaacaggacgaaggagaccaacgaggtacacaaaatccgaagttttttttaaagttacagaaaagtttttctttcctgaattacctcctaatattggtataactattgttttggtaatggaatttgttcccgtggccccgtgaactcttttgaatgaatggaccaaaaaattcattttcctacttcgttcccctttcccaaaattaaaaaaattcaaacttatttagaaatttttcaaaaaaattttcaacgattttctggaaacatttttgaaaaaacttgatgcagcggcgcctatcggcaccgccggacccctttgaaccattatttttgaaatgtgaccgcaaatggctgaaattagtgttttttgacgccgcaacctctttcattaaatttgttgctaattgccaacgccattcccccgacagaccccgcagcaagcgatg

SEQ ID NO: 111730 - DNA, 190 bp, Heterodera glycines
  misc_feature (23)..(23): n is a, c, g, or t
  misc_feature (103)..(103): n is a, c, g, or t
  Promoter: Source sequence=SeqID_26260; Location=1..190; Strand=+; Gene=SeqID_57006
ttatgtaattgtaaataatatgnaaatgtattattattattattattaatagtttattccttttttattagccgtatgcaattcaataaatgacttaattatntataattaattaatgaattaattggttcgcgtaagaattaaaatatttttttttgtatacaattcttaaccaaagtttataataatg

SEQ ID NO: 111731 - DNA, 54 bp, Heterodera glycines
  Promoter: Source sequence=SeqID_31968; Location=1..54; Strand=+; Gene= SeqID_62284
ttcaagcgcaagctagccgagttggaagcgacaaacgtcgcagcgcatcgaatg

SEQ ID NO: 111732 - DNA, 202 bp, Heterodera glycines
  Promoter: Source sequence=SeqID_7843; Location=467..668; Strand=-; Gene=SeqID_66136
tttttttccccatttttatagctttattatttgaaaaagtaaaattttattttttggattacagatttacaaagtacaaattccgctctctttgcgtaggggaccctctgatattttcaaattttattttggattatttcaatttatttttacattttatacccatcccccccccccccatttgtgtacaaaggtggtcatg

SEQ ID NO: 111733 - DNA, 139 bp, Heterodera glycines
  Promoter: Source sequence=SeqID_5472; Location=1818..1956; Strand=-; Gene=SeqID_58182
ttgtgaatgcgaaaaaagtccacttaccgaaatatttgctaggcaagagaaccttttacccattaaaacacagggaagttacgtatacttcgattcccaaattaaagctaaaatacagcaaacaacttctcttcaaatg

SEQ ID NO: 111734 - DNA, 115 bp, Heterodera glycines
  Promoter: Source sequence=SeqID_15237; Location=771..885; Strand=-; Gene=SeqID_79446
agtttacgtggaggtgccaggcgaaaaattggaaatttttaaaaattttcattaattttttctaagcccaaaaattttcaaaaattttttattaagccgaaactgatcgacaatg

SEQ ID NO: 111735 - DNA, 695 bp, Heterodera glycines
  Promoter: Source sequence=SeqID_2109; Location=1001..1695; Strand=-; Gene=SeqID_77902
tccccaatccgatccaatgaatttggctgttatcgctattagcgatcagtttttacccccctaccctttagctaattgttgattcgaatttctttttgctcggctttcatggggggggggggggggggggttggacaatttacgcgacgtgtcacagcgccacccaccgcccgcccatcccgcccatggggtgtgttggggacgggggacgaggggaaattttgccgggtccgcccatcagccgcgctgcttctgccgcagggaccgcccatttgggcactgtcggccaccgcatttaagcgctgtccaatcagtgaaaaatcagtcatttccaaaatttcattctgctcctaaccaaaaagcattcaactgacaaataagctggtggaaggaaataggaaaagccaaacaaaaacatttttgaaaatcagtcaacgattaaaaaattttaaataatttttttcgaaaaccgtttcaattttttgtatttcacttaaatttagaaatcaaaaaaatttttggtttaaaagccaatattttgatttcattgttttttaggaagtgattttttcctctatttctgatcccaaatcccattcttcaaagcaacccgtcccactctcgaccgtctaacatgaacaagtggtctgcacttgtgtaagttaattggagggaggggtggggcttgaaccatg

SEQ ID NO: 111736 - DNA, 913 bp, Heterodera glycines
  Promoter: Source sequence=SeqID_439; Location=2113..3025; Strand=+; Gene=SeqID_52867
attttaatttaatatgcaataatttttcatttccgtattcagttatttaaaaaaagcattaaaattatttaatttttattatatatttaatcaataaattgattgcttaatgtttataaaaattttctatatatttccgaagaaaataatttttataattacaatttttattagtttttattttattataacaaattagtgatgatgacaacaaaacaatttctgttaatttatatattaatttttgtgttaacaaaacccggttttatgaaaatcatttatggtaaggctaagggggtcgggggcgttttcttacgaacacaattttttagtataactttttttctttgccaaccaaatccaacattcttggtatcattcaatagcaccaagtgtcctctataagcctgcaaaatttcgaaaaatttcgttcaggttcaataaagttacggcaaaaatttttcaaaaacctggttttgtgaattttcgggccataactttttttgaaacttacctaaatttttagaaattttgcaggctaatagaagacacttatggctttcgaatgataacaagattgttggttttggttggcaaagaaaataagttatatctaaaaacttgtgcttgtacgaaaacagcctgctcctaaggggaatgctaaacaattaattggtgaatttttcaattttttttttcaaatttttttgtctaaaaaaatagaaattttataatgattttttaaaaaagaattgcattataaattttagcaaattataccaaaacagatgcagtcatatttagatgtaagccttttgacgaaaagtttcagtcctataaaagatttattaattaattatgtgctaattaatcattagtgaatgtccccttaggcatcgacactttgcaaatg

SEQ ID NO: 111737 - DNA, 89 bp, Heterodera glycines
  Promoter: Source sequence=SeqID_12232; Location=2802..2890; Strand=-; Gene=SeqID_75805
atcgccacaccatcaaacgaaaaagtgaaaaactgccgacagcaaaattttgtttggtttttgctaaacctgaaacaggtgcaaaaatg

SEQ ID NO: 111738 - DNA, 852 bp, Heterodera glycines
  Promoter: Source sequence=SeqID_11136; Location=277..1128; Strand=-; Gene=SeqID_74479
atcaagtcttttttatcaggcacaaaatcatagactcgattaatggtttaatataaaaatattaaatgattttgatcatttgtagcttcttcactgtctacctcagttgctgcgcattcagaatttggcaccaaccctgatgttgtttctctatgcgcacttcgttttttcgatactctccacgccgtaccaaatttacagagtgatccaatggcgaacacccggcaccttcacgcagaacaacttttcaccatatgtaaaagcaaagaaaaaaaaataattaagtaggaaagggagggattatattgtctatatcaaaagcccaaaaattcagaagtttaatacctatttcgaaaattaggatagttaattttacatccgtttgcgccaaagtgacgtcacagtggaaaatttctggattataatattttgaaaagcgtaaaattttcagaatgtggaaaaactcggacgaatttcaatgaaaatgaaattgtgctaaatttccaaaatatggcatttcatttttgtttaaattcagtgcaaaaaaatctaaccttattaccgatgacattattttaattaatcctccttctatgacccaagtagagaaacgaaaaaaaatgttaacaaaataattttcttttttgctgaattgatttaaatttattatatatatggaattaatgcaaaattattattttttcattttgaaacaaaaaatcaaaatgatatacctataaaatttcatcccaagactctctattggttatcgatgcctgaactagtctattacggtacgatcccgtccaccgtttttctactcgccattgagcgttgtatttgcgcgaaatg

SEQ ID NO: 111739 - DNA, 51 bp, Heterodera glycines
  Promoter: Source sequence=SeqID_17735; Location=1..51; Strand=+; Gene= SeqID_82274
cagaaaaatgtgattggcattttgtgtaatagcgactttgaatcaaaaatg

SEQ ID NO: 111740 - DNA, 284 bp, Heterodera glycines
  Promoter: Source sequence=SeqID_3390; Location=468..751; Strand=+; Gene=SeqID_84490
acagtcaaagagccgacactttcggacgaaattggggagaaaggacagcaaaaaggggccgaagaagcggaagaaaaacggataattgaggaagaagtggaggaggcggaagactttgaaatgccggaacgcagcgaagcgtattgggcgcattggacggtggaaattggcatgtccagcggagggggggggggggagtaccccaattaaacgccctttttgcccaagggaggggcgtcggctttttgcgagacaatttgcgcgtggaatgggcgttggaaatg

SEQ ID NO: 111741 - DNA, 201 bp, Heterodera glycines
  Promoter: Source sequence=SeqID_43464; Location=1014..1214; Strand=-; Gene=SeqID_71119
gatttaccaaaactgggtaaagaaattttttttaatgtgtattaccgttaatttagtaaaaaataaattatattcaatatattcttgggtatactcaaaacaaatttaaacaaattatcgaatgagaccaaaataatgcttaagtttaattgggttgttaaatatttttaattttgaagcatcctgggcattgcgcaaatg

SEQ ID NO: 111742 - DNA, 124 bp, Heterodera glycines
  Promoter: Source sequence=SeqID_3972; Location=1551..1674; Strand=-; Gene=SeqID_52635
tgctgatgtcggacactttcttctgcgtgcactcgaagcacaactcgtaaatgcacctattctgtcatgaaatttatgaaatttttcaattttagcgttcagtatttcccaggcatccataatg

SEQ ID NO: 111743 - DNA, 751 bp, Heterodera glycines
  Promoter: Source sequence=SeqID_16512; Location=891..1641; Strand=-; Gene=SeqID_80918
taaaattttggtgctatgccgaagtgacaaaattatgagtgtaggggtatagccctgaggtggggtgaaatcatttccaaaaaatagaatgttttgtcttaatcagagactcatccccgaggctcgagaagtagggtattctcgcttcgtctctactcagcacttgacccattttggttctcttctctcagattaattgccattgattaatctgtccatttgattttccttgggttaatttgagtggcttaatgcccttctctgccagtgaataggaacggacggcattttctttgctcgcacaacggcactttgggaaaagcaacctaatcctcaaccaaaaagtgaaaagcgaaaaatgaatggatcagatttatgcttttctgaggctgaaagtaatcatttaaaagtgaatttttgtaaaaattaagcatatgtctaaataaaaaaaccggagaaactaattagcaactccttaaaataagaatcaactaaagcttataaaatcttttgagaaattattttttcatattataaaattggtaattttacgatacaataaagaaggttgacgcaaattccgagtgaaaaatgcaaaaaaaaaaattgctcgaattcgggtccgggtttcgaaataggtcgatatggatgtcgatattcgtgttcatcgccccctaaacccccaagagcacctcaaaatcgctcaaaatctcttttttacctcttttttatgggaccagtaaaaccgatg

SEQ ID NO: 111744 - DNA, 206 bp, Heterodera glycines
  Promoter: Source sequence=SeqID_7893; Location=1..206; Strand=+; Gene= SeqID_66306
cagtttcgtaaatcgtacgggggtcattgcccattcctcacaaatcagttctcattaatgtcctcgccctgcattttccacccacccaccaaaatgattgcatttttccgttttaattttctccgcttttcccaatcgctgttcatttccctctcccttttcagtgccctatttgtcagcacctcactcccactcagtccgtcatg

SEQ ID NO: 111745 - DNA, 968 bp, Heterodera glycines
  Promoter: Source sequence=SeqID_6116; Location=6296..7263; Strand=-; Gene=SeqID_60423
attcataaaaatacgaatttttaaattacaaattttgtttagacaatgcatacatctatttagagatatgctgtgttattaattttaaaaatttctgaatttctgttcatcactttttttcaaattgccgtcacatttcggtcacactgatgaaattattgtagttgattaaattattcattttattaaataacaaatacattaattcatttttaaaaatttacaaaattttgtctgtatttccagaattcagtggctcataaaaattacagccccgaaaaatacgaatttccgaaatccgggaccacctccggatttaggttcaaaaatttcgatttgtactgcttatgtgtccatattgctgctgtctgtggtccaactcggtttgtgttatatgggctaaaaatctatcaaaagttaaaaaaaaaatatatatatatatataaaccgggcctcacctaaatgagttattatgaacaaaaaatttttttttaatgagataggaaagctaattactgaattactgagaaaatttaattaagccttgccaaatcaaattttagtaatcactcatttgcagccataaaatattcatttggaactaaaatttcgaattttaatctaagaaaaataatttaaatttcattaatatcaaaaaaaattttcaataacaaaattccctcaaaggtggaagggaaattctcttcgacccacatcaaaatccacagaatcttgccttgggatttcgtctatattctttttgtctaatggttattttttgtctgttttggcattttttgagctttatatatttttttgtattaaattaataattttcatttaaattttcagcaattctaataaattaatgtatttcctctacaattgaaacagagcaaaacgcctttttatttatttttgcagctttatgttcataagattatttgcctaattccagcaattgcatg

SEQ ID NO: 111746 - DNA, 91 bp, Heterodera glycines
  Promoter: Source sequence=SeqID_11010; Location=3306..3396; Strand=-; Gene=SeqID_74329
tttcaaaaaaattgaaataaataaattattttatttaaatttttaattgttaggtctgctcaaaacgccagtgcgtgccgcgaaagcaatg

SEQ ID NO: 111747 - DNA, 117 bp, Heterodera glycines
  Promoter: Source sequence=SeqID_14795; Location=1138..1254; Strand=+; Gene=SeqID_78944
actgagaaaataaaattcgaattaatattttttttaatatattatcttttaaataattatcattattttattccaaaattttattcaccagcatatgcaacaaattggacagccatg

SEQ ID NO: 111748 - DNA, 443 bp, Heterodera glycines
  Promoter: Source sequence=SeqID_14392; Location=2885..3327; Strand=+; Gene=SeqID_78429
tttttaaaataatttgtatttattctaaaatactatttaatcactgtaaataaattcttgtgtcttctccaaaaagatgtaaaaatgaaaggatgtaatggtcaaaaggaaacgaacgatgaaaatcaattataaattataaaactactccttctccctctccattcctccccgttctgttccgccccaactaatcgcgcctattgcgtgtctatctttgagctatgtggagcaatggggcatattttgtgcgtcctgtttgtgcacatattgttaagccgcattaattttagaaagatcattttgccaaaaaaaaaaaaaaattcaaattgaataattcaaatttttttattgctctttttaatttatctaactgtcaatttatgctttacatatttcttgattttactttttagatttaccatattcctcagttgattatg

SEQ ID NO: 111749 - DNA, 125 bp, Heterodera glycines
  Promoter: Source sequence=SeqID_23344; Location=1..125; Strand=+; Gene=SeqID_54053
ttttgaccctaacttttttgaaactcaataaaattttttgaaatttatcagaataatagagaaatcttttggctatctaactatataaacaaaattaaaattggttgtttcagaaaaaagttatg

SEQ ID NO: 111750 - DNA, 122 bp, Heterodera glycines
  Promoter: Source sequence=SeqID_27409; Location=855..976; Strand=-; Gene=SeqID_58103
ggtggaaaaacagaaaattatgatttcaaattgcaatctaaatgaatttttaagggccaaaattgcacggatgacgtggacgaatgttcggatgagatgacgcgttgtttcaatggcaaatg

SEQ ID NO: 111751 - DNA, 284 bp, Heterodera glycines
  Promoter: Source sequence=SeqID_13373; Location=583..866; Strand=+; Gene=SeqID_77249
tttccaatatttgttcaacagttatttagaattttaatttaggtattttgcaccagaatgtgtgttgaatcgaagggagaaattgtccttttgcactgacatttggtccttcgggattttgcttgttgaactttttacgggatggcaatttgccaaaatttggagtcggaagcaagttgtgtctgtgcttcggtcaatcattttcaaaagttattttatcttaatttaattacttttccacgcttcgttttctttgaacatttttgctaattttagccaaaatg

SEQ ID NO: 111752 - DNA, 1003 bp, Heterodera glycines
  Promoter: Source sequence=SeqID_2594; Location=2144..3146; Strand=-; Gene=SeqID_80625
aataaaaagtaagctaaaaccaaaaaaatattcattgaaaattatatgtaatattaagaactttgtgtttttaagttaaaccatgtcaaagagcaacaaagtaattttttatttatttaattgtcaaataattttaattattttttataaacagttaaattctgatgtaaattttcaaattttagtattttgtagcttaacttgtaaaaatattttgatacaaaataatattttataaagtgaaaatcccttccctaacattcaaaagtatagtcaaatttataaatgctaagtgcaaccgaattcatattataatttttttattcaaaatgtttcattgttattattattattattttcaataaaatttgggccatttaatgcttaaaaaaagaaggtattttagaaaaaatattttttgtcattgaaaaatgaatataattttttgtttattgaaaaatgtatttgctaatggaacaaatcatcgatatgtcgatttttttttgttgttgaatacttgaagaataataaaattgtaattttattatagcttttctatgtgataagatattgttgaaaggataattcataaaatttcttattaaatgaaatttaaattgtttatattttattgaaaaatttttgataattaaagtatttattacataaattatttcattagtaataaatttttgcttcctttagatgccttttatactaattttattttacattttttgtttaaattgtcttcaaattttcgctgtggacgaaggattaaatgatttatttgaaaaaattgttgtaaattctaatgaatcaacttcacataaaagtgatgaacaaaatgctggaaatgttgtaaaacgtgaacaaattgaatatgatgaacaaaaaatggcaggaaaattggcacacaaatttttaaaaataaaaaaagaaccaaagtttgaggaggaagaggacaaaacaggcgaagataagaaaaatttatcaaaagatg

SEQ ID NO: 111753 - DNA, 583 bp, Heterodera glycines
  Promoter: Source sequence=SeqID_6747; Location=1588..2170; Strand=-; Gene=SeqID_62729
cccccccccccaaattaaaactccctccccttcccttttgaggggggttgataaacaaaacccccggggctctattttaggaaatacggttaatgtcgaaaaaagcaattgcaacacaattaaaagaatcattttgcgggaacggagcatggagaagaaacaaacagagattgacgtaattaatacacttcgatcactgatcagcaaatgtttcatttgaatggaccgaccgataacaaaaagaaaaaaaaattgttttttcataaaattgttaaagtttacattaatcaacagattgatgttcaaattcggcgaatgatccaaagcacaaacaacgaacaatcaatcactaatttcaacgtttgtgtcaattgataacttacttaatctgtcatttttgcattaatggatgaccaaaatggaggagggcaaatttattgtaatgcgcgtgatcgaaccgaccaaattggagggggcggtgaccttaaagcgaaggcatttcatcctcagaacagaaataggcatttgatgaacacttttcaatttcaattttaatcgagtgttaattttgagtttagaaatg

SEQ ID NO: 111754 - DNA, 268 bp, Heterodera glycines
  Promoter: Source sequence=SeqID_3214; Location=3228..3495; Strand=-; Gene=SeqID_83735
aatataggactaaaaaagcccgaaatatgaactaaaaagatcttaaataggccaaatatcggaccaaaatatagttgatcagatcatttccttaagggtgcaatgaagtgactaaaatttgagcactctaagtggacttgaaacaatataaattttttcgattttcattacattaactgcttaactccgaaaaatcacataaaaaactactttggagcatcaaattctcgaaaaaattattttcagacagttcattatagaaataatg

SEQ ID NO: 111755 - DNA, 557 bp, Heterodera glycines
  Promoter: Source sequence=SeqID_17945; Location=1553..2109; Strand=+; Gene=SeqID_82501
gaagcaaatctgctccttttctgggcaaaataccgacaaaaactttgaaaagggaagtcgcaaacgaagcaaaaacggttcggtcttttggggaacaaattgaaatatcaaaggaaattaacacattgaaagaataattcaacaaatgatgacgagaggaaggaggaggagcaattcgcatctctgaaaaaccgttgccatacaatcgcatcgacaagcgcaccttttgcttcgacaaaagtgcaacagaacggcgtggacagcaatcattctctgtctgcaaaacaggcattgtttggaattaacacaaaaatacatttttaacatttttactttttaatggtaattagcaaaattattttttgtgtatagaaatgcatttaatttaccattatgaaattcagtcttcgtcctcttctcccgttgcatccacaaaaacttttcgacggcggactgcctttgaaacttcggaagcaatgcgtgaaattttcggtgcatattctcctttctcatcacagaaaaaagagaattccggagaatttaatcggaaaaaaatg

SEQ ID NO: 111756 - DNA, 59 bp, Heterodera glycines
  Promoter: Source sequence=SeqID_25196; Location=991..1049; Strand=+; Gene=SeqID_55935
ggtaaaaatacttaaaatcattaattatttatttatttaattaatttttagtcattatg

SEQ ID NO: 111757 - DNA, 1003 bp, Heterodera glycines
  Promoter: Source sequence=SeqID_13235; Location=751..1753; Strand=+; Gene=SeqID_77067
agcaagaccaaagccctacgttgggcgcccaaggctgtagccttggctaattttttttacccaaaagtgtacacttcagtaccaggcgaataacgcgcaagggtttgacctgagcgcagggtggctagcagacttattgtagagctaaatgagctcgattttttcaaattttaaaatttcgaaaattttcaaaatttttcaagttaggcctaaaaaacgattttttcgtttttgaattttaagattttttaacgatttttcccagaaaaacgaagaccacttccaacacatagttttttgagctctatcgactggtaattttttcggaaaaatttcgatttttttccggaaatagaaaaattttttggcctcagcgggacatttgagtcccgggcccataactcgtcaggggtcggttttagacaaaaattgccttagagccaaattgtagagctttttaaactctatcgaatgttgtacaatctgttcggaaattttcaaaaattttcgagctaggccccctagaaattttcagaaattttttttgggtttaaaaagagggtgaaaaatatttttctggggtaaattagggtcctgagcacaaatatgatgtttattttaagtttcagattttttggaattttttaaaaattcaaaaatatttttcaatttttcggccctcgggattttgggcgaatatttgaaaattcatagctcacttcactgtgggactattttaatgaaataaagctttaaaaatggagaaaaatatggagaattttatgggatttatttgaaatttatatctcaaaaaagaaaaaagttattccagaatttctggaaaaattcgaattttcagaaaaaaatttatacctcggttctgaaaagtcactctagaaaaataaaatactacaaaaatccgcaattttttgctctattatataaattttatttggcctttttatcacttttttaagaattgttataaaattcgctgggaatg

SEQ ID NO: 111758 - DNA, 221 bp, Heterodera glycines
  Promoter: Source sequence=SeqID_34074; Location=358..578; Strand=-; Gene=SeqID_63958
aggttcgcatctggacattcaaacccggtatttgatttagttagtaggactttcccacgcgattcaagaatctaggaaatttgttaggtttttgagtgcacataaatgtttgtatagaaaacgtgaaagcgatatatcttttgataaattatcatttaattcattattacttaaattataagttttgtttatacaaattatattaaacattaattcatatg

SEQ ID NO: 111759 - DNA, 855 bp, Heterodera glycines
  Promoter: Source sequence=SeqID_40190; Location=389..1243; Strand=-; Gene=SeqID_68598
ttttctattgatgagacttccagagactgtttcaggtgctgctgcttccggaggcgtcgtagaaaagttccccagcagaatgtgaaatgacctttgacttttaattgaattctttgttctttataacccctatcaaataattcatttgatgattatcacacatattttatatatatttctctcctattccgtattccaatgggtgtctgtacgtgttgattggttggcattaaaatttaaaactgaaccattgctcaaatttaataacggagttcataaagctcattaggaaaaatatttttgacaagaaaatcaaatcttattactaggtcgttgcataaaaaagggcgcttttttagaaaaaaaattataaataaaatatcaaaaataacaatcataactagggttgtaaattatatggactaaaaaacgcgaaatatggactaaaaaagcccgaaatatggactaaaaaggccaaaaatggccaaatatggaccaaaatatggataaaaataggcaaaatatcttaaaaatgtcatatttttaatcaaattctagcttcacaattgcaaacgaaatacatacatttctcaaggttttttgaaatttctcattctgttgtcagcgaaaatttttcggaagcaaacaaaatacttaaaaatttgccaaaatttcgaaaaaaatctcttcttttaaggtggtgtttttttaaaatttccaaaaacccgatcctttgtgtgtacttttcgcttttttttttcattaaatttactgataataaaaccctatttcatgtgtttagtcgcaatccatggcgacataaaaccgaataattttatgtatgtcaaaaaaatg

SEQ ID NO: 111760 - DNA, 358 bp, Heterodera glycines
  Promoter: Source sequence=SeqID_657; Location=1917..2274; Strand=+; Gene=SeqID_58305
taagggtagaggctgaccacgtcaatgcacaaaatctcctccccttcggcacacacgtgatggagcttgaacggctccgtacgaccacccctcaacgcgtcgctgcgtgggtcaagcggacggggcacaaacacatgctcataccgccccctcagcgccgggtccctacgcagccgctccttccactcacaggcccacaccgtgtgcagctcacagccgtgttggtgctccagctcccacaaacgccgcaccgtccgctcgtacagatcctccgccgtccgaccggcggccaaccgttgttgccggttggggaagcactcaacacatcctagcaataaatttggatacaaaaaaaatg

SEQ ID NO: 111761 - DNA, 179 bp, Heterodera glycines
  misc_feature (7)..(8): n is a, c, g, or t
  misc_feature (16)..(17): n is a, c, g, or t
  misc_feature (29)..(29): n is a, c, g, or t
  Promoter: Source sequence=SeqID_18193; Location=1..179; Strand=+; Gene=SeqID_82779
ttgcatnngcctgcannggtctgaattantttgatttgggccaaagcccaattttgaagtaactttaatttaaattatgtgagtgtacaattaaatattgaatttgtaatacacaaaagaagggaaaataaaacgattaaaaagtccaaataaaattggaaattgattgaataataatg

SEQ ID NO: 111762 - DNA, 84 bp, Heterodera glycines
  Promoter: Source sequence=SeqID_131; Location=6953..7036; Strand=-; Gene=SeqID_73961
tctgcgtaatggacattgattattgatgagaaataatttgtgattaattactttttaaatccggagtcagaatccggagttatg

SEQ ID NO: 111763 - DNA, 533 bp, Heterodera glycines
  Promoter: Source sequence=SeqID_25371; Location=557..1089; Strand=-; Gene=SeqID_56115
agtggaaaattgatcagatcggaatgaaaggaaaacgcaatgaatttgaacaattatcatcattttattaatatttctgcactaattatcactggataattttttatcatgggacttgaatgaatggataactattgttcctctaatgctagaaacagttcagatcagtaggcaatgggtatgaatacatctgatctgcgatcacatctctgattagcgaactgatcaaggaaatgaaaataaattaaattaaaattaaaaataaataaataaaattaaaaaataaatttaaattaaattaaataaattaaaattaaataaatattaatacaaaagttaataaaaataaattattattaataataaaaataatacagattaaataaaattaaaattaaattaaataaattaaaattaaattaaataaataattaaaattaataaattaaaaatataattaaataaattataactaaattcaatttattcgagtataaatagcaaaattttctcttattattcatttaaaaatg

SEQ ID NO: 111764 - DNA, 128 bp, Heterodera glycines
  misc_feature (25)..(25): n is a, c, g, or t
  misc_feature (89)..(89): n is a, c, g, or t
  misc_feature (118)..(118): n is a, c, g, or t
  Promoter: Source sequence=SeqID_33250; Location=858..985; Strand=-; Gene=SeqID_63370
ttaggtttaattatcccgggacaanttattaaaaattacattttatgcctttgaccaaaaagtgccatgaattccgagcaatcgtttgnccaatacaccaaagcaaattacaatggancgaggtaatg

SEQ ID NO: 111765 - DNA, 106 bp, Heterodera glycines
  Promoter: Source sequence=SeqID_25495; Location=372..477; Strand=+; Gene=SeqID_45937
ttccgcttcctttacattttttgccgggggtgccaaattattttttgcgtttgttccgcggatttcccatgcgattggtaccgtcggtcttctgcataaattaatg

SEQ ID NO: 111766 - DNA, 333 bp, Heterodera glycines
  Promoter: Source sequence=SeqID_370; Location=693..1025; Strand=-; Gene=SeqID_84702
aagcaaatttggatttatgatgctttttttaattatttttaaatcattttcactattttattttattttttcttaaataaattcattgagaacatccctccgaattattgcttgccttttaacaatacatagcggtagcggtaataattaattagcgtctctttgcttttgaaagtgtcacaactgattcgcggtggagggggtgggttgggtggttgcggaaattaattaataaccggcggcatgcgcacaacaaagccaagcattcattccttttctgcttaaaattacattgaccttacatttttataattaaatttagaaataaaaatg

SEQ ID NO: 111767 - DNA, 548 bp, Heterodera glycines
  Promoter: Source sequence=SeqID_8616; Location=1..548; Strand=+; Gene= SeqID_68684
agcgaaatgtgcgaaaacgaaaaggcattttattctggtcactttttactttgactgccccgactaaaaagcacaggggaaacctttcgtttttttttgttgactattttacgttttaaggatcactgaagatgggcatttatttatctcgaccaacatttttgcaaaaaaggaattcccttgtgtttttttcctcgggacaatcaaaataaaaaagtgccgtattttgtaaaaaggtgggagaggaaaaagaaaggacaaattgaatttaacaaagtcgagaaatgataatgcgagttgagttgagtcgcctttatactaaagaaaaaacaaacgtgcacaaacaaattttcaaaaagtgttcggtgaaatttgaacttccttcgattttgacatttcgatttttctctctgtataaatatgcaaccattttcatttgtcgactatcattttgcacttcattaaagtagcaatattttttaattaacaatttcagcgaacaaacttccaacgtcctaatttctgaaacgaccaccattccccaaatg

SEQ ID NO: 111768 - DNA, 358 bp, Heterodera glycines
  Promoter: Source sequence=SeqID_3219; Location=523..880; Strand=-; Gene=SeqID_83752
ttgggcggctgatgcaatttgcaaatgaaagaaaggcaaatcgattgttctatgattttttgctggaaaacggtttttgccagcaagagattgaattccgtcttcttttataaatttgttggctcacaatcaggcctgtaaaccagaaaaaaactggagggcgacatttgaggatttttaattttttcccagtgtaatttccaagaaataattttcaaaattataatgtttgttaatagttgttggtcaattgggctaatgaaaaataacgcgtaatattacattacaaaattttcaaaaatacccacttttcaaaaaaatctttcgaggggagggcgtccatttctgttagggcatg

SEQ ID NO: 111769 - DNA, 471 bp, Heterodera glycines
  Promoter: Source sequence=SeqID_19506; Location=1..471; Strand=+; Gene=SeqID_84231
aaaaagataaggaaggcacaatgaacgaatgagtgaattaatggcacacattgcggtaaaaagtgccgcgccaccattcactccccgagggcacagcggcaaaatgcaatcaatatcaattttatctgctgtcattaggcatatatttgtgtttgtttgaaaatgccgccagcgccgctcatccgaaacaaaaaagtgcggtgccgccgacgatttgtgcactgcgcgccctcccctccccccgcctcagggcatttatgcccggagggacgggcagataattagcaaattgcgcgaaatattgtgccatcgccgtcgtcatctcgcgggagacattgtgccaaattgggtatcaaagcagcgtgcttggaaaatttggataaataatggaagaaaatttccgaaatttaaattttttgatatttaaaatttagtagaaattcaaatccaaaaaaaattgtgccaaaaatg

SEQ ID NO: 111770 - DNA, 802 bp, Heterodera glycines
  Promoter: Source sequence=SeqID_12333; Location=393..1194; Strand=-; Gene=SeqID_75933
aatgggaaggtatctgtaggatatcaaaaatgggaaaggaatacggtagaaaatggaaaagtgaatacggtcgttatgaaaaagggaaaggaagacagtaatttaataatattaaaatctttacagtcaacaaccagcagaaatactgtagcacctttgtccactattagtagaacaattagcacgagcacaacgccaatgccaacagcaatttcaaccacaacagttccactgactcaaactgtaattagagaaaaggtgttgattaattttaaaattgcataaaatcttaatttttgatttaaacatttttatggtataattcgcagcaaaatttgaatgagtttgacctcgattctgcgccccctttctgcattgatagacaaccgctggaacttcgttgcgcttctcaactcaaaattagacaccaaattgacaccggacaacctaagcctaccgtaatcccatggcaagttgttttgtttgaaattgactcgaaacaaccgaatttaggcctacggtagttgacaatgacccgcacattcaaatcagtgcagtaaatatgaacatttcggcaaaagcatataaattcagaggtgttgttagctgcttatttgaattaagcttttctaataattttttgaaaaaataatttttaaatttaaaattatttcccttttaatttgtttttttccacaaggcgatgagacggaaatcgtttggcgagctgttgattttcacggtgaattgaaacagtgtgtgacaaagcttgtcttcgaaggtggtacctcttctgacgatg

SEQ ID NO: 111771 - DNA, 64 bp, Heterodera glycines
  Promoter: Source sequence=SeqID_1119; Location=3768..3831; Strand=-; Gene=SeqID_68143
tgtataatatattcaggtttatcatgacaaaaaggcgagctgtttcattaaaaagatcaaaatg

SEQ ID NO: 111772 - DNA, 134 bp, Heterodera glycines
  Promoter: Source sequence=SeqID_15176; Location=1..134; Strand=+; Gene=SeqID_79376
ctgctgatgaggaagacaattttgaggagcgcactcgtcaattcttcgccttcgtcaaccagggaaacattggacaattgcgtgcgctggtcgactcgctggacgcggatgagctgagcattttgctggagatg

SEQ ID NO: 111773 - DNA, 1003 bp, Heterodera glycines
  misc_feature (427)..(427): n is a, c, g, or t
  misc_feature (497)..(497): n is a, c, g, or t
  Promoter: Source sequence=SeqID_4730; Location=1975..2977; Strand=-; Gene=SeqID_55550
aaaaattttaaaaaataaaatcgcgtgaaataaaacattttccacatttttatgtttattttcgtcaaattttatcaatttttcgaaatttaaatttttatttaatgtttttgtgaaatttttccttaaatgaagaaaattttccatctttagacgttaaaagagccaaacgggccgttctaatagaggggttttttaaatccagtaagtaaagcttcgaccgtcccaccaaacaccaaaggagcggcgcacgagttcaaaaaagcggcaaaaatttcaaaaatggcaaaaaacgcagcgaaacttagccacttaaaaaattgtaaatttgcgtaaaaaatcaaaaagctagagatcggagcggggccatatcccgcgcgggatttgcgggaatttccagtccgaatcccgcaccttttttggaaanagcgggatttcgagaatgcgagatttgcgggattactcgagggatttcgtcccgaaaaaattttgaatcncaatgccgcggggcagcgagaccagcaagtttgaacttttcgggctctatatcaccccatttttcacatattttataaaattattataaattttttataaaataatatatgaaataatttaatctaaaatttgttactaaattagtcattaatggaaaaacaaataatagtcaggcgatgtcgataggccgctgggaaaattttgaaattaatcgtaattttttgatagatttttgtccaaaaatggcaaattccagttttaagattcgtttttttcaaaaatgatccggcagcgcgtctttggggggaaatttgtaatcttttaatgaaatttttaagaaattagccagaatttgagtgaaaacccccaaaaaaaagagacaaaaaagcacaaaagcagcaaaaaatgcggcacggacccctaaaaggctgtaaatgtcgcgcattccgcaccaaaatataaatcctgccgagaatatttcatcatcgcataaaataatacaatg

SEQ ID NO: 111774 - DNA, 220 bp, Heterodera glycines
  Promoter: Source sequence=SeqID_25518; Location=780..999; Strand=-; Gene=SeqID_56263
actgatagtgctgcgtgctctattgttaaatgatttttttgccataatttttaaaattaatttaattttcattatttattttgcgcaaaaaaccccaaacccccggaaaagccaaagctatttttgtgatgaatttgtgcaaaaacaaaaataatggtgtcataaaattaagtagcggttttaaagtggccacagggcggcagcactctctcagaaaatg

SEQ ID NO: 111775 - DNA, 679 bp, Heterodera glycines
  Promoter: Source sequence=SeqID_18392; Location=555..1233; Strand=-; Gene=SeqID_82992
ttttcttgccgaaacttttgcgccaattttgccctcttttccatccacccacggcacttttctccgtcgccgattgagaagaaatttgaaggccgagaacggcacggaccaattgacggacatttggatgcactcagtttcacgaattcaggcaattaaatgtgaaatcaaaaagtgtccggaaaaagttttgaattgtgtttcggcaaagtattggaattgtaaacccagtcggaaaataaacaaacaattgccgcgttctggcattttgccgcatcggttgcttttgtgtttgaggtgaggcgtggtctttcagatggatgaactgctcgagaagtgtctccaaatgcacagcttttgtacggacagtgaggggcccgagagaggcgaaccgggcccagcgggtgccacgggcgacgtcggaaaaacaggcccagagggaccgcggggacagacgggcgaagtgggcactcattactcgcctggcattgatcatgtaaagtgccaatattttagccaggccaaccggggccccaggggccaactgggccacaaggggtaagccaagggaaaagcctaatgccaaaaaacgaaactgcgcacttagccagctggccaagacgcgatttgtccaacttgtccgctgcagaaacacttggaattcgaagggtcggaaatg

SEQ ID NO: 111776 - DNA, 355 bp, Heterodera glycines
  Promoter: Source sequence=SeqID_10677; Location=4348..4702; Strand=-; Gene=SeqID_73925
ccaagtgacggtgggacttccgaatgaaacttacagtgtaggtagattacccccctttgtattataaaatttttttatttttgctaaatgaagcttctggccgagatatgaagcttttcctttttgccttattaatgtcattcccaaagaaagaaaagccaatgtgagcgtctctggcccagtgtgtatgccttccattccttttttcttcttttagagttcaattcccccaccctgcaaataattattttttgttttttacatgtccagatagtttttaagccttttaacattaataattttcatcataagaaaaatatcgatttttgggcgttagcaaaaaaccatcaaaatg

SEQ ID NO: 111777 - DNA, 202 bp, Heterodera glycines
  Promoter: Source sequence=SeqID_14156; Location=1623..1824; Strand=-; Gene=SeqID_78157
ttgcgaccgctacactcagcgcatttgtgcatcatcccatcaccaaaggtcgtttattgattttccatccattcatttctctgtgcctgaccaccactgcagcattgccggccgaaaccaagcaaaaccatttctctctcttatcaccattcaaattcatcactcactctgctccaattgaattcaatttctgactaaaatg

SEQ ID NO: 111778 - DNA, 92 bp, Heterodera glycines
  Promoter: Source sequence=SeqID_17448; Location=1..92; Strand=+; Gene= SeqID_81932
tcaaaactagttaaaaaaccagtttaaaggacttgccatatgaatttttaagattttcctttcattttaagttgggttgggcccccgaaatg

SEQ ID NO: 111779 - DNA, 170 bp, Heterodera glycines
  Promoter: Source sequence=SeqID_37361; Location=1..170; Strand=+; Gene=SeqID_66450
aaatcaacgagtcatcaaaatatgagacaccgagaatatgtggacatgttccggcaatgtcaaagtgccgaaaggcatttgctaaaagattagtcaaaataattcaagagttgtgccacatagttggttttgattggcaaaaaattgggcaatgttttggccaaagaatg

SEQ ID NO: 111780 - DNA, 1003 bp, Heterodera glycines
  Promoter: Source sequence=SeqID_3539; Location=193..1195; Strand=+; Gene=SeqID_47641
ccaacgatatcggggaaacggcggaggggggggacgaactgtttcccaattatattgcatatttaaattttttttttgcaattaataaaaaagcacccaaaaatcacagaaaaaggaatgaaatatgcaaacaacaaaattacacaattattctccttccatcccccgagggtgggtaaatgtttcaataaaaataggtatgtgaaatttgcctcaaggggaaatcactaaatggcaaaacaaaaaaatagtgatgtcttatttgttttgccctcgaattaacaattaatgaatggattaaaaaaaagtgacgaacgaactcatttattagttaattaggtttctttttgagtttccaattacagtagcatttgccttggattttgcagagtgatactgttgaagagaaacccttttgaaattgcctattttggtccaaaaaacctaggaattgattccgagtccgttaccagcttcagttcgttcgttatttacgtatatatatttataccgtaaaataaaattccatgggacgctaaaaattttatgggacgcaaattctgcagtagaaactatttgtttttggaaaatttatatttttatgtgagttttagatgcagaaatttcaattccttcacaaatttcatcatttttaaaattcccagtcttcccaacaccgtatgttatgggtgactgatctcctaaccatagtagttttaataaaaatctttaaaaaatttggcttaattaatttccccgcagcagaccctaaaaatactttaattttcttaaaaaaattatgacacccgggatcgggatccggcaaaaccgggatttgaatcccggtaacccaatcctggcctggtgccaatcacgaatcccgactttttcaaaatccgggctcgactgattatttaataattaaaaatcattattagaatcataatttctctttttattaatttgcattttaaaattgactctttttcggcttatcgtcatg

SEQ ID NO: 111781 - DNA, 415 bp, Heterodera glycines
  Promoter: Source sequence=SeqID_8302; Location=865..1279; Strand=+; Gene=SeqID_67631
gaaaggaggacgaatgatcggagaatttaatcggaagaactttttttgtcgtttcgatttacaaaattttcgaaaatatgttttgttatttggaaaaatgtaaaacatattcctattatccttaaattacataaaagataaatgaattttgaacaaaattcggcaagcacatataaaggatctaattttttaaaatatgtatgtaaatgctgtaacttttaagttaattgtaagcattaaaaaatttaaccaaacgccgctcaagcataaaaactagagttgagcgggaccgggaccggggcgggaaatcccggttttttcaggtcccggtcccggtttttggaaaaacagaaatcccggtctcggttttgcctgtcccggtcccggcgggactaaataagcactggtaagaatg

SEQ ID NO: 111782 - DNA, 1003 bp, Heterodera glycines
  misc_feature (35)..(35): n is a, c, g, or t
  misc_feature (50)..(50): n is a, c, g, or t
  misc_feature (54)..(54): n is a, c, g, or t
  misc_feature (94)..(94): n is a, c, g, or t
  Promoter: Source sequence=SeqID_1756; Location=5298..6300; Strand=-; Gene=SeqID_75742
gtagagcacacacccagacacgagggaattaattnatatgctcacataanttgngatatggcttttgagtgtctacaccagtgatgcccgcggntgagaaaaattcggggtcgggttcggggtgagaaaacttcggggttcgggtcgggttgcctcccttgtctacactttaactgaacctaataaactaaaattaacaacttttataaaaaaaggcaaaatgaaacttttaatttttaataaaaaggaaacttttaccaaaaatttaaatttttaattttaaaaaaaaaattttttaaaaaaagggggggaaattttgggtgggaagggggaaaattgggcggaaaaaaaaaaagggaaaaaatttttttaaaaaaatttttttttttttttgcccaaaattttttttttttcccttttaaaaaatttaaaaaaaatttttcttttttaaaaaaaaaatggccttaaattaaaaaaaaaataaaaaaaaaaaaaagggccttttttttttttttaaaaaaaaaaaaaaaaaaaaaaaaaaaaaaaaaatttttttttttttcccaaaaagagggggttgtttttttttatttttttttttttttttatataaaaaaaaaaaaaaaaaaaagaaataaaaaaaaaaaaaaaaaaaaaacaaagcctttttttttttttttttttttttttttttaaaaattttcttttggggggggggggggttttttttttttttttaggaggagggaaaccacgagggggaaaaagcccccctgtgcccacacaaaaaataaaaaaaaaaaggaaaattttttttttttttattttttggtttgaggggggaaaattttggaaatttttcccccccctttgaaccccttttttttttccccccttttcaaagcgatccggatcttttaaaaaattttgcttgttggatactcgttcttttcggatcgtatcccccccctggccagcacgcttatcaaagcacaaaaaaatg

SEQ ID NO: 111783 - DNA, 119 bp, Heterodera glycines
  Promoter: Source sequence=SeqID_13800; Location=1582..1700; Strand=-; Gene=SeqID_77729
gctttattctgttggccggcggtgaaattgattacggcaacggcaacgtggcacgcctggtggactaatggacgctcgaccttaccaacttcacgtggcaccaagtggccgcccaaatg

SEQ ID NO: 111784 - DNA, 589 bp, Heterodera glycines
  misc_feature (76)..(76): n is a, c, g, or t
  misc_feature (93)..(93): n is a, c, g, or t
  Promoter: Source sequence=SeqID_28691; Location=1022..1610; Strand=-; Gene=SeqID_59273
ggttcagttatgacgaccagcggagcattcggattaaggttttctattagcaaagccaagcaattagttcccaatntaaattgtgattaaatntaattaagatggaatggctccggcagaagggattgggcggcacttacatttgggcgattgattacgacgactttaacgaagtgtgcccaaacagcaaaaatgatggtttatcatttttgaaatatgctttcattatcttctctaattgttgcttaattaattaggcccctaccccctaattggcacaattgcgcgagaacttggcggagtgaacagacttgggctgccagtggcaaaactaatgaaaaaagtcaatttcaaaatataattagaaaactcattattttaatttataatttagaaaaacgattgtctgtccgcttcttccgctgattttgacactcacttttgcctctccaaatttttgtttacgttttttgccggcatttttcttcttttggcattttctgcttccctttcgtcagcaatttctaacaatttcaattcatttttctctcttttaaggtgctttttcatctttttcctgttcaaaatg

SEQ ID NO: 111785 - DNA, 92 bp, Heterodera glycines
  Promoter: Source sequence=SeqID_7228; Location=1703..1794; Strand=+; Gene=SeqID_64197
cgtgatatttcgatttgagactgactattcaacgattacacaaaaatatttagttggtccaaaatgaccagttgatggactccattaaaatg

SEQ ID NO: 111786 - DNA, 577 bp, Heterodera glycines
  misc_feature (15)..(15): n is a, c, g, or t
  Promoter: Source sequence=SeqID_34389; Location=834..1410; Strand=-; Gene=SeqID_64195
agaaaataaccaccngttgcagtgcataatctcgattaataataaattcgttttgtgtgtatttgagtgaaatttcgttgggatttgactgggattcagttttcaaaatgcacgagtatatagcattttcacaaatgcaagatttttttgttttccaaaattctaaatcatttcattcaaaatgataatccaattaatgacagtcttttgtacttttggggaaggaattggtttaaattgaaacaaacaacagcaggtgtttgtgattcgtgaaataaaggaaaaaaattaattcgatgaaagcaaaatctcgtaccaagcaaaaattaatgccattctttcgtattttaataaatcaaatgggtaattaatttccttaactgccttgagttcagaaaatactaaattttacatatttgaaattgctttactttctcagtctctttacccctttcgttatgtttccgtttcaattttttgcctaattatttgccgacttcattaaaacatcgacattttaatgaaataagcgtaaattaaattagttattattagagctcgtattttgaggcatatg

SEQ ID NO: 111787 - DNA, 785 bp, Heterodera glycines
  Promoter: Source sequence=SeqID_14874; Location=1..785; Strand=+; Gene=SeqID_79021
ttattagtttattaccgtttagctaataccgttttttaatcctttttttgtttagaacattgtccctgcggacgttgtgaaaattgcgccatttactcttttcccgtcgcccttcccacgcgaactttttgtccaagcgcagaaagtgcacaaagtgaggaagtgaataaagacaacaaaataaaaagatttagttattttatttataaaataaaaggcaattaattaattatttttcattaattaggccactcaattaattcatttttcattaatgaggccatccaattaatgtattttctcattaattaggccatcctttaatgatttttcattaattaggccactcaattaattcatttttcattaatgaggccattcaattaatgtattttctcattaattaggccatcctttaatgatttttcattaattaggccatccaattaattcatttttctattaattaggccatccaattaattcatttttctattaattaggccatccaattaatgtattttcgcgccgcgtcgaactttgaatttttgaaagatgtgcacaagggactgctgaaaacagaccaaaatttcatagaaacttttaaaagcattgaaagcagacacttggaaggcattaagcaaccgctgactttgttctgcaacagagcagtgagttgctgaaaattttgaagggataattaaattaattaatttatttttaatgttttagaaaaatattttaaaattgcaatattttagttacaatatttttaggattatatg

SEQ ID NO: 111788 - DNA, 449 bp, Heterodera glycines
  misc_feature (13)..(13): n is a, c, g, or t
  Promoter: Source sequence=SeqID_39152; Location=631..1079; Strand=-; Gene=SeqID_67794
ttatgaattaatntttgcaaaataataaataagtaatgattaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 111789 - DNA, 390 bp, Heterodera glycines
  Promoter: Source sequence=SeqID_5216; Location=1..390; Strand=+; Gene= SeqID_57295
ctgattgtgtgtgaatccaattgacaacaaatgtttctaccctggatgtggtcattgttttaagaaaactaatgagcaaatttttaaaattattgataatgtaatttacaagaaaataaaaaataaataatcaaaaattcatttatttaatatttaaatattttaaattgaaagaaatattcataaataaaaactaaaaattaatttattttttattttaaaaatacacctaaatgattttttaaaggttccaaaaatttaacaaatttaagatttaaaatcgaagatttattttcgtattgttttttcccattccaaaattttttattttttttattttgcaaaaaatttttaatttttttaaattaaataattcattattttcagatg

SEQ ID NO: 111790 - DNA, 93 bp, Heterodera glycines
  Promoter: Source sequence=SeqID_10181; Location=3622..3714; Strand=-; Gene=SeqID_73286
agtgggtaaaaataagaaactgctgggaacatccaacatcagtaatagaaaccattggaactaaatcaatctttaattgttccgtttaagatg

SEQ ID NO: 111791 - DNA, 66 bp, Heterodera glycines
  Promoter: Source sequence=SeqID_30482; Location=1411..1476; Strand=-; Gene=SeqID_60889
gtaataattgtgaaaaaaagttaattaatttaaaacaattaaatttcaaacttttaattagctatg

SEQ ID NO: 111792 - DNA, 88 bp, Heterodera glycines
  Promoter: Source sequence=SeqID_10960; Location=2504..2591; Strand=-; Gene=SeqID_74267
ataataaaattatttttttcaggaattaatgagtaaaaaaaaaattaaaacaaaagtctgacgtgaagaaacccgtgcagaaaagatg

SEQ ID NO: 111793 - DNA, 131 bp, Heterodera glycines
  Promoter: Source sequence=SeqID_25875; Location=359..489; Strand=+; Gene=SeqID_56649
ttgtccgttgtagtgaccgagacttgggcaacaacacacgtgcatcatcactaagagtctctcggtgctctgcaattgaagatgatcaccgataggaatgcagaagggcgacaaggataggtacaaaaatg

SEQ ID NO: 111794 - DNA, 73 bp, Heterodera glycines
  Promoter: Source sequence=SeqID_11681; Location=5049..5121; Strand=-; Gene=SeqID_75153
tttcctcccgatttcaaggccaagttcacggtcttcggactgcagatcttcccttgggacggggtggatcatg

SEQ ID NO: 111795 - DNA, 514 bp, Heterodera glycines
  Promoter: Source sequence=SeqID_15390; Location=1991..2504; Strand=-; Gene=SeqID_79652
cacctttattgtccaaaaacgattcaaatgcatcgcgtctttcctggatgaaccccctaatttctattcatttaagtctacttgaatcgtttttggacaataaaggtggattttagtgaaaaattaattttcggctttggttcgaatttgggtccggagttcgaaactagtcgaaatgaatgtcattttcgtgatcagcggcccgaatacccctggaaacacgttttaataattaaaaaaaacaatttttttatgtggcgtaaactgcataagtaccgagaattccctccctcccaaatcataatattttcagagcttaattgggcacaaaaatttttgattcaaccaatttatatctcaacgctttctttagcaactttggacgaggaggaagcgaacctcagctcgggagacgactgcgacaacgaactccgccaattgcaggaggacggggaactttcgctggaagaattgcaacggaaatattacgggggaggagaggagcgggaagatg

SEQ ID NO: 111796 - DNA, 401 bp, Heterodera glycines
  Promoter: Source sequence=SeqID_44026; Location=820..1220; Strand=-; Gene=SeqID_71581
ttatttttttaaaatttttcaaaaagtattctttaaaattgtattttttgctttttttctcatttttcctggggaaaatttgccaaaaaatggcccaaaaaattaggcttaacaaggcaaaaaatggcgaaaatatggatttattcccgaaaacccccaaaatatggatttatatggaccaaaaaccttcaccaaaccaaaaaatttaatgcagaaatgctatttttgagcccttttcttcatagcatatgcgtaaaaaatatgatatccatacaatttcgagccctaattatattgcaattgttgaacactctaactgattttattaaaatttaaaggctattcaattgcaagagaatggggcgaaggaggaaaattcggagtccgatttcgaaaaaatg

SEQ ID NO: 111797 - DNA, 282 bp, Heterodera glycines
  Promoter: Source sequence=SeqID_321; Location=1..282; Strand=+; Gene =SeqID_82138
ttgtttttcttcgatattttgtcacaaatatttttacagtatattaaatttttatgatttagtcaaatgctcgagactctctgtctcgacttgagaaaactcttctctcggggcttttttccgctcattacgcctcaaaacaataaaatgatgattgagcataattagtcaaaaataggaaaacatatcgtactattattttctccttaaaaaaaattacatttcgacaaatttggttttgcttgtattccgttgagagaacccgctttagttgctgaaatg

SEQ ID NO: 111798 - DNA, 494 bp, Heterodera glycines
  Promoter: Source sequence=SeqID_2476; Location=893..1386; Strand=-; Gene=SeqID_79929
tatttgagtattgaatgatttcaattgatttatctatcaattaaaaaaaaagataaaatttaatttgccaaattataaaaaaaaaaaataataataatttttggtttcggaggattggaaattggaaaaagcgcaaaatgactaacgaaatgaaagaaattttgatgaaaatgaatcagatgaaaatggaacaaaattgaaaagaaaagtgaatgagtagtgggtccatcagttcaatcatttttatagacaaaacagtaaatcagttttggcattttcgaaaataggcattttgaaatgggacggcaaatgcgccatggaatttttcaagcattgcccgccttcgccacagcaacaagctgctttatgccaaaggcatcataaatggcattggcattgctgaaggaagatgttcccaccaaccgctactgcccgtccctccccctccccccgggcattttcattaggatgccggatttggaatgggcaaaatg

SEQ ID NO: 111799 - DNA, 1003 bp, Heterodera glycines
  Promoter: Source sequence=SeqID_2159; Location=5194..6196; Strand=+; Gene=SeqID_78162
agtgacgaaaagtgacgtccaaagaaaaaatttaatgtagaaatgcgtttttgagctcctttcttcaaaacaattgagcgaaaaaaagttttttcactagaaatcccgaccctactaatgtgcgaagggggagggaccggagggcctttcagtgcagcacccctcacatttgctcatcccggccgttcccccatctcatttatgcaacatttctccagcgaagcgacgccactattttttcagcgctcattccccatcccatttaatttgcatttatgcgtttttacgatttaaaaatatttttaaatatttatgtaatattttaaatatttatgtaccaaaattttattaattgaaactgatcagaaaagcgcctgattaaacatttattgcgttttcccctttaatcttttgcttcaaatatggtgattttccaaatatatttattctccaaaaataataataataattgggttatggcccagacaaaacggcattatttttccccactcaaatttaccgatcactataccgtatccttttttgggttttcaaatgataattttggatcatttttactcaatcaatttccaattttatttggacttatttttaattcgttttccctttacgtgtattacaattcaataaacaattgcttattttcgttaaatttaatttccatttgtttttttccattgtttattgccgtttttattttcaatgcgctgttcctggtttgatcagccgatttggcatttacctccaaacatttttcacttttggccgacacttatttatgtatttttatttttttttatttccccattggacgtttgtttgaattttgtcattgccaatgcattttttggcatgctttgttgaccaccttttccctacatttctttttgcatttcttttatgccgattccataaaggcatatattaattgcttattacaaatgctgataaagtaaagtagttaacccctttatcgtgcatg

SEQ ID NO: 111800 - DNA, 539 bp, Heterodera glycines
  Promoter: Source sequence=SeqID_38500; Location=779..1317; Strand=-; Gene=SeqID_67288
cggcccgtccgagtacatctcagcaacggcgctcaaatgctaattaaaacagtggagacgggtgtgcaggtacggcctggtccggacgaaccgaaggacaagtccgtgatggttacggacgaagatgaagatgaagaaattgaagtgccaaagtttttaacctcatcaagccagacgcagggaagcagccgatcacccaggaccaataagaaagcagcaaatcagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgctcgccagtagcctactcgatcgactgtttgttaggtctgggttcgtcggacaagtcaaacaaacgagaggatttgttccctcaaaatg

SEQ ID NO: 111801 - DNA, 1003 bp, Heterodera glycines
  Promoter: Source sequence=SeqID_8136; Location=2108..3110; Strand=-; Gene=SeqID_67091
aaaattttcaatcaattcaagcaccaaattttgagaaaattttgctttttaaaccgcatatgcaaaatggtacaaatgataaggaaaattaacaaaatgatgataaacgataaaaccaataagggacacaaaattggtcaattaaacactaattgtctctgtccattgagtgatcgattgatcaccgtgaccagccaacggcaagcaatggggtgatttgatcacctgctgctcgcaagaattgattggatttccttttaaactgagaatgatcagccaaaagcatttaatcaaactcaacgtttaaaataagcaccaatcaaatgggaagcgtacaaaaaaaaaatacgcagaaaattttgcggtttattgaattttttaatcaagtcgacttcagcatggctctgatctcaaaaatttgaatatcgatttatttatataaaagcaaaaaaaatttttgaggatatattaattttaaaaagaaaaaaaagtgatgatggaaaataaagcatacgaaggttatgttaaaacatctacatctttttgaagtcgcaaatagataaagaagaatttaaatgatgatatttttgatatttaattattgaaatatctaaaataaaacagatacaagatcttattaaagaaatttctatattatttcatccagataaaggtttatatgattttgttgattctttaattctcatttaaattgcataaattcaatgaaaaaattcgtttaataaatttttgtcgttaaataaacattaaataattggccacaagaatatcaaataacaaacagttcacttgttggaccttaagtgggagtggcgggggaggcgaaatcccagaaaaatatgttgcaataaattctgtattgttttaatgcggaaatcgcttttcattttgtaaaaattaaaaataaaaaatttgcaataaaaattggaagcggaaaatggcgaaactctcgccggtgtgtgcagtggggcgagactgaatg

SEQ ID NO: 111802 - DNA, 158 bp, Heterodera glycines
  Promoter: Source sequence=SeqID_5612; Location=1..158; Strand=+; Gene= SeqID_58651
atttttcgggaccaatgttctttactattaacccccccgcgggtggtgtgacattttattatacttacaattagtattgtataatttaggacgattcagacgagaaggacaacacagcggatgaaggtgatgatgtagaggaaagttcggagaagatg

SEQ ID NO: 111803 - DNA, 1003 bp, Heterodera glycines
  Promoter: Source sequence=SeqID_5389; Location=3137..4139; Strand=+; Gene=SeqID_57863
ggcccggtgcggggcgggatcccgcgctagattaggcgcaatcccgcatttttttgggggaattgcgggattaatccagcgggatgaagtcccacaaaaacttgagttccaatccacagcaggatccgcaaatttgtttttttttgtgcgggatcccgcaggaatcggcattgcattttttgaaaattcattaacagaataccaattttctgaataaatttaaaataaattcaattaaatttaaaacagttttccatcgtatttcatccaaaatttatgaaaattttcccggcggtgcctgttggctcgccggactaacctttaagctgattattaattctttaaatattctcaaaaagctacatttggccatttttggacaaaatctattaacaaagccaaaaaatttcaaaaaattttccaggcgacacctaattccaaaaagtttctaacaatttgaaaatgggttttttgaaaggccatggccaaaaatatacgaaaaaacaatgtaataagttttcttaaaatttgattattaacagaagatggtttgattttggttatttatatacgctatttccgacaaattgttgttacctatttttttctaaatttgacttcccctgtgtttagtgtatataaatggcgcttttccacctttttctccattattctattctttttcttccgccctatattttgacccctcggcgtcggcaccaccctaagtaattaatattctaattgttttcttttttccaattttaattttgttttcccccctcattaagcaaatggccggtgactccgaacgcgacacgggcaggcatcatcaccacaggcatcatcgacatcgtcattcagcgcgcaccgttttgagaaatttgggctaccaatcaccgcacaaactgggcagtggacaatacagcaaagtctacaaaggtggttcacaattccatgtgcttttccagcaccatttcccttcccttttcagtgtttgatg

SEQ ID NO: 111804 - DNA, 343 bp, Heterodera glycines
  Promoter: Source sequence=SeqID_2291; Location=2605..2947; Strand=-; Gene=SeqID_78937
atttttgttcttaatgagcttttttttacattttcccacgaacttaaattgatccgtttttcgtttatttgtttcattatgattaccgatgtgatttttgcaaccctttcatatcatattattactttaagtattaccaaaattctcactttgttcttattataatttattttatttttaaacaacttaattgtccaaattctctctacggcattatatttttttcatccaaaaatgcataaattataatattttttaaatttaacaattgttgctcttcaaacaatttattggaaaatcttttgaaaataatttttttggttataattttaagattgttatg

SEQ ID NO: 111805 - DNA, 190 bp, Heterodera glycines
  Promoter: Source sequence=SeqID_31560; Location=924..1113; Strand=-; Gene=SeqID_61890
acattaaattttataacaaagattttttagaaaaaaataataaacaaattgaaaatcatacgaaaaattatgacgaaaattttgaagaaaaagctaaaggtatattttttaattttcttaaaaataaaattcgagagctcgacattttgaaaaaagcatcgatttatacctggttttttcatttgacatg

SEQ ID NO: 111806 - DNA, 405 bp, Heterodera glycines
  Promoter: Source sequence=SeqID_1162; Location=1611..2015; Strand=-; Gene=SeqID_69072
ctttccaaaaatttgtttcttttgtcaatctgccgtcttttcattgtcagaatggccaaagatgttatcttcctttgtttggctcggggagtgatcaacaaagattaatgctaggaatattggacacaaaagaataagtgactttaggcgtcccactgaaatgatttggcgacgcttcaataataaaatttgggctttgatcaaatatgcatagtcaattttggtgaaataataaaatgagggattttcttaacaaatcatgttaaatatattttctctctctctctctctctctattactttatattgtttaaaaacatgaaaagaaaaataaatagcatttttacgtaatttttttaatgaaaattttgcgttagtgtgtgcatcggcaccctgagcaggatg

SEQ ID NO: 111807 - DNA, 232 bp, Heterodera glycines
  Promoter: Source sequence=SeqID_30559; Location=390..621; Strand=+; Gene=SeqID_60973
tttggcaacgccataaaagtgccaacggcggattccaaagcactcgcaagccgaatcagaaattatttatcggtctttcttcatcttttcccctttttttctctcattcctctttttttctttctctctctctctcgctctcttctctccttatcacttcctcccccctcttcagaaccccgccgtttcttggcagccttccaccgatcaacggcgcttaatcggtcacatg

SEQ ID NO: 111808 - DNA, 848 bp, Heterodera glycines
  Promoter: Source sequence=SeqID_10318; Location=3168..4015; Strand=-; Gene=SeqID_73497
attttgaggatttttttttgggaaaatcacagatctcttcggaaaattgatcttttactgttaaatatttttggcatataaaataaagtttaggtaagattagcgataatggacggggcggtggtttggggtagggaacattaaaaaactcatgtgcaaatattccaccaaaatggtggatttatgggtaggatgctatttaattactttttggctgcattttgtcaccattgagctgtaaacgcatttttcctggagacgttttgggcgccgacacaacagacccccttcgacaatcctattcccacctaattacgtgtcgcctttttgtcatcatttttcaccctcttttaagctcagcccgccatttcagactttcgtaataacatccccggttatgtatataaagttataaaaataagtagtctattctctgattaattttgtttttgatccaatattactttgttatatgatcatttaattttttgtaaattcaagatacgatggaaaacaaagcctttttaaaaatcccaaaagaaaaaaggcaagtgaggaataaaaaaaattattttgcaaaacgtaaggatatcccagaatcaaatttttacaccgaaatatccaacacaataagagaaaataaaaaattcggtctgagagaaaacacgactaggttcatattcaaaaatactgaagaaaactcaaaaaaaaatttcaaaaaaataattcaatacctaaccaaaaaagctatagaaaaaaatgaaaaaaattttaaaattgaaaaaatatcgtatgacctttattgtgaagctttgaatgacccattaataataccacccagagatatg

SEQ ID NO: 111809 - DNA, 1003 bp, Heterodera glycines
  Promoter: Source sequence=SeqID_13; Location=1605..2607; Strand=-; Gene=SeqID_69063
aataaacaattctcaattaatgaaaaaaaaattggctgtcttttcctaattaaaaatgccatggtattggcgtgatgaattgccaaatagcatcagcagaaggcagtggagggcacaacaggtgaaaaaagcacaaatttaattttttaaaaaatttctcgatcgaattaataattttgaaattattttcgtttcttttcatagttttgttttattcttgaataatcatttttggactcatttcagcgtctacatcgtcctatccagcgtgcgcaaggtgttttaaattattatcccccccccccccataaagagaattaatgaaaaaattataagtctaactaagaaaagttaatgaggcccgggatttttttaaaatttatttaatttcaagtcccatggccatttgtacaccagcagtatttggggacagtacaatttcctccacctccgcctcatcttgttgatcctcgccatggacattttctcccaagacggtggttttattcatttattttttttaatttaaaaattttaaattgtttaaaaatttttaaatttaaattctaagacaattaatatttttctgacatatcttataaaaaaatatgattgaataagaaaaaaaatataataataaataaattttttatttttttggcggcggggaaggcaaacacagcgaaatcaagtcaatgcaaacgcaccagtacagcggcctccagtaaaactgtttaaaatactgtactgccctttgaaccccccttttttaaaaattcaacagtactaatgctttggttttcaaaatttttagtaaaaaaactaattacaatcgtaatattgtttaaccctttttttcgcaccaaaaatacagggtttggggcagtacaaaaaaatcggattataacttttgggatattaaaaaaaaaagcagcagcaggtaccattgttcattcgcaatattggtgctcagctgcaaccagtttcggttcagcaggctatg

SEQ ID NO: 111810 - DNA, 1003 bp, Heterodera glycines
  Promoter: Source sequence=SeqID_2847; Location=38..1040; Strand=+; Gene=SeqID_81911
agcgcgccgcaaaaaaagcagaaaaaaaggagtcgcaaattaggaaaatgatcagtgaaaactagagtggtacgggaccgggaattttgggaaaaaccgtgaccggtaattctcgcccagacccggtcccgacccaccgtagtgaaaacaaaaaaattggaaaaaattcattccggtgaaaaatacaagccatttgaataaattttaaccatttttcattgcataaaataaaaattttaaatgtccttggatttcatgaattttccccactatgtccttgcaaatcggatgcccgtccttggaagccgacattgggcgatcccatccctgccataacgttttgaacctaaaaaaaatttttgccaatgcaccaaaatttaaaagttcggagggattatccataattgacattggtctcatttatggtaatttgttttgacagtgattatttttataatttattttcattttattgcttgttttctttattcacttgctctgtttcgctataattttgacagttacagagtaagtggtccccgcccttctgtgacttatttttcttgcttaataataaattaaatttaatttaaaaaaaaaattaatcaaatcttttttggtaattgcctgaacgctgcgattttatatattttagcttcgttagaatttgtgctttcgaatgataccaaaaaggtagggtttatcgaacatgaacaaagttattgtataaaaacccgggattgacaattgattggactcataaaggtcgattggactcataaactgcactagagcaaaatccgttccctaatcatgacacataaacaaaaagatacaaaaacattcatcaatcccttttcatgtctataaaaatgtttgttttttcactttgtctcgcatttgaaaaaaaaataaaaatttctaacgcaattaattattctgctctttgttgtgtgatatcattcggaactcggccaaaattgtgctaattgccacaaaaatg

SEQ ID NO: 111811 - DNA, 227 bp, Heterodera glycines
  Promoter: Source sequence=SeqID_1302; Location=2497..2723; Strand=+; Gene=SeqID_72087
agaagtgcgccaaacacatcaccaacaaatacccaaatggcctcaaggacgacaactactcctgcccacacttcaaccctaacgaccgggccttcgtttctacttgcacccatcttgagctaaacgccgcgttggatgccggctatacagtgcgcaaactttttcacgtcttgcaatacgaccagtggagtgacaacgtattcaaatcctacgtgagtgaaatgatg

SEQ ID NO: 111812 - DNA, 109 bp, Heterodera glycines
  Promoter: Source sequence=SeqID_30797; Location=1..109; Strand=+; Gene=SeqID_61184
tttattttaaattaaattaaattataatttttattaaaaaattgtcagcaatggaattttgtttattattcttttcaatttgtatttttaattgctcaaaattgaaatg

SEQ ID NO: 111813 - DNA, 426 bp, Heterodera glycines
  Promoter: Source sequence=SeqID_32527; Location=1..426; Strand=+; Gene=SeqID_62839
cagcatgcgcgttttgtgagggcgcgcattggaacgacaattgcgaaaagtacagaacttcgtcagcgagatacgcagtcgccagagagcgaaaattatgcgtcaaatgtttaagaagggcgcacgtggcgatgaagtgcccacgcccttcgaagtgctacttatgctacggcgaacacccaacagcactttgtcgacaagggaggcgacaagataggcctacgagggccatcaatcccgtcactcaatccaaaatgagaaacgagatggcggagaaggatcaattcaaagaaattggttcggcaccgacacaatgcaatgcattgaccaaggacaagtcaaaagtgcttctgcgaacaacggaagtcacaatcttcaatccatctgatccaaagaagagcacgattgcgaccgttttcatcgatg

SEQ ID NO: 111814 - DNA, 393 bp, Heterodera glycines
  misc_feature (4)..(4): n is a, c, g, or t
  misc_feature (8)..(8): n is a, c, g, or t
  misc_feature (16)..(16): n is a, c, g, or t
  misc_feature (19)..(19): n is a, c, g, or t
  misc_feature (62)..(63): n is a, c, g, or t
  misc_feature (72)..(73): n is a, c, g, or t
  misc_feature (81)..(81): n is a, c, g, or t
  misc_feature (94)..(94): n is a, c, g, or t
  misc_feature (123)..(125): n is a, c, g, or t
  misc_feature (141)..(141): n is a, c, g, or t
  misc_feature (152)..(152): n is a, c, g, or t
  misc_feature (178)..(178): n is a, c, g, or t
  misc_feature (181)..(181): n is a, c, g, or t
  misc_feature (183)..(183): n is a, c, g, or t
  misc_feature (186)..(188): n is a, c, g, or t
  misc_feature (190)..(190): n is a, c, g, or t
  misc_feature (194)..(194): n is a, c, g, or t
  misc_feature (196)..(196): n is a, c, g, or t
  misc_feature (200)..(200): n is a, c, g, or t
  misc_feature (208)..(208): n is a, c, g, or t
  misc_feature (213)..(213): n is a, c, g, or t
  misc_feature (216)..(216): n is a, c, g, or t
  misc_feature (223)..(224): n is a, c, g, or t
  misc_feature (230)..(230): n is a, c, g, or t
  misc_feature (233)..(234): n is a, c, g, or t
  misc_feature (236)..(237): n is a, c, g, or t
  misc_feature (242)..(242): n is a, c, g, or t
  misc_feature (245)..(246): n is a, c, g, or t
  misc_feature (254)..(254): n is a, c, g, or t
  misc_feature (259)..(259): n is a, c, g, or t
  misc_feature (262)..(263): n is a, c, g, or t
  misc_feature (265)..(267): n is a, c, g, or t
  misc_feature (270)..(270): n is a, c, g, or t
  misc_feature (279)..(279): n is a, c, g, or t
  misc_feature (282)..(283): n is a, c, g, or t
  misc_feature (285)..(285): n is a, c, g, or t
  misc_feature (291)..(291): n is a, c, g, or t
  misc_feature (293)..(296): n is a, c, g, or t
  Promoter: Source sequence=SeqID_42193; Location=498..890; Strand=-; Gene=SeqID_70147
tttngaanatttttanatngattgtgagtgctttgtggaattttgagttttgattttatganngatattttnntaattganttttaatttgatnaaaattgattaatttgtatttaaaagatnnnttaattaattaatttntttgattttanatttaaatttgtttaattattttganttntnttnnnanagtntntttnataaaatntgttnttnaattggnnatgttngtnntnnaattngtnnaatatttntttantgnngnnnatnagttttaanagnngngttttngnnnngggaaaatttagcattgtgagaaatatttccgaagaagttcctttaattgagatttttaatggattgaatgggcaaaaaaaattaaatgtcaaaatg

SEQ ID NO: 111815 - DNA, 156 bp, Heterodera glycines
  Promoter: Source sequence=SeqID_6390; Location=1714..1869; Strand=+; Gene=SeqID_61356
gaaatttctcaatgccaccacttccgttagctacaaaattcaatttattattgatccattgtcaacgcaaattgtgccatttgaattagctaacgaacggaccatggagaagctgacactgatcaaaaaaagcggacatcgtcatgaggaaagatg

SEQ ID NO: 111816 - DNA, 181 bp, Heterodera glycines
  Promoter: Source sequence=SeqID_14104; Location=3820..4000; Strand=-; Gene=SeqID_78087
aaaaaaaagcaacaaaaaaattgttcgaattcgggttcggggttcgaaattggtcgaaatgaatattatattcgtgatcagcgccctcgagaaccctaaaggactttgaagaattgcataaaaccccctttgcctcttttttttgggacctgtaaaccatactattaccgccaaaaatatg

SEQ ID NO: 111817 - DNA, 1003 bp, Heterodera glycines
  Promoter: Source sequence=SeqID_10960; Location=721..1723; Strand=-; Gene=SeqID_74268
cgaaatacagctacagcatgaactggactcgaacctgggaccctccctttggtgaccttctcacagaccacttcgccacacatgcaaatcttttctggtacagcagctcatttcccggacgctgtgataaatagcattgacaagtctgtgtttcattctcgttctcagtttgaattttgataactcaattaatttcgtaatacattcaatgtccatacatatacctatttagtacatcaaaacagctgcaaaataaattaattaatgagtatagatgaatgttggttgacacgatgaggcgttgaaagtcgaataaaactaagggatggtccacacacagcaaaagtttagtttttatttttacttttgtcgctttttatcgcgacctattcaccatctttggcttgttacaaaagcattcttcatttattgagtggtaaaagtcattgagccttaaaattgttcattcgcatgtggatttagctgatgcttactgactttaaactttaaagtttaaacccaatgaatccgtcggcgtttcttcggtcattgctttgcttccctaacgttctctcgcagttctctcttttgtctttttcactgataaaaatgtcccgccactgataaggtgcggtgaccgacaaattaatttattattaagagccagccctttcttcattttccatttatcggtacttttttttacaaccgaattccccccccccccttttttcacttaaaacgcgtctttccattgtccgatgattctgcaatttccattcggggattttaatgttttgttgctgcttacaatcagcactgttcttttggccagatgtttaggcacaattgtacagtttgaagatgaattagaattgatggaaaacaccggtgggtcttggtaaaacttaatgcttttttcaaagtctatttttgtgaatttcaaatatgcattcggattgtgcaaattaaatgttggattgtttgtcagggacggcggatg

SEQ ID NO: 111818 - DNA, 383 bp, Heterodera glycines
  Promoter: Source sequence=SeqID_28006; Location=833..1215; Strand=+; Gene=SeqID_58666
aaataataaaaatgagtgaaagaattttttgttgaaaaatattttcaatttgtacaaatttatcttagtgtgtttaaataattatgtagtggagtgccattgggccgagccgggaattccagtcctccaaggggatcccggaaaatgcgtcaatagaaaatgcgtcggtgattagaatttaaaaaaaaaattctatggcattaagtattgtcgtataaaggtcaaaatattataatctcattccgaatctcggacaccaactcgaacaaaaataaaagttcaaattttgcatttttcatctaaatggttagatgatctttttatagcagaattaaaggctttcagtttacttaagtgtataaactgattctgaaccaaaaatg

SEQ ID NO: 111819 - DNA, 86 bp, Heterodera glycines
  Promoter: Source sequence=SeqID_8408; Location=1..86; Strand=+; Gene =SeqID_67960
ataatttgtcactttcttcacaatttctcatctgctgctgtctctttttatgttcatcactgacaaatgctgaagaagaaaacatg

SEQ ID NO: 111820 - DNA, 1003 bp, Heterodera glycines
  misc_feature (563)..(563): n is a, c, g, or t
  Promoter: Source sequence=SeqID_21926; Location=489..1491; Strand=-; Gene=SeqID_52562
agaaaacaacggttatattttttcattgtgcgttttgtataaaatttttctttgttcaaattttgtattctttattaatgttgtttgttgcttaattattcatttttattaatccttgtaaaaatgcatttaattttttggactaactttcctcgctttattaaaaattttgttttcatttattataattattaataatttaataggataattattagtttaaaattttttttaactcaaaaaatataataaaaatattttatagtagtaacccctgccattccgtcgccgcttgacgctaattagaagtgacaggtggcgggggaggggtgtcaattagtcactaattggggggtgcgctaattggtcagcggtcaacgggcactaattggtcagccgtaggggatgggtggtgtcaattaattagggaaacctagacctatgagaagggtgtgtaaaattttcatgtacttttttttgacataaaatttgattgatttaaaaagtgacagccgaggggagggggaatttgattggtcataaagtgacagccgaggggaggnggaatttgattggtcataaagtgacagatgagggaaaattcaaatctctgataaaaagtgacagatgagggcgggaaattttttgattaattgtaaaaatgacagatgaggggaaattcaaatttctgatgggggggggaggatcggaattttgattgatcaacatatgacagtttttgatattattaaattattcaaatgaagtgaaataatttgttttgcatttggactttatcaaacttgttatgaaggtgtaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccaacccattctattgtttacccaaaatg

SEQ ID NO: 111821 - DNA, 581 bp, Heterodera glycines
  Promoter: Source sequence=SeqID_32699; Location=1..581; Strand=+; Gene=SeqID_62972
cagtttcactttcgccctctctttctttctcacctttttctctctttctctcactctttttccctcactcactcctctctctttctccccctttatttcacttttctttctccgggcctcactatctctatctctcttctcctcgaaacaaaacttgcgaaaactttttcggcccttttgaaaataattaattaattttaataaataaataaatacatacataatttattcgattttcctacagaatctcagtttggaatgggcccataacagcttgcaattgtcaatatctttaaatgcactcggcattttgtattggtttagaacgggtggagctgactatttcaatgatttttgtacaattttatcaaagacaattggacaaaatgtaaaaattaatttttattattttattttaaagttcttaaaattttatgggaatttttgtcattaaattaatcattttaattagacatcgatctttttgaaaaagcctggacctggacctggattccatattggacctggatttcctggacaaaaatccaaggtccaagaaaaacccagtttgccgaaaaatg

SEQ ID NO: 111822 - DNA, 943 bp, Heterodera glycines
  Promoter: Source sequence=SeqID_26933; Location=561..1503; Strand=-; Gene=SeqID_57669
tgattttattatttatgcgatgcgatgggaagtcgcaatttatacgcgaattttaggagttttttttgatcgcaattactctcacccccgggggctcttcgctcattttttcatgcgctaaaagaccagttgcttttgcacacagaccgaggttttttgtcagaaaaagccccggccgtcgtccatccatctcgttttatgaacacataagtttttctccataataagctgaaccagtcacactttactttttgcttatcattaactttcccatttatttttgtttcggtcaattattttttttagaattaatgaagttgaaaaaatttttatgacggaattttcaagataaagagatgtcaaatcttttgaattttaatctgtttatttacatttatttctgatctttaaaatgtcacgaaaaatattaattgaccagcataacaaattctaaacataatttcaaaagttattgccgcaattgtagcgttttgtccatttgtttacacagcatataatcatggttataacaacattcgtaagtcaaaatgcttccagtccaatggattattggaaatttaaaaaaaaaattccttatatcagttagaaattttttgaaatttaagcaaataacagaatggttttgtgtaatttaattatttttttttgtgtccatatctttttgcattcttaatatttataagttttcaatagatttaaagaatgaaaaacgagaaaagatataatttttgcaaaattttattattacttttttacaattaattggacatttattgacttcatttttagctaatatgtaataaaattaacaaataataaaaaaattcacattaattaaaaattcttcatattgagcaatccattcaaaaaaattctcaaataaattatttttctttacaaatattttcgaatagcaaaaatg

SEQ ID NO: 111823 - DNA, 57 bp, Heterodera glycines
  Promoter: Source sequence=SeqID_788; Location=6730..6786; Strand=-; Gene=SeqID_61291
tttttcgtgtttgtttttcggtccgaagtttttttcgagcttaaatatagccaaatg

SEQ ID NO: 111824 - DNA, 332 bp, Heterodera glycines
  misc_feature (24)..(24): n is a, c, g, or t
  Promoter: Source sequence=SeqID_37462; Location=947..1278; Strand=-; Gene=SeqID_66530
cccccccccccccccgatcagaanttttgaaaaaaaaatttatttttttaaaaatattatattaatttttttgtaaaaataacaaacgagtttatgaaatgaaaaaaacagatcatttacaattgaacgcgtctaatgcaatcaattcaatttaaaaaaaacataaattatttttaaaatttaaggttggggtcgtttcttccaatgtcggatttactgcttgtgtcgtattttccggtgtcggattttcctagagccgacgttacgacccgcagcgaacaacaccacgcccgctcaaggtggtcatgccaacaaccacacaccaacacatg

SEQ ID NO: 111825 - DNA, 142 bp, Heterodera glycines
  Promoter: Source sequence=SeqID_10531; Location=2202..2343; Strand=+; Gene=SeqID_73763
aatattatgtgtccgatttgacgattcgtgaatttgctaatcccgaaccctttagaactcgatacgaataaccactaggggcgactgagcgaaccacctaaaagtttaaatttaaactcgagaaaaagcaattagcaaaatg

SEQ ID NO: 111826 - DNA, 189 bp, Heterodera glycines
  Promoter: Source sequence=SeqID_3038; Location=4022..4210; Strand=-; Gene=SeqID_82890
ggtcggcacagtcctccaaagacatccaaattagcgtttatgagtagctaaacaaatcaaaaaagcgacgatttggcactttccctatttgcacttttatctccttcaactttttttctccattttcggctgaccattctttcatcagcgactcaatggttggcattggcattccgtagaccagggatg

SEQ ID NO: 111827 - DNA, 192 bp, Heterodera glycines
  Promoter: Source sequence=SeqID_40606; Location=908..1099; Strand=-; Gene=SeqID_68881
ttattactaaaaaaatcatttagtaaaaaaaaaattaaaaaaacgtctcggtcttgagtttttggcagtctcgagccttgggtcaagtgaaattttcagtcccgagtgacacgaataaaatgccaatttaaatatgcctgaatttgaatctggcccaacccaaaattgtaattcagagttattttctcaatg

SEQ ID NO: 111828 - DNA, 76 bp, Heterodera glycines
  Promoter: Source sequence=SeqID_9885; Location=1333..1408; Strand=+; Gene=SeqID_72913
tgctgtcttggtctgacaacaattggtatttaatgaacctttccttccacagtttgttcttggcgaccatggcatg

SEQ ID NO: 111829 - DNA, 1003 bp, Heterodera glycines
  Promoter: Source sequence=SeqID_1533; Location=1304..2306; Strand=+; Gene=SeqID_74307
ctaaaaaattacggattttttaagagttccagtaaaaaaaagggcgggacttgtcctggtcatgatgacttactctaatttacaaaatttaatatatttttcttaatttattccggcggcaaatactgcagtcaattagtagtgactttgttagttttggttttaattaggcatttttaaccaattttgtaaatttaattcaaatatttcacaaaattcttgtgaattagtccttaaacattttaattttcctatttttcccatttttttaaattatttttcaatttttatttttcgaatttttccatttgatttgtttacatatttttgcattttcataaaggtacacaatatgtatgacatttgtttgcccattatttcccattcggaaatggtcgcgctgacctttctcgtcggcttggctttatttgcccttttaatacttagtaaaagggaccattttggcatttcatcaaaacactgaattattcattttcggcctcttgggagttaattaaaattttgatttaaataaagcatttaaaccaaaagattttccataaatttttccatcaaaatttttaataaattttaaattatcttaaatgtttagtcaacaaaattttgcttgaaattaggtgtacttctcgtcattttaaattaatttaatgattcaaattttctttttaaataaaatgcacctttttcttgtcaaagctggtaaaaaaaataaaaaataaattagtaaatttattaatatatttgcctaattattccgaatttaaaaagaacgttatttaaacttaaggaagttttttttcgatttaataaatctttttttttatcaaattttgagcattagtctcaaatttttttttttttaatttaattatttttaaatttttattagatttgcaagaaatggccagtgcattttgccgaggcaccagtgccatcaaattttttggaatgtcttcgtcgtgtgaaccccagcgaagaaatg

SEQ ID NO: 111830 - DNA, 510 bp, Heterodera glycines
  Promoter: Source sequence=SeqID_34951; Location=1..510; Strand=+; Gene=SeqID_64629
ataaaattgaactctgctgatccgctgatctttttatgattattacgtcacttatctacaaattttgctctcttccgttcaatgagggtttctcaattatttttgttgttttccaatgctttcggaagaaagtcgtaaacacaaaacacttccatttcgtctcccccccccccccccttcactccccacttttttctctgtttgctttgccctttcatttcgtttttatttttgtttaattttccattggttttatttgtggcttttctttaataaaaatattttcaattttgcactttttttaaattttgttaaagattttcttgctaaatttgtgtcgaataaacgcattttgggaatattttaccggattaaataaaaaaaagatggccgagacaattaaggcaagcggaaaagtgattcattaaaacaaaattgatttaattaaaccattgggtttattcaaatgattgagtttgactttgttttcaggatgccacccatcgcatg

SEQ ID NO: 111831 - DNA, 70 bp, Heterodera glycines
  Promoter: Source sequence=SeqID_22654; Location=822..891; Strand=-; Gene=SeqID_53337
attatgaaaaaagaggaaaaattggcattttggcgaaaattttaagccgcggccgacgcgagggaaaatg

SEQ ID NO: 111832 - DNA, 550 bp, Heterodera glycines
  Promoter: Source sequence=SeqID_28938; Location=1002..1551; Strand=-; Gene=SeqID_59514
tcctgcaaatccggcattttaaatttgcaggatcccgcgcaggattgcggattcttagaaattttgaaaaaatttcaaagaaatttccaaaaaaaaatacctgacaagaaattttagggcctggcgggatgcattaaaagggcgactaagatttttcgaatgggtcagacggtaaaaagagatcggaaatcaaatctgttaatggtcaataaatttgactatttttttcttttcaaaaatgctttttttctgtgcaattttttcaaaaactaggaacaaaggggtccgtctatgcagataggcgccgtctgaaatttttttttttgaaaatttttatcaattaattaactgattttgaccaaaaaatgaccaaatgtcacactttttgactcaattctacaggattaatgtcgatccaatggtgtcgataggcgccgccgggaaagtccaattcggccaattccaagaacccctgacccaaattttataaaagttattttattggatgtttcatttttccttcatttacacattttagccaataaaaatg

SEQ ID NO: 111833 - DNA, 99 bp, Heterodera glycines
  Promoter: Source sequence=SeqID_19578; Location=1..99; Strand=+; Gene= SeqID_84316
ttatacttattgtaattaaggtgttctaaatgcggctgtgtggtggaaattgaaaatgatgagcacaaaatttcgtgccccaactgcaattatgcaatg

SEQ ID NO: 111834 - DNA, 284 bp, Heterodera glycines
  Promoter: Source sequence=SeqID_16596; Location=1..284; Strand=+; Gene=SeqID_81007
atgagaaaaaaacggaaaagagctgccgaagcagttaaaagggggggggggggacattttaatatgagtgggctgccggcgggggagcccttcggaatcgacgacgacctatggccctttttccgcgacctttgcaccattcattctttacacgttgatgggggcggggatgttttcttgtttgaaaatttcgctttttgtactcctcgtgtaccgtccgtcccgccgctccaccaagccaatcgtcgttgtttttccgcagcagatggctgtttctactgatg

SEQ ID NO: 111835 - DNA, 424 bp, Heterodera glycines
  Promoter: Source sequence=SeqID_16221; Location=1426..1849; Strand=+; Gene=SeqID_80597
aggacttcattcaaatttggaaattatttaaattttaacgaccagggacggtcttttggagggccggaggtgtaaggccgggaccggaaatggcctttacccttctcccccccccccccattttatctctccgatagggctcctcccatcccgaggggcgcttaaaaggcaacggataaccagccaaaggggacagtcggagttcagtcgggagtcattcagtggaatggctaatcgatccccgcctgggaggtacccccaggcatccatcaacatcccttcccttccaagccctgcggggcctaattacggacgcgtaagagggctcctctggactatttccctcataagcactgggtatgggacatcacggctttactcaaattaaaaaacccaaattaatttacatttttagctcgcaatg

SEQ ID NO: 111836 - DNA, 69 bp, Heterodera glycines
  Promoter: Source sequence=SeqID_23196; Location=2290..2358; Strand=-; Gene=SeqID_53905
gtgattcagaaataatttattattgattacagaaatgattgttcaggttccaatgtgacagcgacaatg

SEQ ID NO: 111837 - DNA, 570 bp, Heterodera glycines
  Promoter: Source sequence=SeqID_2152; Location=1..570; Strand=+; Gene= SeqID_78115
cttggctatcgaatgataccaagaatgtaaaatttggttgcctttaagcaaagttatgccatgttttgtcgaaaaattcgctaaaatggcggatttacgaaacgacccagcacgccgaaaatgtttcttaaaaagggagttttttgaaaataagaaatgtttttttgtaagatattcttttgaaaatcttaagaaaaatgagttcttcgtcgccgaaaaaaaagtcaaattcttttttgtattgtggcgcggttgagccaagatttctccaaatggttctgctcctttatgtttaacaaatgcggatcaaatgaatttgtcggtgatttccgtgtgttttatccgttctatagattcataaaacaaatcgcattttgttgatttttaaaaaatacaaatttggcgggcgccacaaaacagaaaaatgccaaaattaatattttcggaggggaggggggcaggacgagctgctcccgtctacaaaatccacaacacaacgcaccagccaaatcctccattcggatgcgctcttgcaagtccgacaacgacttcaccgactgcatggacatg

SEQ ID NO: 111838 - DNA, 202 bp, Heterodera glycines
  Promoter: Source sequence=SeqID_15899; Location=258..459; Strand=-; Gene=SeqID_80240
atttcgcaggaattgtttttcaattttcgcaggaattgtttttcaattgaaagtcgtaaaaaataaacattgtttttgctccaatgaatccttcgttccttttgttttcgtatttctgttttatttttgtgaattgcttccgatttatattttatttttcagtttcgtttatagttcatatttatttggtaatcgcatcatg

SEQ ID NO: 111839 - DNA, 1003 bp, Heterodera glycines
  Promoter: Source sequence=SeqID_20671; Location=1229..2231; Strand=-; Gene=SeqID_51233
attggaaaacaatattacggggagtgtcataaaattggaatttgaaaatttatcagttaaattttgataatgaattattgtcataaaatttgattaaccatatgacaattaattaataaatatttacgaaaaataaaatcaaaatttattaaattcacaacaaagaaattagaaagttaaacagatgttggctgctacacaagtaaaagtaaacaaaaatattttgagatgaattgttaaaaaaatttttgaagtggatgagaaatgattgaatatattcattacttttattgatcagaaaataaaaaaagcattggaatggaaaataaaataaaaatatcgaaaatgaatttttactataaaaaaattcttttattcaaaattaattaattttgataaaaaaatatattaattgcttcggaattcctttaaaacaggtgaaaattttaattaaaaggttggaattttttggcattctattatccgttaattaaaattttatggccaaaaaattaagtaaaaaaataataataataagttttcacgtcttttttacataataaagcaggtgttaatttttgcttacctatttaacctaatcttagggactttctgtcatttttttaatataattttcaataattaaatttttgggcggcgccaaattggtaaattgagaattcacagaaaaaggatcataataggcatgaatgaaccttgaaaaatgatagaaaatttttttgttattaaagactaattttattcaaaaataaggcgaaagaaagccaattttttccattttcaaatgttaaacgaaatatatttttcaaaggataaaatattaaaaaaaaataaaatttgatcagaaacaaacattaagcatctaaaaccccataagtgaaaaataagcaaaaacttgtttgaaaatccgaccattttatttgttaattgagtttaataatttaaaaatttacaaaatttagttttagaattttttaaaatg

SEQ ID NO: 111840 - DNA, 1003 bp, Heterodera glycines
  Promoter: Source sequence=SeqID_17753; Location=238..1240; Strand=+; Gene=SeqID_82290
ttttgatatctcattttttgaaaaaaatagattttttagggatacattttaaaaaaatttttttaatttttcacaaaagattttctataatttccaaaaatcctcaaaatatgcaaaaaaaaatgaaaatatatatgaaaaattgcgaaatatatacgaaaaagtccaaaatatatgcatatgtaatatgtagaaaaatcccgaaatatgtaaaaatatgaaaaaaaagtcccaacttttgttcgcaaacacaaaaaagaaagtgtttttcctcctatttagagcatgaagaattcaggaaaaattatgtatttacataaaattcccatccctattaatgatatattttttacatcattttgttatataaacaattctaaaaaatgcttgttaatagattatacagaggacttgaaattctaaaaagaaatttaaattaaatctaattgcttccgaaaaaagttataatttataaagcattgaaaaatatattgaatggaaaaggactatttgttctcataaatcatgggtgtgatcttgttcttatttctaagaaatcttattacctaggagtagagccaattttcctttaaattcttcacaaaaattgaaattttatggcgaaatttcattatttaagtaagaaattttaaactttggcgcaaaattcttctgattttttgagttctattgaagtgaaatatatgatttactaatttattccacaaaattgttaaaattcatacgggaggcgaaaaataatatttaataaatttttgatggaataaattgtaaaaataactgatttgaatcaattttgcaaaatcttcttatttttcacctaaaatcttattttttagccatgatgttcttatagaaaatgtttcgatcagacccctgcattattctaaacgttttaatactgccacaaatttattgtttttattttattttataaaattttaattttggttttttcctttttcaggttcaatttccaatg

SEQ ID NO: 111841 - DNA, 72 bp, Heterodera glycines
  Promoter: Source sequence=SeqID_20986; Location=1390..1461; Strand=+; Gene=SeqID_51563
atttttaaaagcaatttttctaaatttaggctaaaagaaccttatttaaaatttcagttgaatttcctaatg

SEQ ID NO: 111842 - DNA, 137 bp, Heterodera glycines
  misc_feature (79)..(79): n is a, c, g, or t
  Promoter: Source sequence=SeqID_1014; Location=1..137; Strand=+; Gene= SeqID_66117
gacgggacatcatgccacttccagggtaatgtggtgaatgtggacgaaaagtttggcatcatttaaaatgccaagctgntcttaggcaagcgtaagccccgagggcccttgttcgccgccgcgttcgcttcgtcatg

SEQ ID NO: 111843 - DNA, 86 bp, Heterodera glycines
  Promoter: Source sequence=SeqID_24218; Location=1362..1447; Strand=-; Gene=SeqID_54934
ttgacgcaaataaaatcgaccgtgtaatccttaatgagtgataagaattaataaagccccgcaaaaaaaggatatttaaaaaaatg

SEQ ID NO: 111844 - DNA, 1003 bp, Heterodera glycines
  Promoter: Source sequence=SeqID_7919; Location=1047..2049; Strand=+; Gene=SeqID_66378
tagaatttttgcctactgcacttttttccgtgaatccaatggcatttttatcagtttaattagagtttatgagtccaaccaagtttaaagaagttgaaatttacaaaatctcagcgtttagcaattgacaaaaaaagatataataattaatgaattgttgatttttccaccttttaaatatttgcattcacttgttttctcgttacaaatttattgtttaaaaaattatgggttcttagttgattggactcatataaactcttaataatttttttcttaaatcttagaattttttattagcctattaaatttaacaaattttgttttatttctaaaaaaaaatatgaccaaaaaggatcaggaaatacagagttttttgaaggagccctcctcaaacggccgccgtaatcgagagaatgtgcactcgttttggcgcaaaagcaaatgtttgaatttgaggctttgcgaaaaacatatttttacatgctaataatgattaattattatttcggatttaattataaataaatgtgagcatgaaaatttattttctttttctttttttaaaattttatgttttgaattttgttgttttctcccaaatgaatttatttttacgtttcttcacttggcaaagattttctgtatttcctctaattacggtcccaaagggcggctattttttaatgcccactcggaaatttaagaaggaggtggggaggaacggcattttgtgaatgaaataaaggattttgtacaaaacaaaataaccacacgtgttcaaaataaattgacaaatatttttaatttaaattaaaaaatcccacattttggtcctacccaaaacaccgggtcaggcggggtcactgtggcagggcattttggcgccgtcaaatttaaaatgttataaattttttcatatatttcaatcgatgagtgtctatgtgttctctattaacctacaaaatttcataaaattattttaggctgaagaaaagatatg

SEQ ID NO: 111845 - DNA, 338 bp, Heterodera glycines
  Promoter: Source sequence=SeqID_5705; Location=978..1315; Strand=+; Gene=SeqID_58978
ttttcttacgacacaacatttttcttctatacaaatttttcaaacaaaattctcattcattcatttaaaatttcattaccatttacataagcaaaacaaaacctttcatatcaaaatcaaatcaatttataacacaaacaataaagaaagaaaaagaaacatttttaagactgtttttttacacaaactgacaaaagaaaaaaatgtaaaacaaaaacatttcatttttcaaagcattttatacaacacaacagaatgttaatattataggattttcttactgagcaaactaaggagtgcctctttcttttattaaatattttataaaataaaagatg

SEQ ID NO: 111846 - DNA, 646 bp, Heterodera glycines
  Promoter: Source sequence=SeqID_1155; Location=2139..2784; Strand=-; Gene=SeqID_68978
ttttgttgattttaggaaggatgttgttgatacttacatagaataagaaacagaaaatgcattcattggtccgtggaaaaactagatcaatgataagccagaagttagtgctttaaaaactcaacattgaaattacacatatgtcagtttcaaaagttgtttaggtcatggacaattttttcaacaaagagagttatcgggtcagtttttgtatttcttattgcactaattgcgataggggacggttcggtgcccgccgtttcggtgccagtccaagttttggactacaacttttttcattgttgaccaaatctaataatcttggtatcatttgaaagctttatatgtttagaagctttttataatatattgcttagcgattaggttaccaaaaaagttataacatgaaataacaaaaaaaccaaaattttggaagttttttcctaataacttttttacaagctaatttttttttttttttttttgtaaggctaatagagcttgtgaagggctttcgaatgataccaaaattgttagatttggtcaacaagaaaaaaagttataataaaaaaactaaggctggcgccaaaacggcggcgccaaaacgacccgttcccctaaaaattatagtactaccaaaaaaatg

SEQ ID NO: 111847 - DNA, 371 bp, Heterodera glycines
  Promoter: Source sequence=SeqID_14812; Location=1126..1496; Strand=+; Gene=SeqID_78963
tttcttattagaatctgaaatttctttgtttttgaagaaaatttgaaatgacataaaaatgaaatgaatgatttatttgatgcaaaaacattatagatattgtatattctctctttttattttctcattggcattatgtatttccaataggcgaaatgaatgtttctggcttagtaggcgaaatgaatgtttttggtttggtaggcgaaatgaatgtttttggtttggtaggcgaaataaatagtaggcgaaatgtcagtaggcgaaatgaatagtaggcgaaatgacagtaggcgaaatgtccggttttgggttagtaggcgaaatgaatgtttttggcttagtaggcgaaatgtcgagtaggcgaaatg

SEQ ID NO: 111848 - DNA, 240 bp, Heterodera glycines
  Promoter: Source sequence=SeqID_6317; Location=1005..1244; Strand=-; Gene=SeqID_61128
ggtaatttgacacttttaatgtttcattttattttttattttaattcatttttcctctttttaagcatttcttcgcatctccaaaaatattttactgttttatggcttattttgtctgctctttttggggtttctatccttttcattagctatcgaattatgcgacgaattccgcaaaagtaactgccgattaattaactaattaattgattatttatttagttagatatttaattaatg

SEQ ID NO: 111849 - DNA, 78 bp, Heterodera glycines
  Promoter: Source sequence=SeqID_17133; Location=913..990; Strand=+; Gene=SeqID_81570
tttttcaatttctcatttctttccttttcttttttgtctcaaaactaatctaaggttaagaaaccaactattgcgatg

SEQ ID NO: 111850 - DNA, 586 bp, Heterodera glycines
  Promoter: Source sequence=SeqID_20207; Location=1..586; Strand=+; Gene=SeqID_85005
cgtgggggtttccccgcgcaggttcgaatcctgccggctgcgaaatatttttgtgtttttttaacagttttttctcctcaattaacctttcattttcttttgaaaaaattaaaaatgatatatagaaattaatatttatttaaaaaatatttttctttttaatttttagttataattcaatttttttaatttcgttgccttttttcgcgaaattttttatttatattcgtttcaattgtctttttaaaaatgtatttagctaaaagcatgcttttcataacgcagtcgtgtccgagtggttaaggagacggacttgaaatccgttggggtatccccgcgcaggttcgaatcctgtcggctgcgattttttttcttaaattacgactaatattatttaaccttttttaatatataaacatacattaaaattagaggagtcaattaattttttagatgtaaaccgacaaaatttgatgcatttttcgttttcatttatactattttttttgtctatttttcaaaatttcccatagcaattctccctataaatgtacgaataattatttttttagtttatcgaaaaatg

SEQ ID NO: 111851 - DNA, 706 bp, Heterodera glycines
  Promoter: Source sequence=SeqID_3814; Location=363..1068; Strand=+; Gene=SeqID_51988
tttgtgtaacaaaataacacattcatttttttttctctttttctcatattatttctctatcttccttttctttcctctctcatttcctctctttctttgtgcatatgctttctctgccatatttttttctctcttctcacaatatttctctctctatcttttcttttctttcctctcccatttcctctctttctttgtgcatttgctttctctgccatatttttttctctcttctcacaatatttctcaaatttctctctctatcttttcttttctttcctctattttctttgttctgtactattttttctctctcttcccatttgctttctctgccattttgtctgctatggtgttttgtattagcaagcagcaaaaattcatttgtttccttccttacatatttattagagcaattgaattttatcaataaactgctaattgttcactaatacgcaccatttaaaaaaaattaaaatattttttcaattattttcttggcaaataaaccccaaacaaaatcacctcattttaattccattagcagcattccaattaaaaatataattattttcgttatttttacacaaataacaaataaatattcatcatggcaacaccaaaagtaaaatgggcaaaaaataaaattaaaaatttaaaaaaagtatttattttattaaagttgtacaaattccatgtcgaaatg

SEQ ID NO: 111852 - DNA, 61 bp, Heterodera glycines
  Promoter: Source sequence=SeqID_33118; Location=1..61; Strand=+; Gene= SeqID_63273
ctgtgaattgacggaaatgtaaaatttgaattcatcgtcgtcaataatactggattcaatg

SEQ ID NO: 111853 - DNA, 482 bp, Heterodera glycines
  Promoter: Source sequence=SeqID_2630; Location=1810..2291; Strand=-; Gene=SeqID_80808
aatttgcggatcaatggcattttatatccaaaaacgatcaattatttttttttgtcgggttttgtgccaatgattcgtggctcatttttgctgacaacgcatggattcaattgttttcatcgttcatttgatttgtttcattgccatttattttttcgccattctctgttttgcccatcctttccaatgtctttcacgcaacatttaaacaatttccaaataaacatttgtgataataattaaaataaatttggaaaaatgcaatttcagttttaaaaaggtcgacaaaaataccgacagatgagcaatgattggatttgccgattcgttggagaattttaaatggatttgccgactcaccagcgactttgcatttaaactccgagattaaaaaattcttttggttaaatacacttttaattaattaggttcctcaacaaaattatcatttcaaagaacccaaagcagttgaaaaaggaatg

SEQ ID NO: 111854 - DNA, 71 bp, Heterodera glycines
  Promoter: Source sequence=SeqID_24150; Location=506..576; Strand=+; Gene=SeqID_54849
gagcacggcacggattgctggggtcgtgggttcgagtcccaccgggcgagttaccttttatgttctacatg

SEQ ID NO: 111855 - DNA, 696 bp, Heterodera glycines
  Promoter: Source sequence=SeqID_16051; Location=1..696; Strand=+; Gene=SeqID_80409
cttcaataaaaactctaagtctaaacagtcattcaaattttgcattttttaaattttaaatccaaaattagcacaaaataagcacgtaaggctgaaataagcatattatagctttctaagacccggcccctccaaataagcacaaatcttagaaataagcacacttgggaactctagatttcacaaaaaaaatgaacaaattttgcgattttgagttccggcagtgccgatggggcgccgccgggaaaaactccgtgacaatcaccaaaatgatgatgaatcagcatagttaagagcatatttatatcgaaaatttaagtagctataaaatgcataaacagcaataacaacaacaaaaaacaaacggaaatggaaaatattaattaaagggaagaaatttcaaaaaaaattcaacataaacctgaaaattatgtaaagcaaatacgtgtattatggaggcaataaaataataaattaacaactgctgaagagaattcagtggctgctaaaggaaatgccaaatcaattaattggatggcattaggcgacaccaacaaaaattattaaaataatataaacaaaatgaataaattttcaccatttaatttttataatcattcataattttgttaaaataaaacataaaaattaagcattaatattaataaaatcataaggtaacaacaaataataatg

SEQ ID NO: 111856 - DNA, 1003 bp, Heterodera glycines
  Promoter: Source sequence=SeqID_17959; Location=2000..3002; Strand=-; Gene=SeqID_82524
aaaaactaaattattttgtaaagatgaaaacagtgctatgaactttgaatgtattttaaaaaagcaagtgtgtagagaatgttggataaatagtacattaaaggaagggcaacttattcaatgtgactgtgaagatctgataattggaaatcttgaacctaaactaccatttaccaatgataaattaaacttgagaagagaaggaaacaaaattttaagtgagacaaattatagtcctatacaattattagtgagagtttaaaatttaaaaattgtggctgaaattgaaggaaatacatgcagggcaaagcaaatcggaaaattgacgggttgttatgagtgccgaacagggggaactctcaactatacttgctggactgattggggtgaaagtatcgcggaagttaaatgtccagggggtcttatttttttggcaaaatgtaataaaaaaggcgaaaaccaaattgatgttcttccatttgctaaagctaaagttaataggaattgtcaagtcgtgtgcccaggaggaaaaagttcatttaaaatcaaaggcagacttatctatgtaccaataagtgaaagaaaatttaaagtgcgaaattctgagaaacttaaaataaaggatggagatggtattaaatgggaggatttattagaaatcgatttaaaaaatttattcaacccgtttaataattttaaaaatatgacatttctcattttaatgctattattagcaatgggtgccatttacattttcttacgatttctgccctattttatgggttaccgatttgtcataggaattttattgtgcaaatttgtaagcatttcttgttctttgtccacgggagggatgcggagcatcaaagatcaaaatggaatgataaaatttgatgaatcagttcatattatccaaaacgagaaggaacaaaggagagtatttaaatggaccgaaattcgggaaaggcaccattgttccaatattttaaaaaattcaaaaatg

SEQ ID NO: 111857 - DNA, 1003 bp, Heterodera glycines
  Promoter: Source sequence=SeqID_23008; Location=614..1616; Strand=+; Gene=SeqID_53712
catttcaatcactgggactcaacccacaagcatttcaatcactccagaattcaatctcaccaattcttcgaaacccaataaccggaaatgaatgataaaaccgacagcggctcgaccgcttagcggcctcgcactcttcttttggcattttcttatggcataacagttcttccttgtttcttgacattttcttacgacacaacatttttcttctatacaaatttttcaaacaaaatctcattcattcatttaaaaacataagcaaaacaatacctttcatatcaaaatcaaatcaatttaaactcaaacaacaaagaaagaaaaagaaacatttttaagactgttttttacacaaactgacaaaagaaaaactgtaaaacaaaaacatttcatttttcaaagcatttatacaacacaacacaatgttaatattataggattttcttactgaataaactaaggagtgtcctctttcttttattaaatattttataaaataaaagatgggatataaataaggaaggggtgctagacaaattcactattgtctctcccttccatttcttttactctcttttcttttccattgcaatttactctctttttttcccactccctccttctcccacacacacgcacgcgtccaacagactgctgctgcacagcagcacgcgtctgttcactgtatgcccctcccacccgccgctgcccgcgtagaaacacagtcagacagtgcactatttcccacctttccctccctctactttttttcaaattcatttttaacgcaaaattcaaacaaaacgccacactaattcaaaacatggacacatccggacagacactcaactttattatataggatcatgtacaatagaatagacactgacaaatgaatgtagcgcgaagtcgaaaacataatcgaaaaatttgatatactttttgtcattttaaaaggaatttgttaatattcacatagtacatttgcgccttaaacagcatg

SEQ ID NO: 111858 - DNA, 123 bp, Heterodera glycines
  Promoter: Source sequence=SeqID_25207; Location=788..910; Strand=-; Gene=SeqID_55950
actgttaaagatgtctttattcattcgttgttggatttatacgaagcgagaaatcggaataaataattgaagtctgttccatcaccactactgactgactgatcactggggaaggagaaaatg

SEQ ID NO: 111859 - DNA, 1003 bp, Heterodera glycines
  Promoter: Source sequence=SeqID_10123; Location=222..1224; Strand=+; Gene=SeqID_73213
ttaaaatattttttgaataaatgtaaattttaatccgggttagaaaaatcttgggagataaaagggtctgggtgccgttaggttctgattagagaccggacgggatttttatgacttttatttctttcataaaaaattaccaaaattattattttaatttttaaaacaattgataaattttatttggtagttttatggcgcaacaatttctaagattttgtccaaaaatcagaataaaaattgttctctacttatttttccttcggtgcctatcggaaccgcctgacccaagaacccattattttcttttaaattagttcaaaacaaaatatggacagtatttggataaatttcgctaacaaattacatttcaaattttcaaaaattttcctggcggcgcctgccggcaccgccaggctccccccttgttccccaaaagtttttttaaaaatgcactgcaaaagaatttttaaaaaatctgattttttgattccgatgcacttcacgacttgctaattttcctcaaaacaagattaaaatatttttgtccacaataattatcaaaaatcattggaaatcaaaagttagtgttgataataaaaccgtaaatattaattcataagttgaaaatatgttaaaaatttaaaaaatcattaaaataacacattttaaaatgttttatgccatcagaacccattcataataatttataatctttcgttgaaaaattacagctgtaatagttaggagtgcgtctgtcaataaaactttatgaatattcttaatgcttgcttttatttactgtttttatgaaaatatagaatttttacaaaacttgattatgaagtgaatatttattatttgcttaaaatctttatttgattttataataatataatgcaaacctacaaaggtatgggtccatccctatcaagatggaaatggtcgcctcggaaggttagtaatgaattggatcctcgatcgcggcgggctgccaaacatg

SEQ ID NO: 111860 - DNA, 108 bp, Heterodera glycines
  misc_feature (67)..(67): n is a, c, g, or t
  misc_feature (94)..(94): n is a, c, g, or t
  misc_feature (103)..(104): n is a, c, g, or t
  Promoter: Source sequence=SeqID_37057; Location=870..977; Strand=-; Gene=SeqID_66233
gcttttcattttcggtctattaaataaaatacaaaatgaaattttttagaaaatatgaaactgtgcntaatattctttcaaattgtattatttntaatgctcnnaatg

SEQ ID NO: 111861 - DNA, 225 bp, Heterodera glycines
  Promoter: Source sequence=SeqID_31979; Location=1150..1374; Strand=-; Gene=SeqID_62292
tcgctggtacacttatgtaaattttttgtacgagtaacgtttagagaaatccccaactgatttcagggatggtcccagtctctccttccccccccccccaagacccctggacacccaaaattatatttttgctcaaaactttatgatttttttttttgctggtacctcctgcaagacctgggaccgtccctgcctgatgattgtcccctgccccattttagcatg

SEQ ID NO: 111862 - DNA, 625 bp, Heterodera glycines
  Promoter: Source sequence=SeqID_41931; Location=776..1400; Strand=-; Gene=SeqID_69962
ggggaggccgatcctttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgatgcgcccagatttatggggagaccgaatccctcgggaatagcttccctatagcctgtactttaattctgcgttggatttttgctccccataaatgtttgagtaccccaaacggacacttgaaaaaatcgatttttttgtttcataaatatttttttcagaaagtgctctaaagtgcaccaaaattttatttacaacttaattttagcactctgatgctttagtatcaaaaaggaagatggagaaaaaatttttccttatattttggttatatcgttttgcttttggtggggtgcttggaacagtggaatcatg

SEQ ID NO: 111863 - DNA, 1003 bp, Heterodera glycines
  Promoter: Source sequence=SeqID_7059; Location=380..1382; Strand=+; Gene=SeqID_63706
cgtccttaaatgttttaaattagttttgtctgtccttggcattcatttgaatttgtctatggaatggcaaggacattctcatatgtccttggacattgttattaagcatcttaacgtgacggatatagaatttttactatgcgaatatggacagtttcactaattgcattgacttttgttccttcaattttaacacacaaaaatttcttgcctcctcccccctccgtaccaaatgtcctttaatttcttaactgcccttgaatttatactctaaaaagttgtcttcatatgcaaaattgaaaatggtacatgtataagtaatttttgtccttgaaaattgaatgggattttttgatgcgtcttacattttatttctatgtctccgaaattaaataatttttttttctaaatcgcttcccctcccgcgaacatccgtcgtcgtctttttgcctttaaatttctgtccttaaaaattgcaagggtcgtccttcctccaccaccacctgttgcttctgctcctgctgtttctgttgttcagcaaaaagttaaaaagttccagcaccaaaagcattcaacataaatcgcaaacaaaaatttgtttttaacttcaaaatatgctctcttaaaatattgaagaaggagcagcaaaattttatttttttcgctcatttggaggcggaaaaagggaagaaaaaaggagccgagggggggggggagggttcaatttcaataacagaaaagcaaaagcattcattccgcccgcccgccccgccccgatcggtcggtcggtggcgatcggcgccgctggcggcggcggtgaaaaggttttgttgtttttgttgtttggtcttccccctctcccccccccccctcggggctcctcacccttaggagctgaaaagtgatcagtcatcattcatccgtcatacacacacatttatacatacatatgtttaagggatgggggggggaggaggagggagggtgaaagaagaagaagatg

SEQ ID NO: 111864 - DNA, 60 bp, Heterodera glycines
  Promoter: Source sequence=SeqID_43790; Location=333..392; Strand=+; Gene=SeqID_71376
gcctcaactgaaaaagcggcagcgaatggaatttcacttcggggaaatgtgccaaaaatg

SEQ ID NO: 111865 - DNA, 139 bp, Heterodera glycines
  Promoter: Source sequence=SeqID_4918; Location=1..139; Strand=+; Gene= SeqID_56190
aagatcggtaaaaagcctgtatctgtacctgtatttcccgaatgccgtacagaaaaaatccaggctcctctaggcctggatccaggcctgtgtacctgtattttttttggtttaattacccaagtttgagcacgaaatg

SEQ ID NO: 111866 - DNA, 285 bp, Heterodera glycines
  Promoter: Source sequence=SeqID_11156; Location=3169..3453; Strand=-; Gene=SeqID_74507
agatttctatgcatttgaccaaaattttttcaaaatttccctcatggcgtctaacggaatcacagggtcccaacttttttcaaaattttctcaatcacatggtaaaaatatgtaaaaatttcttatttatctcccagggcgccgaaaagtttttgaaaaattgtaatggaaaaatatttttttggcccgaaaagcataaataaataaatgattgtccctctcgaattttgttttgaccaatttttccaaacaaacagaaattgactgctgcgagtccatcaaatg

SEQ ID NO: 111867 - DNA, 612 bp, Heterodera glycines
  Promoter: Source sequence=SeqID_24543; Location=1..612; Strand=+; Gene=SeqID_55265
tcgtactcagcgcctcaaaacacccgtagaaaagtgttattatggatttcagaaaagttaaagaaaattttttcaagactaatgaatggaaagacatggttgctcatttaaatttatttttttacagaattttgggactcagaaaattccaagaaccccctctgaaaacaaaatttttaaaaattttcctcgaactcgtcccccaaaacgtaaatacaaaattttattggtgcatttttgaatactggcaattttcgtaacaaagtgcacttaaattttcaatttttttcaaaaaaaattttcacttgggaaaagtcccggttggtcccggtcccgggttttttcgctgtcccggtcccggtcgaaaaacttggtcccagtcccggtcccgacttttctggttccggtcccggtttttgtcaaatttcccggtcccgctcaacgctattcataaccccagtacaaagaaaaaaattaacttaaattagacaattaggtattccctaaggtgttttggcaagttcaatcctagacacacaattcttttattctgattcatgcattacagacaatttgcctacgcctctttcaattattaaattattccaaatg

SEQ ID NO: 111868 - DNA, 195 bp, Heterodera glycines
  Promoter: Source sequence=SeqID_14924; Location=1793..1987; Strand=-; Gene=SeqID_79090
ttgtttttagtctaaacaaaggttccttttttccggcatatttggctattgtttgtcttcgtcttcgcttaatctctcatggcaaatccagcagggtaaataaatatatatttttaattttttaacttttctaaatgtttaagccaccagctcccggacagtttattgaatgacatcttcaagtgtattaacatg

SEQ ID NO: 111869 - DNA, 682 bp, Heterodera glycines
  Promoter: Source sequence=SeqID_29354; Location=1..682; Strand=+; Gene=SeqID_59862
attaaaaaatttagaaatttttttattatattgtatattttttgaaaaatttccgatttcttgcaccgcaaaaaagtggttttgaaaagaaaaaaatagtcaaatttatgaaccgttaataatttgatttccgatcaactttttaccgtcggatccaatcgaaaaatcttagtcgacccatcagccccttttaatgcatcccgccagcccctaaaaatttatttttcagcattttttgatttttggaaattttttgaatttaattgaaattttttcgaattttccaaaatcccgcaatcccgcacgggatcccgcaaattttaaatgcgggacttgcgggattaatcccgcgggatcccgtcccgcaaaaaattttgagttccagtcccgcagcgggatccgcaaatttgaaatttccggtctctactacaaaccacgtaaatagtgtttttagctttgtttgatgcttctaggatcctgttttacttccatatttttccatatttcagatttttgtccatatttccatatttgacaatgtgttggactcataaagtttaatagagttaaaatatttgttttaattaacccttattttcctaaataccaatattttaagtgaagaaatattgtaaattttcaactttcaacttcaaacgtcaaaaaccattgccagaaaatg

SEQ ID NO: 111870 - DNA, 675 bp, Heterodera glycines
  Promoter: Source sequence=SeqID_17397; Location=1820..2494; Strand=-; Gene=SeqID_81875
ttttaaagtcaacaacaaaatttgtttttcaaaaattgccgtgtgaagtgaaaataaataaaaggaaaagacaaaaacctgttgcattctcgagaagattggttgtggaattgttgaccgaaacaacattgcaatatgttgatgttttgcactaattaggaaaagcaaaattcttttttaatacgataattataattattacccaaattgatttaagttttatcataaaaatattcattttagataaaaaaaaaatcgaatttaaatgctaatagaagtaaaaaattaaatcttattgctttaactctgtaaaagttaattaagcgcttcaaattgtttttgttgactctttgcccttccgttgccactgattgatgattgttacaactgcgcgcaccaatcattcattcattcgttgattcattccgatcactgatcaatcggggcaaaacaatttgtgttactatttaagcagcacacccaaaaaatttgccattttacattttttttctatttttgttattagaaattccgaattccctttcaaaaaatgctttctctgctctccattttgccaattgttctcgccgcgttcgttgcgccttttgcaaatgccgtcttttcacgcccagcgttacgctgagcttgaaccccaaagagattgaactgctgatg

SEQ ID NO: 111871 - DNA, 1003 bp, Heterodera glycines
  Promoter: Source sequence=SeqID_6587; Location=3609..4611; Strand=+; Gene=SeqID_62085
ggatcattatcaattattatcgatagaacatccattatgatagagaatattaatcaaaaatcactattggaacattattgatcactgcactgagggatcaaagatcacttaatatcaatcgatcatcgtttcctatttgatcatcaataaaagacatgatcattgatcgctgtactgagggagcagtgacaacttttttatcgacagatctttttggagtttgaaatgccataattgcctgtcgcaaatgccacacaaatgtttttttatttttgccagttttgtgcttttctcggcaaaggacggcggttccatgctgcgcccggcacatctgcgcgaggtgctttcattggatgccgaagtgaatggccaagtattgcgcagggacagcaacacggggtacaaactagcaaaatttgcacagattccgagtcgaaattttgaactcgagatctcgttatttcatttctgaaacgggttttttccagcatgcattagttttttgaaaatctaggtgttggtgttgaatttcacgaaaaatttgaagccccccccctcgctcgcaaagggcccagagagggggggggggagtggaaattttcttaacaaattcattaaaaagtccaaaaaattttcccggcgacgcctatcggcgtcacccaaccccaaaaatctcaatttttcttaaaaaaattgactcaaaatcgtaaaaattggccatttttggtgaagatctgttaacaaatcacaaaagcgtttttttaaaggttcgggaatacagactcgagaatctcggccgtattaggagattcctctcacccttccaaaagcaaaacttttttgtaaaaaaaaaaaaatcgaccctaaaacccgaaaatattcttacgcctgattttaattcaaccgtcatcgagactctcgagtttaattgattcattataatggctattacaataaataagcatcatattaatcataattgaattcatccctccacagaatg

SEQ ID NO: 111872 - DNA, 422 bp, Heterodera glycines
  Promoter: Source sequence=SeqID_19001; Location=905..1326; Strand=-; Gene=SeqID_83739
tcgatgattgatcgaattcccgttttttttaggttgattactgtcaaaatttaaatgtcatttttctgtgatcatattattcggtctctgtttattgttgatgtcccatttctctgcttttttctagttgagtaaatttttgcctttttttgaagcgttttaaatttcgaattgcaagatttatggtatccgaattttttctatttatttattttaatacaaaaatggttgttgtatcacgcggaagtgagcttattctgccaaaggcagatcaaacaatcaaatgatgtacataattaaaatttgcgacaaaacaaaaagttttttgctccgacaattgtaaaatataaaaaagattactcgcccgatgggactcgaacccacgacccttccaatcaatcagcagggctgctggacacatg

SEQ ID NO: 111873 - DNA, 403 bp, Heterodera glycines
  Promoter: Source sequence=SeqID_21302; Location=761..1163; Strand=+; Gene=SeqID_51892
ttttttcgcttctctgtcttaaatattgctttaaaatcgatccgtttgttctcagaaaccgttttcggcactttttaatgaatttactgaacaaattggtctgatttatcaaacaactctaaaaccattaatagtttgaagtttaagaaagggaagaaatcgccgaaaatagtgccaataataaggacaagtcaaagcgaaatcgagcaaatgcgaagagaaagtgtgaagccgacgtggggagacgaagcaatcactttgaaggttggccatcaaaaacagtagaaggaccgaccgattgatccaaaacacaaagagtgatcaatccgaaaaataaagattaatcagtgaagtgatcagtcggatcagaggggaggggcggatgagagactgcgaatgaatg

SEQ ID NO: 111874 - DNA, 85 bp, Heterodera glycines
  Promoter: Source sequence=SeqID_19520; Location=1..85; Strand=+; Gene= SeqID_84251
cgcctcatttgataaagttttgtccccaattttgcagatgtgacgccgctttgggactgctgtcaatatggtcaattaggacatg

SEQ ID NO: 111875 - DNA, 368 bp, Heterodera glycines
  Promoter: Source sequence=SeqID_715; Location=7831..8198; Strand=-; Gene=SeqID_59673
tctaaatgactgacagggaagtgaatgataaggggcgtggcataggagggcatactgtggatggatttcgaaatcctcccgtctggaggtccctgcgtgctctcacttgagtgggcgtggcctattcccacatgacaccccctcccccccccctctccgtcacgtcacatacagtacccccacacttttcccttctcattttcatcttaacacacaaaaatattcctcgaactggctcctcgtaagcagaatgagcagtttttggacgaaatccagagtaaattttaaaataaaacacaaaatataagcattttatagaagcgaaccacgtggaagaagcacaaaacaatcaaagaaaacataaaatg

SEQ ID NO: 111876 - DNA, 157 bp, Heterodera glycines
  Promoter: Source sequence=SeqID_7427; Location=1..157; Strand=+; Gene= SeqID_64785
tttcatcctcagaggatggtgaatggcatagttcaatctcaccagccaattcccaggctgaaaatcgagagctttttgcttttgtcgaggttaaagaggcgcttcattgttgtcgagggacggattcgaatatgcttttgaaaaagactcggcaatg

SEQ ID NO: 111877 - DNA, 141 bp, Heterodera glycines
  Promoter: Source sequence=SeqID_4770; Location=24..164; Strand=+; Gene=SeqID_55656
cttttattgggattaacaaacccataatttgtaatttccatttatttcgcttccatgtaaccgagaaataaaaagaattcacttaactaatatataaacgacctaattacagagtcgctttttagctaattaactaaaatg

SEQ ID NO: 111878 - DNA, 279 bp, Heterodera glycines
  Promoter: Source sequence=SeqID_27420; Location=1..279; Strand=+; Gene=SeqID_58111
tctaatctttgcatatatttcgaaggttttatatgtttttcttaaattttctagaataatcaattggttggtccaatcgttccatttttgcttatttgtttgttttttcgatgtaataatatgaccatttgaaccagttctctctccatggcttccctcattttgctgcttttaccgctgttcgtctgctccttccttttcgtttttcgccacctcaaacttcgtcgccagttcagttccgtcccttcccctcgctcctatcccttcataggacacatg

SEQ ID NO: 111879 - DNA, 1003 bp, Heterodera glycines
  Promoter: Source sequence=SeqID_25529; Location=314..1316; Strand=-; Gene=SeqID_56271
ttttctacatattaaatatgtacatatttttatacatattttggactttttcgtacatatttttcattttttttacatattttgaggatttttgagaatttatagaaattttttgtaaaaaattaaaaaaaaatttttttgaaaatgtatccctaaaaaatcgattttttcaaaaaatgatatatcaaaaattaatttgtaaaatattcaaatgtgattctaagcctattctggtcatttttatggcattttgtgcctatttcactttttacgaagaatttttttccaaaaaataaccattaaaaaaaatttatttacatattttcctatacatatttcatacatattttagcattttttatacatattttatttacataaaattagcagccctattcattacaaataagatatttaaaaaatcaaaaaacttttataagctaaaatcgacatatatttataatgagaattaaaccattcttcgaagcatttcatgccaagacttgctgaagtgtatgaatgtggcttattattatttttaattattattattgttattaaatcttcgtatttttgttttcctgctgctgatatacgtattgacaaaaaattatatgtctgtctttgtgactaatttttttaattagcttttttgttgttgcacattagtctgagttaaatttgttgaattgataacaaattttaagatctttttttgactgacggcgtaagtgtcgaggcgcaaaagtcgcaacaagtcgaagaagccccaaaccaacaaatttttaaaaattattatttccgtcaacattttttcttattcaattaaaattggttgttgtttattatattcatttccgtttgcgcaattattattattttttctttattatgccaaaatgtatgtgcgtataataatgaaattccacatcattttctcaatgcataaattaattgtaaaaaattgaataaattattatttaccttttaaaaattaaaaatg

SEQ ID NO: 111880 - DNA, 145 bp, Heterodera glycines
  misc_feature (32)..(32): n is a, c, g, or t
  misc_feature (49)..(49): n is a, c, g, or t
  Promoter: Source sequence=SeqID_31256; Location=1..145; Strand=+; Gene=SeqID_61629
caattattaatagcatattctaatacatacanaattatttagtgcacanatgatatttttagtttcaaaaaataaataataaatgaatgaaaaatatgataatatcataaaatcttagtttaataaaaatcagataacccaaatg

SEQ ID NO: 111881 - DNA, 615 bp, Heterodera glycines
  Promoter: Source sequence=SeqID_41785; Location=1..615; Strand=+; Gene=SeqID_69833
cgggattttgcgggattccagtccgcaatccagcattttttggataaatccgggatttgcaggattaatcctgcgggaccaggtcccgcaaaaaaatttgaattccaatcccgcagcggggtccgaaaatttgaaattttcggacactaatcagaagcctccaagtgccaccgagacgttttgtgactgtgccgggttcctaatccggcttccaaatcttgacacaattgggcgtgaaacatgcggtcgcgcaccacgcattgggaacatcgaaaattatcatattaaaacctgccggattggtacaaatcaaattccgacgctcaaaagtttagaaaatttaaaaacgaaattccgaggcccaaaaatattatttcttggcacccctcggcattgtgacaagcggatttggcactaacaacagcagccggcccatgaataattgcccccgcttctcagatcactcagctggcacttgttcatcggagcctccattcggcgccggacagtgacgtggacgtagtggacggagaggaggagcacgaggaggaagaaacagaacatggaacagaagtgaataatggtgcccgagtggtagatgatgaaactgaaatg

SEQ ID NO: 111882 - DNA, 61 bp, Heterodera glycines
  Promoter: Source sequence=SeqID_13821; Location=1..61; Strand=+; Gene= SeqID_77756
attggtgcagcaccaattgacggcgggggaatgcgcgtcgaacaaatggatacgaaaaatg

SEQ ID NO: 111883 - DNA, 447 bp, Heterodera glycines
  Promoter: Source sequence=SeqID_334; Location=12957..13403; Strand=+; Gene=SeqID_82942
actaaatagaaatctttgctcaaaacataatctccgcgaaaaccctaggaaaaagaaacattttggtaacttttcggaggactaattacctgggatagccaaattcaatcattttttccattcttttaatcatactgtattttaagtacgtggaccaacctcgggaaacaacttcagcctgtagaataccaacaaaattgaacagtctttcggaatttttttttaaacaataagtcctgcgggactatttattgctttatctctcctttatcagttctgaggaacttacatatcatcgttttattaaaaaatatattctaatcaaaatcttgaaacttatcgctcttcttttgatcctatacagttcgaataattatctttaagtcttaaaaaaaaaagaatagtatattttatcactaaccatttttattgtcactaagcaaaatg

SEQ ID NO: 111884 - DNA, 168 bp, Heterodera glycines
  Promoter: Source sequence=SeqID_9661; Location=1..168; Strand=+; Gene= SeqID_72250
tagcggtctctgttctcgagtcacggagaatttcgactctcggtcagtcctagtgtaacgggctaccacctttttatgcatttattatacagtggagtcattttcggtattcttttaattatataatgtcatctcccattttagctactgtacctctgcatcaagatg

SEQ ID NO: 111885 - DNA, 89 bp, Heterodera glycines
  Promoter: Source sequence=SeqID_20391; Location=1199..1287; Strand=-; Gene=SeqID_50910
tctgtaaaatgtttaatattatcagcctatcggcatcggcagactcaaattttccatttgtttaaaaatatatgttaatagttcagatg

SEQ ID NO: 111886 - DNA, 330 bp, Heterodera glycines
  Promoter: Source sequence=SeqID_30493; Location=1345..1674; Strand=-; Gene=SeqID_60897
ttttcgctgacacagaatggcggttattacaaaaatttttttatgtatttggttataaattgtgaagatagattggccatttttgagctttttagtccatatttcgggcatttttagtccatatttaatgtccatatttggggtttttaatccatataatttcgagtcctattcataatcaaactttgtggcgttctttttacaaagttttgttatattgaaaattattagggatgaaccctatatttttgcaaaatttccagccttctaaatgatacactaatattatttttgtgaaatttaaaggtttttttagctcaatttgaaatg

SEQ ID NO: 111887 - DNA, 271 bp, Heterodera glycines
  Promoter: Source sequence=SeqID_38339; Location=793..1063; Strand=-; Gene=SeqID_67184
tgcaggtctaaaaataaattacctaattaactataaaaaataattgctttaaataaatttaattacctaattaattataaaaaataatttggtaaaaataaattacctaattaattataaaaaataattggtaaaaataaatttaattacctaattaattataaaatataattggtaaaaataagttaaataattacctaattaattattaaaaataattggtaaaaataagttaaattacctaattaattatagttgttaaaattatatg

SEQ ID NO: 111888 - DNA, 785 bp, Heterodera glycines
  misc_feature (70)..(70): n is a, c, g, or t
  Promoter: Source sequence=SeqID_10981; Location=1..785; Strand=+; Gene=SeqID_74291
ttttttctacaacttttttaatagttaaaatcataagcaaaaatcatttttaaaaatttatttccaaatntaaaaatcaataaaacgcttttttgaggcgctctttttccaaaaaaactttttgggaagagggggcaggcggcgccgggaaaacttttgaaaatttgattaaaatttgttaacagattttcactaaaaaatgatcaaattttgcgattttgggccattttctaataggagttttgggggcgcggcggtgccgataggcgccgccgggaaaaaaattggaaattttgatcatttataaacaggttttcactgaaaattagccaatttataggtaaaattttgaaaaattttatgggaatttaatccaattcttaggggtgtaaaagtcgcatttcgcgccaaaaagcgaaatgcgaaaagcgaaacctaagcacatccctgtactttacttcaaatattgtttaatataatctgttctattttaagtagggtaggtcgggaccgggactttttggctggaaaaaccggaaaaaccaggactttccttataaatttctaaaaagtattctaattgatgggtcataattttgcccaaattacttttttgccgtcaaatgccagcccataaatagaggggagattcagcgcaaaagatcaaatgttcattcattcatttacatgcgaagatgaattttatttccaattttcatattttttttatttaaaaattttaatttgtagccagtccaattaataccttattaattcgaaaaatg

SEQ ID NO: 111889 - DNA, 1003 bp, Heterodera glycines
  Promoter: Source sequence=SeqID_8735; Location=2555..3557; Strand=-; Gene=SeqID_69017
gatttgcaattacggaaatccgtaatccgtaattacggcgattttctcagttacggaaatccgtaatccgtaattacgggggtccaaaaaccccgtaatttcccgtaatccgcaatccgtaatccgtaatttttaaaaatcaatttttgtcagagttttagaaaaaaatttttaaatagtgattaataaaaatcaaaaaactgattttcttgatggagtttcttcattttttatttaaattttacaaataatttataattttgtgtctgatcaaatcattctttttgaatttatgggttgatttttgaaaattttttgaaagtctgatcattataatcggatttatgtatatgtatataattatttcaacattttaatagccagaaaaaaattacgggggggggggggaatccgaagaattttttttggtaaaatttatttagtgttatttaaaaaagttcagcgccggacagcaaaaacaggaattgtaaccatttttagccaaaaaaagactactttttgccattttgtagtcaaaatttaaaaaaataaggtaaaatccgtggtgagccgaagtgacaaaaatatcagtgagagactttcagaggggtggcgtcatttcagtacggaagaaattaatttaattaattaataatataatttaaaattgaataatagctaataataataaatatatttgttctctatttcagtttatacggccacaaaaaatacacgaccaagtaatttcttgataaatttcatgcatcataactttttctaaaaccatcaaaattatacatttttggtatcttttggtagccctaagtgttctctattttcctgtaaaatttcaaaaaatttcgttgagtttcaaaaaagttgtggtcacaaaggtttaccaaatcaatttatgaaatttacaagccacaacttttttgaaccacaaccaaattttttagaattttaaaggcaaatagaggacacttcgggctatcaaatg

SEQ ID NO: 111890 - DNA, 79 bp, Heterodera glycines
  Promoter: Source sequence=SeqID_13949; Location=403..481; Strand=+; Gene=SeqID_77911
atagcatggagaagaggaagttgtggacacttcatcaatcgacggggaaccattggcctcagaaggcggcgatgaaatg

SEQ ID NO: 111891 - DNA, 155 bp, Heterodera glycines
  Promoter: Source sequence=SeqID_13719; Location=1..155; Strand=+; Gene=SeqID_77637
catcaatttaaatatttattaatgtaattaaatattatccaaatcattttttagttcttttatttttaagttttttttatttaaaaatatgctttgtataattttaatcattttaataaattaacattttttttcagaatgtgccactgaacatg

SEQ ID NO: 111892 - DNA, 224 bp, Heterodera glycines
  Promoter: Source sequence=SeqID_24796; Location=280..503; Strand=+; Gene=SeqID_55543
agtagggcatgtgcaataacatcataaactttaaaaattaataattttaatgaaaataagaaaatgttttatatatgcttgaaaatttccttaagagcaatagactaggatttagaaaagaattgtttagacaatcatcgagaaattgtcggagtcaaggaaaagtgtcaataattattttagtccggataataaattataaatattttagtataattttcatg

SEQ ID NO: 111893 - DNA, 193 bp, Heterodera glycines
  Promoter: Source sequence=SeqID_2944; Location=1632..1824; Strand=-; Gene=SeqID_82464
aacaatttaaagaaaaaaaaacttttcaatcatttttaagttattatgaagagttaagagttagcaaattaaaatgtcatttaaaaaatgtttaatagacttggggaaaatgacattgtccattttattcatcccctttcaatttccatttgatttcctttgcttttcctatttcaggcaacttttcccaatg

SEQ ID NO: 111894 - DNA, 1003 bp, Heterodera glycines
  Promoter: Source sequence=SeqID_9231; Location=103..1105; Strand=+; Gene=SeqID_70694
ggacaaaaaatgagagtgtgaacacacaaatcgaaataacacaaaatggtggtgtggtggggggggggggggaagcgcaaaaaaaaataaattagcgcatacaaacatatggccaattttggcgctaattcgaatttgcgtacgcttttcgctgctttttgttgggttggccatttttgtaatgttctgttgttgtgttgtgtttgttgtgtgatgatgtgatggtggaagaatttatttaggctgttcatttggctgctgctgttccagcggtacaacacaaaattagggaacaaaaaatgtgacaaaaattactgataatttttacaacaaaaaaattggaaattttttgggatggaaagggcgcacgcaaacagtacataataccataaaagtgcaattttaaatttaaagaatacgacaaaaccattccaaacaaaatttttctttataaaacgaataaagaaaggcaaagggagttaattttataattgtctttagttattaaatctaattatcgcatgttttaaagtgaaattaattttattttattattccaaggtaattaggtgttatggttactgctaattaatattttaattactttcagaaattataaaaatattttaaaccttgttcatgattcaattattggattaaattaattaagtcttaaattatttggatttatttcgagcacttttccacaaaaatgctaattaattatgcattttaataagggaaatgcattcacatttaattttatgcaacacatttaaatttatattaacaattaccaaccgaacaaaagtgaatattttgttgttttttctgtcaattaccattaattaattgatagggtaataggcaacaattggtagtcggtaattaacaccataattaggtaaattagtcattgtttgtttttcccgcgctttctcagcacattccgtcatcaccatttttctgtttgcttctcattgaaattggcgcagcaaaaatg

SEQ ID NO: 111895 - DNA, 497 bp, Heterodera glycines
  Promoter: Source sequence=SeqID_16386; Location=1..497; Strand=+; Gene=SeqID_80779
gattaatgacgacattctttcttctctctgttaaacctttcatacatgcatcattgaatacaatcacaatacacacattttatcagtggtttcctaaattaaaatttaattattgcaaaaataatttttaatttcaattaatttaatttttgtagcaaaaatttgagttttttttttaaattaaatgaaacaataaattgccaagaataattatatgtctgctgtttaatagtttatatttgtcattgttttaaacccaaaacaattttttgtccgttctcacgacaaaaaccaataaaaattaaaataatgacactcattagtgaattgggcacttcataaacatttggtacttaatatttgtctccgttttcatcgtcaacacattctttttccttgttccgtcatcgcattttatgtcgccatatgactgcgaattgctcagcaacaaaaaactttaaaattaatttgaaatattttaacggtaattaaaaatg

SEQ ID NO: 111896 - DNA, 499 bp, Heterodera glycines
  Promoter: Source sequence=SeqID_10041; Location=1..499; Strand=+; Gene=SeqID_73101
ttctaagctattgcttcgcgattagtcaattaccaaaaaagttataacatgaaattgcaaaaaagccaaaaatttggaagttttttcttaataaatttttacaggctagaaaatctttttgctttttgtaaggctaaaatagagcaagtgaagagctttcgaatgataccaagatcgttagatttggttaacaacaaaaaaagttatcgtccgaaaacttgggctggcgccaaaacgtcggcgccaaaacggcctagtcccatttgcggggtccttttaaccaaaattcttaaaataaattttaaccgaatgtcagaaaaaatgaaggagttgagggataagaaataaaaaattttcagcaaaagtaaaaataatcagcctgtcggcacaccctgggatacatttcttaatttaaacttcttgcaaaaatttggtttttaaaaaattggaagataccaaatttgaaaaaattgtaattttttttttcattttttagatg

SEQ ID NO: 111897 - DNA, 65 bp, Heterodera glycines
  Promoter: Source sequence=SeqID_1124; Location=1..65; Strand=+; Gene =SeqID_46604
tcaaacgatgaagatttaaatttaaataccgatcagcaatattcactcaaaatgtgcaagcaatg

SEQ ID NO: 111898 - DNA, 307 bp, Heterodera glycines
  Promoter: Source sequence=SeqID_26696; Location=1..307; Strand=+; Gene=SeqID_57460
tttgaagaagtgtcaaagaacatgcagcaataagcctgcaaaatctataagtggaaatacatgagtatagaatttatttcagaaagtgtcacagacttttggaaaaatatattgcaattatcaacaatttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatg

SEQ ID NO: 111899 - DNA, 1003 bp, Heterodera glycines
  Promoter: Source sequence=SeqID_18451; Location=1392..2394; Strand=-; Gene=SeqID_83049
ttccccaccatttgttgcgtgacacttttaaacgaaaactgacaaaaaaaagaagaaatttctgttttgcaatgtcacgaataggagccaatgttttaaaatttaaaatttcagtgattagtttgagttaagccatttatttcactgtaaatcttcattatattaaattccaaaaaataaaaaaattaaatttttgtaaaagcatttcctaaattacaatgaatgaaacgcaaataaacgagaacgaagaaatgataatattgaaggtgcttttatttaaatatttttgataatctaaacaatttttttaataaagacgtgttctaatcaaaatccttgctggacaatgattggttatggcatatttttgttttttttgacaatcagtggaattttgttaaatttttcagtaattttcatcacaattcggacaaagtttacattattttttaactaataattcattacaaaatttctttcagatcatttcgtggctctgtgaatattttgttggcattttattcattttttgaaataatcaatttttgtggaaattttttgtcaatttttacggctttttcaggccagtattttatgtcatttaaattggtctttgctttactgtggttcctttaataagcaccggctgtgccctccttattatgcttttcattgctattgaccgactgtttgttgtgctttttccgctaaagtataaaatttgatttaaaatctttttacttattttcgttttaataaggaaattcaatcagtcactttttcttactgttgttttgatggttactgtaattcacattattgtgcaggcatttatttatttgaatttttatgatgataaaatgaatgcgattaaagttattggttattattacgaaattggcagcctcatttatgattcagtcagtttgtttgtcattgttttgcttggttgtttcaattattttagaaacattgcttaattgttcttttcgagggagcaatg

SEQ ID NO: 111900 - DNA, 449 bp, Heterodera glycines
  Promoter: Source sequence=SeqID_13226; Location=436..884; Strand=+; Gene=SeqID_77056
agatccgtttgaaagtgagcgtaatgaataatattacaaataacaaagtgccttcttcgatttaatctgaaaaggtaatgtgggaaagtggatgaaaggagataatggaggagaaaaagcgggggaaggggcggatgaagacgaaaaaggtcgaaatgtgaaaaatgagtggggaggggggcacaggacgatgaaagtgcgggagggacagagtgatcttcgagacggcggccatcacttcgcctcccccaccccatttagcgaacaaatttttgtttaaagcgcgaacgtagacaccaagtgcgggaatttgccccgggcatgggaatgtgtgaagaaaagttggtaggaagcggaggagcgaaggaagaggaagaagagcggaagagagagaaagaaaaagtgagaggggaaggaaagggaaaaaaggaagaaaaaaggaagaaatg

SEQ ID NO: 111901 - DNA, 438 bp, Heterodera glycines
  Promoter: Source sequence=SeqID_30636; Location=939..1376; Strand=-; Gene=SeqID_61044
tgttcctagtttatgaaaaaatttcgccgaaaaaaaagcatttttgaaaagcaaaaaatagtcaaatttatggaccattaacagatttgattcccgatctctttttaccctctgacccattcgaaaaatcttagacgcccttttattgcatcccgccagcccctaaaaatttctttttcaaaatatcaggtattttttcttatttggaaattttttgaaatttaattaaaattttttcaaaatttccaaaaatccgcaatcctgcgcgggatcctgcaaattttaaatgcaggatttgcaggattaatccggccgggccggtcctgcaaaaatttttgaattctaatcctgcaacaggatccgcaaatttgaaatttccgggctctagtatagatcctatttaatttaaattttcaatttttagtttccgacggaatg

SEQ ID NO: 111902 - DNA, 90 bp, Heterodera glycines
  Promoter: Source sequence=SeqID_24968; Location=1628..1717; Strand=-; Gene=SeqID_55703
tgcctattttggaaaatttcgttgcgatttcagatttattttaattattttattaatttaaaaaaaatttcagagcaaaatataaaaatg

SEQ ID NO: 111903 - DNA, 721 bp, Heterodera glycines
  Promoter: Source sequence=SeqID_3520; Location=613..1333; Strand=-; Gene=SeqID_85001
tgtattttgagtgctttatatagcacggtcacttgagtcccagttgagtttggcactccattttcggcacttttcatcctgaaaaagggcaagcgcgcccctaattctatttttccaacccatttcaaacctttttacatcgattctgaccgtttttaagcatttttgagtttggggcctatgatcaatattttccaattgtttttaacgatctttaaggggataagaaaattttttgaaaaaagtctcggggttttgggtctcggtctcggggtcgagtctcgggaaatttttggtctcgagcagcactaataattaaagagaatgtctaactgtaaaaaaagatagtgataaaaacttctaaattctaagtgaaccattaatagatagtgctgagaaaaaaacatctctcattttggtgtattatttctttatctctgttaatagagaaaaaatgaatttactttgcgacgtttagctataaggctttacatttaaaaaaaataccagaattttgaaatataagaaaaagtgcaaaattttaagaaaaattaaggattttctgttttatttaatttacatatttaatcctttattctttttgtttgcttcattttgtgtgtgtttcttcactgtcatttttcctaatgtctctgttttaagttaatacagtgaaattaatcaattgaaacggcaaagtgtgctaattgctatacaaatg

SEQ ID NO: 111904 - DNA, 156 bp, Heterodera glycines
  Promoter: Source sequence=SeqID_9611; Location=1..156; Strand=+; Gene= SeqID_72081
aattaaaattaattgtccttattatttagttcaacctatctgtgccacttccattttcacagaaaattgatggttttcgagtgaattcaacattctttttccgtgttcaactgcttaatgaaacgcataacacagtgaacataacatttacagatg

SEQ ID NO: 111905 - DNA, 570 bp, Heterodera glycines
  Promoter: Source sequence=SeqID_26; Location=6738..7307; Strand=+; Gene=SeqID_82132
aacgaattgtctgagggctaaagagagttagaataggatgatttaattttttaaatcgatctttttatttttaataatttttacatttaacttttgtaaagtttaataaatgaatatttggaaataaaaatagtatcaaatgtatttgaacagaaataatttctgtaatcggaatttgctagaggaatgagatttttgatttgtttgagagtccatttggatgattgatgagaatttttgaatttgttttccgttattaatggaataattaattatatgcgccccaaaatgtcggtgaatataaaggaaaattcgccagatgcgcaaattggggtcaagaacacacattaattgttttgatcaaatttgattataaataaggaaattgtacgagcgagattcattcattcattaatacataaaatatttattattattatttctgttttcttaaatatttcacaaatgtctcaacaatgtaatttaatttaatatttttattattcatctaaaaatccgttccctttagccatgaactcatcggactgtcgctcaccgactcccgacatg

SEQ ID NO: 111906 - DNA, 1003 bp, Heterodera glycines
  Promoter: Source sequence=SeqID_22665; Location=240..1242; Strand=+; Gene=SeqID_53350
atatgtcacaaaggattaagtttaatcatttatttttcagcatatgatttttcacattaactgaagcagtactaatgtacaggtgctgtaaaaatattttaattcgatactaaaatatcggtaattttatgagttaagataaaaatatagatagtgcactttgttacagcttttggtcataaaatgcaaaaaaaacttctaatttggctctatttttaaaaagtggattttatcatcattttaagatatatttgagaaaaatataatttttgtactgttatgagcatttttgtaaatttgaagagttttttaaaattcattaatgtcaaaagtcaatattttctgtaaaataagaaacctgtaagatttacaggattaggttccactataaatgaatttttgtcttttaatatatgtagtgaaaggaaaagacatttgtataaaatttataactaattaagaaaaatacgaataaaaagtttcctttttaaaaacttcagcagtcgcgatcatggaaaaagtcaaatttaccgcaaaaacccatgggtattggctgttttttttcgcgcattttttcgggggaggggggtcgacggtccctggtttttttcacaccgaaacgaaccccggttttttttaccttttttcccaaaccaaagggtattattggctgtttgttttttcgttaataaattaaaataattttggatttaggttggggtttaatattaaacaattttttcatctttattttggtaatacaaaaactttttttttaaattatacaattttgaattacgtatacattaataagacatttgtgtgcaattgctgcagaatgccccctcccccccaattgaccccagacaaaatcaattctgacggataaaaaaatgacttataaactgaaaaaaagtaccacaatagaccaaaaaaagaaaaaaaaaggaaggaatggagagggagggaggaatgtattgagaatggattgagacgagggatg

SEQ ID NO: 111907 - DNA, 790 bp, Heterodera glycines
  Promoter: Source sequence=SeqID_10339; Location=667..1456; Strand=+; Gene=SeqID_73521
tttggtcaacgcttgggcagcagttggattcagcacatcaaaatcggcaattccggtacttatacagtttgacccacataaaaaaaattttttgtttctaatgataaaaacgtgtttctaggggttttcggggctgctgatcacgaatatgaactctattggacgaatttccgaacccctaacccgaaattcgaactttttttcgaaaaaatttttttgtttttaatccgtttaaaatgtgtcaaaatgcgtgctccatgattctccggtgagctgctcgttcaacacatactcaaaaaataaataaaatttaacaaatttctaaaattcaacaaaatgccaaaatatgaagtgtaaaattggcgcgacaatcagttttcgcatggatacaaaagatacttttaacgaatctggctacgctagaaactgtgcttgaatctgaattttgtagtttaagtcttactttagctacgaattattttctatcatgaaccagctggacaattttactaccaaaaaactttatgaaaaattagcattggatgataatgaattcaatgactggcttatgcagttgggcctattgcatggcaggcgtatatgtccggaatgtagaactgtaatgggacgtcgccagcctaacagaaacagaaaatatggagcgtggaaatgcaaaaatacacaatgtcatcgcccggaaataggctttcttgttggcacattttttgccggctctcatcttgacattaagcaggtgtttacattgtcatatttctgggcgcaggaaatg

SEQ ID NO: 111908 - DNA, 62 bp, Heterodera glycines
  Promoter: Source sequence=SeqID_24646; Location=1..62; Strand=+; Gene= SeqID_55380
attttccaattattttgcccaatttcagtccgttccttccgctcactttcaatttcaaaatg

SEQ ID NO: 111909 - DNA, 148 bp, Heterodera glycines
  Promoter: Source sequence=SeqID_1339; Location=806..953; Strand=+; Gene=SeqID_72884
tttttaaaaaattgcaaatgattgtcgtaaaacgacgggtgaactcattatctttgtgttaagccccgcccaaattgcgccaaaacaagcgcctttgtttccccgctattaaaaccaaattattttaaaatttttcaatttaaaaatg

SEQ ID NO: 111910 - DNA, 422 bp, Heterodera glycines
  Promoter: Source sequence=SeqID_23800; Location=479..900; Strand=-; Gene=SeqID_54499
acgagtgcttgcagatgtcaccaaagtggccagagaaaaaactgaatggattgctgagctcagcaataattgattggaatcataataaaatttttttttaaacagaaaaaatccaatttatttaaaatactggttaatatgtagagaatcttaaaaattttgagggaaatcacgttaaggaaatcttgttgtccgcccatatacatatatgtatccccgttcaatcggtgtacctatggatggttgttatacattatttatacataaatataggtcccatacagacacaaaaaattatcagactattggagtgctaaacaactgttgcatcaatgaagaggactgcatctgttaaaaaaatcacgtgacgataactcaggtctgcaaaacttgatcagttgaaggagaaatattcaaaaatg

SEQ ID NO: 111911 - DNA, 609 bp, Heterodera glycines
  misc_feature (4)..(4): n is a, c, g, or t
  Promoter: Source sequence=SeqID_25958; Location=23..631; Strand=+; Gene=SeqID_56711
tttntggtttatttcaaataatatgtatgtctgaaaataaaaatatgcatttaaaaagaggataaagttggtgtaggtaaattgagatgattaaattggaattaaaaaaaaattatgaatgaatgaaggacgtatacgaacgtatgaatttatatactaaaatttctctggagactcactttggctatgggtcaactccactgtgcagagaaaagcatagtactatctcgtcgtttctctttttctttgtaatttttctcactttggcgtactatctattcattttaattacctatataaaaaacaacatttacttcgtgacgtttacctttttatctacactagcggggaagaattttgccgttttgaaattaatccccggcacttcatccgatcctattgtaggcataatacataaaatccatgccaatacgttgccaaaaagaatacaaatatttaaaaaatgacctaataatgtgaataaatcaaaaatgactcatttctatacgttcattaactttattctttccgcctttccctcccttttttctccaaattcattattttagcttttcacttgaagtgttcaattttattacctgagaaatg

SEQ ID NO: 111912 - DNA, 479 bp, Heterodera glycines
  Promoter: Source sequence=SeqID_11579; Location=1203..1681; Strand=+; Gene=SeqID_75017
tttcgggcctgattccaatcccgttaaaatccagtgttaatagcagattctctttaaatttagtatttttataaattggtccatattttcaatttatatttatatgaagtgcaccatttttctattaaggttaatcatccttttttgaatttacgcttttgtataaattattttatttatttttccattttaacagtgaatcatccaaaaaaaagtccatcacttttcgcttggaaaacgacacgactgactttttttgcacttcataaatatttgttgttagccaaacgaacaatgaattaacatttattccaattagttaatggataaaccaatccgtccatttgtttgaataatagtaaaaaaaagaaaaataatttaataaatgagcagcaaaaactaataaattaaatattttatttattattttttaaataaataaataatacacatataatcattttagcagggctaaaatg

SEQ ID NO: 111913 - DNA, 111 bp, Heterodera glycines
  Promoter: Source sequence=SeqID_31434; Location=1086..1196; Strand=-; Gene=SeqID_61779
cattgaatcacaaactttaattaattttacgtaatttaggaccaatcatcgaagggacccgcccgtttcacagagactgacgcaaatgtccatgacctgaagcgcacaatg

SEQ ID NO: 111914 - DNA, 662 bp, Heterodera glycines
  Promoter: Source sequence=SeqID_3572; Location=650..1311; Strand=-; Gene=SeqID_50916
actgaataagcctggcctgaagcggcgtttgaggacgaccgaaaaggggaaaacaaataatggcatggattgatcaaaggcccttccgtttgtcaattttggcactttacttggtgcctgcaatcgaatgtccaccgccgccttcgccccgactccgttcctcgcctcacaagtgaacacgccaaagtgctgttcggagacctctctcagctccaaaaccgcctcaaactcgtctacggcatctaacggagagggaaatgtgaaggacagcccccctcccccctcccgcgtcactgacctttgacccgcgaaatgtgccgtttgtaatcgccccctccaaattccgtgccgatttctgttccgtctcggctccacgtaacttttggttcaggccgtgccgaaatccgacacacaatttgagccttaattcgaattaatttattggcatatgcaaattatgttcgaattttcctaccgatgcgccaatctctgccgctgtcagtgccaatccgtccacaaatcgttcattcaatgcaatcggctgatggatgacactgagcagcgattgactgctgacgggcggagaagtggccgaattgtgggccaagcacgagtaattgcccttgtcagcccaactgatcggatgcgcaaatcggagaatg

SEQ ID NO: 111915 - DNA, 567 bp, Heterodera glycines
  Promoter: Source sequence=SeqID_30851; Location=530..1096; Strand=-; Gene=SeqID_61244
taacgggtgccattctgcaaatcactttctaactttttaaacggcaccttaagatggtttcgttttggtaaacatttgaccccctccaccctcctctcagcggtggttttagtctctgctcggagggcaaagtgcgcaaaagtgggcgtcataatcattcactcattcatttgcccttccatttcgccctccacccaaaacagcgacaaattcttcgccaaattcctcccaaaattacaaaatttatgccaaaaaatcaattaaaaatgccaaaaagaaaaatgccgaccgaattaaatgtcgaaattgtggcggcacttccctttgatattcgctgggccaatgtgcgaatttcttttgcatttgaccattttttgtacaaaaaacaagcccaatggatcagaaatgaattgatcagacaaaaaattgtggaagaaaatgttttttcaattaatttttaatttatttaaacaatttttttggatttagaggcaacggcttggacaggcaaaacgtcggattaaattaatgtcgttccgtctgtttgaaaaccgcttgcgcaacatg

SEQ ID NO: 111916 - DNA, 460 bp, Heterodera glycines
  Promoter: Source sequence=SeqID_41380; Location=1..460; Strand=+; Gene=SeqID_46659
agttgttttttgtggttttttaggtttagttggtattacgtcggattggtctttgtcgggttggtttttagtcgttttttataggcgttggtgttttgtcgtttttgggtgagttggtgttttgtcgggttggtgttttgtccgcgcgccttccttccttctcttcccattcccaacacctccctttcctcccctcccattcgtcgattaacgattaacccactttttgctttctctcctttccacatgtgctagacatcgctgcatctctgccttaacatttattcagcgcttattctcctctgagtttcatttctaattttctcggtctttccaatttcatcactttttctttcccaatgtaactgtaatgtcatcatttttatagtggccttaatacataacatttgaattatcttttagcgatcgaattcaacaccctttcaatttggcgatcatg

SEQ ID NO: 111917 - DNA, 631 bp, Heterodera glycines
  Promoter: Source sequence=SeqID_18535; Location=1938..2568; Strand=-; Gene=SeqID_83165
ctgcttttgcctttggctttgccatctttggcgcctctttcatgccattttcttttttcttcctccccccccccttcccctcttgtccattttgtgcttcttctctttgtgcttttcccccgaattttatttatgcgctcgctgtccactcgcctttccgcttttccttcctccttaatccgttgccccgggcattagtccccccattcatgcaaaaagaaaagggagcgaaggaatggacagccgcgacggcggacggcaaaaatttgcaatccaattaagcggcaatggcactgggaattttaagtgactcggctgacggaggtactaatttaggaaaaaaagaatgttcccaattcgaaataaattttgcattttttaaatttaaatttttggaaaatatttatttaatttttattcttacagcctaatatttgttttcttaaattgcttattttattcaacatgttctctttttaacatttatggtgtttttgttagcgataaaggtaaattttgggcgtttacaaaaataattatttttaatatttattaattaaaaaattaattaattttttcaaaaaatattttctatttatttgttacctttttagaaatagaaatcaaaatg

SEQ ID NO: 111918 - DNA, 651 bp, Heterodera glycines
  Promoter: Source sequence=SeqID_21938; Location=1820..2470; Strand=-; Gene=SeqID_52574
cttttggctttttctaagcctaatagagaatgttaagagctttcgaatgataccaagattgttggatttggatgcaaaagaaaaaaactatagtggaaaaacatgctctatggcccaaccgtgagggcccaactgacgggttccgctaaatttaactttttttgatcaatttaggaacaaaggtaatacataatttgaaaatttttattttcgctttttgtccaaattcgggtccgagattcgaaattgcccaaaatgaatgttggattcgggttccaatcgaaccgtaaattttatgaacaagaaacggaaaattcccgtttttttccattcttcgcggcaaaattttttccatgccgacatttttaagtgaggccaacgagtatttaaaaaaacttcctattcggggaatcaaacaataattgtaataaattttcattatctaatcaccgagcaataaaattctcagttttttgagtcgtcatgctaaaattttatccccataatttttgtgcaattttatggccatgtttagaatttttagtctctattttatgtccatatttagtgattttatatccattttttccgaaccctcctcattcataatctctcacaaatgtgcggcgcctggggcaaaaagacgagatg

SEQ ID NO: 111919 - DNA, 395 bp, Heterodera glycines
  Promoter: Source sequence=SeqID_2944; Location=249..643; Strand=-; Gene=SeqID_82465
agagagcgaacattggctgattttctgatattcatccattcctgtttcaaaggatttctaacatattgtcacttgcaaattccataaccccacttcccatccgatgatttctttgacacacagtaaatagcccaggatgtatttactaacaactaaatatgcttataaaaacgtatagttcagacactcttttgattgcatcctcggtgctgatatactgtacatttgaaaattcagagataaatttatacaaaaaaattacaaacaaactatattaattttttattacaaaaaaattaaatttgatttatattctaaaaatgaatggcagttattctagaaaattgataagtgtgttttttattgtcagattggttatttttattttatcgatg

SEQ ID NO: 111920 - DNA, 363 bp, Heterodera glycines
  Promoter: Source sequence=SeqID_26944; Location=1..363; Strand=+; Gene=SeqID_57687
aaataaaaacaggtaatgggaaaaaaatgaaaaaatgtgccaaagtcaaagaaaagaataattaagaaaagttaaacaaacctcaaggaaaaacacttaaaaaatgcaaataaattaataattatacatgaatagagaaatggaaaaccaagagtacaaaatcatcccgatttgaaaattaaggaaaattaaaaacaacaagcaaaaaaagtctgtatggcgtatgcatttttttctttttgatcattcaatcgtgctttttttttttttgcgcaggccaagcagttctgtgttgagtgcgagcatccggttgaccggcgtacgcacccgctgggctgccgcgctgtgtgtggcctgtgcatg

SEQ ID NO: 111921 - DNA, 128 bp, Heterodera glycines
  Promoter: Source sequence=SeqID_13286; Location=1105..1232; Strand=+; Gene=SeqID_77128
aaggctacttttgtaaatggagtttacttttccacagagaataaatgccaaatattcctacggtgtcggcgatactgtaggaattggcgttatttgtgccaatcgacagatcgttttcaccaaaaatg

SEQ ID NO: 111922 - DNA, 428 bp, Heterodera glycines
  Promoter: Source sequence=SeqID_5595; Location=565..992; Strand=-; Gene=SeqID_58598
aaactactattggcagagggggcacgagatggtgaattgcataagagcgctcctgattgtatggatttggacacatatgggtacggaggcaatttatgttatgcttcatttttgataatacatattttaattaaatttaaaaaaaaatccaaaattcaatttcattaattgccgtaagttccctgaaatcattaatccattttattcgtacctaataattatgcaatgcttttaaaaattcattaaacccattttttatttgatcagctgtaacacgtaatatgtacacaactctatggaaagcctcgcgattcattaaattcgctgaatttactgaaatatttaagtgagaaaagggaacggaaaaaacacatttccattttactaataaacattttaaatttccgtttaaaaagtattataaaatg

SEQ ID NO: 111923 - DNA, 206 bp, Heterodera glycines
  Promoter: Source sequence=SeqID_17323; Location=2607..2812; Strand=+; Gene=SeqID_81796
attacatttatttgcacataaaataaatacatcattaaataaatgattttagtatatttgataaataaaaataaaatttaagtaaattaatgatttttcttttaatttaaacaaggaaacattgaattaattaattttttggcattattttattgattatttatgtgataattaaataaataatttaacagtttaaaattgttatg

SEQ ID NO: 111924 - DNA, 980 bp, Heterodera glycines
  Promoter: Source sequence=SeqID_28803; Location=256..1235; Strand=-; Gene=SeqID_59381
ttttacccatgcgaatagtctgtcttattttctttatgcgtcttttcgtgcatttgtattgctttagttgcatgaagtcggaattccgacttccgaaaaaattttggacgtcggaattccgatttccgaaatttttgatatacattttctattttattttgttttcaaatgaaataaactagagtgaagccggaccgggaccgggccgggaattcccggtcatccgaggtcccggtcccggatattgaaaagctcaggtcccggtcccgataggggaaccgggaaaaacaagcactggtaagaatgggggtctgagtgaaaaattactgatgaaaattgaagtcaaaggaaaaaatttaaaaaaagaattaatatatgtttcctataaatatgattgctcatagttttttttattgagacatattttatcattttttaaagaaaatccgtacaaattgagcatagtaatcccaaaaaccaaccttttttgttgaaaatctgtaaacaaatcacactcaaattttcaaaatttccccgacggcgcctatcggcaccgccggaccccctttctttcccaaaagttttttggaaaaagcgcgccgaaaaaagtgatgtgaaaagcaaatctgaattgctaataatattcgatcatttgagtcataaaatgattaattgtttgaaataactgaagtaaattcgatttgaaaattttcagtaatttaatttagctttaacttttggatttataaaataaatagcaatataaaaattaattttgtattatttacacttgaaataaattaaaatttgaatttttttaaattttaaatttttttttgaattttcaaaaattcccggttggtcccggttccctgtcccggacgaaaatcgaggtcccggtcccggcaagtcccggtcccggttttgcccaaaattcccggtcccgcttcactctaaaataaactatttttagctcaatg

SEQ ID NO: 111925 - DNA, 811 bp, Heterodera glycines
  Promoter: Source sequence=SeqID_12089; Location=2105..2915; Strand=+; Gene=SeqID_75643
gataaatttaaaaaacccattttttaaaatttcctccatttttaggctacgattgttcaaggaaatgtttttgtacatggaaaataaacaaacacttgaattgcgttcggtgttcacttccattgtggaggtgtttaattgacctttttcatttccaatatttcgtttttaaatttagaaatttttactctccggtgaaaattggcgggaattgctctttctcctcaaattgtcactattttcgcccgcggtgactttgccgttcattaatgaacttttgcctcacatcagtgggttttttgtcgattcgttttctcaaaatttcgttggattttttttttaaattacaagtgacacaaatttcatgtcaattgttccaatggacaggaatacaccattttcagttcaacacccgttccttgttgatcgtcttcaggaactcgctgccaatccggcactttccattgccatttcacccacaaattttttgcagaatttttttgagaaagttgttgaaaatgcgagcacggaatacgtgtttaaacttgcaaaaattgtttccttttccctttaatcctttttttctgtcatttgacctttgaatgtgaaaatgctttaaagtggtaaaacaactgctgaaaatctcacccttaattaattgaaaataaaatatttatattttttattgtaattaaaacgccgaattaaattcatttttcattatattacattaaaaaatacctatttgataactttacttaaattacaattctctgcttttcttctcactaacttttgctcccaaaaaatg

SEQ ID NO: 111926 - DNA, 703 bp, Heterodera glycines
  Promoter: Source sequence=SeqID_3064; Location=4460..5162; Strand=-; Gene=SeqID_83041
tttaacacggcatcggctcgactcgttttgacccggtccaaccattcattccctggcaatgagaagaaccttttggttttcccaaagtctcgacccatttgtctctgtcgagaatttgtgacctttgacaacatttgacccccacaaagtctcgagattcccgatagaaaaagcactattaaacttcgaaatttttcaagagaaaaatcctgattttttttataagaaaattccatcaaaaaattttttcaccgattcgggcggcgcaattttggggtggactctccatttggtgattgtccaaggcgcttaaccgatgtgccatcccaccactgttagcggggtgtgcttctttgttgtgccatgccacttccatctcatttggctatcactgactgcttcctcgaactcaataaatcctagtgctgttcaagacgctcggtcttgactcgagaaaagtctcgggttttttggtctcggtctcgagtctcgggaaattttcggtctcgaacagcacaaataaaccccaaatgtcattctttggtcaaatgtctatttaacaattttggcacgttttcagcaaagaacgggacagtttgttgttcaattttgtgggcgacgaaatgcgcactctttgcgacgccggcgaaacggcggcggtggacgacgacaacgatttgcacatgaacagcctgaaggcatg

SEQ ID NO: 111927 - DNA, 229 bp, Heterodera glycines
  Promoter: Source sequence=SeqID_7184; Location=144..372; Strand=+; Gene=SeqID_64072
ggtttgtcgatccgatttggaattttatttttaaagcccttgtctcaggtcattgctgaggcggccaacggaccgacaactccggctgctgatgcagttttgatgaacagaggcgactgtcttattgtgcccgacatgtttatcaacagcggaggtgttactgtgtcgtacttcgagtggcttaagaatctcaaccatgtctcttttgggcgtctgacttttaaatatg

SEQ ID NO: 111928 - DNA, 361 bp, Heterodera glycines
  Promoter: Source sequence=SeqID_12537; Location=1071..1431; Strand=+; Gene=SeqID_76184
actcgaatttcactttttattacacaacaaagttgaaatatcaactttaaactgtccttttggcctttatccgattgctttccgttggcggggggacaaatgcctaaaatagggaatgccaattttgtttaattctgtccgaaatttcattttgcatttgcctttcagctccaaattcgcgagtgccggattggccgcattgacgagggtgccctcggggactgttcacggtcggctctgtccaacttcagtccaaccaaattgtgcgactgtcgcccggttggtcttccggcatggacaatgttggcaaattggtgttcacttacaacaccgtgcgtgagccgatggtgtcgccagaatg

SEQ ID NO: 111929 - DNA, 1003 bp, Heterodera glycines
  Promoter: Source sequence=SeqID_12862; Location=1020..2022; Strand=+; Gene=SeqID_76591
aacgctgagtcagtgtccaaatttttcaaatggattttgccggattttgaaaaacataaaaggattttttggagaatgaaaaacaaaagtttaagacattttctgaacaatgaacaacagaaaacgacgcttagcctaagaattaaaaaatagaatggagcagcagctgaagagaattcaaaaatagagagaggcgttgttgggagaaattaaaatgagagaattttttaaaaaatggtcccttttatagagaatttggcaatcgtttgcttttcaatttttaacttttcgatcattttgcctgaatttacaggggtataaaaggggacaattttggctgacaatcattgcatttccattcactgtttcgtcacttccttttcattgtaagtttattcaacatttggggacgctgatcatactgatcacgaaacaggcatccatttcaaccaattccgcaccttgggccaagattcgaaccaaaagtcgagaattcaaatttctcgagtttcgcatttttgtctatgatgattcagtttgtttcagaaaatccaaaccgattttcaaccaaaaatgcgaaactcgaaaaatttgaaatttcactttctgttcgaattccggcccggaagttcgaaatttgtcaaaatggacgccatttcacattactctcttttcttcatttgctgttgatgctgttccgttccacttccattctctttcagcgcctttgctgaaactcacctctctgtgctgctgttctgtaccacccgctttttgtgttgtgttcactgtgccgacgaccacaacgactccgaccgtccgcaaatgacaagaaccagccgaagcagcagcagcaacagaagccgaggcaggacaacaacaacaacaagaagccacagaagcagcagcagggaaagtccgagaagtgtgctgatgcgccagctcgaaatgttgatgcaaagcgcgagcaaaaacagcggattccgtgcgtgtctcaacgatg

SEQ ID NO: 111930 - DNA, 686 bp, Heterodera glycines
  Promoter: Source sequence=SeqID_13650; Location=1282..1967; Strand=-; Gene=SeqID_47146
tgaccactggattttcggattttttttttgagggggaataatgaaaaaaaaattttaatttaaaaactgataattttcaaaatttagcgctgttctaaaacttgaatcaaaaagtcgaaattctattttgttgtttgagttaaggattcgaattggtcaaaaatggatgtcagatttttcaaaatccgagttcagtgattagcgtatttttaagcctagaaaaagtgttacgaattaaaaaaaaaatttttttttcgggaccgcaattccgaaagattgccagttttattgttttaagttagggttggttcggtgcgtttttaccttttacttcgagttcgaataaaaataaaatttcaaaatttgtttggcaatttttttggcattttgttttcaaatttcaaaagaactttttttgatctttgattctttgatacttctctttcattggattttgacgattgaattggcttttttcgttttaaaattgatgtataggcccaaagattagttaaaatttttctataactccgttttttttattaatttgtatgaaaaaataaaggtacaatcagaaattcttgaaaatttttgatttaaatgattttaagaaatttggattttgtcatacgacttatttactaattttagcattttacaaattcgtgccaacaatttgagggatg

SEQ ID NO: 111931 - DNA, 694 bp, Heterodera glycines
  Promoter: Source sequence=SeqID_6044; Location=3130..3823; Strand=-; Gene=SeqID_60126
ccccccccccccccgaagccaaggattgggttacgcccttggtctggaggtaattaatttttgaaagcgaaaaaatttgactttttatcagatttgaaaatgttgataattttgatcgctaaaagtatttgtttttctatgattcaataaaatttcaaagaatttattaaacctaattgcaaaactttaattatggtccgaccccataattaacctcgggggggaaaaaccggcgctcaaattcagtcataatgagttaaattttgttcacataaaatctagcagcagatgaatgaaaacactaccacgcatcttttgaaatctttgacaccctgacgaatattcgaacaatcatataactaatgtcctcatgatatcgtcattgacatcttacccatcagcagggtaactctgtatcaggaaatatacaattcgaaaatggtatgtatggtcccttatgggcatttttccaatgagggtattattggtacaggaagcctatcaattctttgttcctgtacagctcatgtagtgaaaggtagcgctgatctgagcccggattcgtgatcagcgacctcaaaaaccccttaaaaatttattttcattaaattttaaaacacatttatatgcatttgaaaatgtatgctaaaagtagcctgtaaactatgaaagtaccattaaattttaaaaaatg

SEQ ID NO: 111932 - DNA, 94 bp, Heterodera glycines
  Promoter: Source sequence=SeqID_614; Location=1365..1458; Strand=-; Gene=SeqID_57486
tttgtcaggctttttcggttttgtggccgacaaatattagatgcgtaaaagtgaacatttggtgctggatgtcatttttgttcacccggacatg

SEQ ID NO: 111933 - DNA, 306 bp, Heterodera glycines
  Promoter: Source sequence=SeqID_36821; Location=1..306; Strand=+; Gene=SeqID_66038
cacattttttcaccctagaaaaaactaaaataaaatttttcatttaatttttcatcgggaccgcaattctaaaggattaccaaaatgatcataaataaaattttaaaccaaattttgaaaacaaattgattgagataacttattgttgagaaaaaaggtaatcaatgacactaacttaatcagacgatcattgggtatgaaaactcaaaatgtccaaaacctataatttgtcactaatttattaaatttcatttgttgattggatttacttatttgattttaggctatattcaatttttggagatg

SEQ ID NO: 111934 - DNA, 486 bp, Heterodera glycines
  Promoter: Source sequence=SeqID_42519; Location=1..486; Strand=+; Gene=SeqID_70387
aaaaggcataataaaagtcaattgtagaagggaaaatgggtttttttatgctcaataatcggaactaatgcgcagaaaaaaggcatacacctcaaaagtgggtctctactaatttcataatccttaattattaaataatttaaaaaactaaacacattaaatgtaaaattttaatacgcatatttatttagcttgagtatttgttgaatttcgcaacaaatgttgtcaagcagttttgccaaactgaagctgcaagcgctgaccgcacacttttacccattgccaaacgtgactatttaatgcaaaaattaatacatattgctaacttttggcgttgggcacactgacaggaaaaacctgaaaatattttcccaaatcttctcggcggtgcctattagccttgcttaacccggcccaacctttttcgtttgcttcggcacctatcggcaccgccgaaccaccattttaccatatttttgaaaaatg

SEQ ID NO: 111935 - DNA, 171 bp, Heterodera glycines
  Promoter: Source sequence=SeqID_380; Location=1..171; Strand=+; Gene =SeqID_50799
gtccattccgatgtcaaaaactcaacaaatgtttcttccactcgctcttcattgctgcatttcgatcccatccctccgctgcatcgacaggtccttccttcccttttctttatcactttgccaattatttggttttgccggggactccaaattagttgtttatggacaatg

SEQ ID NO: 111936 - DNA, 60 bp, Heterodera glycines
  Promoter: Source sequence=SeqID_10008; Location=2006..2065; Strand=-; Gene=SeqID_73058
cgtgtgtacggagtggtgccgaagcacgtgggggagacgcgcagggaacggccgaaaatg

SEQ ID NO: 111937 - DNA, 553 bp, Heterodera glycines
  Promoter: Source sequence=SeqID_17170; Location=989..1541; Strand=-; Gene=SeqID_81612
cccccccccgctcattccgttgtccgttgccaaatttaattagtgctggcagatgctggaagccattggtcattaattaaacgaaaaattcatttctaattctgtttaaaatttcatttcactatatttgtatttcaaattgaaattttagagtattaatttattttaggtcccctttttggtcaaaaattttcatttctttttcttgctaaagtaacttaaaaactttattttgtgtttattgggattacagacattggcgccccaggcattttacgcctcgggaattttcgtcccaagcgaaaatcggacatctgcgccccggaaattaatttcttacaatcagaaatgcatatgaaaaaactgatcttgtgtgccaattcttgcttgatccaattgcatttttttgttgctttgaagcacttttgacaacaaaaagtgaaaaaatatgaaaattttaacccaaaaaggaccaaacttaaataccaattttaattttagataaaaaaatcgaatgtcggcttttacataaaaaaaaataaatttgaaaatg

SEQ ID NO: 111938 - DNA, 613 bp, Heterodera glycines
  Promoter: Source sequence=SeqID_20048; Location=1..613; Strand=+; Gene=SeqID_47627
aatcattaaaatttagtaaatttaacaactctcgtgcttaaaaatttatattttctttaaatttaaaaacctggcaatgttattatttcgtcaattcttagtgggtttaacgtagagttaaacatgtatttgtttctgtttggacttagtcctgaatacccagcttagttgggcccgaagtatcaagagtcccgtctaattctgtttaactcataaaatttcaagtctttgaacagaccgagcattgtaatgatagacaatacaaatgtatgacattgacaaagaatgaattgtaatgagtttagcaaaataagcatggttaaaattgaatcgattcataacttgtttcaatttaatatgctttaaattagatgtttgcaatttatagacaattaagaatatttttaattttagtccttaatttggtgcccaaacttccgcctcccttttcagccccccccctccccttattttttaataatttctatatatgcgtctttgaaacgagcgcaaattattaacaatgtaacttaaaacaattttcaaactaaagcaggaggacaaaggacaatcgacgcttaaaagccttccgactcgtcaatatttggacatg

SEQ ID NO: 111939 - DNA, 1003 bp, Heterodera glycines
  Promoter: Source sequence=SeqID_23207; Location=463..1465; Strand=+; Gene=SeqID_53912
atgataggctttttgtaagttagaaataaatatacttttggtatatttttgcttcattttgtttactcgtgggtgtggtccggtgggttgttctcttggttatgttcttcattttagcgttggatcagttccctccaagtaatttttttttcttctaatttttcaaaattattcctttttcgataggaattcaatcaaaattttaacatttaaaatcataaaatattgtcatttttggactaaatctattaacaaagtgcactaaaatttcaaattttccccagcggcgcctatcggcaccgccggccccccttgttccccaaaagttttttggaataagcgtgttttgaataaagttgtaaaaatgagcttttttgactcaaaatgaggcttttttgcataccaaatgaggcttttgaaacttttaatctgggagccctgtttttagcattttaattttgattcataatttttcagttgaataaatgcaattatttcaaacgtaatagtaatttttcataatttttaagaaataagaaaattttaaaaaaaagtaattcccctccaagtagttgtttttcttctaatttttcaaaattattcatttttcggtgggaattcaatcataattttaacaattaaattcgtaaaatattttcattttttggactaaatcagttaacaaattgcacttaaattttaatgaatttttgttttgtgcgtttttgaaatgataaatattgtaacaaattgaatcaaatttaaaaaaaaccaaaaattagttaagaatagagtcaaaaaaatatttttaacgatttttaagcgaataggaaaattttttgaaaaaagtctcgagtctcgggttttttgggtctcggtctcggggttttcggtctcggtctcggggtcgagtctcgggaaatttttggtctcgaactgcactataatcttctaatattaattgctgcccatttttgaacccactttccaatatatcacaatg

SEQ ID NO: 111940 - DNA, 387 bp, Heterodera glycines
  Promoter: Source sequence=SeqID_18940; Location=1377..1763; Strand=-; Gene=SeqID_83665
gaaacgcacaaaacgtacaaagtcattttttgaagggattgtcaggaggaaaaatttgaagaggcgaaaatggagaatgaataatgacgaaaagtggcagaggagcaaccacttttatactaatttttgttgttacaatttttcacgatttttataatcagtcgtatttcaaaacgcattgctataaaagccttctctcctctcccatttcctttcattcgctcatttttttctttccgttttgtttacgcaaaatatttccttacttttctcggtttttcttgttttaaaggaaaaattggttttacaaagttctttttctgtttttctaataagcaaatttaaatctgccgaaaactgtcttaataatttgccaccaacaaaatg

SEQ ID NO: 111941 - DNA, 834 bp, Heterodera glycines
  Promoter: Source sequence=SeqID_20683; Location=952..1785; Strand=-; Gene=SeqID_51243
cttcgaaatgagatctttgtattttccacaactattatttaccactcttacatagacagctactttttacatatattttttttattaatcttatttatatgattccaaaatagttattcgctttgcaaatatgaataaggacaatagcaattataatattttttaaaaaatctgtggtatttttcttattgctatattgtaatattttccttgtatacgatttttacaacttatgataaaaaataataaatttatctcatatcatcttttaaatttaattttttattctttatacatacaataacaatctaattagattttaatttgagacggttccattatctcacccaaattataatgtgtagatttttttctattttttcaaaatatgtgattgatgtaaaatttatattatttaaataataatggttttcaataaaataatgttcgatcccacttcgaacgagatgttgtttgagattatcattttcgtgtttacaatgacagtccacatttattttaaacaaagaaataattttaatgcatttttcatatttaaaaatgtatttttaaaatctttaatttgttaaaaatttaattaaatttatttatttttatgttggattcgaacccggacccccaaaattaggaatttaaccaactgagccaccaacttcatgtgaaaacacagccaaattttcgattttcgaggccctgtaacttttgaagcaggcggaatgcaccgctaaaattaaaaattcacaatacaagtcgaccccgctctatccaatggtatatagcttatatgcattttcccactcacagctcggaatg

SEQ ID NO: 111942 - DNA, 60 bp, Heterodera glycines
  Promoter: Source sequence=SeqID_9012; Location=2146..2205; Strand=-; Gene=SeqID_69990
cggataaattgttcgggacctggcttccggcccatgagctgaccagttctaccgatcatg

SEQ ID NO: 111943 - DNA, 722 bp, Heterodera glycines
  Promoter: Source sequence=SeqID_4032; Location=1324..2045; Strand=-; Gene=SeqID_52907
tctggatttttttgaaatttgtttcaataagcaaacaaaatgtttatgacctgtggacctgtggacaaaacccaggaaatccaagtccaggaaaaatccagcctggatcgaaggtcgaactctaattaaaaattggagccgaaaattttaaagaatttgataattataaaaaatagtaataaatgaattattaattaaatgttttttccacctcagaattgatgccactgactttcaattgccccattactatgaattctttaaccaaatccagctcaaatacagcaagaaattggtgatctgatcgggttttgaaaataattttcgccgctcgcccattgatccggaacaataaaaagaaagggaaaagtgatcagccacagctagccataaaacaaattgcagtcttaaatcagtccgtacatcgtaatactgatgaatgatgaagaaaaaactggaaaatcgaaagcgaattttattggcgcgccgatacaaaaaaaaaaaaaaaaaaattgaattttattaattttagtcgattttttcaattttcccaattaaaatgagacccaaatatgctttaatcaaggttctgaatacatagtttagatggaaaaaatagaaaaaaaactacgtgaatataaatttttcccgcagcccaattgaaaaaatatacaacagggatatttcgagaagaaaaataaattacgagacttgcaggcatg

SEQ ID NO: 111944 - DNA, 101 bp, Heterodera glycines
  Promoter: Source sequence=SeqID_3285; Location=722..822; Strand=-; Gene=SeqID_84069
ggtgacaaacacacacactaaaatgttataaatgtgtgcaactttcagtcatctccttgtggaccacctcagcagcgcgcctcgttctactcaaggcaatg

SEQ ID NO: 111945 - DNA, 108 bp, Heterodera glycines
  misc_feature (83)..(83): n is a, c, g, or t
  Promoter: Source sequence=SeqID_14533; Location=1..108; Strand=+; Gene=SeqID_78584
tctagagtcagacgccatttgagggacaatttacatttgcgcattcattgtggaccaaattacccgcgggaagcgccgatcgntcgctttaccactaaaatcaacatg

SEQ ID NO: 111946 - DNA, 619 bp, Heterodera glycines
  Promoter: Source sequence=SeqID_5147; Location=5339..5957; Strand=+; Gene=SeqID_57082
ttgtttgtacttttcttgtagaaatatgctcaggttggagtcactggctaaaaaattagtttcgtacaattatgaaccctctaagagttggttcaaaaacctagttactgtttatctagtgaaaaaaggtttttttgaatgggtcttaacaatccgttctaaatttattttctaacaggttatctgtttattttatttaaaattaattcttacgctaaaaaacgtcaagcatgaaacgccaaatataattaacataattttgccgctaattttaaatattgttcaatgcctttttatttactttgattactatcagccataactcgctcgcttcattcccatcgagatttacaattaggaaaaaggtcatttgattatcattttattagggaataacttttgttaaagctttgccgctccttaaaaatgattccgtcgatggtaccattgacttctctcactgagatgaatcgattgaattataaataaaaagttatctaaatcaaggtgtcaattattcttggcttttacctttttttacagctttcctaaacattaaataatcacgctaacatttcacgaatacaacttcagcattaaacagtgttgaattgaaatg

SEQ ID NO: 111947 - DNA, 1003 bp, Heterodera glycines
  Promoter: Source sequence=SeqID_2572; Location=3859..4861; Strand=+; Gene=SeqID_80464
actcatttcccactgacgcactttccgggagcccctagtgctattaatgattgggcatcggatttttaaagtcgaaaaagtccaaaataaggccctaaataagggcgcaaaaaccgaaataagggcaaaataaagtcgaaaagttcaaaatttagggggtataattttttaaattgctgtttttttatatgaaaataatttcaaattaagatacatttgaaaattttcgagggtaaaagacatacgattatcgaaccaaaatttgtttgtaaatgaaaaaagatttccacgtcacaagatgccaaaggagtaaaaaaaattttcgagatattttaatgtgttttttcatgtaaatgctgatttcctcgagcataaaccacaaaaaggtcgctaataattttctcaacagatatcttttccatgttcatatcattttttatttaattaaaaattctaagtttgtatttaaatataataatacaatttgataagaaaattaataaacatttttattgctttcaatacggatcaattgtttcttaattgttgaatttgaagtgaatgattaaattttttgagattttataggaatttagagccggctgtagagttgtttattggaaagcgagaagaaactaaaaaaatgtacgtagttcgtcctgagcctacaattcacttcgcatctcagatttgatttatattgtatttatttgtttgtaaatgaaaaaagatttccacgtcacaagatgccaaaggagtaaaaaaaattgtcgagattgaatttttaagaaccttttcatttcttatggatgtcctttttgtaaatgttagggtcgattcttagggctatattgttctcaattttttgggaaaatcttatatgttatttttcgtttttttattgcatttttgtcaataattcttaaaaacccagtctctaattgtcgggttcacttgctgtcgaaatcacgcatagaaagtgagaaaatgcgaaataactatg

SEQ ID NO: 111948 - DNA, 240 bp, Heterodera glycines
  Promoter: Source sequence=SeqID_28226; Location=285..524; Strand=+; Gene=SeqID_58867
ttccctcgccttcgattgtttattttcttgtggcccatcattttttggcagagtgtcccaaagtcaatcactcgggatgactttttcctcctctcccctcccgccctctccctccctttttccctcctccttaattaagaatttccgatcaaataattacttctttgtgtcactaattggccctcgggcgttaaacgacgactgacagagtaattaaatttttccgacgccaaaacaatg

SEQ ID NO: 111949 - DNA, 387 bp, Heterodera glycines
  Promoter: Source sequence=SeqID_16068; Location=1991..2377; Strand=-; Gene=SeqID_80427
ggtaatttgtccaaatgcaaatcactgcacaaatgtataaaaagccgttgttccgtatcggtaattaatcaatctcgagaaattttccatctgatgacaaatgatcagctcatctaattgagttggattttctataaatgattctttctgaccattttaatctcataatggttttttaatagaaaatatttgtgtctccttagccttaatttaacttttaaatttacagagttatttttgaatttatgaattgttttttagatcccggaaatttcaattttgcgaattccgctgcgggattggaattcaaaatttttgcgagaacgaatctcataggaatatcccgcaaaatcccacaatttccaaaaaaatgcgggttgcggaatg

SEQ ID NO: 111950 - DNA, 1003 bp, Heterodera glycines
  Promoter: Source sequence=SeqID_6675; Location=1115..2117; Strand=+; Gene=SeqID_62450
attaataataaaatattcatttattcttataaataatttaaaaaattattttttttcttaataaaattcatttttaatacaatttaatttactacctccatcttaacttttgattttattaaaacaaatgaatttatttatggttgaagaacttttctcaacatcataattaaattttttatttctattcgttaaaattaattacagtactccttaagcgggccaactaaataaataaattatcaaaagggaagggagcccaataaacaaataattaacggaattttccaaactttaaagttaaaggaaatgatggaccaaataattaaaataatatttataaattaaattaataattaaaaagatttatcaaattattattattatttctgaaataataattatattttttattttaaatttacaaataaattatttatttttctcataaaaatttttttataacagttttatttacctacatgattacttttgtacgattttattatttattttgaaaaattttctcattgtttattcgatttttccttgttttcattggcggtccgtcgttctcatctaacaaccttattcatttccctatttttttcaaatcaataaggttctttattctttgccattttcggctgattgtcaaaacttaacccaccaaaacaaatgaaccgaattcgaaaagcatcgacagtacacagcagaaatgaatcaaaaattccggtgttgaaccctaaagccgatgtttgtaaaagagcaaattaaaatgagtcatttctcggtcttataacctcaaaagcaaaactttgtttatgtagcagcaaacatgttcaagggggagtacatcatgtgcatggaaccgcgggtgaataggaaacataattttgaattaccggatttttaggagtacaccccaaatctcaccggcgaatttttttaaataattaaacttattattataaaatttttttcaagaaataaagttgaaatg

SEQ ID NO: 111951 - DNA, 605 bp, Heterodera glycines
  Promoter: Source sequence=SeqID_25218; Location=1..605; Strand=+; Gene=SeqID_55961
tttttatgtttagaaaatacatcaattttctgatgttgataaaaagaataggaagggaaaggtagcaaaatgttgtataagaaatgtcatttttaaattttaatttaggctattgctaaaatgataatgtcacccaaattttcgacaattttaaggccggaaagaaaaacatatcgaaccacaaacaaaagatgttgatgaacaaaatgatcaaatgagtaaaaatattttagcattaataactaattttcaaaattaatttcaccgaggcaacaaattaatcttataaaattttttttagacagaattaaacagaatattcaccaaaaaaaattttttaaataatttttaaatttaggaaactttaaaaaaaattattccacaatttaatatttttatacggaatagaaaacatagcgattttcgtgagaagaataaagggaaaaacttaagaagagtaattaaaaatatagttattaatgcgaattttaccaatgaatttaataaaaatgttgcaaaatttaaattaattttatttataattaattaagaattttaagagaaaaatattttatctttttaagataaagcaaaagtgcccgatg

SEQ ID NO: 111952 - DNA, 112 bp, Heterodera glycines
  Promoter: Source sequence=SeqID_10146; Location=2429..2540; Strand=-; Gene=SeqID_46841
tccgttgtaaagacgccgcctcacgaccgcctatttgtgttaaatatccgattttgggttgtcacgacatttgcattggtcgaaggattactacataggccattccaaaatg

SEQ ID NO: 111953 - DNA, 249 bp, Heterodera glycines
  Promoter: Source sequence=SeqID_35783; Location=757..1005; Strand=-; Gene=SeqID_65253
cgctttttataattcctacctttctgaccgatgccctatgagtttcacttacaaattattttacacccgctccttttgcactcaattattgatcaaacaatttcattttccaattggatttaaaatgttcgccattcactctgtaaaagagagagatagagagagcgagagagaacataaactaataacacgagacaaacctgatatatttaaataacatattttcagttttttttaacattaaatatg

SEQ ID NO: 111954 - DNA, 175 bp, Heterodera glycines
  Promoter: Source sequence=SeqID_43629; Location=1310..1484; Strand=-; Gene=SeqID_71259
ttttgcattttttgttgttgcataatttagggattaacttagatgatcaataactgaaagattgtttccccaaactatgtttttgatggcgtgaatttacatcaaacaaatttctttttgcattctttcttatttttcccaaatcattttccccaaaaaattaaaattattaatg

SEQ ID NO: 111955 - DNA, 158 bp, Heterodera glycines
  Promoter: Source sequence=SeqID_17617; Location=1..158; Strand=+; Gene=SeqID_82128
gagaattggacatgtacgatgacgtccgattggtggagccgcaacttggtaagcgaattgggggagggaaggggggggggggattggcggatcagcgaaagggctaatcggagtgattgaagagcagccactgttcatccccgagatttatcgcaatg

SEQ ID NO: 111956 - DNA, 769 bp, Heterodera glycines
  Promoter: Source sequence=SeqID_13271; Location=1792..2560; Strand=-; Gene=SeqID_77105
attttgaaaattttcggtttttttaataagatttacaaatttttgggccaggcaatgccggaaggcagcgccaggtgaattttaaaattcagctctattttcgaacgggttttaacaacaaaaatttttgaatttccgataatttttgttattcttcgatatttggtcaaaaatattttgaaagatattaaattttcatgatttcgtcaaagaaaattgaattttttaatttcaacgaaaagaaaattttaaaaaaaaaatttgggttaatttgttaacatattatgccaaggatgatcgtttttatgggcatttttgtttaacattactttatttaataaaaatttggcaaaatgtttaaaaaattcaaattttttataaattttttttgccttttctccaacgaaaatgccatgtcttaatcctgtaaaatcccgaaaataaatttgcaaaatgccaaaataggtgtcttaatcctgtaaaatcccgaaaataaatttgcaaaatgccaaaatacgtttcttaatcctgtaaaatcccgaaaataaattttcaaaatgccaaaataggtgtcttaatcctgtaaaatcccgaaaataaatttgcaaaatgccaaaatacgtttcttaatcctgtaaaatcccgaaaataaattttcaaaatgccaaaataggtttctaaataatatttagggagtaagcaatcattggagttcaaatttttgacaaaatggggatgtacggagaaaaaactcaatgaatttcgcatg

SEQ ID NO: 111957 - DNA, 294 bp, Heterodera glycines; identical to SEQ ID NO: 99762
  Promoter: Source sequence=SeqID_22052; Location=804..1097; Strand=-; Gene=SeqID_52690

SEQ ID NO: 111958 - DNA, 242 bp, Heterodera glycines
  Promoter: Source sequence=SeqID_24379; Location=66..307; Strand=+; Gene=SeqID_55109
ttgctgtttaatcacgaatctgccttctatgtcaacaaattccaactccctccaaaagggtacccctcttagaagaaattttttagagggccccaaaatatgtttagtttacggagtttgcactaataaggtgcatatgcattttggaatttagaaaatcaagaatggccagcaaaaacaacaacaaaaaataaataaataggtaaatatttttttggcgaaattaatgatcaacaactatg

SEQ ID NO: 111959 - DNA, 581 bp, Heterodera glycines
  Promoter: Source sequence=SeqID_11246; Location=1228..1808; Strand=+; Gene=SeqID_74611
gctgaaattaataaggtaagaaacaaataatgaaatggagagttagttgaacgcgcctcattttggcgttggcgttgtcgcgcgttgtcgggcgctctgtcggcggacataataacaaataatgtgaatgaatgactgtaaacgaaaattcccctctttatatacacattttctcttccaaatcgacacaataacttcactatgggtcaactccactgtgcagagaaaagcctagtactatctcgtcgtttctctttttctttgtaatttctcttactttggcatactatctcttcattttaattatgtaaaaaagagaaattaatctgatgctaatatcttttttttaatgctaccaatccttttcaaacttttggggccgttttattagaggttttttggaaaaatgccaaaatatgcacataaaatatgcacgaaattccaaaatatgcacataaatcgcgaaatatgcacaaatatgcaaaatatgcatatggaaatacagtctagaagcttcaaaagaagctaaaaacatgtttttcgtgcgtttcaggcctcccacagtctaggaaaaaaatatg

SEQ ID NO: 111960 - DNA, 478 bp, Heterodera glycines
  Promoter: Source sequence=SeqID_4383; Location=1..478; Strand=+; Gene= SeqID_54240
cccccccccccccttatagtccaaattgatccctcaaatgcccttttcccaatggtacccctatgatccccttcccctcctccttcccctccggtcattgaaaggctctctctttctgttaaaagatggcaagggcaagcagtacaggcacagagagaggtacacgtgcacccgcaatgcacccaaatcattcaaatatataatccccagctgtaattgatgacgaaaaaaaacaacaaattaattggggtgggcggggaatgaatggtgttccttccccttcccccagaaagctatttaaatgccaatttttcacagcagaaccataaagaacggcaaaaaataaatttttaggtattttagcaataagaaatttatttaaatcaatgcatttttaaaaaacaattaaatcattattctatttttaattattttcagttttcctaatattaacaattaataattattagcacaaatg

SEQ ID NO: 111961 - DNA, 215 bp, Heterodera glycines
  Promoter: Source sequence=SeqID_21087; Location=1..215; Strand=+; Gene=SeqID_51674
caattggaagagtgcatgtcgccattgaatacgtgccgacttcggggattcgcttttggatcaaaaggacatggtccgaatttcactatttttccaaaaaattacgttgttttatgcactcaaaagcactttttaggagtcgcattgtctgttcttgtccggccgatcgttctcaaattgtgttggcatttctcaaaagggtaaccaaacacatg

SEQ ID NO: 111962 - DNA, 246 bp, Heterodera glycines
  Promoter: Source sequence=SeqID_10490; Location=2120..2365; Strand=-; Gene=SeqID_73703
ctttgccgtctttctggaaactttaaatttctgggggttatttttctaaccaatgtttccaaaaaatcatggggtattcaagagttttcccgtttctttgaaaatttctctataatgatatagtctattgtccataaatcggctgtcaatttcccattttttcatattttagtttggacgatgccaacggctgtcagaggggcggcttaggacgcggaaacggcggcggcgccgatttggaggatg

SEQ ID NO: 111963 - DNA, 211 bp, Heterodera glycines
  Promoter: Source sequence=SeqID_43801; Location=805..1015; Strand=-; Gene=SeqID_71385
acactacgtaaacattcatttataaataattttatgatttatcgtgaaacattctgtcagattaaatatatattcgtaataatcacattttttcaccccaagaaataaattaatgggaaatgctttcttacgaccaattctcacccctcaagttcttgaagtcattgtgtaaattctcgcattggaaggcgaagttggacgtgccgccatg

SEQ ID NO: 111964 - DNA, 905 bp, Heterodera glycines
  Promoter: Source sequence=SeqID_4944; Location=3887..4791; Strand=-; Gene=SeqID_56310
tcgctttactcggtgtttactgtccctgcacatatttgcggtgtttgcctctttttgccccccccccgccccaattgactgatgaaagatgagttcccaccgtttcttaacgttaacatttactgtcaatcattgactgttaggttttcactgctcacagaagggatggggcggttggcaatgaaaatgaaggttaaataccatgtgacaccaaaacggaatgaatgatatcgctgttattattttgggataaaatgggggaatgaatgaatggccatcagttgaaattggggagattagtacaacgattttcagttagtgagggaaacggagggaaaaggcggagccgaggggagaggggacactgccaaagagcagtgagtaagcagagagagagaaagagttatttacgagtcaattaaattcattatttgttatgatcggacacgtcgagcaatttaatgagcgaccgttgttttggacataagaatcccttttctcggtcttttgatcagtgccaactaacaattcgtcattttctcattgctccctttggttgttccatctcattttattaattgttattatggccacaccttctccatcaatcgttgggtttaggaataaagttaaggacaccactcctcggtttgcccccccccccccctccagcagcagtgtgctgtcaactgtcatcaatgacatttgtctttcttccctgtgaagggacttctcccggggaacccccgccccctccgttttcccttttggggcgggaggtcccaccgatcaaagacttcccccccactcatttgtcagtggtgctttttatcagcagcagattttcacctcattgaccattttaacatcatttcagtgaactgtcacatcactcctttccgatg

SEQ ID NO: 111965 - DNA, 221 bp, Heterodera glycines
  Promoter: Source sequence=SeqID_2418; Location=74..294; Strand=+; Gene=SeqID_79612
ggtttgaacacggaaaacattttagtaaaaaagaaaccgcacaaaattgaattagatccaattattcatcgggtcacaatgtaccaaaatccgtttgtcatttagaaattcatactattcgaaccattgttgcaaattaaaaatatattgtatgccaatgtaaggtccaacacgtgtcgaacatttcctcgcatccgtacggttcggtttggctgaacatg

SEQ ID NO: 111966 - DNA, 129 bp, Heterodera glycines
  Promoter: Source sequence=SeqID_1449; Location=667..795; Strand=-; Gene=SeqID_73626
accaagttacgctcatcatcggacccttatcgtttaataatgtattcggttgcataaattcattagcagccttcgtaatagtaggtatcttatcgttagtatagtttacaggtaaatacgaaaaggatg

SEQ ID NO: 111967 - DNA, 111 bp, Heterodera glycines
  Promoter: Source sequence=SeqID_9836; Location=1156..1266; Strand=-; Gene=SeqID_72855
aatttttgataatcaattttcatttttgattcttttttgcataataaattataattctcttaaaattaggtttgaaattacattaattgttttcccatttgctaggccatg

SEQ ID NO: 111968 - DNA, 544 bp, Heterodera glycines
  Promoter: Source sequence=SeqID_43486; Location=1..544; Strand=+; Gene=SeqID_71134
gagtgtgtgtgaatttgcaaaatggtgggttactttggttatccatctctccccttctccccccccccccccttcttttgtgtacctttcgttcgttcgcttaatcaatttttatcttctgtgaagggatgactcactctcatcgttcgcatttgtcacattttatttttccgagtttactctttaaaaaatgtgcagcttatttttcattgtcagaatagcaatttaggtaaaccatcaaagtaagtgatgaatgactgtacagagaattcggaaacggcactccaacaacaattattattatcagaaaatattcaacagaaagagaaaaaccaattccaaagccgaggaaatcactgccaaacaattttcacaataaatcaacttttatcacgactaaatacgatttggataagagcaatttggtcccaattcacaatcagccaattcaaatagccaataccaacagaaacaccacttaataactcccacccggccactttcgccacctccgttaccgccgcggccttcgctttccggcatg

SEQ ID NO: 111969 - DNA, 1003 bp, Heterodera glycines
  Promoter: Source sequence=SeqID_1232; Location=3738..4740; Strand=+; Gene=SeqID_70318
acacgtcagcggacaatccgtcagtaatagacaatctgtcagatgtccttaaaataatttgatgtccccaagtcgcaaatccccaaatgttaggtagccgagtgggtcagcatcattgatttttcgataaattctgaatttttttgttcataaattggagacgagaccagttataaaatacaaaattttaattttataaatatgctttttttattttttaagaaaatgattttagatccgcccaaaaatcttttttggctcggatttcgggattttcatttcgaactagggattagctctaatatcactgcttagtacatacaaatcccctttctcgtcaacagacattggcaccgttcggtccattggcgtggcaaatttcgactcagaccatgtcgaacacttagtcaagaacggcatacattgtgtgccggccgttgtccaatgcgaaatgcatccattcctacagcgtgacgatctgcttgattactgtaaatccgcagggattttcctgcaggtggtcaaatttggaaaaataatctaaaaagtcggaagggtcagtgaaaaatgcaccagggaatcagataattttctaacaaaatttcagacgaattttttcaaattaaattgttaagccaatttgtgttttaaaaatttaccttgcggcacaaatttgcacgaagggcacaaaagccccttaaattttttctaactataacctaaatacttaaaatttcgccaattggatttgaattgtgagtgtctgtttctcatgtttgtggatatggtgctagatggtcctagaaaagtttctcattggggcgagccaggggacaaataaattagaaaatcttttctctattaattgttaacttttaaaggcccacagcatttttgcatacaaagaacaaaaaccttcctacctaaagcaacaccagcgctatttgctgctgaaaagcatagcatcattttacaaaattggcacatcggtgagtgatggatg

SEQ ID NO: 111970 - DNA, 702 bp, Heterodera glycines
  Promoter: Source sequence=SeqID_19538; Location=770..1471; Strand=-; Gene=SeqID_84269
tttttcttaccttcaaattttaataaaaaagaacgatttatacaaattatgtgcatttaaattttacgaaaattccctttcgaataacatggattaatgtatatttttatgaataggccttcacaaaggaatatattattacatgaatgaaaccatttattcttggatttggccaacataaaaaattgttattatacattttgttaaatttgtctaacatataagcagttggcccactctgcgccaggcccaatgggctctgtctttcatatcacattgtacagacggttccaggaaaatgcgtcaatgaaattttagtgtgataaaaaaacaaatccttgggctttggaggtcactgaccacaaatccggtatccatttctgccaattccgaaccacggacccgaattcgaacaaaaaagtcgataatccaaattattaaattttgagtttttggtttaaaaaatgcgtaaatgttttcatattgaaggattgattgatggcctttcagtttacttccatgtgttccatgtgtttaaatcgattttggaccaaaaattcaatttcggatatttagactttcgactttttttcgatttcgggtccggggttcggaatttagaacaatgttattatagaattttacttttatattacaatacttaatgctacagaactttcttttaacttatttgtatcaatg

SEQ ID NO: 111971 - DNA, 519 bp, Heterodera glycines
  Promoter: Source sequence=SeqID_38207; Location=1..519; Strand=+; Gene=SeqID_67096
atttagctgggataaagcgcttcgcgcttcttgagcttcgctacctagataagctattgggttgtgaagtaatttggaatttttaaaaaattttcagggatttttaggccggtttgcggcccaaataaaaaattataaaaaaaagatcaaccaagaaattatgaatattgaaatttatataaagtaattaagagagttcaattatcataaacagaatgctaatagtttaattaaatatttattttatttaaaaagagtgcaattataattagttaaaaaatttctctcataaagaaaaaaatgcatgcttaaaactagggccgcgatttcatgttcacattattcgttttaattgcatttttaattttcaaatttggtcaaagtgaaatagaaaataaaaaattgctacaaaaaacttttgatgaaatatctggagaaaatgggaagaaattggagaagaaaaacaaatgatgaacaaaaagttcgaaattgtttaaaaattcatcgaaatgacaaatg

SEQ ID NO: 111972 - DNA, 375 bp, Heterodera glycines
  Promoter: Source sequence=SeqID_44768; Location=1..375; Strand=+; Gene=SeqID_72200
cccccccccccccccccccctcgcctcacgcatcattttcctccaattctcattctcagcgccaccacatcccgccaatatttcaccccatccattcattcattcttcgtacaaaacagcagtacggccattgcttgtgtcccctccgccatcaccatttccttggcttcgcaatttttgcttcaccttcaaattttgaaaaattttacaaaattggactgtttttttattgcatcataaaaatcattgtttctgtgcacaaattgttgttattttgttcagcaaatgcaataaattacaggctttttggccgatgaataatttattttgttcaaatttttcttgaattttctaaattttagaggaagaaatatg

SEQ ID NO: 111973 - DNA, 619 bp, Heterodera glycines
  Promoter: Source sequence=SeqID_5147; Location=5337..5955; Strand=-; Gene=SeqID_45990
tttcaattcaacactgtttaatgctgaagttgtattcgtgaaatgttagcgtgattatttaatgtttaggaaagctgtaaaaaaaggtaaaagccaagaataattgacaccttgatttagataactttttatttataattcaatcgattcatctcagtgagagaagtcaatggtaccatcgacggaatcatttttaaggagcggcaaagctttaacaaaagttattccctaataaaatgataatcaaatgacctttttcctaattgtaaatctcgatgggaatgaagcgagcgagttatggctgatagtaatcaaagtaaataaaaaggcattgaacaatatttaaaattagcggcaaaattatgttaattatatttggcgtttcatgcttgacgttttttagcgtaagaattaattttaaataaaataaacagataacctgttagaaaataaatttagaacggattgttaagacccattcaaaaaaaccttttttcactagataaacagtaactaggtttttgaaccaactcttagagggttcataattgtacgaaactaattttttagccagtgactccaacctgagcatatttctacaagaaaagtacaaacaatg

SEQ ID NO: 111974 - DNA, 132 bp, Heterodera glycines
  Promoter: Source sequence=SeqID_25540; Location=261..392; Strand=+; Gene=SeqID_56280
tttggggacacttgttgggccttcaacattatattagggggtggtaaaaaacgatgaatctgagcccaattcaacaaatccaaattcgtcggaattgacaattgccccgtcgtaccccttttttctacaatg

SEQ ID NO: 111975 - DNA, 274 bp, Heterodera glycines
  Promoter: Source sequence=SeqID_245; Location=634..907; Strand=+; Gene=SeqID_79587
taacaatgcgactgaatgaaacacaaaagaatgagtgaaccaattaacaacgtaattaattaatgaggtgtcaacagaataatgacggaaaaacaaaaacaacaactcactattctctggtgagcattgttgctgaagtgcagtccaaaaaaagagggaaaatgaacaatgaatgattgtttctgtccgtaaaccatcccttttatactacacactttgcacgtcgtcattgctcagcagcgacaaaaatgaattgtcatacctagtagggatg

SEQ ID NO: 111976 - DNA, 287 bp, Heterodera glycines
  Promoter: Source sequence=SeqID_5809; Location=1..287; Strand=+; Gene= SeqID_59302
cgccaaatttcaaatgctctctcaatgagtatttggccgctgttgtggcttataacggtttttatttcaatgttccagtgaaaacaatcgcaaaaattgtattgagtttgatttttgctgttctgtcctcccaaaatttgtccacaaaacagcagcagaattctaatgagacaatttttgatggcattttgacatttgaccatttttcggtgatccgtccaaatgaatttgaatttggcgccgaagaattggcgggaaatttgaaaattgaatttaacgaaacgatg

SEQ ID NO: 111977 - DNA, 421 bp, Heterodera glycines
  misc_feature (13)..(13): n is a, c, g, or t
  misc_feature (68)..(68): n is a, c, g, or t
  misc_feature (74)..(74): n is a, c, g, or t
  misc_feature (88)..(88): n is a, c, g, or t
  Promoter: Source sequence=SeqID_12253; Location=3463..3883; Strand=-; Gene=SeqID_75841
gagaagccctttnttaattcgtgtaattttggagaaactcaagaaatttaaattttccattattaatntaattnttataaatttcacnaataaatttatcaaacggcacttattgaatttaaataaattatgtctttaaattatttttgtcaattttatatcgaataaatcgagcaagaaaatcaaaattaattataactcttttaaatgcattctatcaagaccattaattttaatttatatattgaaaagttaaattaataattaaaatttataaattcttgctttcctcatatttttttttgatttataaatctcaaatttcatttctattattaagttaaatgaccgcactgaaagcttgttcatctttccaagcacatgcattgccgcctaccgaactgaagaggaacaaccgatg

SEQ ID NO: 111978 - DNA, 471 bp, Heterodera glycines
  Promoter: Source sequence=SeqID_8923; Location=1..471; Strand=+; Gene= SeqID_69653
tcccgttgatcaagagggaagtcgatctgctgataaagaatctgctcaaggccgactgattgaagctttacaggcgattctcgcataaattatttatattttcttctttcctgtccttccttttggcatctgtgaagaactgtccttttaccccattaaaagcttaggcccatttttggcacatgaaattactaagtcacggaaaccaaatcaaaaattggcaaaagtttgttgttctcttactatcgtgtctaaatctgaaactccatgtaaattttcttttatacattcactctctttttctgactgatcatcgtttatttcattttttgtttgaatgatcatcttttctctccgtgaactattggataaaggaagttgttgatttgttgagaaatttcattcgtgtaacgattaaatattcgctttcgttaggtttcgtctcatataatttcttttgaatgcccaatg

SEQ ID NO: 111979 - DNA, 130 bp, Heterodera glycines
  Promoter: Source sequence=SeqID_37892; Location=264..393; Strand=+; Gene=SeqID_66869
agtaaacttagttttccaattttaatttcgcaatccaaattgcgaagggtttcggcaaactttgatggaaacgggcgattcgcttctgattgtgtgcgaccggcgcgaccccgagttgggcattggcatg

SEQ ID NO: 111980 - DNA, 184 bp, Heterodera glycines
  Promoter: Source sequence=SeqID_1939; Location=910..1093; Strand=+; Gene=SeqID_76924
agtaaagaaaattctaactttttttttctaaaaatgttcttaaactgcagcttcccactcccgggtgctacacaaaattttggccgggacaaacaacgctgaatctttttgaaaaaaaatcaaaaaatttttcatgaaaatcttaaaaaatttttcgcgagttttagaataaaatttactaatg

SEQ ID NO: 111981 - DNA, 265 bp, Heterodera glycines
  Promoter: Source sequence=SeqID_11844; Location=1663..1927; Strand=+; Gene=SeqID_75348
agtttttataataatatcacaaataaagtctggtaaaaaaatttgtgagccccggactataacttttttctttgtcaaccaaatccaacattgttttatcattcattcgattgcactaacaaataagtgtcgaaaatatggtttgatgtatttttggccataagtttgttttatcttaacaaaattttttgaagtttttgcacgctaatagaggaaacttagggctattgaataataccaatattgtaggatttggtctacaatg

SEQ ID NO: 111982 - DNA, 92 bp, Heterodera glycines
  Promoter: Source sequence=SeqID_16337; Location=2731..2822; Strand=-; Gene=SeqID_80726
cgaccggctcaccacccagaggatcggccgcttgtctttctaacatcattggacgcaaagtgcgcaccacctacaaccatcgtaatgggatg

SEQ ID NO: 111983 - DNA, 1003 bp, Heterodera glycines
  Promoter: Source sequence=SeqID_491; Location=172..1174; Strand=+; Gene=SeqID_54227
tctagtaatttctgtttatcttattctttatttataaaataaaaaaagcgctgacccacaaaatgtccagcccacgaaatgtccaagtctcgaatttgagttttttattattcagatgggcctaaggttaggcaaggggtaatataaagggtatattcgtattcagagaccccgaaaaccctaaaaatcctaaattagactcattttgtttttataaattttgggcatttcgtggcttggacactttgtgggggtgccaaaaaaagattattattacatatattatcaatttgacaaaaagaaagagacaggaaggagacaaagttgagagaaatgagatttggatgaaaaacgttattaataaaactctatcaaaatttattttaaattatctgaaaaacgccccgagccggcgcctagcactcgtatgttattattattcaatttttttaaatttaaattttagcgttttaaataaaaatttgttgacggattgtccattggcgtaatgtccgtgcccctccccccactttccatgtcccttttgactttgtttacgttttccgcctctctctctctctcttttgctcaatgattcgctcgctctgttttctctctgtgtttccatttcattcgctttctttcccgaacattctcagcaaatggagtgccatggagaagcatttcatgcggcaataaatacgcaaaattttcgggctgttcaattaaagcttctctgcagttaaatctgaacatcccaaactgatttatgctcctctccccatttccgattacttttccgtgattttttctctttttcccactttttccatttgatttttagtttcccaactgatccgattaaacatttctctttatttacaattagcaatggttttcctgtcaaaattctcccctaattcaattcaaaaacaataattctcccgttgtttttcagcatttaaattcaaatctttcaaccaattctcttttcgtcaaaatg

SEQ ID NO: 111984 - DNA, 382 bp, Heterodera glycines
  Promoter: Source sequence=SeqID_3985; Location=80..461; Strand=+; Gene=SeqID_52700
tctcgttcaattctaagttgcaccaaaattcattttatttttgaggattcacaccgaaaacttcaaaaaataaacattgaaaaaatgaatttcgatgtaaaaagacaaaaaaaaaaaacgaataaatgtttaaaaacatcatttatttaataaattttcagtgacaaatttgtacttttcagtatttatttatgtcgggcctacctgattatatttctgtcgtgtcggacaaatgttggcttttgctcaaaaatatgagcatctttcaccttttttgtgtaattttagatttttttaaataccaaaattttttacttctaacggtcgcttcacaaatccgctctcaacattcgcaacaaaggcacaactgaagaaaaaaatg

SEQ ID NO: 111985 - DNA, 220 bp, Heterodera glycines
  misc_feature (56)..(56): n is a, c, g, or t
  Promoter: Source sequence=SeqID_9686; Location=1..220; Strand=+; Gene= SeqID_72348
cgccgctttctttctcaaaagtgtccggaaatgtacattacgtattgccgaggtgngcatgttggtaaaaatgttgctaccgtttaccacccattcttcccagctgtactccgaagaacagttcaagacgtacatgcacgaggcgggcgatgcgatccgcgactgtgcgttgggttgcgccgggtggcggttcaattacgacggtgtgtcaccgaacatg

SEQ ID NO: 111986 - DNA, 594 bp, Heterodera glycines
  Promoter: Source sequence=SeqID_16709; Location=188..781; Strand=+; Gene=SeqID_81111
tatcattgttgatttgaattattttggcgttttgttttagtttttgtgaccctttattttattttgttttgtttggagtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgtggcgctcctgtacaaaaggtggctcagcagtggcaataaacgacaaatttggacgagcaacaacgattttaaaaggaaaagtaaatccttctgcaatttgtaacaggaaaagcaaatcctggtctctggaaaagggaaacaaatccctactgaatttcttcattggttgtggaccacaaaatcagtaaaacgggaaaactaaatccctcttcatatcaaaaaaaaaaaaaacgcagcttcgaaaaggaaaagccgtaaagtgtgaaacaaatcacgaaaatttgtcagttcggtaaattaactccgtctacaaaactgacttcaaaaccgggaaacgaaaatcccatttcaacatg

SEQ ID NO: 111987 - DNA, 168 bp, Heterodera glycines
  Promoter: Source sequence=SeqID_19732; Location=1..168; Strand=+; Gene=SeqID_84474
gtcccttcatgttctactttgaaatgaaagtcaccaaattggggaaggtaaaatgacatttattaactaattaaattcacaaaattcgcataaaattattgtttttggcattttttatatttacatttttatagttttgcctcgattggattcgccaccaaagaaatg

SEQ ID NO: 111988 - DNA, 296 bp, Heterodera glycines
  Promoter: Source sequence=SeqID_26534; Location=1..296; Strand=+; Gene=SeqID_57272
tttttcaaataatttttaattttaataaataatcccagaaaaatgctattttttttttggagaaaattttaatgcaacaaacgctctcgaacatgaaagaaagggcggtgcgccgtggccattttatttttcaaataatttttaaatttaatagatattccagaaaaatggctatctctttttttgagaaattttctatgcaacaaacgctctcgaacatgaaacgaagtgcggtgcgccgtggccattttatttttcaaataatttttaaatttaatacatattccagaaaaatg

SEQ ID NO: 111989 - DNA, 421 bp, Heterodera glycines
  Promoter: Source sequence=SeqID_11246; Location=3183..3603; Strand=+; Gene=SeqID_74612
tacacttccacagttgctcaagtcggcgccaaactgaatggagcgcctcgtcacctttaaattcagattaatgggatagaaaacatttttcaccacaaccctgttcatctaaaaggccaagaaatttgtgctcgcgagcgaagggaacaaaatggctcaacaaaagatgtgccttgggcttctttgagagaaacacgcgcattcgctcctgggcagacaaaaaagatttaaaatcgttgacacgctcctctagctcatccaggtcattcggtgacaatgggctctggcctaaatttcataatttagtttgagaaagaagaaaaaagggacttttgaaaatttttggattttcccgaggtgcacaagggttctctgcaaattgaaaaattttcgaaaatttgttcccccaaccagaaaaatg

SEQ ID NO: 111990 - DNA, 112 bp, Heterodera glycines
  Promoter: Source sequence=SeqID_34096; Location=1..112; Strand=+; Gene=SeqID_46378
tagagtcggttaggtaaaaaattaggaaaaaactgacattttgaaggcattttgttgaaatgtttacccatttttatgctcttatcttttaatatagcttggtgaactgatg

SEQ ID NO: 111991 - DNA, 412 bp, Heterodera glycines
  Promoter: Source sequence=SeqID_23213; Location=695..1106; Strand=+; Gene=SeqID_53933
agttcgtacggcacatttacagaaatgacaaggctgtcgagaatccgaggagtctatggatgagaatttcaagccttagatctctccctctttttttctttctctctctctcgccctctttctctctctatctttctctctctccctctttctccatttttctttctctctctctatctcctctttctctcctccccctctttcgctctctctctctcactctccctctcgcactctctcctctactcttttctattctcgacttatgctcccaaaaattctcgactgtaaaactcacgggatcacaggtttggctgctgcccggacggcaaaacgcatgcccaaggcgcgaacaatgagggctgcggctgtgagtacgcgcagtacgggtgctgcccggacgggcacaatg

SEQ ID NO: 111992 - DNA, 210 bp, Heterodera glycines
  Promoter: Source sequence=SeqID_11001; Location=1..210; Strand=+; Gene=SeqID_74319
gacacagtgcaaccgcagctgctgatcggaatacggcgattttgggacttcgtacaaggatttcggaagacggcggaggggacttatctgatcgacaccgtcttcggcactgtgatttgcggggagcagtttcagaccacgacgggagttactcccgattcgtcggtattcgcgatccccccatgtggggaggacgagcgggatcaaatg

SEQ ID NO: 111993 - DNA, 472 bp, Heterodera glycines
  misc_feature (56)..(56): n is a, c, g, or t
  Promoter: Source sequence=SeqID_19293; Location=1..472; Strand=+; Gene=SeqID_47576
tgcaaaaaaaaaaaattcttcccatactctcttatttttctatagaagtatcattntaaattaaattattataattaattgattattatttgttaattagcagctaattattaaataaaattagtcacaatttcaagtctatctgtcgtcaatccccaatcgttcattcatttttagaattattattattttttggcctatatacgtcattgaatgcatactgatcaactgcaaagagaacatcatcaataatttgctgattggaaagggaaaaagtgtcaaattaattgctcttctatcaacgcaattcttgtccatttgtaacaatttttgaggtaatagaaaccatttcattgattgcctttagtcttttttgacaattgcaatttttttcgcttttagtaccgaacatttcctcgcccccatcttcgcatcattcgttcattcttcgaatttttttactgagtgaatg

SEQ ID NO: 111994 - DNA, 211 bp, Heterodera glycines
  Promoter: Source sequence=SeqID_29680; Location=1008..1218; Strand=-; Gene=SeqID_60146
atatgagcagcgggttgccgagctgaattcggtcctttgggtcctttttgaaaatttatgtcgatgttctaatttcattaaaaatttaaatttcccgtgcggcattggcaaaaagggttttcagttcctgattttttatacaattcactcgtgtttttaggcgcaaaatagaaaaaactgaccatattaattaattttttaggccgggatg

SEQ ID NO: 111995 - DNA, 111 bp, Heterodera glycines
  Promoter: Source sequence=SeqID_9260; Location=1..111; Strand=+; Gene= SeqID_70783
ttatattatataagcccattaaacaatagggaattttcttgaaatgtccagctgtgcgctgtacgtcgtttgcacacctctgttttgcgacgttcgattgctgtgccaatg

SEQ ID NO: 111996 - DNA, 1003 bp, Heterodera glycines
  Promoter: Source sequence=SeqID_16403; Location=47..1049; Strand=+; Gene=SeqID_80801
ttgagccatagaatttccgcattttcgtctgggattttttttgaaattacatttttgaccgcactgtttgtttgtgctgtttaacaattacttaataatcacaaaacagactccccccacccctcccatttattcacgcttgcataatttatttttgttccgccatttttgtttattgattagcggagcttttttgggttaaattcctattaataattttttttcattccgttttactttttttcaccgaaattgaccttttttatagtaggcacagtttttcaaaaaatttactgaatttaatttcgccattacaattttcattactcaaaccaattatcttttttttgaagaatttgtttaaaaatgtcaaaaattgagagtgtataggcaggcccgtaaccagttaggggccggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatcagagcaaaaaaagttcgaattactgggtttttgagttcattctggccataacttttttgaaacttaacgaaaatttttgagattttgcaaattaataataaacacatagagctatcgaacaacaccaacaattcttaatttgattgacattgaacaaagttatggttcaaaaagtcttccgacgacgtttcggccgacgacgttttggggtgcaccggttaggggcaactaaacgccgctggatgccaattttccatatgttttcaaaaatcaggtctcaaaatggccaaaatttcctttttttttccagtcgccgccgaaaatttaggtcaaaattacactggaaaaatttttggaccgaagagccaaaaaaaagccacatcacaagctgttttgcaagaaaattgtatcaatttgaatg

SEQ ID NO: 111997 - DNA, 483 bp, Heterodera glycines
  Promoter: Source sequence=SeqID_6635; Location=4545..5027; Strand=-; Gene=SeqID_62280
aaaaaattcaaattatttattaatttctaataattataatttaaataaaaatttataataaagggattcacccatttttatgtagaaaaagacaatttttttttgtaactccttttattatttcagtttataacttaaaattcttcatgaaaaatattttctaaattatctataaaattctggaaactttttatgaattcgaatatctcttcaaaaattaaaaacccaaaaatatgtttaattattataatttagtggatttatgtataaaatttttgtgagtaaatatatattttttatttctgaaaataaatgaatggagttaaccgtaaaaaaaccggcattttgtgggttttttgtacataaaaatggcatggtgaatcccgctattaattgaatacagcgaaagaattgacattctatggccgagtttggcccgaaggcaagtacaaacttttttgggacgtaaaaggctttgaaatg

SEQ ID NO: 111998 - DNA, 354 bp, Heterodera glycines
  Promoter: Source sequence=SeqID_21323; Location=1532..1885; Strand=+; Gene=SeqID_51917
aatgttatatgtaaaaaaataatgaaataattttcagtaagcaataaccaattaaattttatttaattattttaataaacacattaattgttttcttgttcggacaattatgtttcaatacaagagtttgaacaaaagaacgaaaatttaaatgttcgcaattttcagttacaaaatcttattggaacttagttcaggatttttggattcaaaagtcataattgaattcccctctgcagataatatttttgcacaaaaattttaaaaaattataattttttcctgaatttagctaattttttatttatattttggcaccaatcctccaccaacgttcagaacccatcagaaatg

SEQ ID NO: 111999 - DNA, 77 bp, Heterodera glycines
  Promoter: Source sequence=SeqID_32406; Location=147..223; Strand=+; Gene=SeqID_62713
agttggttgaattattagaatatttggtaattaaaatatgaatccctttagaattggtctgcccaacgatagaaatg

SEQ ID NO: 112000 - DNA, 641 bp, Heterodera glycines
  Promoter: Source sequence=SeqID_2782; Location=1438..2078; Strand=+; Gene=SeqID_81560
agagcgtgtggaaacgaagaaaaataggactgttcgttgactattcgctggatgtttagtttcctgacattgattatttgttttcgaaaagtcacttgaatgctatgagtatattatttaattaaactgaataaaagttatttctctttcgtcaaaaccatgcaattaattaaaacttgggtaaagttaccccgaattgttaacaaaatcaacaaattgtggtaaatgttaattgctgaactttttctaaagataatgaaatttacaagggctcaaataatttgtttgaattattctggagccatttatacgatgttggtaagttaattcttgcagcgacctctttttgctgttcttttagacgataagtggggtcgcaactttcaacctttatttcacatgccccgatctttatggtgattgttattggacttccattttcgccctattgattctgttccaaatatgtgtcaatttgtttttgtttcattattatctcaaaaggaatcaggtacaaaacctctaacctaccaaaatccctggacaaattcacaaaattcaggtacaattttggaccgccaaaagcagttggttgtttgatcatcagaatttcgagaaaaacacgaacaaagcgctgaatg

SEQ ID NO: 112001 - DNA, 443 bp, Heterodera glycines
  Promoter: Source sequence=SeqID_2363; Location=896..1338; Strand=+; Gene=SeqID_79333
agcgtaatgaacgaaacaagtgcgcttaaaaactatttaaggaagggaaatttttttggttcgcaaaatgtacgagttcagtccatacattcgcgcaaattcggatttcttcaaaaaattagcctcaacaaaatcggataaaaggaaaaacgatttgctgaaaggcgcatccgtagaacaaattctcggattggttgagatttgtgcaaatattttaaaatttaactttcgcctcaaccggcgacagaggagacgattggccgtgtacgcagactattaccgagcaattgcacgttcacgtagtgagcgcacagccagacagaggctacaacagggcagcggaatagctttaggagctattttggcgccaattttgagcgttttggctgaacagctggtccagaaaattgttgcaactccatcggcacaacaacaacaaaatg

SEQ ID NO: 112002 - DNA, 149 bp, Heterodera glycines
  Promoter: Source sequence=SeqID_26386; Location=400..548; Strand=-; Gene=SeqID_57119
ttctgataatgatgaaagaaacaaacctaagtcagcgctaaaaaaacaaaaaggtaataaaatttatattcattagtcaaaacttcttgaaattctagacaaaactaaaggtggtaatccccatactccaacgcgtagaaaaatgaatg

SEQ ID NO: 112003 - DNA, 1003 bp, Heterodera glycines
  Promoter: Source sequence=SeqID_24980; Location=417..1419; Strand=-; Gene=SeqID_55709
aatttttactcagatttttaaaaaataatcttcgcaaaaaataataatttaataatatttgattttttaaaagcaaacattaaaaaatagatatttgattttactataaatagaaaagaagtatctctgaaagataaaattgatatagtaaagattggttgcctctgagaataattaatattaccatgattacattaaaatttttaaaattaaactttgaagagggaaattctcaaaaatttggccaattttctttaatagattttattaaaaattataaatttttcttaaaaaattggctgaaaattacaaagtttaatgtcattttctttagcctgagatattattggatgtgtaaactttatagaattattaagatgaaaattaaattttttttttgtatatttttacatatagttgaaaaataggaagtaaaaaaaaatggacgatggctaaaacaagggaaaaaagcaaaaaaaatttcatgtaaactcctaaagattgacaaatgaataagaaaattttttaattaagtctcgggtcaatggaaattttcggtctcgagcagcacttccgctcaccataaaaagaaaagcaacgggaaggaaaaaagcaaatgttagcgtttgtataaaagcagaaaaaggagctgatttacgattaaaatttaaacagttttcatattaaaaattagtgaattatcgatatttacatgaatgccaagaaaatgggaaaaattgagcaatatttgtgaaataaataaataatattacagaattttttatacaatttccattatatataaaaatgaatttgtggcatttattattaatatttgtcaaagcttttataattgaatcggtcaaaattcgaccaaactttgatgaaatatttggcgacggatgggacaaagatgggagtgatcaaacagtaaaatgaacaaaagaagcaaaataaaaatttgaaatttgttaattttcttcaactaaacggtgatgaaatg

SEQ ID NO: 112004 - DNA, 962 bp, Heterodera glycines
  Promoter: Source sequence=SeqID_634; Location=1853..2814; Strand=-; Gene=SeqID_46032
atgcgcaatgaatgaacgcggcggacggcgatggcattcgataataatggacgaacaatttcgcatttaattgtctgtcgtgtgatatttgtgtcccccatttttgatgtgttcattcattcatttcctgtgtatgttaccacatatgtgtagtattgtgtttgtatgctgccaattcggtttgtatgtggaataatgtgtatatatgtataaaatatatatgtaatcctttggaattcggccagttattgctagggttaagatttatgtttatgaaaaatagtgtgccctattctattcattttccttccacactttaacctgttaaaaaacggatttaagcgctttgccgcatattttttgattttacaaatctttttttaacacctaagaaaacctataatttttggctctgggccatcaaatacaatttccgaattgggggccacatattcaaatttcgtcaaatcttgaacactgcaaatccaaacggatccattcgatgatttttagcctaaattgttgcttttatgcctcacaaattgctgaagcgctatttttggatatttagcgaactctttattgacttttttaaagttctcgacgagctaagtctaaaaatcaaggaattaagtcgaaccggcgccatttaataagcactgggacaactgagtcccaatgaaaatggaaacttcagtaccaaagaaataaaatatgaacaaaaataatttggtcaggtcaatcattttatggtacattttggtgtttttgtttcagtttatatggctaacttttcaaatcaaattgtttgaaacgacaaaactccgcgttgtgcttttgcaattcagcgaattttccctatataaatgggtaaaatgtgaaaaaatttcattgtctatcaaattattatttcgttgctctgatcaaagttcaactgtcttctactgctgtacaacaaaatg

SEQ ID NO: 112005 - DNA, 454 bp, Heterodera glycines
  Promoter: Source sequence=SeqID_22676; Location=1036..1489; Strand=-; Gene=SeqID_53362
atagcttttacaaattgtttaaaccgttgtttttcttctactgtcccctttttgaaaattcgctttttctaataaagtggcaaattcgttttccgttgttttttatagccgaaattttcgtgttttgtttaggtcagcggctgctcgtcgcctatccctgcactttgctctattcggtgtttgcactgctcgccattttttgacactctccccccatttatttgtttggcctcttttctgccattgttatttatttatttttgtattattttgttatttgacggtcttttatgcctttcctttgttttggtcattttttgggttggccatttgcataaatataaatattctttcgaatttttccttaaattatcaatgcttttcttcgacattttccaaaatactttttgttttgtttcatttttgcattaaataccaaattggttttaaaatg

SEQ ID NO: 112006 - DNA, 682 bp, Heterodera glycines
  Promoter: Source sequence=SeqID_4180; Location=3234..3915; Strand=-; Gene=SeqID_53493
ggtaataattaattacacttaattaatagggcttccttttttaggcacaaaaaatcgcgaaataggcacctaaaaaggcataaaaaaatcgcaaaataggcacaaaaatcctcaaataggcatataaaattttttattaacgctttttaggtaacaaaacactttaaatcttaaatatttcaattgaaattattaaatatttttatgtttttttcgaatatgaacaaatttttaaaccaaaaaatttttattaagaaaaaatattaaattttgggatcaattttttgaaaattttttcaattcttatggggtgtattttctggaaaaattttttgggtcatttcttaggggtgtatttttcgtttttattgcatttttgttaaggattttttcgaaaatcctaaaataggcacaataggcacaaaaacccccgaaataggcaaaaataggcattataaaagtcatcgtagacaccccaaaccaagcggaaaacgcgtcttttgtgcttatctatgcgtatcaagtatgcaaaaattttaggcatttgcctaaaaaaggaagccctattaattaattaatcgtcctaaattgtgcccgaattttcccacatttttgcaaggcccctccactgatttcgctctgtttatctatcggctttctttggttcagtgaattggaaatg

SEQ ID NO: 112007 - DNA, 423 bp, Heterodera glycines
  Promoter: Source sequence=SeqID_16629; Location=437..859; Strand=+; Gene=SeqID_81038
ttcattcgcattggacatttatttattattttgttctcctccgccgctgcactcctccgacctcaccattttgtgcatttatttttatttgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcaattcaaaagcctgggcggctttcatcggacatcgacaaaaactgatcacctgggtggtgtaagttccgctgggtgcggtttctcatcaacaaaaactgatcacctggggggtgtaaagttccgctgggtgcggtttaatcaacaatcaaaatg

SEQ ID NO: 112008 - DNA, 105 bp, Heterodera glycines
  Promoter: Source sequence=SeqID_10364; Location=478..582; Strand=-; Gene=SeqID_73542
atttatgtcacaataattttcctgaattaattgtcaggaggtcttttttgctcactaaacaattgtgaagcggcggcgaagccaaacgaactgtggcagcaaatg

SEQ ID NO: 112009 - DNA, 133 bp, Heterodera glycines
  Promoter: Source sequence=SeqID_8359; Location=443..575; Strand=+; Gene=SeqID_67799
accatggtttagacccggtcaaactgttcgaccatctgctcgaggagggggtccccgaagttacgcatctgctcccggaactgatcacccccggggccatggcattccttcgggaagaattgcccaaacgatg

SEQ ID NO: 112010 - DNA, 382 bp, Heterodera glycines
  Promoter: Source sequence=SeqID_24658; Location=1677..2058; Strand=-; Gene=SeqID_55396
tgtttgaggcaactaggccaggtggagttgcaattgcgcctttgaaataaattatggaagtacacaaaagcagttttaaaaagcaatgggaaacacccatttttaaaaattatttaaaataatttagctgaattaaaatatattttaatcactttttatttaaaaaatgtttataaatttattgaaattagatttcagtccaaaaaacttttaataaatctattttaaagctgaaattctaatttttaaaagcaattttgttagtaattaattacattatcaaatattgaaaaataatcgcttttatatcgaaagatttaaaataattttttgtccattaaattaaatcaattcgtcaaattggtcgccttttattaaaatg

SEQ ID NO: 112011 - DNA, 73 bp, Heterodera glycines
  Promoter: Source sequence=SeqID_17184; Location=2461..2533; Strand=-; Gene=SeqID_81633
tgtcgccgaattgggccattgacgatcaccaaccgccgccctggcccgcacagccagaagcgggagtccaatg

SEQ ID NO: 112012 - DNA, 440 bp, Heterodera glycines
  Promoter: Source sequence=SeqID_32549; Location=387..826; Strand=-; Gene=SeqID_62858
tcccccggcggtggatggagtcacgggcacgggaggtcagaatgccaaaaaaggaggaaaattcaaaacctaccaacgatgggttggccgagttttgcgtgatccccccccccctttaaatttcgaaattcgtcgcatttacaccagagcacaaacccattaattaaatttaaaaataagaatcgaaaatgtcgaggaaagaaaaaacagcgaacggaaattcttctgagcaaaaaccatctttaatgattgtgagtggcactttgtccacatcggcacactgaacgattcatcgagaaaaccatcagcacaaaattgaacaaaaagcgaagagaaaatggcacaactttagaaatttaacaaaatataaatattaaacaaatattaatttcaaattaaaaaaataaatgagctgattgtcaggtcgcattctgaagatg

SEQ ID NO: 112013 - DNA, 732 bp, Heterodera glycines
  Promoter: Source sequence=SeqID_1617; Location=6319..7050; Strand=+; Gene=SeqID_74864
tttttttaaatctattaaaatgtaaaactataaataaaaagaaaattccattaaaaaaaaataaaatggacgccttccaacaatttaaaagggaggatggacaatttcgtcatccattcacaatgattgtgtctgggagcacaggcagtgggaagtcagagtggataatgcgtctgttgcgaaatgtggacaaaatgatctctacccccattgaacgcgttatttatagctatggcgagctgaacacaaatgtagtgaatttacagcgcgccggcaaagttggcaatgtgccagtcactgtacacagcggcgtcccacgagcggaacaagtgcgggagtgcgccaaaaaagaaaaaaccttactggtgctggatgatttggtggtggggatgagtcagcaatatttagacgcactcttcacccgtggctcacacaattggggcgtcagcgtaattttggtgactcaacacctgttcaacaaagagctgcgtgtggcgcgcacaaattcgcactatctagtgttaatgcgaaaccctgcgggggctttgcagatatgccaatcgccaaccacctcttcccgtcaaggactgcccattttattgaggcctaccgggacgcatgcgcgaaaatttttggctaccttttggtggacatgcacccagagactccggaagagatccgccttcgaacaaatatatatgaacaaaaacaaatagtttacatgccaaaatg

SEQ ID NO: 112014 - DNA, 1003 bp, Heterodera glycines
  misc_feature (267)..(267): n is a, c, g, or t
  misc_feature (910)..(910): n is a, c, g, or t
  misc_feature (971)..(971): n is a, c, g, or t
  Promoter: Source sequence=SeqID_13363; Location=1407..2409; Strand=-; Gene=SeqID_77237
ccaaagaaagcaatttgttagttttattatagaatccgaattagttaatattaaataaattttattaattaatatgttcattttttatattttttttctcaagagaaataataattttaggattaaattaaagcattttcaagctttcgtgtagtttatgtacttgacaacttaaaacccatgatttgccttcattaatatgaaattcattctcctttcaactttttaatacctaaatccggccttaattgttttgccttattttanacgtgctcaatttttttgtagaaataaaaacaaataatttttgaagacaacacgaaaacaaaacgccaaaaaccaaaatggaacaaaaaccatttgtgtttgttcttcatatttttctcgtccttcagctgtgccaagtcgtaaattccttcagaaaatatcggtatcacaataataaacaataattattggctattttaagactatttgtgtttagtttaataggagagagatgttgtgataacaaatttaacttttgctaatacatatttgaaaataaaaaaaacttttttataaaattaagaaacaaaatagagacttttttcaaaaatatagtcgtaagaaatcaaattacttcaaaaaagtctagaaattattcagtttacaaatttaagaatggtttagggatttttatgactttttcactttttcaaaaattaataaataaatttttttaaattaaaaatttttaagcatattttatttttttttaagcatttgcagcttgcttcatagtcaagggagagcatttttttggtttttattatacttttcctcattgttgataaaaaaatttgtattattccgcataggccatgagaaatcgaaaattctttttggggtaggtgtacccttctctgtntttcatttcggaaagatcgcataagattacatataatgttttttaaaaataggcacaaacnccatttattggcattcacagttgccacttatg

SEQ ID NO: 112015 - DNA, 230 bp, Heterodera glycines
  Promoter: Source sequence=SeqID_10065; Location=43..272; Strand=+; Gene=SeqID_73132
tcggtgactttttttggttttaaatttttaatcctaaaaaagaattcatttaagttgcttgttataattcattttttcttttatgatatcattcacacaaattcgaaatttggacaataaattaaaaatttcaactcatttggacaatcaaatttaaattaattccaaattaatttaataaggcccaaaatgaggagaaatcggtgcttgaccgttgcaacggaaaaatg

SEQ ID NO: 112016 - DNA, 212 bp, Heterodera glycines
  Promoter: Source sequence=SeqID_43182; Location=1038..1249; Strand=-; Gene=SeqID_70915
aattttaggccccccctccagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 112017 - DNA, 608 bp, Heterodera glycines
  Promoter: Source sequence=SeqID_7213; Location=1176..1783; Strand=-; Gene=SeqID_64169
tttggtgagagtacagtgccattaaaaatctttgtaaaatatttttttaaagtgtgccaccactgttggccatcggtgggacgtgccaatatccgccaaccggtagcaatgacatttaaaattggcaatatgtaaaacgcacattaaagcattcatggaatgatgatttttttctgcatatttaattttattttttcatttaaaatattttatttctaattattaaatttaaaaaaattattcccaattgattccaaaaacattaaaaattttctaattttaataaaagattaatattaatgaggttgaaagctgcgaaatagcggtgccaaaaaaagtgccgaaatacgaaataacacacttggtgccgtaatgcgaaatagcggtgccaaaaaaaaatgccaaaatacgaagaccggcgactaaaaaatgccaaaatacgaaataccggcacttttcctgcgataatgcgaattaatggcgccaaaaaatgccggaatgcggtctaatctatgattgacgcaatacttaaaaaattgcttattcaaatcattaaaaattcatttactttacaaaaatttaaaattaattgccagtgccaccggatg

SEQ ID NO: 112018 - DNA, 729 bp, Heterodera glycines
  Promoter: Source sequence=SeqID_30099; Location=1..729; Strand=+; Gene=SeqID_60539
aacgaagctcttcaagttcggaccattcaaaccacccaaaattatcatcgtgaacttatttaggcgcctccaattgtcaatccattggggcaaaatccgcagcaaatgatccgttggccaagacaaccgtggattgggagacctgttgaccctcgctcacccccgcattgacgaaaaatatgcatttgttaataaattttttgttgattgagcattttatgtaaagggttgaacattccctgattcctaaagttttaagggacagaaacaaattttaggaaaatgttaaacgacacagaaattaatcagaaagaaaataacgaaaaagtaattggattggctttaattttagttatttattcgttttcttttttgtgtttctgttccgctatcgtaagagaatgacaccgtgtcttttttagctaacaatgcccctgccccccgagttattgtttgaaatagttgaagcccttccctcctcaaaattgtctacagtcttcttgagcaatcatctcttgtcgtcgtgggctcaaaaacgtctcagagggactttcaattcgctgatgtcacagaaacaagaatggagaaatctgttaaaaatatctcgtttggtttttgaaagtcacagtggattaaatatgcaataattggtttttagtttttcgtggttttatatccattttattgttaattcttaatgcgtttttaattagtttttcagcaaaaatg

SEQ ID NO: 112019 - DNA, 210 bp, Heterodera glycines
  Promoter: Source sequence=SeqID_24986; Location=712..921; Strand=-; Gene=SeqID_55720
ggtatgtgaaaaacaaataacaaaaatatttaaatatttcccgaagtaaataatatttataaataaaattttacgcaaaatgtcgagaaatttttttaaataaaactaaaaataaaatttgcttatttaaattttttattcaatatttaaattattcataaaaatataattataattaaatcatatttttattttcttttatacagaatg

SEQ ID NO: 112020 - DNA, 1003 bp, Heterodera glycines
  Promoter: Source sequence=SeqID_13668; Location=253..1255; Strand=-; Gene=SeqID_77575
gcggacggcacccattaccaacagagagaacgacgaccaacagcaaaaagagcaaccaacgaaaagcaacagaaattggaggagcaatggacgactgagagaaggtaaaggaaacgtagtgcgacattttcggaccgacatttgcgtatcactatttctgggctaaactgtcaaaaaacaaaaaataataatttttggcactatatggaaagtgacagtttttgaaaattttttcaaaaggggggacccttttgttttgcaaaattttttttgtgatagtcataaaaatttattctctggggtttttggggtccccgatcacgaatccttcaattattttgatccattccgatttcctaatctaaatttgaacaaaaaatcataattttaaaaattcaaaatttcgatttttattcgagttcgggttagggattaggaattagtcaaaatacatgtcagattcgtgattagcgacctttaaaaccccggataaaaaattatcatggttttttatcttaaaaaaattttgcaaaacaaaaggatcccccttttgtttcaaaaactgttactttccatatagtgcctaattttttttcaaaaactgagtgaccaaattagttttatttgtcattttccgacttgaacaccattcttaaagagtaatgtgatcaacttatgcaatcaacatcgaaataacctattttatatataagaagtttagtttccattaataaaaatagaaaataagaaaatgaatgcaatgccaaagtgaaattgaaaatggatgagagatgacgaaagcaaaagtacaaaatgcaaatgcagatgatttgtgtatattctaacctttatttttgcttcaacagaagcagaaggtgtaattgatttggaggaagaggaaaaaggccaattaattgatgaaaatgggaacagcccgaggaggaggaggggagaaatagaaacggagagaattgtggtaggggagagtgaggatcaaataatg

SEQ ID NO: 112021 - DNA, 55 bp, Heterodera glycines
  Promoter: Source sequence=SeqID_17848; Location=1663..1717; Strand=-; Gene=SeqID_82380
tcccgacccttttgccatctttttaatcccgtttctcgacttgtttcctctgatg

SEQ ID NO: 112022 - DNA, 1003 bp, Heterodera glycines
  Promoter: Source sequence=SeqID_2860; Location=4328..5330; Strand=-; Gene=SeqID_82006
tcgacaaattagaatgtgactaattatttatggaaaatggctcttacacagtttaggcccgaaaataaggttcccggtgatttcgtcagtgagtgatttcgtcagtaagtgatttcgtcagtgagtgatttcgtcagtgaaaattaattaaagcgtacaactagctaaaaaaattcaaaaattcgagtccaagctctaaatatttaaacgagtcacgatttgcagtcttctataagatttctcaaattgttgctctgccgaatccattttgatttgcgcttttcacgtcccactttacgtcagctgggctacgcgaaaatcacctaatcgtaacacactcgaaaaggaaaaggtcgtttccatgcgtgatcggcagacgcctatgattcgacttggagacataaaatgattaagagcatcaacatactcaaaatgtagaaatacaaaattattagacagggatggagcgaggacagaaagctcacgcggtcgcgcattgcggattcaaattgccgcggtcgcgctccacccctggtaagaaaattaaaagcgaaattccaagattatgcagaatgaatggctggcgaccaagaaattaacatataggattataaaagtagcaaaaacgaggcacaaatacaaaatattttatgatatgcaaatgaccggtccatatatcgattgacaaccgagcaaataatttcattttgcatttaaatatcgaacgaattttaattttaaatgttttttcgtaaaaaatgattattatcactgacgaaatcccttactgacgaaatcacttctgacgaaatcacatgtttccgaaaataacatatattttttacaattatgaaaattaaaagaattgtttaatgattaaacgatttgtttaaataattgataaaaatagaaaaaaattaaattaaacttaaaattttcattattttgtaagattatatttatttcattttttaaacccaattacagtttgacgaatcggatg

SEQ ID NO: 112023 - DNA, 340 bp, Heterodera glycines
  Promoter: Source sequence=SeqID_116; Location=1..340; Strand=+; Gene =SeqID_72233
tagacaaaataataacaaacattaacaacagtgtgaataggatcattgggggccaagccagtatccgttacttttgaaaatgcccgtgcgctctgggaaaaattatataaggagaaggaatttaaaatttcgaaaaagaaaaaatttaaaatcggtgatatcgttcgtattaccaaggacaagggaaaattttcaaaggggtacctcccaaactttaccgaagaattgtttaaaatcgttgttgccaattcgacgacacccgattcatacaggatcgaagatttggaaggaaatttaataaaaggcatattttataaccaggaattagtgaaaacagatg

SEQ ID NO: 112024 - DNA, 454 bp, Heterodera glycines
  Promoter: Source sequence=SeqID_14251; Location=926..1379; Strand=-; Gene=SeqID_78267
aattgattatttggaaataaatgatgatgatttttgttaaaagtaatattgtatttgaaaaattctggcaaataatttttaatgttggaaaattaccgggttttaccggtaccggtaccggttgaaaaagttggtaccggtaccggtttttgcagtaccggtcggtaccggtttttttacaattaccgaagctcaactctatgttattctaatgaatcttttttaaaaggtaatgagttttattatattatgattcattttagaaaagttttttctttttaaaatcaattgtaaataaaaaattttatgcaaaaagtcataaaaattcaattatttcttaaaagaaaattttttattcatatatcgattttcatatttaaaaagacgttgatttcctttcaaaaaagttttaattaaaattaatgttttttatttttaggaattaattttaatg

SEQ ID NO: 112025 - DNA, 68 bp, Heterodera glycines
  Promoter: Source sequence=SeqID_16302; Location=1525..1592; Strand=-; Gene=SeqID_80690
tttttgctgtccttttgctgattgacactttcgcatcagtggcgggcggccaacggcagcggagaatg

SEQ ID NO: 112026 - DNA, 165 bp, Heterodera glycines
  Promoter: Source sequence=SeqID_11490; Location=1..165; Strand=+; Gene=SeqID_74906
tgcgagattaaagcaaagattgacttttaacaattaaacttttattttttgttttttacgcatacacattcaaaagtcttttttactactccattacttttatgcttttgttgtaaataactatgtacatatgtattcgaagattgtgcatttcattttgctatg

SEQ ID NO: 112027 - DNA, 192 bp, Heterodera glycines
  Promoter: Source sequence=SeqID_2222; Location=1381..1572; Strand=-; Gene=SeqID_78552
ggtccgtccgtttaacatttaattatgcttaattaatttaattattcaattaaaacatatttagtttttgtttttccgtcctcgaacagagttttcctcggtaattttttatcatttaaattaatttaaatgtttttctgccttttttttgttttataaattttattttcgcctcttttcttccatcagatg

SEQ ID NO: 112028 - DNA, 402 bp, Heterodera glycines
  Promoter: Source sequence=SeqID_8419; Location=2906..3307; Strand=-; Gene=SeqID_67999
ggcacgtttttcaacgcattttcccggcggcaatttaaaatttacacaatttttcatgaatccctgactaaattttctttccttgttcgtatcccctccaaggctttcctatcaaaatctctcaaaaaatttcgcaaaatttcttttaaaaaatccaaaaagcactcaaatttccaaaataaaaataggaaatatagtaaaatgcttaattaaacactgaaaatcgtttagtacttaaactaaaaaattatttaaaaaaattagtgaacattttctttcagtttccatgcccatttgttcgatgcccatcttcgccatgcgctcgactttcccgtccagtcccgcttctccattgcttttgcgcacattgccacaaactttgagaatgcgttgcacgaaatg

SEQ ID NO: 112029 - DNA, 1003 bp, Heterodera glycines
  Promoter: Source sequence=SeqID_1313; Location=3876..4878; Strand=-; Gene=SeqID_72330
ttggcttttttattacctttttatgaaagttttaaaattaatggtatttaatcataaaaagagaaaaaagaatatgcattttatttcttttggttaaatttagaatgaatctgaatttagccagtattttttgttcatttttattcatttttagagataaatttatagtcgaatttattggatttttattaccgtttaatggcagttaaaaaatttatggcaattaaccatagaaatataatcaaaacattttatttttgcaaaagaaaaaccatcaaaatattcagtcaaaattcagtccattgaaatttttttttgattttttttattacagtgcaaaaagaaaaatgaaatttttaaaagaaaataaataaagatttccaatttttataacacgaatttgcaaatttaataaaaacattcattgaatgtgtaaatagtcgtcccaatattcgcgcaacatgtcaccctcacacgccaatgaatcgtttttattgtgcaatttgccacagcacatacagtaatggacggacaaaaacggtgtcgttaccgtatcagtcgccattttatttcgccaaaaaattttgttaataataagctcaaaaaatgttaaattaatcttaatcagtctaaaattttaattttttttaaaattatttaatttaaatgaaactttggttctgaaagtaataaaaaatgtacgtttcaataaaattcattaagtaaataaaattatgataaaataatcggtaaatatattctttttaatataattttttttatgaaaaacccggaacttagcgatagcattttaattaattctcggctaattattctgcgttttgatgtgtgtaaagctgagaaacgaactatgaaatgaccaaaaaactgaaaataactatcaaatttttaatttttcgattttttgaaaatttaatgaaatattcttcaaataaatagaagtttggaagattaatgcatcaaacaagaaataaaaattatg

SEQ ID NO: 112030 - DNA, 1003 bp, Heterodera glycines
  Promoter: Source sequence=SeqID_14175; Location=1561..2563; Strand=-; Gene=SeqID_78181
taataatgcattgcaatacatttaaaattgataattaggcaaccttaattaacttttcgttgtgtttcgctttttctgtttttgtaaatatttcgctttctttcggcccctccgttttttgtttttcacctttcaatcgccaaattacttataaaccccggactttgtacacaatatttcaccaccacctgcacttgtcctccgtccgcatttgctgtccattatcattatcattgtcaattatcattaatatcactaatatcaattatcatttttatcaatacaaacatttcgcggtcgatatgggaccacttttccgcgccatgctcccatcccccgccggcgatggtctgtctctgtcccttcctccttttgctgccccattgataaaggagccgcccgctgcaccaatctccccccccccccgggggaagcgacggaatgaatgatttccctattcttttatgtatttatgctcttttattaacgatatattttttattcaattaggattcccctttgttcagtttaaaataagcctaattagcccaaagtttcttaatgaattcgcttttattttgcacattgatttatcatttattgattgacctttatcaccaattttcctttcccaaaaatttaccacccctcatttgtcgggaaataaaaaaatgtttattttaattatcttcaacagacaatttctttttgaattgctttctttttgattcctcttttttgtgaaaagtgattaattaattaattaatattttgctataactgtcgacagcgtaaagaaagaaacacgccattcatttcaacaaaagaaaaagctcgccttttcaattaatgacttttgtgaaatgtgaatctctgctgctttatgcattttttaatttttaccattatttaagctcaattattactacatattgtcaaatatgaatttatctaacattgatcaattaaaagtgtcgcctctgtatgaaggcagttggtaatg

SEQ ID NO: 112031 - DNA, 679 bp, Heterodera glycines
  Promoter: Source sequence=SeqID_3604; Location=1458..2136; Strand=-; Gene=SeqID_51058
tctaaatatttttaatttaataaattgattgtcctttaaatttgtgcattaaaaatatttttgtgagtttttaattaaattttcgaattactcccgctcccgcccgggactcccgttaaaaatggacgggattttaacgggagcgggatttttacgggaatcccgttcgggactcccgtcccggaaaattttgaactcccgatcccctctcccgctcccggaaatttttttttaccggactctacttaaaaatatacctatagaattttcgttatcttaaaaaaaattttttgtaagttaaaaggttcccctttttggttttatttttgttttctcaaaaacattttcctttttgcacatcaaaaggttccctcttggttttttaacaaaaaactttagtttttcgacccctattctgattttttgtcgacccacactctatatatgtgccccgatctcagtgccgcttatatgttctcaacaatttttaatattttcattagggtagtttgcgaccaattaaaacccgggtacatgcgcaattctcctgaatttgtccagcaggctgacagcactccgctgatggaggtacttacttattcacacttccatggaatgttccattgtatttccattttgctaggcatgttgtggcgggcactctgacgtagttcgaatg

SEQ ID NO: 112032 - DNA, 566 bp, Heterodera glycines
  Promoter: Source sequence=SeqID_11198; Location=1484..2049; Strand=-; Gene=SeqID_74549
tttgaggattgactttctaaaaaaataaaatcaaaatttgaatgttcaatatgatgagattttttcttataattaaataaaaaaaattattaaattaaaatattttcacaaaaaattaataattacaattattgaaaaaataaaattttcatttacccttagctttttcaaattttggattcttccaaatattaatttttaaatttatgagatttttgagtctgtcggtaccaataagcgccgagtcaaatcagatttaacctttcaacccgcaaatgtcgtactacatgggcggggcatgtcttaatcgagaaataattggaggtgatcgacagccgttaccgcttaattggggactaattgggccgcactgatgcagctttaatgaaaaataattggaggagtggacaatgttttattaagatataattggtctcgagcatggcttaaatgagaattaataaattaacttaaattagaattaattaaattaattatggcttgaaaatgctgcccaacttttgaaggatatgcccaatcttccgaaaatagtcaacaaaaaaatg

SEQ ID NO: 112033 - DNA, 314 bp, Heterodera glycines
  misc_feature (61)..(61): n is a, c, g, or t
  misc_feature (91)..(91): n is a, c, g, or t
  Promoter: Source sequence=SeqID_18955; Location=1..314; Strand=+; Gene=SeqID_47555
agtcaaaatgaatttatttattcgatagtactaacatttaactatttatggttaaaatttnaaaaaatttaattgagtattaaaaaagttntggtaaaataatttgattcttaaattattgaaaattttggagtataatttttttataatttaatataaaaattttataaattaatattgtaatagaaaagatttaaagttattgtataatagtatgaaatataaatttggtttaaattgggttaagatatgaatttatatgttttatatttttttgtttttatagtagttggaggatttaggaaaagtatatg

SEQ ID NO: 112034 - DNA, 98 bp, Heterodera glycines
  Promoter: Source sequence=SeqID_31683; Location=1109..1206; Strand=-; Gene=SeqID_61992
gacccaattcaaaaaggaaaaaaatttgcagtcaaaaaattattcgaattctccaatttggtttccataatttccgaaagttattcggtatcataatg

SEQ ID NO: 112035 - DNA, 463 bp, Heterodera glycines
  Promoter: Source sequence=SeqID_2019; Location=4338..4800; Strand=-; Gene=SeqID_77350
acagctataaagtgcaaaattacaaacattaattaaaaatgcactagataagcaataaacgatatgttggaaatttacttatattaaattacaaatgagtagggacgaaatcaaaaaaaaaggtcaaaatgatggaaaaatggcgaaagttgtaatagagacgctaaattgcagagtttagaggggctaaaaaaagaatgaattttcgtgaagttctaatctaaaccaagaaaccaaaaataaataagtaaaagtaaagcgtttcacactttttttttgtttttctagtgggtaccctttgctataaaagtgccaataaaatttgaaatcttgtttaactatacttttattatatgcgtaaaataatttattaattaaaatttccgtaaaataatataatttgaacaagataatatttaattaaattcaattattaaattaatttttatttaattataaaatg

SEQ ID NO: 112036 - DNA, 1003 bp, Heterodera glycines
  Promoter: Source sequence=SeqID_9861; Location=699..1701; Strand=-; Gene=SeqID_72889
tatatgatgatttttataaagtttttagtgtatagcgagtatttaaataatgcggcgcttaagtgtaagcttttattttaatgaaaaaagttaatttaaaaaaaaaaaaatattttttgggttttttcagggcctggttagaccagaaacccggcccgcccgcacccggtttaaaaacttagacccaaacccggcttttctggaccctgtaataccaggaccaaatttttgcttaaatacccggcccgtataatcctatttcaaaccaaggaaagctcaggaaaagcttaagacactgcagtgaggattagggctggaattaaagtcattaaaaatctccaaaaaaagacttaaaaagcataaataaatcgccaaaattcattaaaaaacaacgaaaaatgcaaaaatatttctgaaaaattaggcaaaagcaaaagcaaaaaaaaacatattttaacaattttttgaatgacatttaataaaaaaaaacttgtgcgatttgtttcaattccgtccataccgatgattagggcggccaatttcgtgtaaatacatattttttcctggttctccttgctaaatagtaggaaaaaatgatttttttcaccctataatttaattaaaaataattttttgtttttaattttaaaataattattttccttttactttgatcacttgcactttttgtacttctcaatagcatcgtttcaattgaatttaatttcggatatagatgagatcagtaatttgcttgaaaagagacttaatttcttttaaaatgttaattagtgagtctgtctgtgatttttaagcccattcttctatgtgtcaatattaaaatttacttttcttattaaacgaataaaggtctttgcttgtcatcgtttggcgtattacttttttctctttttctttattctgaatgctccaaacaatgggaaaagtaattaataaaattccttctaatttattaatataaactttaattttagcagtaatg

SEQ ID NO: 112037 - DNA, 81 bp, Heterodera glycines
  Promoter: Source sequence=SeqID_15188; Location=209..289; Strand=+; Gene=SeqID_79386
tcgcggacaacgaatcgtcaattcaacgcatcatcgtggtgataaaacattttttgaattgccgcacattggtacaaaatg

SEQ ID NO: 112038 - DNA, 157 bp, Heterodera glycines
  Promoter: Source sequence=SeqID_44541; Location=447..603; Strand=+; Gene=SeqID_72022
atttttaaatttaatacatattccagaaaaatggctctctttttttgagaaattttctatgcaacaaacgctctcgaacatgaaacgaagtgcggtgcgccgtggccattttatttttcaaataatttttaaatttaatacatattccagaaaaatg

SEQ ID NO: 112039 - DNA, 533 bp, Heterodera glycines
  Promoter: Source sequence=SeqID_5182; Location=356..888; Strand=+; Gene=SeqID_57180
gctgtaaattgtttaaaaaatgaaaacaaataaaatttaagaaaataattaaattaaatttttgaatgaatttaattttaataaaaaaaagaattataattgggcccgtgacatttgtaaaaaattaatttaataattaaacaattatttaaatttcaaaattgtaaaaataactttgttttttttggacctatttttttttttttaaaaagcgcgccgcaaaaacatttttgttgatttttaattatttgggataaattatgaaaatgctgaatattaacccaaacttaaattttggatgcaattaattaataaatttaaaatttttaatgggtgtttttaaattaattttttattttggactaaaaaactaataaaaagcaatcgataaattaaaaaatgaattatataaaaattaattaaaaaataaaccatttttgaaaatcaaatttcatttttttcccacccaaaacttacattggccgcgatccgacgagacctccttggtgcatccgatgttgaaggcagcaatg

SEQ ID NO: 112040 - DNA, 151 bp, Heterodera glycines
  Promoter: Source sequence=SeqID_12997; Location=1..151; Strand=+; Gene=SeqID_76766
ttttcaactttatctgcgccgatggtgggttttggtgttggatttccttgcgcctttttcaacttggcttggaaattgcattatcaaccgtcgatttgctttttacgttgatgaacacttcaagacacgcaaaaggatgttgggcaaaatg

SEQ ID NO: 112041 - DNA, 595 bp, Heterodera glycines
  misc_feature (16)..(16): n is a, c, g, or t
  Promoter: Source sequence=SeqID_20234; Location=1..595; Strand=+; Gene=SeqID_85036
tcagaaacaaaaaatnttagagaaattaaatatgcatacatttaaaaaattgtacccgtttttattaataatttttaaaaactcgaaatctttttcagggggggttgttgatggtgaaccgctagaactcaaatttccatttattttttttaattatccgagattttaaattttttttttggaaaaatatgtttaaatcgtgtaacattttcaaaaattccaagagggttacgattggcccagttgacgctcatttaatttttttttttttaaatgcacagaaattttttttgctattaataagcaaaaaatttgcgcctaaatcctttttttatctcaacagcagctgatcaagccattgcttatggagcaatacaatttgctcaagtgtaataaaactatggcacattcgctacaaaatttacgcaatgccatcggcacaatgaaaaacgcaatttttgagggtttgaaaattaaaacaaatatattaattaataatttaatttttttaaaaggaaaagcaattgcaaattctaaaattaatgagctaaaaactgtgttacaacaatcgcttctttcgttggtcgaccgaatg

SEQ ID NO: 112042 - DNA, 54 bp, Heterodera glycines
  Promoter: Source sequence=SeqID_15507; Location=471..524; Strand=+; Gene=SeqID_47299
agtgacttcgtttgttgttgttactctaattaactgataccactttagaatatg

SEQ ID NO: 112043 - DNA, 86 bp, Heterodera glycines
  misc_feature (37)..(37): n is a, c, g, or t
  misc_feature (43)..(43): n is a, c, g, or t
  misc_feature (77)..(77): n is a, c, g, or t
  Promoter: Source sequence=SeqID_40051; Location=850..935; Strand=-; Gene=SeqID_68485
aagcgctttaaatggacaacaagcgttcatatttgcntaatgnataggaggtccagtatttttctcgtagaattgtntaaaaaatg

SEQ ID NO: 112044 - DNA, 245 bp, Heterodera glycines
  Promoter: Source sequence=SeqID_14463; Location=1..245; Strand=+; Gene=SeqID_78508
tttatataaaataaaaaaaaattattttaaacaaaattaataaaaaagaaattagattttttggtcggtggcagatattcagcgctattgttagacctttaataattgtaaatcctttttcattgatgatttaaaaaaatccggcaattttcaatacaaaagccaattacttttaattggtcacataatttagagcggataatgcggcaatccaatttataaaaagtatcaagcgcgaaacaatg

SEQ ID NO: 112045 - DNA, 270 bp, Heterodera glycines
  Promoter: Source sequence=SeqID_25229; Location=1610..1879; Strand=-; Gene=SeqID_55976
ttttgtcaaagcgtaaaactaaaggccacctctgctaatttccagcatgaaaaatgcggtcacaaaatcggcgacttcgtcgcccggcggcggaggggccaaaggcggcggagggcaccgctcgcgcaaggcacggtcacggtcagtggagttttgtttaatttgaatggctggctaattaccaaattggcactaaatcccccctccttttgcataaatcacactttggccaattcgatgccggccgttcacattcgaacccacgacatg

SEQ ID NO: 112046 - DNA, 561 bp, Heterodera glycines
  Promoter: Source sequence=SeqID_35794; Location=1..561; Strand=+; Gene=SeqID_65265
atttctccacaagtccgacaaaaacagcgaagattttgtcatggtaactaacaaatacatttttgttccttttaaattaccatttttttcctgtacagcttgaaaattttctgtacaacaccaacccgctcattttgcatggcaatgggccgtccaagtcgcaactgaacgtgctggagaattacttgactcgtggcaaaatttatcaggtttttttcaacagttttatgtctctttattttggcaccgctgaaaaaaacattaaaaattcgtacattgatagtccataatacaataatttaagaaaaacccaaaaaacattctttaagaactttcattaataaaattttcaaattttttgaaaaacaaaaaaaatttttttatttttctgatattatatgaattgtcgtgacactttctcatccacctgtttattgttaatgccttacatctttgaaaaatttttttgttatagtcctcttgacaattttccccctattttgcacccacaaaatttatttttttccctcccttttttcgaatttgccggccatcggaatg

SEQ ID NO: 112047 - DNA, 506 bp, Heterodera glycines
  Promoter: Source sequence=SeqID_4395; Location=3815..4320; Strand=-; Gene=SeqID_54295
aaagtgatatggcaattgattttactgtgggagaagaaagaatgacaaaaaagcggaaatgaccggccgataagtccacccaatcactcacgttctgttgatttgatttttggaaatttttacaataaaattcagaaccattttccggtgccttgcctgtaaccgactggcacgagagttctaagtctgagaaagtacaaatgtgctagtttatctgatttctgattttgggctagtggctaaagttcgttctggtttcttaaaatttctcataaattttgaaattttatggaaaattaaatatttatacagcaatattttaaagtttgactcgaaattaaaaagagccataaaaacttgtttccgattttttgatcacgtttgcactgaaatacacaatttgcttattccctccccaaaagacaaacaaatttatttgaaaattttattcctttttcttagattcttagcaaaatgccgaccccaaaactcgggcccggcacatg

SEQ ID NO: 112048 - DNA, 194 bp, Heterodera glycines
  misc_feature (44)..(44): n is a, c, g, or t
  Promoter: Source sequence=SeqID_4482; Location=2933..3126; Strand=-; Gene=SeqID_54618
attgcgctaacaaataaatgttgctttatcatgtgcctgatganagttccctaagaatttattttttggtctttttagcaattttaaattttgaagcagaacagaaaaagcagcaacatttacaaatttcaaattaagaagaataaaacgacctctccaaaaatatttatgtttaaataaataattacgaaatg

SEQ ID NO: 112049 - DNA, 1003 bp, Heterodera glycines
  Promoter: Source sequence=SeqID_13290; Location=771..1773; Strand=-; Gene=SeqID_77129
aaaaatattgttatttaatgaaaatgtgaaaccatttttttcaaataattcacaaaactatttttaaaaaaatgcaaattaattttttaattatttaatattacttatttttaataaatagtgcgtaaaaaacacttcatatgaaaatgtgtaaaacattttttttttcaataatttataaaattattttttttaattttaattaattttttttatttcatctttgcatttaaatggtttttgctttgttttttttttggctatcaaccattcaaatttatgacaaattaataaattttctaaaattgccaataaaaatgattttccatttttttttataaatttttgttccgcttttcgtcattatttttgtttatttgggcgcttttgggaggttctgcgctccgtcaaagacaacaacatcaacaattgcaattttccacaccaatttttgttcgttcgtagcatccccaatttttcacatcaatttacgtgtggtacataattccagcaaataatttgtcgtcgttccattataaaaaatgtatatatattattcccaatttctttaatcattttttatttttagacttataatataatacaatacttagtaatttatcttgaaattttcgttttttatacataatttctacgactaaaataataaaatataaaataagtaatttttattgaactctttttttgtagattaataagaattatttcaatttatttaattttcaattaatcatcaaattttagaaaatactctcgtcacgatcgatcaagaatcgcttcatatttattcattcttaaaaaatctttttatctataatttgttaaatggcaatttttatttatttaatttattttttaaatatcgttaatatatttttttaattttaattaacgtgatttattttcacaccttagtcactcatcaacattgattcgttatttcaataacaatttatttattttttcattttaagataaaatg

SEQ ID NO: 112050 - DNA, 541 bp, Heterodera glycines
  Promoter: Source sequence=SeqID_841; Location=1..541; Strand=+; Gene =SeqID_62625
cccagggccttcccctcccctttccctggctctgtcccccttctcctccctttccgtcccctcttcttcttttgctccggctgatgtttatggccgatgaccaaagctctcgccatcctttcccgtctcctttcttcctcttcctcttcttcccctcatcatcgatggaagagaagggccatcctcccacctttgaaaccccccgggaccaccaaattggagctgatttactggggaacaaaggaaaggaaggagaaaagtgaagaaaaaaagaaaagaaacgatggaaagacaaagcggatggaaaagaaaggcaaagaagaaaaagaaggaataagtcattagtgggcttaacaaagtgatcatttgttgataagagaaaagtaatgccatcccaaaaaactcttccggcaaaacagaacaattaacggaaggaaatgggtgccttggaacaattcattaattattctttatttgaccgacaaagggaatgagaagcaagggataagaggagaatgaggagggagatattgtaatgatg

SEQ ID NO: 112051 - DNA, 307 bp, Heterodera glycines
  Promoter: Source sequence=SeqID_5581; Location=2516..2822; Strand=+; Gene=SeqID_58550
atcagaaattgaatattctcacagggggtttttcctgtcgcaattttgattggaatttaaatatttcagttgggcataatcagcagataataaccaagatttatacttttttttgtcgagaaattttcatagaatcttgggctccatcattgatccataacaaaataatgatcggtgtaatttcgtgtgattttctgagtcaactttttctatttttccccaataagttttttttttaaatcagaataacgggagcagtaccagcagcggcagcaccaacgccaacaacaatagcaacaccacaatg

SEQ ID NO: 112052 - DNA, 130 bp, Heterodera glycines
  Promoter: Source sequence=SeqID_21104; Location=2234..2363; Strand=-; Gene=SeqID_51692
tttacataaatgtggaatattaattaatattttttattaactgttccaacctttgctcatttttcatcaaatttatccgttttgttttaattaccctcttaattatccttcccccgttgccttaggcatg

SEQ ID NO: 112053 - DNA, 1003 bp, Heterodera glycines
  Promoter: Source sequence=SeqID_3442; Location=1502..2504; Strand=+; Gene=SeqID_84709
aaaataaaataaagatagatatgtattacgtatttttcttaaagattaaaaagtaattctctatcgaatttggtgagaaaattggcgggaccgttggagctgaaatttttcgtaaaaatcctgctgggtcaattctgaatttcattttataattcctgaaatatcaaatagcccctgctaggccagtaaaatttcaaaaaaaaatttgacaaatttttttttcttattttgtaactaatcatagtgcctcaatcgtccccccccccgtcatttttcgctttgtggggggaacatttattatcatttatcaaaattatcagagagaggctcagtttgctgtcaattaggattccaagatctcggattgtttgggtctctttaataatttttccattaaattggcagggaactttaaaattatccttgccaatgtacagagaagctgatttttctggtgaaaatggtagaccccacataaaaattttttggaaaaatacacatgtatcttatttattcatcaccccataactttaaaattggatagtaaataaataaataattcagaattttttttctctattacctatatgcaaaatttgttgtggatttatgtaacaagcagaaaaaaaaaaaaattttatttttacataattaaaacaaagagatagtacaccaaagtgagagaaattacaaagaaaaaaagcaactacgagatagtatgtgctaggcttttctctgcacagcggagttgacccatagagcacacctctgaaccaaaaaaaccttataaatatgtcgtctcttggggttaattttcattttgttgtatcccattgtttttactctttttcgctaaaaacctgaatccgcatagtttttcgagacaaaatttgtaaaaagtcgactaaactttttctgatttctcccacctttgaaaacattttgcttctatctctataatatgtaaactcggccaaaaatttattcagtttaaattttcatg

SEQ ID NO: 112054 - DNA, 514 bp, Heterodera glycines
  Promoter: Source sequence=SeqID_571; Location=4067..4580; Strand=-; Gene=SeqID_56437
attgcaattgattgacactgaaaacatcaatgaattcagctcagttggaaataattctgaaaaggttgcgccctaccaaaaataaattcattggtgttttcccatctgatcgaattccgaagcgtgtttctaaatttcctcattgtatggtcgtgaatacgggcaaagaagggacacgaggtgagcattgggtggcttgctatgcttcaagccatcgaggggtggaatattttgacagtcttggtgagtacccaaaccccgatttagccgcctacctcaacacatttaaagaggtgctggtcactaaagaccaaattcaacttcccacatccgatacgtgtggccatttttgtatatattttttggcaagccgatgttctggcgttcctttctgccatgtgattgagactttgcgcaagactcgaagtatggcagattacctggtgaaatggtttgtcagaaacttggtcaacggtctataaaagctcacgtttcctgaacagtgagaaaaatg

SEQ ID NO: 112055 - DNA, 308 bp, Heterodera glycines
  Promoter: Source sequence=SeqID_38046; Location=925..1232; Strand=-; Gene=SeqID_66985
ttgcgttctttttgctctctcatttttccaactctctctttttaagttacataacaacagagttttgccttagctcttttttgacacaccaatcaattggaaaaagggaaaattgagccacaaaaatgaatcgacggtaagaaatttccgaccgtttcgatgttttggtgacacgcattttgatggaaaaacggaattcacaatttggagacgtatcagaattgaaaaggacaaaggaccaaaagcaaaactattggtctattggatggattttccgatgccggaatttgtttgtgcctttatatatg

SEQ ID NO: 112056 - DNA, 116 bp, Heterodera glycines
  Promoter: Source sequence=SeqID_23421; Location=2011..2126; Strand=-; Gene=SeqID_54126
ggaaaacaatcgcaagcttgtcaaagcattattgccttttatcgtgctaaatatgattggagtggcactaaaatcactgatcaacttcttttttcagctgtttatggtagtaaatg

SEQ ID NO: 112057 - DNA, 128 bp, Heterodera glycines
  misc_feature (5)..(6): n is a, c, g, or t
  Promoter: Source sequence=SeqID_35074; Location=682..809; Strand=-; Gene=SeqID_64719
tattnnggttagtttgactatttaaattcggtattgttatagttgttaactgggaataacttgtgacgaaggttttgaccttaaacttataattgacacactttcacaatttcaggcgttgtccgatg

SEQ ID NO: 112058 - DNA, 388 bp, Heterodera glycines
  Promoter: Source sequence=SeqID_2812; Location=2189..2576; Strand=+; Gene=SeqID_81742
aactcctccaacagctcaatggcacgcacctgtcgatggcaggggaaagggacggcacattattacgcaacgcacaaagtgcaggaaaatttcaaaaattttgcctggcgatggctgccagataaaagggaattcttcgcccttttgcatgaaaatttaaaataatttacaaaaaaaaaaaaaatttctgcttgacggcggcatctgacaaatgagcataattataagaaatttttaaaaagaatttattttttaaaacattttgttaagaaaattgtcttaaaattttcaaaaaaacattttttcttgaaattcccaggctaggtgcttggtatggattgaccaagtaggaaaaagaaaggttatggccaaagaaaatgaaaatatg

SEQ ID NO: 112059 - DNA, 1003 bp, Heterodera glycines
  Promoter: Source sequence=SeqID_19554; Location=1119..2121; Strand=-; Gene=SeqID_84285
cctaattttaaagtttttttttgtgcatattttgcgatttttgtgcaatttcacggctttatttgcatatttaggtgcacattttggtcatttttcatgcatattttttgcagccctgctaataaatgatattttatattttttggtatcttttcaaattatgtcctttgaagtgggggcaccccaaaacgtcgccggaagactttttggaccataactttgttcattgtaaatcaaattatgcattcttggtgttgttcgatagctttatgtgtttactattaataggctaaatttaaaaaattttcgttaagtttcaaaaaagttatggccagaaggaactcaaaaacctagtatttcgaacttttttgctctgattttttttgtacattaataaaaaattttgaaaaatttgtagattaatagagtttttcataagctttggaacaataccaagaatgtttaatatggttgagtaggaaaaaagttatggtccaaaaattcgcccggcgacgtttcggctggcgacgttttttcctggtccgctttgaagtcagctcggacggtgcacaattatgtattgagaatgaaagaactttagccgatcattgatcaaaatgactcatcataagcaaaaggaagcttaaaaaaggaaggagctgatcaatattgtgtaaaactcgctgttcagagatcacatcactttaacagttgtgcttattttgtttactttaaaaataaaaacaagaaggagaaggagtgtcgaacgcttatgcctaatggtaaacaaaaacatttgtggtgcctcccgggagagggggaagaagcatggacacatacataaataggatcggtcggtcgtccatcgaccgattcatttttctttttttctttcccgcaattgtcttttatcctgaatatctgtttttttcaaatcctcgaaatttaaattgttttaagccttaacaaattacacaattcctaaattgcttatttgaaaatg

SEQ ID NO: 112060 - DNA, 199 bp, Heterodera glycines
  Promoter: Source sequence=SeqID_6489; Location=2747..2945; Strand=-; Gene=SeqID_61765
atatattactttaatttttgttttattttagaattgttaaacaattagagaattgtttttctgccgatacggctcattttttctaccagtttggtcaaaaatctggtgactaaacaatttatcgttgtttttctgccgctacggctcattttttctaccggttaggctttttcaaatctggtgccagcctgttgccatg

SEQ ID NO: 112061 - DNA, 263 bp, Heterodera glycines
  misc_feature (42)..(42): n is a, c, g, or t
  Promoter: Source sequence=SeqID_44779; Location=1..263; Strand=+; Gene=SeqID_72203
agaagaattaagagtgaaggtaaaagagaaaatgtgtgtatnaaaggattttaatgggaaattttggtagaaataaaaatgaaaaatggaagtaatgataataatgagaaatgtttgggtattttatttttgtgaaatgttttaaatgaaggtagaaattaaataataattaataaattgtaatgaattgttattaagataaaaattggagttgtaaatgttgggtaatgattagaattgtatcagaaaagtgaggtgtgatg

SEQ ID NO: 112062 - DNA, 971 bp, Heterodera glycines
  Promoter: Source sequence=SeqID_1740; Location=5646..6616; Strand=-; Gene=SeqID_75629
ttcgccccaatcgcacatttgtcttaaacaccgcgaggactttgagcgcgcaatgaattgcctaaagtataaaataaagagggcatttttaattggaataaatcggacagagaagcaaaaatacccgggaaaagcctaaaagcaaatgataatttgaatcgaagacacaaaccgatcaaattaattgggctttcaattaatattttttatgaatgaattgcatcgctttgaaaataataatgaaaaaagaatcgaattaaataatttgctaaatttctctttgttccttcacttcagcgccacaaattcgcactttcatttccacgccgcctgctcaaaggcggccaagcgaagcattgacattgaccgcgagttggcggagacgcgcggcttcagcgcaacggaggcggccaattaccaccagcaggacttgcggtgccgcttccaagcgtgcactttgcatgccagggtaagggcgaggagaagcggaacgggggcatcactaattacataattaaaatttaaaataataattttctatgaaataaattaaacggtaaaaactatttttcactcattcgagttttaaaaaaaagtttaatcttttgaatgaaacttaataaacttttattttacactgaaaagtcaaacttttcttattattttttcgtcaaaaaagcggtgcctttttattgaagaattttttcaaaaagcaaaattgacaaaaaaatttgcaaaagtccaaaaaagtgacgtaattcttttagttggcaaaaagtccaaaataatgatttttttggctttagatgaaaataaaattgttttccatgggtttctcatcaaaaaaaagctgcagaaaatttttggaaaactgaaactcccagcccgattgatcagcaagccaagatgggatttagatgaaacaaaaaaatttttatttttttgcggagataaaaaaataaataaaaatg

SEQ ID NO: 112063 - DNA, 619 bp, Heterodera glycines
  Promoter: Source sequence=SeqID_19467; Location=3120..3738; Strand=-; Gene=SeqID_84187
ttttgattggtcgccaaagtgtccattgtgattggccatctaaatgtttgtccactaaaatgtcgaaacgtggcgaaatcagtgccaatttgaggccgagttggtgacgaccaaaaaacggcagaatgttcatccaaatgtcgctgcacagccaactgaaaatgcgggaaaacagtagttaaatgaagtttgtaatttttaaaactcattaccgtcggttcattttgtggcaattagcacaatttgccgtattagaattgcgaaggacgtcaaaagggcacaataataattatgttagaaatatttttaaataatgagaggcaaatggaaaaagcaaacatttttatagttctcatgtcctttgctctcgcaatctggaaaaagaaaactctaaactttattttatcagtacttttcaaactatttttaattttttgtaaaattatttaccaaactcaaaccagcacaacaacagacactgttcgtttggttttttggggcggttttttggggtttatttatttttcaacagatttcttccaacaattcttttgctgtcactaagccgcccttttttctgcccactgatcccttttggcggcccgtgttcgatgcaatg

SEQ ID NO: 112064 - DNA, 228 bp, Heterodera glycines
  Promoter: Source sequence=SeqID_25552; Location=605..832; Strand=-; Gene=SeqID_56292
aggaaatattcggtgaaatgttaattttctttcttttttcgcaataaatttctgaatatcacagaaagacaaaataaggcaaaatcttattgaaaaagagagggggggggggggggaaataaggaaaagcactgaaattggttaaaatttaattaaataataaatgacaatttgttaggtgttgtgcgctccatgagaaatgttatgtgaattcttcctgtaagaatg

SEQ ID NO: 112065 - DNA, 355 bp, Heterodera glycines
  Promoter: Source sequence=SeqID_19105; Location=1..355; Strand=+; Gene=SeqID_83846
gtcagtgccatgctaataaatttggaggcattgctctccccgggaaattagcattcgtttctccacgagggcgacccctttggcaaattggcgttgctgaacagctgcgaaatgaacggaaacagccaaaagcagcagcaaaacaacggcaacagaacacaacggcagtcgacggttatcacagcggaggacggctgccaacttttgagagtcgacgcaacgaaattcagcaggtgaacccccgcggggggggggggggggacagagtccgacggggaacaaaaagggacaaaaaaacagtgccaaatggaagggagtaaatggcataatactgatcagattgctgagtgagatg

SEQ ID NO: 112066 - DNA, 183 bp, Heterodera glycines
  Promoter: Source sequence=SeqID_33935; Location=1..183; Strand=+; Gene=SeqID_63854
ttttcaattttttttttcttttttattgtcgcaattgcttttagattaatggaaacgcttaaaaattttaaactttatgatttattcaaagtattggctctaccagacaacgaattcgaaaaatggctcaaagaacttaaactcctacacaccacccgtttttgcgactgtggcacggaaatg

SEQ ID NO: 112067 - DNA, 83 bp, Heterodera glycines
  Promoter: Source sequence=SeqID_22412; Location=856..938; Strand=+; Gene=SeqID_53075
ggttggggtttttttaattttaatgagtgttttttcgttttctgaaattaatgcccccggacatttccagtcccataaccatg

SEQ ID NO: 112068 - DNA, 264 bp, Heterodera glycines
  Promoter: Source sequence=SeqID_3904; Location=295..558; Strand=-; Gene=SeqID_52365
ttgcaccgtttgttttcacgattttaaagaagtcatttagccaaacaaatgatgccaatgtttggcggaaaactcttcaggtgcgcactttcccctccctttgtttaagtcgcttttcctaagattctgtcggcctccggcttttgctgtgttgcgcctcacctctcaaattttgtttttgacgaggaggaaaatgtaaattttttgctgaacttaacttcacatatcggagcacgtgaagttgtgcttgtggccagttcgatg

SEQ ID NO: 112069 - DNA, 351 bp, Heterodera glycines
  Promoter: Source sequence=SeqID_7347; Location=1..351; Strand=+; Gene= SeqID_64540
tttttgaatattttttaattacaatatatttttcaaaactttcctggtttactccttttggggtgtacagtaaattccatttagttttcactcagatcatcatttttatcaatgtttaatttcccggttcctatttttactcgagaaaaccgtatatattaaaggaaaaacggaaaataaagaataaaaattaggattcttaagtgcatatttatacaaattggagattctatactttgttgaccaatttttagtaaatagtttatgattttaaaaaagtccttaaggtgcctgtcaaaaaaagattttttcaaaaaatttcatatataaaaaacaattttaggcctaatg

SEQ ID NO: 112070 - DNA, 880 bp, Heterodera glycines
  Promoter: Source sequence=SeqID_44883; Location=1..880; Strand=+; Gene=SeqID_72294
attgagctggatcatcggaagcgctattttcggacacattaacacacaatagcaaccagtctgccggattgagtctgccatacagcgccaattaaatacatatattttgttaaatattaaattcgaatttggaattaaatttttaaagtttaataatttaaatgaatcgacaacagttctgctaaactctaatgggaatacaaattctcgaagtatttaattagaaattataagaaattaatttatttgctcaagagtgagaaattctgaaaatttttggataggtttaataaatatattttattaaaaatttaaaaatattattacccgatttcttggatttgattttaatgtcctgtaaatgcggaatttttttccattttttgaaatttcttgattcagccgatcctactattttgactatttatcagttcaacaatttcacaaattttgtttgatcgatgaatgaaagcaataagcagaacatttgcttgccatctactggagatttaatgaaagcagcagctgttgaaaaaatacgtataaagtcaaaggaacatttattttcagtttcatctgtttattaattattttaattttgaacaatggataaatatacatattatttttatatgtttttccacatatttttgtatgagaatgcacaaaattcatttttgaccgaaatattttgtgtaaaaacaattttaaattaaaaaaaaattgtactccgtggtaaataaatattaattcacaatatttattattattatttgtttccctgttttgtattctaatacaggaatcattaattttcgattacagataatattttaaggtatttttattaaaaaaaacaattaattttttgtgtaaaatg

SEQ ID NO: 112071 - DNA, 923 bp, Heterodera glycines
  misc_feature (30)..(30): n is a, c, g, or t
  Promoter: Source sequence=SeqID_16726; Location=1..923; Strand=+; Gene=SeqID_81128
ggtcaaacagacgcttttcccgagaacttnttggactaagtgagtcgcgtccagaaaagagagagagaaaggggagcagcggctttcggtggtttgatcggtcggtttgaaggggccttcccgccatggctttaatgctctctctacacgaactccacatcaataagctgctgccgatcagtctcattcttcacccactcacaactctctccttcctcccccccccttttctctctaactctctccccccttttctctctccttcctcctccccccccccccttttcgccctctctctgtcccttttctatctctttcttttcagtgcctttctctcatcgcttttccctcgtttcgctgtgatcctcgtgaaatgagatcaaactcaaaagcttgttgatgattgaattaatttaatttagccccatgaggcagcaaatattactttcctttccaaatttaactgcaacttaaacagcagcaaaaaaggcacttccaatgcccatttaaaagcgtcgacggaattcggactattttatggcggaagggcgacatcaatttggccactaattgtgcccctcggcgagggcattgtgccgggccaattgcctttggcctgcgactgttgcgccactcatccaaatgcttttcttcattttctctctcctctttccattgaccaaccacaaaagtgtctgtccgtttctcttttctcccattttcaccattcgatgatgagtcccttcccctcctttcttccccccccccccggtgtatctgattttgctaatatttctccgattaaaaacatttttctgctcaccattcgccaatcaaatcgcttatttaagctttttttttgctcaattcaatgattttttgagtcaatccgttgtttttttgtttgtttttcaacggaaatg

SEQ ID NO: 112072 - DNA, 68 bp, Heterodera glycines
  Promoter: Source sequence=SeqID_30515; Location=950..1017; Strand=-; Gene=SeqID_60923
ttgctgatgcatttgcaattattcccggctcgccaactggaaacccatacgacttcggttctgtgatg

SEQ ID NO: 112073 - DNA, 103 bp, Heterodera glycines
  Promoter: Source sequence=SeqID_12646; Location=613..715; Strand=+; Gene=SeqID_76320
atttaaaaaaaaaaactcattaaaaggcgaaagtctgtcaccggaagagattctgctgaaaagaacggttttggacgcgcgggagcaggacagaggcaaaatg

SEQ ID NO: 112074 - DNA, 769 bp, Heterodera glycines
  Promoter: Source sequence=SeqID_36213; Location=326..1094; Strand=-; Gene=SeqID_65591
gttaaaaatctgattttttgatctcgaatgcgctaaaatttatgctttgctaattttctccacaaaattgttaaaaccgataatgggagatgaaaaatataatatttgatacacttttgatcaaacattgtaaaaataactgatttgaagcaattttggcagaatttcttgattttcggccccagtatctgattttttgggcccgatgttctgattttgaaaatttttcgatcctagccctgcgataaacaaacaatttttaacctactgatataaatcattcaaataaaaaatatattcatctgtaacactaatcccccaattaaaaaaagagaacattgtatctctatgtatgtatatattgtatattgtatgtccatatccctgtggcattgtcttgctgaatgtattctcccacaaatggttgttgttctatttaattatgccatatacagtatatgtgtatttcataattgtatcatgtttgcactgtttatgcatgttttatggtccttgttctcattgacgaataaatatatatttatatgaattgtgcattttccaattctctaagacttgcgttttcaaatgtcaagaaaaaaaaaaatttagaaaatgttcatttttcattctgataatttctaattagtgctaaataataattatggcattttgtttatttgatgattttaaatttttaactcttaaattcggcaattttcaatcaaaagctttccaaatttgccattcccattcagatagaaaaatg

SEQ ID NO: 112075 - DNA, 135 bp, Heterodera glycines
  Promoter: Source sequence=SeqID_14421; Location=2923..3057; Strand=-; Gene=SeqID_78458
tcaatcggccacactccccgcgttactttcgacctttgagcaaatcggatccaaaaccaaggttggacttgttttgacttgtgatgagaaattgaaactactgaaaccccaaacgaaatagtatgaatgaaaatg

SEQ ID NO: 112076 - DNA, 573 bp, Heterodera glycines
  Promoter: Source sequence=SeqID_2246; Location=4522..5094; Strand=-; Gene=SeqID_78689
gtattactgtctaaatgaccccgggaggctggcgattctatttcactgggccatcgacagattaaaaatagtaaaaactttgctttttggtgggtgtacgttcggaggaccaaaatgtgatcttcgcagggctttctcggtgtgattttttttgctatatcgtcgtgcacaaattggaggtcagggggcaaagattcgcagacatttcatcaaaccacgttcaagtcacttcgatgcataagtacaactacacgcggtatgaataactcaaggagatggtgttggattaccagaaacgagtgaatagaccggttcgttatccggaaaagaattgggccgacaagggatagcaggatactctccaaggatgtaaagaaagaatatgggcccgtgcagaggaaagggattgttgatgaaaactttaatgtgttgccttttggatatttttgaataaacttttgcttttattcctccgccttgtaaaaagtaaatcattctttatttaaggcatgaattgtatcaatcatcatctatttatggcagaatttatcaattaaaaatactttaagaatg

SEQ ID NO: 112077 - DNA, 207 bp, Heterodera glycines
  misc_feature (16)..(16): n is a, c, g, or t
  Promoter: Source sequence=SeqID_23492; Location=1..207; Strand=+; Gene=SeqID_54188
ggatccaagaggaaangggatcaatcggaagagcaaaatgatgaagaaagccggtggaaggaagatttggtgcgaattggccgaagaaatgatcacaatgaggcctggcgagagtttctgaccacaacgacttccttggacagagaaaaggaagagcgattaaaagcaatgggcaaaattggtttgggggaaaatggccgaagaatg

SEQ ID NO: 112078 - DNA, 566 bp, Heterodera glycines
  Promoter: Source sequence=SeqID_3196; Location=2639..3204; Strand=-; Gene=SeqID_83620
aacactgattttttgtgtattatctcctttcattgtttttctgaattgatccatttaattatcattgatatgccaaacaacaaaaaatttgtcgactttcaaaagaaagtatggacaaaataatttaaaaactgcttttccgaccatttttggtcgtaactttttcaaattaataaaaaaaaattgaaattttgcaggaaaattggaaatatttagggctacttaattgaatttacatttttgaatggacttcaataattaaaaatgttcagaaaaccttgggatttgcaattttttaattaaaaattttcgagcagaatgatcgctcacccccccccccttgtttaggcctgcttgaccgtgccgaactccgtctgcgcctgtccgacttagacctgcgccgggttgcccagtactgtcgcaatttggccgacttggccttgatcagcgacctgttgcccaccattgccggcctgtacttcaccgcccgggtggacaccaaccgggccccgttggacctgtcccaggccgctgtactgctcggtgtcggcctgcagcgcaaaatg

SEQ ID NO: 112079 - DNA, 605 bp, Heterodera glycines
  Promoter: Source sequence=SeqID_29691; Location=1..605; Strand=+; Gene=SeqID_60159
atttttccagcaaaatgatagaaattcttcaaattttaatgaatgtaaaatttatttttttatttaaaacaattttcgttttcagcataaagttgcccacattcaacaaaacccaaactttttcatggccagaaggaaaaagcgtgcttctgtcttcggtggctgcttctttggattgcttttagcactgatcgctaccgtacctttttatagctaccgtttcaaaaaacgagatgtgtaccaataaatagagagtgccagagaaaaacattatctttttttctctaattttttgtcttcttttggcgtactatctaatatttttattattaggaaaaacaacatttatttcgccacatataactttttttctactcatacaatttacaccaaattttgcatatcgatagagaaaaaaattctgcatcgaacgtatcaaatatttttttaggttatacatcccattttttcaataaaattcattttatagcttttaatatattcttttttgttctatgggtaaaagaaatttaccacgcaagcttaattgcaaaaaggcgttgaaagagcgtgagaagaagcgggaggagagaaaagcaagaatg

SEQ ID NO: 112080 - DNA, 140 bp, Heterodera glycines
  Promoter: Source sequence=SeqID_13608; Location=2129..2268; Strand=+; Gene=SeqID_77515
ggtaaggatggaaatgaaaatattttatcaaatttaattcgattgattggtaaatgggtctttttcctcttcgtatgtccaaactccaaaaccgagaaaggaaattattaaacaaaatatttcaaatcaatattgaaatg

SEQ ID NO: 112081 - DNA, 1003 bp, Heterodera glycines
  misc_feature (363)..(364): n is a, c, g, or t
  Promoter: Source sequence=SeqID_24818; Location=64..1066; Strand=+; Gene=SeqID_55567
actctcgacgacgccccaggggggggggagtcgtaaatgtgccccgggggatatttagttgttcattgtcgctgttttgcaaaattattagggatgatcggaatacaattttataaaagttaaagcgtgccgccgtcaaaatgtggagaaaaagagcagagaaaagcataaatttaatttattttatgggaaaaggagaaagaaatctacgaataaagcatatttatttttcatcaaaaatgaaaaaaagaaacaatcgaagcaaaagacgaaaaaatgtaaaataataaaaacataaaaatataatataagcacataaaaaggaaaatgaattgatttaagaaatttaaaaatgggagaggnnggggggggggaaagaacaaaagaaaatgaatgaatgaatcaccgggggggggggagagaagtaggccataaacgaattaataataaacaggttctaaaattttaaaataggataaaacgaaaaaaaggtaaaaaaaggggggggggaagggggatggccgagggaggagactgatgtaaggtatcgatatttgtcttcttttgttgggggaggattgaggactcgtgtcagttcagcttattattcacgtgtcaatttacggggttaattcacgtgacaattcacagtcatgatttacgtgttaattcaaaatcatgatttatgtgttaatttacggtaatgattcaaatgttaattcccgggcatgatttacgtgttaatacacggtcattattcacgtgtcaatttacggcttaaagcacgtgtcaattcagctcattattcacatgtcaatttacgggttaaatcacgtgtcaattcagggtcatgatttacttgtaaattcacgatcatgatttacgtgctactttacgggcatgatttacgtgttaatacacattcatgattcacgtgttaattaacggtcatgatttacatgttaattcccgggcatgatttacgtgttaatacacggtcatg

SEQ ID NO: 112082 - DNA, 86 bp, Heterodera glycines
  Promoter: Source sequence=SeqID_16422; Location=1..86; Strand=+; Gene= SeqID_80827
aaaaaaattaactaaaaaaattttgtgtacaagttgcctagtgcacgaactctgtataaaataataaaacactcatttttaagatg

SEQ ID NO: 112083 - DNA, 268 bp, Heterodera glycines
  Promoter: Source sequence=SeqID_22573; Location=1..268; Strand=+; Gene=SeqID_53239
aaattttcgaaaattttaaaatttcaaaaaatcgagctttcaaagctctacaataagttcgctggccaccccccgctcagatcaaagcctggcgcggcattcacctggtactgaagtgtactttttgagctcgcttcagttagccaagcgtgcaggccagggggtggctctaataaaaaaataaaaaataccagcatatagaggacccttcggcggagtgccctcacagcgggaagtttttgattcgggatttagaaaaagagttatg

SEQ ID NO: 112084 - DNA, 161 bp, Heterodera glycines
  Promoter: Source sequence=SeqID_26719; Location=143..303; Strand=+; Gene=SeqID_57478
cctaaaagagcgaatttacaacaacaaaaaacgaaaaacaattgacacggggaaagaaatgagaaaaattaattgtcgggatggaagcaaaaatgagcaaatcttggtaatttaattctcgtggcacctcaaaatcggccactttcactgcgtaaacaatg

SEQ ID NO: 112085 - DNA, 289 bp, Heterodera glycines
  Promoter: Source sequence=SeqID_14698; Location=457..745; Strand=+; Gene=SeqID_78814
gttcccctccccttcgtgtgtttatgttatatttttccccattcgtccaccattcccattttagtatggcgttttgtgcgtgtgtctgtgttggcattttgcccattcattttactcaaaaaaacccaaattctccttctccaataaattgcaaaaaaaaaatatattagttttttttaatttttgggcgttaatcaacgccatttcacatatctcttttttgttttactaaaatttgttatttatttacaattttgtgatcatgtttagctgtgtttttgccagcatg

SEQ ID NO: 112086 - DNA, 247 bp, Heterodera glycines
  Promoter: Source sequence=SeqID_12126; Location=1045..1291; Strand=-; Gene=SeqID_75697
ccgtaccactatcatcacgtggatcattgaagaccgttgttcctccctccgtgcggatgctgtttgcatccgcccggaggagttcactaaaccaattgagtgtttgaacaccgctcatttgggatcattctccgaacacttgttggcggcgccctgcaacgccaacgtctcgatcaacctcaccgatgtggtgcagcagttgaacaacgccaacattgccaaggcgacgggatgcgtgaacagcatg

SEQ ID NO: 112087 - DNA, 241 bp, Heterodera glycines
  Promoter: Source sequence=SeqID_19563; Location=1103..1343; Strand=+; Gene=SeqID_84298
gttctattaaatgcatacaatcaaagatttaaaagattaaaagatttattaacaaaattttaaggggttcctgaaaagccgagtttaaaatgaatttgaataaaattttaaggctttcaataaaacccgaattttcaggaaaatttaaaagaattatattgatttacttaaacagacactttcagtgaaaattatatttaaaaaaactttggaaatcaaataaaaactaaggccgcgcatg

SEQ ID NO: 112088 - DNA, 278 bp, Heterodera glycines
  Promoter: Source sequence=SeqID_25587; Location=473..750; Strand=+; Gene=SeqID_56326
attacgctatatttagtttcggcgggggggggggggatacggtggctgagtcggggatacggtggctgagtcggggatacggtggctgagaatttttcttttcaaaaaataagatgattttttagctttaaaaatgcaaaaaaaaggatggtgtgatctatacatatttattatgattgccattagatcattaaagaattaattattcttaattattctgtacgatggctgaaatttaaaagtctgttaaaactattttttagcaatttgttcaaatg

SEQ ID NO: 112089 - DNA, 113 bp, Heterodera glycines
  misc_feature (57)..(57): n is a, c, g, or t
  Promoter: Source sequence=SeqID_45026; Location=1282..1394; Strand=-; Gene=SeqID_72425
attgaaagggaagcattggcattagtgtatgcggtttcgttattctcgccatatatnagttgggtctgggggttacaaaacttataacggattgtagtgccttaacaggcatg

SEQ ID NO: 112090 - DNA, 1003 bp, Heterodera glycines
  Promoter: Source sequence=SeqID_16952; Location=829..1831; Strand=-; Gene=SeqID_81381
aaatttaacccctaatggttttctaagttcaagttagactcatttacctaagctttttcacaatttcagctgggtgttgtgcaacgatatttgatggacactttcccctctttttgaccgtctacaactcggcctcagattggcactgatttcgccccgttttgatgtttagtggagaattcgatgggaaaagcaaaatgatggtggagcagaattcgcaatgaaaaatttgaatgctgtaagcttttaatattttttaaattactaaaataccagtttcacaaaaaattgtcaaaactttttgatttttttataaacaaaaatttttggctctaatccactttgtgtccaatcacttttatgagtccaaaggtattttaaatgtaataatatgagaaaacaaaaaaaacaacatttaaaaaaagcaacaaacgaaaataatcaataattacttaaattattaaatcttttctgataatggcctaaacgctgagcttttatatattttagcttctggactcataaaatacctttggacttataaaaatcgattggactcataaagtgcattagagccaaatgtttttagttctaatctatagtttcttttactacgaatttttttaaacccattaatttaacttggtacaactaaaaattttatttattgtgttacattattttatttggttgcccagcgatgtttgggtggacatttccttttatcgtcctcaaattggcactcatttcgccccgtttcgatgttttagtggacaaacattttgatggataaagtggatttacgtaagttctattttttcaacatttttacattgagacatatgaaattgggaaccaaatttttttttgacttatgttttcgttattgaacaggcttacaaattaagaccttttcacttcttttttgggttttgaacataaatttggtactttttttttgctattttatattcttaacattttcagcaactgcgtaacaatg

SEQ ID NO: 112091 - DNA, 247 bp, Heterodera glycines
  Promoter: Source sequence=SeqID_30658; Location=1689..1935; Strand=-; Gene=SeqID_61066
gatatgaagctgacatattggatttataaataagtaaaattgcccataaaggattcatctaattcccgctttaaacccaaagttacgcaaaattgcatacaaaaaatttgaaatttttctaccatatatctcgcataggtggagctttggcctagtcgcacttctgacaacatttaactttgtttattaccttttcgtcctgttgctattcccctgctggactcaagagaatactgtgcgcaatatg

SEQ ID NO: 112092 - DNA, 147 bp, Heterodera glycines
  Promoter: Source sequence=SeqID_25801; Location=1068..1214; Strand=-; Gene=SeqID_56563
ggtaaaaagggggaaaagggaaactaagtgatggcattcaaaccaaaatggcattggcatacactcaactcaattatgtgaaaccaatttggccaattccctccatataactcctaaaatgttgatattcccgaagacacggacatg

SEQ ID NO: 112093 - DNA, 232 bp, Heterodera glycines
  Promoter: Source sequence=SeqID_5888; Location=4076..4307; Strand=-; Gene=SeqID_59568
ttggcacgcgcggtgctttggtaggccatttaagcaattcgagggcaacctaaagcaacataaattttattttattcccttttcataaatgccactacatatattcatctccatgttgtttttgcctatgatattccatggggttgctggctttgtttggcatgccaattttgacaattgcaaaaattcatgcgacaagctaatcaaaagagttgagcagctgtcaatcatg

SEQ ID NO: 112094 - DNA, 1003 bp, Heterodera glycines
  Promoter: Source sequence=SeqID_11988; Location=1701..2703; Strand=-; Gene=SeqID_75512
ttaaaatcattttttaaataaattaaaatcactagaaggtcgataatttaatttttattaacggaaatttcatgccatctcgcaatttttgtccatattttacgaacccaattaaactcatattccccattttttttttgcctttttggtgattgcctacctattcgctatgttatctgaaaaaaatgttttttcttaaaatttgagtttccttttccctattattttacttttttaaaaatctatgactcaacatattcacttttttattgttttttaaaattttaattaccataaccatttattagcctccaaaatttcgcaggcagtttatatagccttgcgcgcctcaattggcgcgcgctaaggctagaggccttcgttggcgccgactgcatgtgattaatatttttaattaagttaataaatggttatggcaatttctatatcaaaatctcgcggccagttatatagccttgtgcgccttgattggcgcacattaaggctaggcgcctcaattggcgccggctgcccgcgagactgttaaatagattagaaaaatatagatttgtatactttaaattttcttgatgaatgttttgagttaatgataggtctgagtaatcgattaaattttttaagtttttaaagttttgtcaatgttagtaaatattttgccttttctgcccaatcttcttaagatacaccccttaaaaatcggcctaaaattttctgaaaatacgccattaggaaattaatttctttaaaaatatatacctacactgcgctttttgcttttaatttaatttcatgtttttctagtccgttgcgaaatcaaaacgaccgcaaatcgccccctttaaaactccttccaaaaaatctgtccccaaatcgaacatacaaaaaaaaatcgccaaacaaaatcgtaaatctaccagctgtcgcggaaatcacttgcttgagtggataaataatttaaaaaataccaacacaatactatatg

SEQ ID NO: 112095 - DNA, 1003 bp, Heterodera glycines
  Promoter: Source sequence=SeqID_416; Location=7344..8346; Strand=+; Gene=SeqID_51903
aaaagtgcaaaaaccaaaactcacttttcccattacacaatcttggtatcatacgatagcccttgaatttcgttattagcttgttaaatttcaaaaaattttattcactttttcaaaagttatgacaatttttccagctttttggcttaaacttttgaaaaacttaataaaattttttgaaatttagtaagataataatgcaattcaagggctattcgtatgatatcaaccaatattgtgcaatttagtttcgtctaagaaaagttatgagttgatttagtcaaatagcaaattttgcactttttgccccttgacatagcaccttgtgttcatagcagtgtattttaagtgccatactattttaaaatttgaattaacaaatattgaactacaggtctcaagaccattttgcgcataataaatttgaagaaaaaagcctaagcctagacttagccaggcaaacctaagcgttgctctaatttcttattttttaatatttatataaagaaaacaagattaagaaaattatattgttgatcaatgtcatcattttaaattattgcatcattatttaatataatataaaaactacattaaactaataagggatgttggataattcaattgatgtcactaatttaaatttttataaggctgcatgattttcaatttttaattttaattataattttacttaaattgacaatactttttttataaaaatagaaaatagaattttaattaatttcttaataaaaaattgtttttaattaattttttatgtaaaaatattaaataataatcaatgtgcatttatgcttcattaaatcattcaatttatttaatttaagaaaacataatgttttgttctttttcgaaaactccttttcatattatcattcatttttttctaattcaaatttcgaatgcaatttcatcagtgagttaattaacagttaattaattggtcgaatcattttttaattagggagacgacaaaatg

SEQ ID NO: 112096 - DNA, 258 bp, Heterodera glycines
  Promoter: Source sequence=SeqID_41807; Location=464..721; Strand=-; Gene=SeqID_69848
tttgcacttgtctaaaatcgggttcaaatctgagtttttcaattcctaatgtgcaaatgtctggggtgaaaaagcccgaggcgcaaatgtggggtaaccattcggaaaagccttcaaacgcaatagaataagaaatgtttaaaaacttaaaagtgaaagtttccaaatcatttttgccttttcttacaaggcaaccgcaatacaatacagccgttccttaatgctttttttagcattttggcctccatcggcgcaatg

SEQ ID NO: 112097 - DNA, 1003 bp, Heterodera glycines
  Promoter: Source sequence=SeqID_8090; Location=369..1371; Strand=-; Gene=SeqID_66947
cgttttattcggtacagtcgtaatgagggaatagaaatatatggatataaaatggcgaaatttggccataaaatatggacaacaaatcgcgaaatatggacatgaaatagcaaaaatatgtggaataacaataaatatggaaaatatggatatagaaatccacccaagaagcttctagtcaagctaaaaacatgtttttcgtacgtttcaggcctcccataatccaggaaaaaatatggatttccatataattctacttcctattatgaatttaataatagataaaagcaaatttaaaatttttttttataaaaatattgaatttaaagaatctaatggacgtgtttatgacgagaccaaggctacgcacattcagtctatggcaagttaaaaaattattcattatttatttttcgattttgcattgaacgcttttgtgttatgtaaagcgaaaacttaacaataactgagttttgcttattttcactaaagaaaaataattattcattttttaaaaattaaggtgcatttttcttttttcagtcgatttttaggagtatatttttcattttttgaaatcccgtattacggggtgttttttacttagccgtttttcgccaaaaaaaaaccttttttttttgccattttagtcttcgtttttcaaaaatctggtaaagtgggggtgcggcggtgccgataggcgcccccgttaaattttttcagaattttaatgcgatttgttaagaagttaaaatttgctgaatttacttttttggatttcggggggggggggggggcgtcaaagcaaagaatttccgcacattaaatatatttgcaactttatttcaaagaaacaaaaacactaggaaaggaaaatggttttacattttggtttaggatgtcaaagcactgatgtcaaggcgcttcgcacacgacggaggaggaagggaaactttcctccgccaacttcggctcctgctcgccgccttccaactccgtgatg

SEQ ID NO: 112098 - DNA, 262 bp, Heterodera glycines
  Promoter: Source sequence=SeqID_32560; Location=1..262; Strand=+; Gene=SeqID_62866
gcggtaatggaaaaaattttgaagaggctatgcggaacggagtagcatcggggttacgagatagaaaattgtcctaaaaagagatagccatttttctgagaattaattctcaatttccgcagctcttgcggtaatggaaaaactttgaagagtctctgtggatcggattagcatcggggttaggagatagaaaattgtcctaaaaagagatagccatttttgtgagaattaattcacaatttccgcaactcttgcggtaatg

SEQ ID NO: 112099 - DNA, 51 bp, Heterodera glycines
  Promoter: Source sequence=SeqID_25982; Location=935..985; Strand=-; Gene=SeqID_56732
ttatacataatttctttttaggcgtttattggactttcttttatcattatg

SEQ ID NO: 112100 - DNA, 365 bp, Heterodera glycines
  Promoter: Source sequence=SeqID_3411; Location=1..365; Strand=+; Gene= SeqID_84568
agggatgtcgtaaatgatttttcacaaaaattcaaaattgaaagttaatgcgaaaatggaggacaaaattaattcgagaaataattattgtattaagcgaaaatttgcgttgatcagtaaagacattttgtgtagggcaatttggacaatttcgattaaaaactatttttgtgaattgtcccaattcgtcaaattcgatttttgcagcataacgggagaccatttatgcctcaattaattaattgtttgtgcaacaatttgtaccctttaaaaagcaagtgaaaatggtcagaagaaagcgccaattcatttattttattcagtttaattattttgtcttcgaaaatttaattgcccaaaatatg

SEQ ID NO: 112101 - DNA, 660 bp, Heterodera glycines
  Promoter: Source sequence=SeqID_11628; Location=1088..1747; Strand=-; Gene=SeqID_75074
tttttgtgccgatttaattgcattaagcttgcacacaattttccttttttccatataattaaatttgccttaaaataaaaattaaagttaaataaaagcgattgttttctttaaaaaagcgattgaaaaatcctatatttttttctctatcgatatgcaaaatatgaagaaattctgtaaggcgaaaaaaaagttctatagagcgaagtaaatgttgttctttacattattaacaatgaagagatagtacataaaagtgagagaaataaagataaaaagtaaatgtgacagaacgccaattttttcccataattatccataaaaagatttattgtcgcttttttttcttttttaccgtccatgagtgtgtcccaagccccaacaatgacaagaatttctctggaattttataaatatattttttccagtttacttttaggttaaatttcattatcattataaatatagctaataatataaacaaatttaggtgaaattctttgtcaaaccatctattttaggttagtcggtgaaactccgattttgggttaataggcgaaacgtaaggcgaaatgaatgttttccaaccagagaaaaagcaattttagatttagtaattattagggaattttgctggcgatggcatcgatgtgcaaaatg

SEQ ID NO: 112102 - DNA, 627 bp, Heterodera glycines
  Promoter: Source sequence=SeqID_1914; Location=987..1613; Strand=+; Gene=SeqID_76757
aacggtgatgagaaattatacatttatgagcggtcgcccataaatgtatgattgttaattgctgctaattaaataatgattatcgtgagttaatagactcaacgactgtccataactgtaggatattaagtgctcaattaaataatgattgtcatgagttaataggctcaacgactgcgacgatggcaacgaggacggcaacaacgtcacattggcacgcctttttcgagtcaatgccaaagtggtggctaaagacaaattgaagcaaaccaagctgcagaagttccttcgtccgcacaacattgcagaaaaatactcctccggcctcggcaaaaagaaggcaagtttttaaatgagtattccattcaaaacgtacaagtcaactcgtacactgttgtacaaacgcaattcgtagaaaaatcaactcaaattttacaaaataaagcctaggcttaagcctaaacctgaacccgagcaagcctaggcctaacataaagcttaagcctaatcctaaagcctaggcctaacctaaaaattgtacgtgtttcctttgtacaaaaaaacagtgtatgagttagccttttgtacgagttggcttgacaccagcagttggagaagtgccagatg

SEQ ID NO: 112103 - DNA, 739 bp, Heterodera glycines
  Promoter: Source sequence=SeqID_19178; Location=1..739; Strand=+; Gene=SeqID_83928
gcgctaacccccgctagttttattaaaaaggttactgtcgaaaacacctggtttaaaactagcctaaaaaataaaacgccaatacattcaaatttaaaaaaacttttggtgggctttcatttttttctgctacaaattttttgtttatcttggaatgtacaaatgcacgaaaatgcatttattagtttgtttcatttggctccctcttaatttagcaaattccaaattttactaaaatgagcgaccattcgtcggacgattcaagcggggctgagggtggtgatacttaccaagtttgcgaaaaaaacagcgtcccatcactttttggaatttcaatggattttttctaggttgaacgggtgttgaagaagcgcattatcaaaggggggaaggtggaatattacatcaaatggaaggtttgaatttagaaaaactttttttacattttaaatccgtcccctttccttttcagggctacgaaaacatagaggacaacacatggtaaagatgctctgtttttttttctgaatatttgcatttttctttacgggtttccgaccccggcgcattacttttcgattttatgtgccttgcgctttttttttgttccacgcgctaccgccaaatttgtgagatcaaaattgtcagagtatgggtcctgaaatagtgtccccccccccccgcaagtacggaatctgggacatacgcccttttgttaaatttaaaaaaaattcggatg

SEQ ID NO: 112104 - DNA, 211 bp, Heterodera glycines
  Promoter: Source sequence=SeqID_16159; Location=242..452; Strand=-; Gene=SeqID_80521
tttctaatattttttaatgatttattcattataattaggccaaagagccttttccgtttttatcccaaaattaacttttgtttgttttccgttcttcttttgctctctttggtcgccttttattttatttcatttttctattaaaattcttttttttttggtgtattttcaagggcatttcgtgcattttttgtacaaatttttgggcatg

SEQ ID NO: 112105 - DNA, 394 bp, Heterodera glycines
  Promoter: Source sequence=SeqID_4022; Location=1111..1504; Strand=+; Gene=SeqID_52846
acaaatttcgtccatttgtcccttttttcgacaatttgtcatgccaaatggggccagctaactcgaattgcttagtcatagttctatctagtcgagaaatttcttgggttttgggattctcggctttctgcaattagcccattttgatactttgtcgtgcgatgtcgaccatttgtccaatttattaaaaaaatttcggttaaaaggttcataaaaacaaggatatttttcaccttgtacagaattaaaaagtattttctcgatagtctttcattttttgttaccccaatttaaaccgtaacccaatgtgttaggctaccgtatcgagttgacactgtcgcatcaggcgaacattgagcaagcagaaaaaagtgccgaaacggatgacaacatg

SEQ ID NO: 112106 - DNA, 411 bp, Heterodera glycines
  Promoter: Source sequence=SeqID_1113; Location=5138..5548; Strand=+; Gene=SeqID_67991
ttttaattttatgaattaaaaaataataaatgtcaattttttatgttattaatggtttgtatctctctatcgtctttaatgtttgtaatggttttggtctttttctgcttttaattttggtatggatcatttatacaaaaattgaataactaaaaacataaaatcaggacatttatttttcaattagaaagactcgggcaattaagaacgtaaagaaaaaagagatccagaccatattatggtaaaaaattcatttatgttttaagttttaatttataaattatttattattttatctatttttatttgatattttgctttatttttagtcattttatgaagtttttcggatccaagttggaatgaatgaccaatttgtccaaattccgtctttcaggcatcttggacatg

SEQ ID NO: 112107 - DNA, 353 bp, Heterodera glycines
  Promoter: Source sequence=SeqID_3798; Location=1307..1659; Strand=-; Gene=SeqID_51913
tcacgaatcttacatgtcttttgactaagtagtaatcactaaccctcactcgaataaaaatcgaaatttttaatttttcaaattatgatgttttgttcaaatttagattaggaaatcggaattgatcaaaataattgaaagattcgtgatcggggaccccaaaaaccccagagaatacatttttatgactatcttaaaaaaattttgcaaaacaaaagggtccccccttttgaaaaaattttcaaaactggtcactttccatatagcgccaaaaattttattaatgccattattacctctttttccatgtttagaccgaacaaaataccccaatattttctttctaaattatg

SEQ ID NO: 112108 - DNA, 304 bp, Heterodera glycines
  misc_feature (21)..(21): n is a, c, g, or t
  Promoter: Source sequence=SeqID_37495; Location=1..304; Strand=+; Gene=SeqID_66557
tttaaaaaaagttattgaccntggctgagaaatcaaaaaaaccaagtttttttttgaagagttaataatttttttgaaactttactaaactttttgaaattttgcaggctaattgatggcacctagagctatcgaatgatataaaaatttaaaaatttggtttcttttaagaaaagttatatgaaaaggtcagccgtgttccgggaaatttttttttgaataatttcctgaaaaatcagtgaaacttagtttttaatttaattaaattaaatttttaatttagttggaaaaaattgaccaaatg

SEQ ID NO: 112109 - DNA, 127 bp, Heterodera glycines
  Promoter: Source sequence=SeqID_8784; Location=751..877; Strand=-; Gene=SeqID_46643
tggtaatctaaacatttatttatttattcttattttagcattcattttttagttaaattttcatttttaggccatttaactaaaacataacttaatattcttcttctccgttcacccaaacacaatg

SEQ ID NO: 112110 - DNA, 1003 bp, Heterodera glycines
  Promoter: Source sequence=SeqID_2339; Location=460..1462; Strand=-; Gene=SeqID_79218
catgttctttcaaatatttccttttctccactccaaaattttattaacaaatttaatcaatactgtaaatttaacggccttaaaatcgcttcaaataaatgtttaactttacatttaggacacaaaaaccaaaaaataaattattttattgatgactttccaattcctaaaaatcccggaaacgaaccagtcagagaccttggcatttattttactaatgatttgaaatgggcacaacatattaacattatctcgaaaaaagcattacgatctgctttcgctatactaaagtcaatcaaaactcgtgatacgaaaatacttgtaaatttgtttaatatttattgcagaccaattttagaattcggatctccaattttcaatccttatttaaaaaaggatatagaaaaattggagaatgttcaaaaaacttttttgagagtaatatttagacgtaacaattatactgttgattacctaattatgctgaattgttaaacatttatgatcaaaagtcgcttgagagtcgtaggttaaaaatagacttaaaactttttcatgaaataattttaggtaaaataaatttacaaaataacgaatccttttctttttccaaaaaccctgtaaaaaacgaattcactgtaagaacagcttattgctcaaccaatgttagatacaactcgttctttattcgaacctctcgtctctatagacttttacctaaagagacgagattactaaatcctaatgagtttgccattcttgaaagatctgatcttaatttgttgatttctttgccaccccaactccaaaagtgaccaattgattgttttgatattattatttcattatttctttatttttcggcgtcacgcttttgcgtataaatgattgattgattgattaaaaaaattcaaaaattcgagccataagaacaggcccgtaaatatttaaacgagtcacgatttgcaaagtcctctataagatttctcaaattgttgcaatg

SEQ ID NO: 112111 - DNA, 812 bp, Heterodera glycines
  Promoter: Source sequence=SeqID_11362; Location=1174..1985; Strand=-; Gene=SeqID_74754
atcacagttttgaaggatggcagagaatttgcaagtgcactcgcgcagtggacaaagtgaagccaaaaatggagaaagagcggcaaatttaatggacttttacatggaattgatcggcaaaaaagaaggaaaggcacaggtaaagaaaaaacaaaataaaatgtaaaaagtggaatttggcactttcttggcaaggctttcactcaaatgccggagcatcgactgacaattggcacacaaacggagcgaacagagagcgagacgaaagagacacaacggagcggagatgggacggaggaaaaaagtgccgaaaagggagggcaacagaacgccaaacaatgggcggaggggaggaaaagcagcggcacacgacgactgaacattttcctgaaggcggttgagcatgtcagtgcttttttgggctgtttgccaattattactcgaggcttttgggttcaaatttcaaatccagttaaataaggggttgatttttgtgagttcggtattgactctctctctatcttggccgaattcagagaaaatgttgcatttatttggtgtttttatcagtctcagtattaattagtgaccaaataattgctttgtttgttcagttggtggacggcgttctttcacttgcgcacacttccgccacagatcaccgcccattgcttcagcacaactccaacttggcgttcagctcgcgcttctccaccttttcgcttagcaacgcttttttcaaaggcatttggccattttccatttgccatgccaattcaaattcattttcagaaagccgtttgtgcgctatg

SEQ ID NO: 112112 - DNA, 1003 bp, Heterodera glycines
  Promoter: Source sequence=SeqID_17394; Location=501..1503; Strand=-; Gene=SeqID_81872
tccaatttttatgaaaattgactattatatttcttatgcagtttttacaacccgttttaaaccggttgttcaccgtttaaaccgtttaagtcattaaacggttgtgtttttgtaattttgtaatttcataattttaccattgtatttcttacgcagtttttacaattgtctattcttttgtggtccgacggattgagtttgtgttttgcaggtgtttcagccggattataatttaaaaggttccggattaaactgttttttttaaggttaaacggttgagttttagtaattttattttacaattaattgtatattcctcagtgtaccgacggattgtgtttatgttttgcaggtgcttcaaccggtttataatttaaatggtaccggtctaaactgttaaacggttgtgtttttgtaattttgtaaattcatgttttaccactggattttcttacgcagtttttacaacacgtttaaactggttgttcaccgtttaagccgttaaatggttgtgtttttgcaattttgtaatttcatattttaccaatgtattttcttacgcagtttttacaacccatttaaattcggttattcaccgtttaaaccgtttaagtcgctaaacggttgtgtttttgtaattttattttacaattaattgtatattcctcagtgtaccgacggattgtgtttgttttgcaggtgcttcaaccggtttataatttaaaaggtaccggtctaaattagggttcgagccccgcccccgcccccgggggcgggacaggttttttgggctcacccccgcccccgtgactctgacccccgcaacccccgcccccgcgaccttcacccccgcgggggaacgggggtgaaaataaaaatgtgtgatgcattgttaattagctgatgatacaaaataaataaatttactttccaattttttatttaacaaatatttcaaatcacaactttttttatatatttttcttgaaatcaggcaaaaatg

SEQ ID NO: 112113 - DNA, 74 bp, Heterodera glycines
  Promoter: Source sequence=SeqID_26719; Location=1104..1177; Strand=-; Gene=SeqID_57479
ttttttgatatttgtttggacttcctctacagttactgctcgaactcggcggtaacaatgccatcattgtgatg

SEQ ID NO: 112114 - DNA, 888 bp, Heterodera glycines
  misc_feature (58)..(58): n is a, c, g, or t
  misc_feature (169)..(169): n is a, c, g, or t
  misc_feature (197)..(197): n is a, c, g, or t
  Promoter: Source sequence=SeqID_30110; Location=807..1694; Strand=-; Gene=SeqID_60552
ttcacgatcatgattcacgtgttaattcacgggcatgatttacgtgttaatcaaatcnatgatttacgtgttaatttacggtaatgattcacatgttaattcccggggcatgatttacgtgttaatacacggtcatgattcacgtgttaattcacggtcatgtgcgttnaacttacagtcattattcagtgtcaatntaggggttaattcacgtgacaattcacagtcatgatttacgtgttaattcaaaatcatgatttatgtgttaatttacggtaatgattcacatgttaattcccgggcatgtacgtttaatttacagtcattattcacgtgtcaatttacggcttaaagcacgtgtcaattcacggtcatgatttacatgttaattcccgggcatgatttacgtgttaattcacggtcatgtgcgtttaatttacagtcattattcagtgtcaatttacgggttaaatcacgtatcaattcacgctcataattcaagtgtcaattcagggtcatgatttacttgtaaattcacgggcatgatttacatgttaatacacggtcatgatttacgttttacttcacgggcatgatttacgtgttaatacacagtcattattcacgtgtcaatttaggggttaattcacgtgacaattcacagtcatgatttacgtgttaattcaaaatcatgatttatgtgttaatttacggtaatgattcacatgttaattcccgggcatgatttacgtgttaatacacggtcatgattcacgtgttaattcacggtcatgtgcgtttaacttacagtcattattcagtgtcaatttaggggttaattcacgtgacaattcacagtcatgatttacgtgttaattcaaaatcatg

SEQ ID NO: 112115 - DNA, 1003 bp, Heterodera glycines
  Promoter: Source sequence=SeqID_4562; Location=460..1462; Strand=+; Gene=SeqID_54899
tcaaagaggatttttttgaaaaatgaggatttgcgggtttttgtggtcttttgagaaatttgaggatttttgtggtcttttgaaaaaaaagtgacaaaaacgcatatttttttgaaaattaggtatatttggcaaaatgttcgaattttttcttcaaatcttaaacatttttttgacaaaatttgttaacaaatcgcactcaaaattccaattttttcccggcagcgcctatcggcactgccggaccccctcccccaatgcttccaaaaattttttggaaaaccgcgccacaaaaagagcaatttaaaagcaaaaaaatttaagagatgtcaatttattaataaaacaatagaaatcgaattattttatattattttttggaggttttaaataagattagttttagatatttaccaaaaattaccaattttgcggcctaattttgcgattcttgaccaattttttaagaaaaaataggaattatttgggtccggcggcgttgataggcgccgtgattgttttcaaacggaaaaatgacagttgactgattttgtttgcaattttatgatgtttcaaaaaatgaggatttttccttccaaatgaggattttttgaggtattttaatggcaaatgaggattttttatggctgaaatgaggattttcaaaattttgagatcacatctctggtatatggtcaaaagaaatcgtctaactatgctaagaataaacaaaatactcatttaaaaaagttgaacacctaattagagcactttttaatgaagcaattgatgtaaaatcaaaattaaagaatattagccaaacaattatatatgtatattatggaaattgatatgctggggcaggaaaagcccattgaagcagaatgaccacgaacttttttacctacccaaagagcatttaagtttaatatttttcttatttctttttttgcgcagcgctttatttctgtgccactttttcgtcggtttttacaaaaaaatg

SEQ ID NO: 112116 - DNA, 259 bp, Heterodera glycines
  Promoter: Source sequence=SeqID_937; Location=1..259; Strand=+; Gene =SeqID_64514
attatttttttttttgagattttcagcagttttttttgaaattttatgataactttcataaacttttcacgaaacaacttaacatattttttccttgaaaaatttctgtttggaattttttttttttaattattgctaccagattccggagtttgacattattgggaatgcaatatgtaccatttatcacatacattgatcactccgcgctcactatttcaccgctccaatcactactatttgcgacaggacaggcatg

SEQ ID NO: 112117 - DNA, 188 bp, Heterodera glycines
  Promoter: Source sequence=SeqID_12572; Location=1..188; Strand=+; Gene=SeqID_76231
tgcaggtcgaaaaagaaattatttaatcagaaaaatggcatagagagcaattcacggcacaaaatttttcggttaaatctctctggattgagtgatccacgaaaaaatacattaaaaacttaaaaattgcccccccactctttcgtgtgatcacctccaaatgctttgactcgatcagtggcgaaatg

SEQ ID NO: 112118 - DNA, 397 bp, Heterodera glycines
  Promoter: Source sequence=SeqID_9677; Location=650..1046; Strand=+; Gene=SeqID_72299
aaaaatcaaaaattttcaagaaaaaatcttattgttagaaattttacaagaaaatttcaaggaaaaaaattttgaaaaatttctagctattttttggaaaatttttcttgaaaaatagtaatttatcataaaatgaaaaaaacgctaggaaaagtttaaatttgtttcttgaaaaatttctaactttgaaacggcgggcagattttgggcgcgatagtttggagtgcacccagaaaaattgccactttttgcaattatttattttataaatttgtgccctcccccgaagaattatccggcactccgtgcgttcgcttctgtccgtttgcgtgtgcccgagccggacggactgctcaatgtgctcgagtgggcaaattcgttggcgcgccgctccatg

SEQ ID NO: 112119 - DNA, 497 bp, Heterodera glycines
  Promoter: Source sequence=SeqID_2403; Location=3582..4078; Strand=-; Gene=SeqID_79546
acacagtgtaaaacgaaatttagcaagaaattttgggaatttaacagaaagtttttcgttttatgcacttgagaattcgaatttgattctgagtcctggaaaacttttaaaacactaaattttctactaagacaaaaaattttcgcttattttttcaatttggtcagatggaagagaacgacgaatttgcaagaaaatttttattataaaaggacgcgttttcgcaaatgcgcatcatttgttcaacaaatcgctattcaattcaattatttccgtcatttctgcccaaattttcgtcgtcaccgccgtcgccgctcataataacgcgcaatgtcttcatcaaaaagtgaaccccacaacagcagcaacaacgacaacgacacacgccgcaaaacaacaatgacaacgacaacaacacgccgcaacaaaatcagcagcatcaccaccatcatcatttgccacgtcgctcatgcaactcgcactcgtcgccgatgatg

SEQ ID NO: 112120 - DNA, 455 bp, Heterodera glycines
  Promoter: Source sequence=SeqID_21545; Location=1497..1951; Strand=+; Gene=SeqID_45662
atcaccgggaccgggaaaagtcccgattttttcccggttttcccagccaaaaagtcccagtttttcaacccgaaaaggtcccggtcccgggtttgcccaaaattcccggtcctgtacaacttcacttttaattaataaattatatagcacaaaatgattgaatttggtttttttttttgttcgcagctattaaaaaaacaacaacaatttaattgaatttattttttcaaattaatgaaatttgtcgaaaattactcctagatgacggaatttacgcaatttaagcaacgacaaattcatcaccaaattcatttgccatttctattttattaaacaaaatatttttaaattttcaagaaaaaaaaaattcaaaacaccaaaaactttaccctaagcattttcaattaaattcacaaattttttaaaattaggtgctcagtaagcctggcgttatg

SEQ ID NO: 112121 - DNA, 795 bp, Heterodera glycines
  misc_feature (5)..(6): n is a, c, g, or t
  Promoter: Source sequence=SeqID_5111; Location=1266..2060; Strand=-; Gene=SeqID_56947
tatannttttttgaaaaatttcgtcgaaaaaaatttttaaatattttttttttgtctgagacggagttggccccttatgcactaagacggagttgacccctaccgtccccaaaagccacaaaaatcctcattttccaaaaaaaaatcctcattgacctatcaaaaagccacaaaatgaggataaatcctcagatctggcatccctggttattggctatcattcttgaaagatttggctttatgtttaacaaatcatcaatttaagtaataagtaaccgattttcattaataaaaatatcaaatatgaacaaataatatggaaaaaaacaaaaacatgtggaacaaagccaagcaaaaaaaagagaagacaaatgtgaaaatgcaaaaatattttgctaattggaaaagaggatgatcaataaacgaacccaggtttaaaatcaaaatttaatgtatagaacataaaagataaatcgcccggtgggactcgaacccacggcctttcctcaccgtggaatgctctaactgactgagctacgggtgcctgttttggttctctcatgtcctttatctcactttctttcacactccgcttccttctgacatcacagttgggacgcggacagaaaatgacgcggacgcgacacgcgtttgttcaaaattttgttttttattttaattaaaccaacgtttgtaaaatttttgagctaaaattcggtggtaaaattaaaatgcatcactgactaaagaaagtgcctttccttcgttctgtcgtcaaattccctcctcctgatg

SEQ ID NO: 112122 - DNA, 234 bp, Heterodera glycines
  Promoter: Source sequence=SeqID_1651; Location=1..234; Strand=+; Gene= SeqID_75077
attcggctttttgtttgaattcaggtccgggattaggaattagtctaaatgggtgtcatatcatgatcagcgaccggaaatcccctgagtgactttttaaacataaaaaaccagtttttgcacattttgatctcacaaaaataattcatttgcactttgactttttcatcttcattctttattttttcgtgcaattaactttctcgtttttcagcaaaaaagctattaattatg

SEQ ID NO: 112123 - DNA, 1003 bp, Heterodera glycines
  Promoter: Source sequence=SeqID_18743; Location=397..1399; Strand=-; Gene=SeqID_83415
aaaataagagcgtaaaaacaaaaaccaatatcctgcaaaataatatgaccgaaaaatttacccatttcaagtgaattatgtatgggaatctgtttctgaaatttcactttcacaaataatgtttataaaatgccttcgtagaaaaaatttgttttcttctaatgttataattgctttggaataattacttccaacaattatcaaaagttagtgaaatttgttgaaagaattaattaatggcttagatttaaatcaaaattgcagcatattaaatctgtaaaattcatctgaaaaacagatacatacgaaaacttaactcattaccttggttgatatttaagcacaggaagatgatttaggaaattttccttcacctattttcatattaaaataagagcgtaaaaacaaaaaccaatatcctgcaaaataatatgaccgaaaaatttacccatttcaagtgaattatgtatgggaatatgtttctgaaatttcactttcacaaataatgtttataaaatgccttcgtagaaaaaatttgttttcttctaattttataattgctttggaataattacttccaacaattatcaaaagttagtgaaatttgttgaaagaattaaacaatggactcaaagctccggcattctaaacactgggactcaacccactaactttcaatgacattccaatcactgaaaatcaacccatcagcatttcaatctctaagactcaattatcagactttccaatcgctgggactcaacccaccagcatttcaatctctgggactcaaatctccggcattccaaacaatggactcaaagctccggcattctaaacactgggactcaacccactaactttcaatgaattccaatcactgaaaatcaacccaccagcatttcaatctctgggactcaattatcagactttccaatcgctgggactcaacccaccagcatttcaatctctgggactcaaatctccggcattccaaacaatg

SEQ ID NO: 112124 - DNA, 1003 bp, Heterodera glycines
  misc_feature (39)..(39): n is a, c, g, or t
  misc_feature (67)..(67): n is a, c, g, or t
  Promoter: Source sequence=SeqID_6767; Location=47..1049; Strand=+; Gene=SeqID_62817
cttccgtaccaggtgggcacaaaatcatgaaaatcgcgnccggatcagtcaccagcagagggttacnccatgaaatatcgagaaaaaaccctcaaatctcgagtctcgctgagttttagttgatgggaagtcttgcgatttaaatacgttctcaaatttttaaatatataaagaaagagagagcttcctagatccaggcctggattttcctgggttttgtccagaaaatacaggttcaggtccaacagggaagcaatccatgttcaggctttttcgaaagtcgaactctaaaaaggtataaaattcattttcaaatggacataaaagtgagaaaattcaaaacatttaaatcttagagatcacattagccaaccatttctaagcctcaatctcgagtcttggttttaaaaatgaatcatttcgagtcgagactttgagacgaggaccaaaaaaacagaatgagacttggcccccaaagactcgagaccgaaattctggaacgacaataacattttgttgaacagtttcaatttgatggcttcagtttcaacttttaaaatatttttttcaattttctaaactttaaattgtcaaaaaattcagcttttcgatgaacgagtcgaacaaatttattgtgaattgacgctgcaaaagaaaaggcgaaaaagtccggcgaaaaagccgccactgaaagcgaaaatgaaatgcgcaacgtaattaaaaaagcggataatgaacgaattaaaaatgaaaagcgaggatcacaataattaaacaaaataattacctcctgattacctaattaagcgtaattaggtttcccccgacgccgtccctgcccaacacattgttgacgaccggttaccaaaagaatgggaaattgatgtgcgtcaactgcacatttccccatcagtcggacgtggacacggattacgatagcgacaattacggtatggtagagcaaagcaacggccaaaattgggcggagacgacaccgatgatg

SEQ ID NO: 112125 - DNA, 237 bp, Heterodera glycines
  Promoter: Source sequence=SeqID_31522; Location=803..1039; Strand=-; Gene=SeqID_61847
aaaaatgcgcaattgtccacaaattccacgtaataaaagaaagaattaagaaaatgggaaatattcgcgagaaaattggattaaaatagaacaaaaaattagcaaaaaatagggaattaaacagacaaaaatttataaatgaaaaaagaattaggaataaaaataaaaaatgaccaaaattattatgaaaagaaaaaaagggaatttattaaacaaattgacgagtttaaaagaatg

SEQ ID NO: 112126 - DNA, 1003 bp, Heterodera glycines
  Promoter: Source sequence=SeqID_155; Location=406..1408; Strand=+; Gene=SeqID_75374
atgccgagcagatcatcattattttattatttatgtaaatggttcaatttgattgtttgtgctgcttcatgtgcgcataagataataatatggcggcaggccctttatttgcttggacaaacccgcgtaaacatttgcttttcagccattaatttgatttttttttatgggaacgcaaacatcccgaccttctaaatatgtggcttgaatcccggatgttttcagcatttcacaaagtgatgctcaatcccaaatcaaattacctaatttaaaaaaaaacacccaaaaatcttcaattctttctttatattttcaaaaaatgccacattgactggctccttccaaaattagaaaaaagtgtaaattctctgattctgagaaccctagcaaaacttcttgtgaacaaagccgattctttggcggcgccaaatcaccattttttatggcctaaaaattgcaccacatccctttgataatcatgcaaataatcatattaatcggttttgttctctgatcagaatttgcgcagcaactctctgcggctgttgctgatcagtgatcataatggatcagcttcaattatgatcaacagaggaactgataagcaatgatcagaattgttgtaggataattctgttgatcaattttgtccccactagttaattattttttattttaaattggttaaaataattcattaatttcctaaaaccttgttactctgatcaaaagaattatttttttgatatctaagcacatttatcagctaaattaactgatcagaaaacattatttttcgatcagaagaattcgagaaattttttcaaatttctgagttttccattatttatttttttgcaaaattaattcataaaacattttttaagaaagtgctctgaaacgcatctacctatatcccggcctggtcccggttattaaacaaataactcagggatttaaaatcgaaaatcccgggaaatcccggccctgatcccgaaaaatg

SEQ ID NO: 112127 - DNA, 356 bp, Heterodera glycines
  Promoter: Source sequence=SeqID_9503; Location=1..356; Strand=+; Gene= SeqID_71658
cggcacttccaaaacagaagcagaaacgcccgaagcagcagaggggcgaaggggacgccgcgctaacgagtgggagaagttccgactcggaaaggcaaacaaaaggggggggggggcagaagtaaagtgtatgcaaccgaacccccaattaccacgccactccagcgaaggtggtaaattcataatcttgcatacaatcaagaaagtatcagcctgcaaaagttcaaaaatgttttcggggaattcccagggaaaaataaataattttgcatatgaataagtacactaatataaccaaaaaggattaaataatgcgaatatgagcccgctttaagactgtgtgaattttcagaatg

SEQ ID NO: 112128 - DNA, 114 bp, Heterodera glycines
  Promoter: Source sequence=SeqID_21392; Location=466..579; Strand=-; Gene=SeqID_52004
ctattagtgtttttatattttattcttttttttagtagaaacataaatattttaaaatttggaatatttcttctacagtttttttataactttttaatttgattttagataatg

SEQ ID NO: 112129 - DNA, 498 bp, Heterodera glycines
  Promoter: Source sequence=SeqID_43336; Location=506..1003; Strand=-; Gene=SeqID_71038
ttatgaaccgttaataatttgatttccgatcaactttttactgtcggatccaatcgaaaaatcttagtcgacccatcagccccttttaatgcatcccgccagcccctaaaaatttatttttcagcattttttgatttttggaaattttttgaatttaattgaaattttttcgaattttccaaaatcccgcaatcccgcacgggatcccgcaaattttaaatgcgggatttgcaggattaatcccgcgggatcccgtcccgcaaaaaattttgagttccagccccgcagcgggatccgcaaatttgaaatttccggtctctacttggagcccaaaattgaatcgccgtgtttaaaaaatttaattttttcgaaaccggctgaccctatgaactgttaaaagtgaccaatacgcataatatttttcttttaataaatttcagcaaaacgcatttatttgttcatttatttctgttgacggactgattattggcaaaaatg

SEQ ID NO: 112130 - DNA, 605 bp, Heterodera glycines
  Promoter: Source sequence=SeqID_14270; Location=1573..2177; Strand=-; Gene=SeqID_78288
aaggttatgggccagaaaattttaaaaagttggttttctacactatttttggctataaattttttgaaaccagacggaattttttgaaattttgcatgctaatagaggattcttaggactatccaattttgacatgacaactcgtacaacaagggacctatcaaagaatagactagtttcatctttcattttaacattttacaatattttttaataggaaagattttctttttaattttttaaaattaaattgtcttttgtatgagttgtcatgagttgttgccaatgttttccaatttttaactcattctcagcacgcaacaatgaattcaagaaaaaaaagcattggaaagtgggtccgacgatgtagtagtgattttgtccaaaaaattctaacttttcaacggggaaagaggtgagaggtgtccgccgagaaaacaaattttcgtttttcaccctgcctcccccggccctctacgcaccccttggactgtgtgtgatttttaaatatttacgaaaatttatgaaaaaacaacttttttaatgcttattgtttcttgccaaccatttctgcgtccaattttggcacatacaacattgaaatg

SEQ ID NO: 112131 - DNA, 340 bp, Heterodera glycines
  Promoter: Source sequence=SeqID_3587; Location=1..340; Strand=+; Gene= SeqID_50983
cccccctccaaaacacatcgggcttttgcacgctaatttgtttttggcatactttgttaatgtcggttttattccatgatgagaagattgtttcgcccagagcatatatcaataccaatggcccgaagaactggaatttatttctttttcgatgtttatactccccctatttattttccactctaccaataataacatttaaataaaattataattttttatttcttatttgattaatttcgatcaatattttttgataattaaacaaattgtatttttcaaaaaagacctttctcgcagtagcaactcatcggcttttttttactcccttcataaaatg

SEQ ID NO: 112132 - DNA, 381 bp, Heterodera glycines
  Promoter: Source sequence=SeqID_24669; Location=838..1218; Strand=-; Gene=SeqID_55407
aaaaaaaagttaaaaatgctatgcttttttctttgttcactaacttagactacatgatatcattcgaaagcttaaatgcttagaagatatttataagctatttataagggattacgcagctcagaaaaaaaaaatccgtgggcagctctaccaatgagctaccgaggcacatttgccctttcttttactgatcgtatctccacgatttaagcgcacagtcagcttcttccttacagtaatagttagtaggctattagagcctgtgaagagctttccaatgatatcaagactgttggattcggtcaacaatttaaaaagttatattgtttccgaaaaatttttgggtttcggaattccgaaaatttttggtgcctcggaatg

SEQ ID NO: 112133 - DNA, 93 bp, Heterodera glycines
  Promoter: Source sequence=SeqID_24075; Location=956..1048; Strand=-; Gene=SeqID_54769
tctgtgaaaagaaaagcaataaaataccgtagtgcaaaaatactgtacatgtttttcatattttgaaatcccactgtagggatcaataaaatg

SEQ ID NO: 112134 - DNA, 811 bp, Heterodera glycines
  Promoter: Source sequence=SeqID_34666; Location=755..1565; Strand=-; Gene=SeqID_64399
aaaaaaaaaaaaaaaaaaaaaattattttttttcttttttttttttccttccccccccccctccccccctttttttttttaaaaaaaagaaaaaaaaaagagggggggggggtttttttttataaaaacaaaaaaaaaaaaaaccccccctctctttttttttttttaagaggaaggagaaaaaataaaataacacccacccctccaaggggcgggcgcgccccccccaattttgtggggcgggggcggggggggggggtttaaaaaaaaaaaaaaaaaaaaaaaaaaaaaatttttttttttttttttttttcccccgcccaaaaaaaaaaaaaaggtgtgaataattttttttcgccctggggggtttttttccccccacaaactcataccacccccttgttgtttttccactttttttttttttttgggggggggaattttcccccccttttttttttccccccccttttttctttttttccttgggggagaattggggggggaacctttttaaaatgaaaaatttttaaaaaattttgttttaatagggggaaaacaaagggcttttttttgggccaatttgggggggggcttacccaaagataaaggagttcccccgttctttttccgccaatcctttgcaatttttttaaaattggtcttggtcagggaatttttgcgcccagttttttggttgttttcttaaaacccttcgcgatcttctaaaccatcctgaggatggggaacgcgcactgaaagagtggaccgcaaaaaagttcaaacaacctacaaagaccgaaatggcatg

SEQ ID NO: 112135 - DNA, 156 bp, Heterodera glycines
  Promoter: Source sequence=SeqID_28105; Location=81..236; Strand=+; Gene=SeqID_58756
ttttgaaaaaacgatcgggacggatcccgggtcgggatcccgaccgaatcccgatcaatcccgaagatttttttcgggatcccgcgggattatcgggatttgctcaaacccatttttttttacttaatatcaatttttgtattttcgcctcagatg

SEQ ID NO: 112136 - DNA, 551 bp, Heterodera glycines
  Promoter: Source sequence=SeqID_5962; Location=1..551; Strand=+; Gene= SeqID_59842
aaaaaatataaaatttcaataacctcgcggccaatttgtggcttatacctcattttttaataataattttttttagaaaatcacacatcccaaaggagaatgttttattatgactaaacccaatgctctttgttacaacctttggaaatagatgactacacatagcttaagaccaaagaggcaaacaaatttaaaaatgaacaagcaaatatttttttaaaaaaaaacttcatattttataaatcaataaaccaaatcaataaataaaatcaaatttaaataaaatcaataatgtaaatcaatcaataataatatggtactacttataaaatattctgtatattagagacacagacagtaacctgccaaaatcttttggttcaaattaatcgataaaaatatgttaagtgcaaaaaaaattaataatgtactattgtaagcgcacaaaaaaaaatcaataatatcaaaaaaaatgtgttccaataccttttggctagagacagagaaattactgccaataccttttggttaaaatcaatcgataaaaaatg

SEQ ID NO: 112137 - DNA, 210 bp, Heterodera glycines
  Promoter: Source sequence=SeqID_18973; Location=1..210; Strand=+; Gene=SeqID_83705
ataaatgtaaaaaattgtttcatatttcgtaaatttctttgattttaaagctaaatttagttaggtagacttaaaaaattcacataatttaaacgctgtctatgccattcaaaaacgatgaaacatttttgaattttaaaatgattttttacaaaaataaaatgggcaagtccccactccccggtgccctcttcttttgcagcaacaatg

SEQ ID NO: 112138 - DNA, 1003 bp, Heterodera glycines
  Promoter: Source sequence=SeqID_4090; Location=914..1916; Strand=-; Gene=SeqID_53154
aaataaagcagtaacgggataaacagttgttttttcaacggtcaaatgggaaccaaagttttagtgaaacttaattctttctaatgaaaatacatataaagcataataaaaaagaaaaataaattaaatatcataagtgatttaaaattattcactattttttttattaaaacagattacccatgaatttttcgtcaaaaaacacatgtgatagactgaaaaaataaataaaccactttaaaatattgggtattaaaatattacagttaacagagcatataatttgcaaattcactttaaaaaataatattgtgtaatattgcgaaatgttaatacaatttacaaataaatatccttacaaataaataaaatgaataaatattcaaatattttaaaattccattttttatgtcttttcatcgattcccactgccccctccccaattaaaaaaataatgtattatatagcaacaaattatagacttagagaaaaaaaagctaagtaaaatattaagcatttaaaaatacaaagttttcacagcacctaaattacaaattcagttaaagaaatagaaattgtttaaaaattgagtaaatgttgatccgctttgaatacaaatatgtgtatatagacaataaaataaataaagatttaaaatgtttttaatatattgtagattaaattttaaaaaataatcaaaaaataaaatcgaatcaaaaaaggcaaataatttttacgagaaaacaaaacctcttaaaaacgatgaaggaaatattgcataaaataatgcgtgtgctataaaacaataaaataaaaattagaaaaaatataaagcaaagttatttgtattttaaactcactcaatgcataaaatataaatgctgaatatgatcaatcatggcggaaaccaaataaatatataattttaaaaaattaaaaacggtttattaaaataattgaaatatcttttctatagacgatccaatacaaatacttgaaatg

SEQ ID NO: 112139 - DNA, 208 bp, Heterodera glycines
  Promoter: Source sequence=SeqID_28834; Location=209..416; Strand=+; Gene=SeqID_46134
ttctgttcagtatgtttttgtgtgtgtgtgtgtgttgtgggcttttgccattttaatcaaatccaaaaagaagacactttctctctacatattaaaattttttgtatatttttgagaaattaaagaaaaatttgaaaatttagctcttttgaaaaccatttaaaccagaaacgtaattcttcacaaaaaaacgaacaaacaaataatg

SEQ ID NO: 112140 - DNA, 223 bp, Heterodera glycines
  Promoter: Source sequence=SeqID_15840; Location=989..1211; Strand=+; Gene=SeqID_80170
gctaaaaatagcaaattatgaaaaagaggagaaaagacaaaccaaccgaacagaaccaaaatcggacataaaagaacgaaaatgaggaagtaattgtgcggaaagaccaggcaaattcatcacaacatggaaattcaagggaaaaactcgttgggaagggccttcaatttcatcgctttcctttcgcaaattttggcagaattcgaccactttttccgggatg

SEQ ID NO: 112141 - DNA, 523 bp, Heterodera glycines
  Promoter: Source sequence=SeqID_604; Location=1298..1820; Strand=+; Gene=SeqID_57370
ttttctcagctgaaaagttgtgcttctggcgcaccatttgacttaaattgcgttcaatttttttactaaacagacaagagaaaatatatatgaatttgtttttggaagggataaacaattatgtttaggatttaacctttttagggatcgtattaagaagcgggcaaggatttcttgggaaccatattccccttttcgggaaaaactggaatgttgtcgcaaaaaatctgcttatcaattctcgatacacggtttttaaagtttaaatttaaatttaacttcgatattattttggcgtaatgttttccttccatttaaatttttttcttcgttcctttcctcaagactatagagttgtacgggatcgggaattttggacaaaccgggaccgggaccaaacgcatgaaaatcagcaaaattaaacggagaattgctaattttcaaattcagaccccccccccttactttttcccaattttgtcggattggggcggcgagtgacgacgaaatcccaataaaaatg

SEQ ID NO: 112142 - DNA, 291 bp, Heterodera glycines
  Promoter: Source sequence=SeqID_406; Location=2433..2723; Strand=+; Gene=SeqID_51620
gttgcgactattcattaaaggataatatcggccataaaatttttgtgaaatcaagtgaacaaagtgatttctataccctcgtgttgggtttaaagcatcattcggcgtatttttgccgaccttacaactttctgctcgccgattaaaagcactcgtgttgtgctttacgaattaacgaattttgttaaaagctcgtgttgttttaaaactgatctttattgttttatctcgtgttgataaattctgatgattttccgctcaccaccactgacaaggcaaaggctcagaatg

SEQ ID NO: 112143 - DNA, 669 bp, Heterodera glycines
  Promoter: Source sequence=SeqID_5215; Location=428..1096; Strand=+; Gene=SeqID_57294
aataaaattaatatttaataaatttctaacaaacatgcccattcgctaaaaagcgaaaatgttaaattaaattaaaaaaataattatccggacaacaattcccaaagaaaatatttaaaaaactgacaaaaaattatactaattttttttttgtcaaccaaatccaacaatcttagtatcatttgaaagctctaagctcttttacatactctattagccttacaaaaccgaaaggattttaagcctggaaacaatttattaaaaaaacatcaaaaatatcgattttcaagtttacaggtaataatttatttgataattgtctaattgccaagcaatagcttagaaaaaacttctcaacatattaggcttgctatgaaaatcgtttgatttggttggcaataaaaaattatagtcaaaaaattggttggggccgaactgatcgagtccgtccgggccacaagcccaaaagaaaataaaaaaaaactgacaaaaattatagctagatgagatttttctagtaaaattatgcaaagatgttttgaataaatatattttacacatttaaaatcatagctttttgaattcgaaaaactacccattcgttaaaagcaaaaatattattgttgctttttctatactttttttttgaaaaatggcactttaggtatg

SEQ ID NO: 112144 - DNA, 1003 bp, Heterodera glycines
  Promoter: Source sequence=SeqID_5656; Location=227..1229; Strand=+; Gene=SeqID_58800
ggaaccttaaaatccttaattttctttaaaaaatgcctcaaattttaaaaaattggctatttttggacataatctaacaatgtattgtatttaaatattcaattttttttccctgcggcgcctatcggcaccgccggcctccctcttccaccctggtcaccaccaaaaagttttttcaaaaaataagccgcaaaaaattgttaaaattttctgcttactaaatttttctgtctatttttttctctaataaaaggattgaccttaaaatttgtgcattaaaaatattttttgagtaactcccgctcccgcccgggactaccgtaaaatttctgcgggattttcacgggattcccgatcccgctcccggaaaattttgaactcccgatcccgctcccggaaaattttgaactcccgctcccgctcccggaaaaatttgaactcccgatcccgctcccggaaaaatttttttaccggactctaattttattgcatttttatgcgttttaaggttttggacggttcagtccctaaggcatttggccacttcagtcccgggtctgtaactcttcagggattggaatataagctcaaatttgtggccagcaatgcattttttaagcctagaaaaaatgcctgccaaatttttaacattttttcgtcgggacatcaattcttgatgattgccaaatgtttcatttaaaaatgtaaatttttgttaagaaaattagaattgtcagtgcgaaaataaatgattttgcctgaatttaaatactccttttggtgctcacaaaaaaaaaaagatttttttgtctgttgacagatttttctatttaagtgctgtctcgttgctgctctttgctcattcctttggcaatttctttgcccattcaccactattcccgttccgaattttatttagtcattcattttcattttaaattttatattttttgtccccacaatttagcacatgtacataaataaataaacaactcttctaatg

SEQ ID NO: 112145 - DNA, 187 bp, Heterodera glycines
  Promoter: Source sequence=SeqID_13017; Location=1057..1243; Strand=-; Gene=SeqID_76792
aaacaaaaataaaaattggattttcactttttaaatttaaaattttcttaggtgtatgatgacttatatttcgggtaaatattgaattaaaaatttttaattaattactatttgttaatttttattaaagattttatcaagtgttacaccggcggacataacaacaccgaatgttgcgaagaccatg

SEQ ID NO: 112146 - DNA, 681 bp, Heterodera glycines
  Promoter: Source sequence=SeqID_19123; Location=1..681; Strand=+; Gene=SeqID_83867
ctgataagagccgctgggaaattttttttgtaattttaatgctatttgttagcagattttgtctaaaaatgccaaaatttgagatttaggctaattttttaaataataatttgtacgatgccgacgacgacaaatggaaaatgaaaagagtcataaaatgaagtcgaactttacttatcaaattttctcaatttaatttaaacagtaaaaatgacggactgggacactatagtctggccgttatagtctgagccaagtttagagcatcataacttttttctttactgaccaaatccaacaaagttgatatcattcgaaagctcttaacaagctctcgaagtcaaattacattttcaaaaaattccccggcggctccttaataatgattctttctaaaaaatattcaaaaattcaaaatgtttcctttaaatttaattttacttaacaattgaaatcactgaataaattatttgcttcggttaaatttttttaaagaatggaaatagcagaatgagacaaataaacacactttgtgcacattcacaaaagactacggtggggcaaagagtttggcctttggccgaccgtcccccgccccagggccataatgtaaatgatcgattataatcatccgatccaatgcaatttctgacaaaaaaggtcattcattctcgcgaaatg

SEQ ID NO: 112147 - DNA, 185 bp, Heterodera glycines
  Promoter: Source sequence=SeqID_23929; Location=1171..1355; Strand=-; Gene=SeqID_54620
gcgccgaacgtcaaaaacattttaatttaaatttatttgatttgttccgacaataaaaaacgtcattattttgtttggattttgtcatctttttcttttgttttggatacttttattaccttgaatttctcattatttaatgaccgaaatataaaatacaaagaaaggatcaaaaaaatcgaatg

SEQ ID NO: 112148 - DNA, 59 bp, Heterodera glycines
  Promoter: Source sequence=SeqID_16098; Location=1..59; Strand=+; Gene= SeqID_80453
ggtaattaccggttttttgggtaccggtaccggtaccggtaccggttttttcaaaaatg

SEQ ID NO: 112149 - DNA, 176 bp, Heterodera glycines
  Promoter: Source sequence=SeqID_3937; Location=184..359; Strand=+; Gene=SeqID_52523
ttccctttcattttgttttgaatcaatctttccgctttgttcagtgcctttgcgcaaaagtcattccgtccatggccgtccgttgaacgctccgtcgtcgcggggctgcgcgtgggaaagggacggaccgccaccgccgtctccgcggagtctacgcgagaggcgcgtgggaaatg

SEQ ID NO: 112150 - DNA, 364 bp, Heterodera glycines
  Promoter: Source sequence=SeqID_6112; Location=3559..3922; Strand=-; Gene=SeqID_60406
agcaacttccggcactgtttggggattgccctccctgccgatcgcaatccgtgaggacttcggcatggacacggtcatccagaacctggatgtggcgcgagggacggacgtcacaacattgtcggtctgttttcgctcacactctgctctcgtccgctgtacggaggccggtttttacaaaccgcacggcgggcagttgacaccaggacgcgacgactccgagcgggcgctcatgaccgaccaaacggcattcaaattgccgaaaaagggagtccccctcattttagtccatcagaacacgcccgcgcaacgcgacgaagtctccacctcttcggccaatccgggccaaaccgacacagcgatg

SEQ ID NO: 112151 - DNA, 106 bp, Heterodera glycines
  Promoter: Source sequence=SeqID_10451; Location=1427..1532; Strand=+; Gene=SeqID_73655
acccgcgttctactttcttagtggaccgggtggaacaggaaagaaacatgtgaacaaggcaattgtacatatgctgagaggtcagaagaagaaagtttgtacaatg

SEQ ID NO: 112152 - DNA, 135 bp, Heterodera glycines
  Promoter: Source sequence=SeqID_35805; Location=1602..1736; Strand=-; Gene=SeqID_65275
cccccaaaaatttttttttggaaaaaccgcgccacataaacaacgggtgtgaaaagcaaaaaaaaaaaaaaggtcgtcgcccgggggaggtgccccccccaagccaaaatcctgggaccgtccctggcataaatg

SEQ ID NO: 112153 - DNA, 203 bp, Heterodera glycines
  Promoter: Source sequence=SeqID_4515; Location=1735..1937; Strand=-; Gene=SeqID_54736
ggtgaaaattaaattaaaattttacaattcaaggcattatatgtcttgttttgtaaaacttacacagaaattaggaataatttaaagattatttttaatatctttacaacaaaaaacaattaaaattggagccctcaataatgactccataaaaatctatcgttaattaagcggtgcgaaaattgaaaagtagtgacaacatg

SEQ ID NO: 112154 - DNA, 172 bp, Heterodera glycines
  Promoter: Source sequence=SeqID_42547; Location=806..977; Strand=-; Gene=SeqID_70414
tttttcaaaaaaaaaaaaattaaattttctttccaattataaaaaaaaaacattttataggaattctttttgttcagttcggtccggacaaaaagcgttattccatttattattcaattgttggaaaagatgtaaacagtgtaatttcattaattatttgccaggtgccatg

SEQ ID NO: 112155 - DNA, 165 bp, Heterodera glycines
  Promoter: Source sequence=SeqID_22075; Location=1..165; Strand=+; Gene=SeqID_52719
ttttaaattagatcgtgacatcatccaaaaggatggccagcctttgtatttgccgccattcaatcgaccaatgctgctaatgccaggcaaaattcacgaaattttttaaattttataatgccaaaaatatttggggaattgtgatgggagagaaagtacacaatg

SEQ ID NO: 112156 - DNA, 74 bp, Heterodera glycines
  Promoter: Source sequence=SeqID_34118; Location=300..373; Strand=+; Gene=SeqID_63993
aattttctgaatcgccagctcaagctatcaatgaataaaaataaatttattatttagtgaagatctcaaatatg

SEQ ID NO: 112157 - DNA, 261 bp, Heterodera glycines
  Promoter: Source sequence=SeqID_2290; Location=4053..4313; Strand=+; Gene=SeqID_78935
agtcagtgaattgtttaaaccaacattagtttggctttttcctgcggttgtgcaaaatattcaaaaagttttagtgccgaaccgcttgccaagcgggagaagaagcagttggtcatccccgtcctccaagtgtccagcagagcacaaatttctcgcattcagaagctggtggacgagggaacagccacagaaacagacttagcacgactgtcgctgttaatcgacagtttggacgacgagcaaagggttggtggtggaatg

SEQ ID NO: 112158 - DNA, 133 bp, Heterodera glycines
  Promoter: Source sequence=SeqID_19325; Location=1..133; Strand=+; Gene=SeqID_84061
ccattcattttctgtttttcaccttgctcattttacgatcccacccgggttccttctctcttaagatttaacaaaaattaatcccaacaattctcctatccccttagcctgcgggcaagaaacagaaaatatg

SEQ ID NO: 112159 - DNA, 1003 bp, Heterodera glycines
  Promoter: Source sequence=SeqID_7594; Location=1647..2649; Strand=-; Gene=SeqID_65335
aatggtggaatcaaagaactaatcaaaaaaattctttaaatcaatttaaaacaaaaataaaaattcataaattgtcaaaaaataattttaaaatatttgattctcaattattaattcgaagaatataaatttttaattaaaaagttaaatttggaaaaaagcatcctaaaagcttcaaactaggcaaaaatatttttttactcgattttaagccgaataagtggggaaaaacatggaaatccataaaaaccggccctttctaatgaatttaattttgtcttttttgagtttgctaatgggcaagtcaaaactgatcgcaaaacaatcagcagaatatacaagacgggtgaattcagctcaatttaatgggttttggtgttgcgcaatttacgggagatcggtgatcgatcgcaacgtcacaagaacaaagcgggccgagcgaatgttttccccatcatttttttgtgtgttttgtggaaacaatcaaattaacactaattacacagccttttcttctttttcttacgcaattggatctcttattttggtgcccagcaattagggaaagttttcttaagcttagaattagacattaagaagaaagtgaaatgaattaatcaccttccgatttaaatttgatttccgaggctaaaaatccataaatcgagaataccaaaagatatgacttcttcagcacgagttctcaggtccctcagattattcacttaaagattttatattttgatgcataaataaaaatcattcgcttaaatggccgccaatttttaaattattagcgcgaatgttttaccggtaataaaaatatttaaattaatttaactcaagaattaccagacttggaaatctaaacgaagaaacgttcagaaatttagttacctttggccttttctcagcactttcaagtagaactttgacaattttcttgaaatagacttatttttatttaactgatcttttttaaaggtgttttaaaaccaaaatg

SEQ ID NO: 112160 - DNA, 460 bp, Heterodera glycines
  Promoter: Source sequence=SeqID_8444; Location=3009..3468; Strand=-; Gene=SeqID_68093
aatatttatttgcaatttttaaattttgaattaatttattttgctaaatcttattttttatgaatgtgataattaattaagccatcttcacaatcagtcgccgagtttcacaaagcgcgcgaagttccgtatgcgccactcgaccaaagaggtgctaattaaaagcaaaaaacacaacaataaaaccgaaaatattaaacaaaacattatgcaataattttttattgaaatagtccatttaaaattaaaatttcgccaaatattaaattataaaaaaagatttttttaattggaaaatttctttttttattgtaaaggatatcaaaagctttcttctttaaacatttttttaagaaatgaccatacttttcaaaaaaaatccatttcccccccttttttccgtttccaatttttaattagtcaatttgttattcaattagcgcgtcgcactgtggaaatg

SEQ ID NO: 112161 - DNA, 110 bp, Heterodera glycines; identical to SEQ ID NO: 98226
  Promoter: Source sequence=SeqID_32190; Location=257..366; Strand=+; Gene=SeqID_62513

SEQ ID NO: 112162 - DNA, 127 bp, Heterodera glycines
  Promoter: Source sequence=SeqID_1515; Location=195..321; Strand=+; Gene=SeqID_74146
ggtccaggtcgatctctaatttctacctattaaaaaatgttcagccattacgctgggccgattcggcattcactgctctgccgaggtgtcgccctttctcgccgactttgtccgcccctggtgcatg

SEQ ID NO: 112163 - DNA, 499 bp, Heterodera glycines
  Promoter: Source sequence=SeqID_20289; Location=1669..2167; Strand=-; Gene=SeqID_85092
aaaaaaaagtttaggggggcgtttttcgggttttttggtaaaatgccgaaatatgggaggtaaaaatggaaatgtggaaataaaaattcatcctagcagcatcaacccaagctaaaaatgctatcttcgtcgtttttagggggaaatgagttggcaaaaaacatatggaaatccatacaaatccggtccctagtgatcgcttgtgcgttatttagctgtgttttgttgaatagtaatttttctttattgtatcatgcgttcagataataataacataataattaaatagaaatattatatattattgtatcaatgtcgtaaagatctgtatgaattgcaatgagatacggcaatagagtaagctgtataatcaatatgatattcctaaagggacttaataaaattctccttcatagtagaattgattaaggcataatgtgctggatttaattgattcataagaatgtataaacacatataattttttaggcaatcaatg

SEQ ID NO: 112164 - DNA, 912 bp, Heterodera glycines
  Promoter: Source sequence=SeqID_35085; Location=610..1521; Strand=-; Gene=SeqID_64728
tgagccgtcgaattccattgcccaaatttttttttttttgaaccgtcggaattcctattttcgatagtccgaaattttttgagccatcggaattccgattacacaaatgttttgtgccgctggatttccgatttcccaaattttttgagccatcttccgattttcggctccagaaattttttgagctgccggatttctattgcctttgcataataccaagattgtctaatttagttataaaattttcaaaaataatttaaataaatcgcatttaaaaaaaaaaactaagatttttaatgtcgatgaacggattcgaacctccgcccttttaaatgaaaatcaaaaaatgttttaaaaccaataaaatcacagccccattgcagccctggatatgaaacactaagcgcggatgaacagttgattaaagatttgcgtgaacaggatgttccaaaggcaacgttcgaaatttttcgtcgctacaagcgcaaggcattttaaaatcaaaaaatttaaaataagaatttaattaaaatcataaatttaaaataaaaaataaaattttaattaaaattgaaaaattttaattaaaaacgaaaatgttaatttatactttagctgctcaatgattataaaaaaaagaaattgttttttaatttttgtctattccatgaaattaaaattgaaaaattttaatttgaaaattttaattaaaattgaaaaatgtatttaacttttagctttcaatgaatttaaaatggaaaaatttaattagaaataaattcatttttaactgttcaataaagttaaaatagaaaaattaaaattaaaattgaaaattttattttaaaaaatgaaaaaatttaaatttaatttaaaaaacaacaatttttatttaattttagctgtacaatg

SEQ ID NO: 112165 - DNA, 231 bp, Heterodera glycines
  Promoter: Source sequence=SeqID_9416; Location=1..231; Strand=+; Gene= SeqID_71337
ttccatgcgtttcctgaaataaaggccattcctaaaacggtgttagagttggagttggggagggaagtgggactgatcaccccaggaccccctcacaaaaatggttggatttctaagggttgggagtcccaaggcctaattcagcgcgttccactggcatgtgtgttactggtagcaccggatggttaggcatttggcctgggcggctaagggacaacccataggaaaatg

SEQ ID NO: 112166 - DNA, 590 bp, Heterodera glycines
  Promoter: Source sequence=SeqID_11961; Location=1650..2239; Strand=+; Gene=SeqID_75481
ttatgccaaggtatgcctcatatttttgcattgaatattcactgatttggatttctttatctctcctttgagaaatgcaattagcattttgtcgtctccgtaattaaaatgattagacaaactaattactctaatttattaactcactgctggcatagcatttgaaatatgaattaaaaaataattaataaataataagaaaaggtattacaaaaaaagaaaagaacattatgttttcccttaaaaaataaaaattaaaacgatttaatttttagtttcaacttatttagataaaaaattatttaaaaatattttttattcgatatagttagtttttaataaaaaggggattgcttaatgaataacgtaattatgaaaatgaaaaatggaaagtaacacagccttataaacggagcaaaaaattgttttgaaattatgatcatcagtaggattacccaaatctattttttacttaaataatttgttattattatagcatacaattacaccggattacagtagtgacgtcacccaagccaaaaggtattggcttggtcccaaacctattgcaagggtgcaggccagggatg

SEQ ID NO: 112167 - DNA, 145 bp, Heterodera glycines
  Promoter: Source sequence=SeqID_11720; Location=1..145; Strand=+; Gene=SeqID_75207
tgcaaaggggcgtcaagtattattcaaatggttggcgattttttacgtaacctttatgtttaaatgattaatcgttaaatatatttgacaagaatttttctttacttagggagtaaatgcatcacattttggtggaatcgccatg

SEQ ID NO: 112168 - DNA, 173 bp, Heterodera glycines
  Promoter: Source sequence=SeqID_7011; Location=1..173; Strand=+; Gene= SeqID_63563
ctgactgactttgatttgaatttggccatttgttgcggatattgccgtcccattctgctgaccgtctgattggtgaagcagaaaaataaccaaaaaaatttggagaaaaatttggcaaaatgttttcatttttttaggatttggaaaatttgaaagtatgctttttcaaaatg

SEQ ID NO: 112169 - DNA, 412 bp, Heterodera glycines
  Promoter: Source sequence=SeqID_7503; Location=1952..2363; Strand=-; Gene=SeqID_65030
ttatttcctataaaaatttcaaaaaaaaatgcaaattaaattttttttaaatatttttatttatctagtgcatacggcggatttccaatgctaaaaaatcgtgtcatgtctcataaatcggaaatatttctgagcattttccaacatataaaattcacgtgtaaaataataattatgaaatcatttataaaatatagcaattaattttataaaagaaaatttttcataaaaatatattttttatatatttgcctttaataacaccggaaaatgctttatgtcagcatattcaaaattgatatgccaacaatattaatggccttttaatgtatatcaatattcttcattttatgtttttaatgtaaaaaatttatttaaaaatttgccgaaaaaataaaaatttacagaaatg

SEQ ID NO: 112170 - DNA, 840 bp, Heterodera glycines
  Promoter: Source sequence=SeqID_14654; Location=1..840; Strand=+; Gene=SeqID_78751
gacgtgcatctggtgagcagaacaacaaacataacaataataattgttggggaaagagatattaattttgcttttatttacatacatccaattttgaagaaacggacggcttttcaatcggctgctgctggacgatgttacccccccccttccccccccccccccgactttctcccatctttttcacacaattatcccaccccccgtgtgtgtttcggattgatgggaggcactgaaaaccggcttaattccgctaatcccgccttgtccgcgcacatcctcagccaaccatttctcggacaaaaattgtaataaaaacgaatttaaatggaaaaataaataaataaatacaaaaagcaaattaaatggacagttagggacaaatactgaacagcggaagacattttcaatttaatggtacaaattttttcattcgcacaatgccgtaaatggtcgatcatttatttgtattttgactttcggcaaggctaacgaagagacaaatgaaatgaaagcagccaattgccagcagatcacattgaatattgacagacactctttattttattcatttcaatccgataaattattcttttttttcttcttttttttgttttttatttttcctgaatttcacttcccctccctttccctttgctttcccccgcgtgcttttggctcatttctcgcgatcgttccacttcccacacataataaaagaacaataaaatgcgaaagaatgagcaacaaattgggaaaccaaattgttttattgagaataatgaatgaaagacggacgaatggccaaatgattggaggaagagaaaaaagaaagaaatg

SEQ ID NO: 112171 - DNA, 1003 bp, Heterodera glycines
  Promoter: Source sequence=SeqID_1772; Location=4819..5821; Strand=-; Gene=SeqID_47025
ttgggaaaatcctcagaatcttttaaattttgataaattgtcataatgttttacaaatatttaataatttgggtttctaatagagcatcaaaacgaaaatctcacccaaattttccaaaaaattttgctaaatttttataaaaaccagaaaagaacaaatttttttctaaaaaatcacaaaattaataattttttaatgaaaatctgttaaaatatggtcaaatttctcaatttttcccctggcggcgcctatcggcaccgtcagcccctaaaagtcctttattttcttataaatttgctcaaaatcacaaaatttggccatttttgtggacaaatctgttaacaaatcgcattaaaaattacaaaattttaccggcggcgcctatcggcaccgccggccccttattccccgaaagttttttaaaaagtaccgcaaaaaatcagcttcaatttttcatgctcagaatttcacaaaaagctagcaaaaattgctaaaattggtcatggacaatcaaaaatataacatttgaacattttaaatgtgttttgaataaatttgtagaaatgaggcttttttgcctgccaaatgaggcttttgaaaattttgatctgggaaccctgggaatacaagagacgaggaagagaaagaaagaggaacaaaaggcgaagaggaagaggaagagaaggggaaaaggaacagaaagaggctattcccggccattaaaaaatctaattcccctcttataaaagctttttggcgcgtggcgcccgctagagacagtgtttaatagcgaatctatttcaattttttataaataaattaaaatcgtctctttcagtgcccgtacggcactggttacctataaattttaatcttgtcacaagtcactttattttatgtctgctttttgttgatgttgttgtttgttttgtttattttcgctattctatagatcattgatatttattgctaaacggcaaaacgtttcccaatctttaaatg

SEQ ID NO: 112172 - DNA, 126 bp, Heterodera glycines
  misc_feature (8)..(8): n is a, c, g, or t
  Promoter: Source sequence=SeqID_31289; Location=774..899; Strand=-; Gene=SeqID_61655
cccccccnccaccgcccaatccctccgccgtctcctccaacctccaaatccaaaccaattccgcgcacgcatccctcgcagcttttcctcaacaaatcaaacagcaatccctccaaccccaaaatg

SEQ ID NO: 112173 - DNA, 59 bp, Heterodera glycines
  Promoter: Source sequence=SeqID_320; Location=2344..2402; Strand=+; Gene=SeqID_82136
tttttgatcagatcgtcgatcggttcggctgggacaactccgcctatgactacgccatg

SEQ ID NO: 112174 - DNA, 1003 bp, Heterodera glycines
  Promoter: Source sequence=SeqID_3077; Location=2559..3561; Strand=+; Gene=SeqID_83096
aataatgaccggaaatcagaagtggagagaatttgttgaccaaatgttgttgaaaggccattgataaaggcgaaaatgcaaatacaacaaaaatattgtccgatttgatcagaatttattgggaaagaaaatgatggattttattggcttttcccatttaaatagccaattaattgagtggggtgagcaaaaaagggcaaatgaactttcgataagtgagaagcaaaggaaggaaaatggagggtaaaagttgcactttcgtacacaaaaaataaaacaaaaaacgaataaattaatggccaatggaacgaacgaaacatttaattggcagaaagagaattatcataaaatatttttatctttttcttttaattcttttggaaattaatgaaagggcaacgaagcgaaaatgaaagtgtaaaggagaagaaaaagtgaaatgtgaaaatggaaaacgcaattttgagagggaaagttggacaccgaactcccgggcattttcaagaccgggatttgattttgaaaatccaactcgcataagccggtagatcaaaatacactgataagggggaaggtgacttggcgtaatgagctttctgacgaacgcctaaatttaacattttttgacccagaaccccattcttaccagtgtacttttggacccggtcgggtacccggaccccggccaaccctaattttgctaacaatggagcacaatcatttataaatttattccacaacattatgacaaaattaaatattaatcaaaattattaaaccatttattcgaaaaaacttttaatgtttttcacaatgtctattgcattttcctaatacataacaaaactgtgacttccttccgtttttcagtccaaattaactgcatagacataaacaaacgccaactcggcaaaattacgtgtcaaaaattgattgcataacaaaattattttttataatagctgatttttcaatcatcaaattaattatcatttttaaaatg

SEQ ID NO: 112175 - DNA, 1003 bp, Heterodera glycines
  Promoter: Source sequence=SeqID_15202; Location=34..1036; Strand=+; Gene=SeqID_79406
cggaaaatatggagtgaaaaaatacttccttggcgtcgactgccaggtcgctaaattttgataaattttttagttataaattaattaagggcgagccgaggaaccctgtcaaaagaatggcgcaagaagaggtttctgatgagcctcaaataccagtgaattgggtcctaaaaggatatttttcaatgcttttttaatttaggatgtggtttgtaacgaagaacttgaagagaacatttttggatgcgtatgctgttttacgaaaataaaataatattattaaaaaaatattaagccaaaacttttgggatgctttctccgaccgcacaaatctttggtaaatcagctataatacaaaattgtacttaattttgttagacgagcctgaaggtttgcatgcccaatgacctgagaaacgaggaacaatgtgtatgtatattttattctttattatttattcaaattaatattttttataaaggccgagcctttgccgccaactgaggaaccgccgacaactgcccaaacagttttaattattttttaaaataatttttaattcggttacagtctacgcaaaaaccaccggatgagatcccaattgaaactggaggaggcggccaagtatcataataagggcgagtgtttgtatggatttacatacatattttttaatcaatttttcaaaattaaaaacaaaaatggaaaaaagcgagttttatgggaaaattgtttgatggcacataaaaagttgataaattccaaaatgtacaaatttttacgtttaagtttacaaaatgaaaaattgtttaaaatattattataatttgaatcttttaagtaaaattttgaatttttgcaaatttttggcattttttgtggtttaaagcaatttttggtactatttagtgggtctttgggtgctttttaggcaataatttatgccaatatatagttttttattggtccatacaaacattcgccctaattatagcctaagatg

SEQ ID NO: 112176 - DNA, 1003 bp, Heterodera glycines
  Promoter: Source sequence=SeqID_2410; Location=2311..3313; Strand=+; Gene=SeqID_79594
aaaaatgcattttgttgggtgattttaattttcctcttttaaaagcaaaagacttagcatccaacattttgaaaaaagaaacaatcaccttgaatcacttttcatttcatttttagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataacttcaaaaaagcaaattatttggaaataaatgccatactctcaatggttgattggaatttatttttttctgattgcccggacatagagcttatttaccaaaaatttatgtttttcctaaataatttgataaggaattatgttcccatacaaacaacgaaaaaagttgaaaaactaccagaacatattttgaaactaatcatctatcgtaaacagctttggaaggacattcacaaagaccatataaaaatcaaatttttggaagtttcaaaaaaaatcgatgtagaaataaataaattttataaaaatcgtgaaaataagtttttgcggaccttagactctaaaaaacgtttccaatttataaattctttccttaagactaaaaatactatgatacctgcatttactgataaaaatggtctaatcctcttctctgataaaaaaaagtcgaatgcattagcgcaacattttttttccgtttttacagatcaaaatctagaacaatttcaatgcatagaaaatcctgaaaaaaatatcgaatatttcaacataactccatatgaaatttatttctctctttccaaactttcaaatgctaacaacactagtattgatggaattcccaacatttttttgaaaaattgtaaagaaaatttagtccgaccacttttccatatttttagtttctcattgatg

SEQ ID NO: 112177 - DNA, 326 bp, Heterodera glycines
  Promoter: Source sequence=SeqID_14114; Location=1..326; Strand=+; Gene=SeqID_78101
ctgttcacgcccagtccggatggtatgccgaagtcctctagatgctctgttaattcaccggatcaatggttttgctgcaattggaactcaagattgtcacaaaaggcaaattatcgttagcttaaaatagagacaattaggaaaaatgagatcgaaaagaacacaaacaagagcaaaaaacgataagcgatgaaatcaataaaaaacaattttttttacgacattctgtctttttttacacaaaaaatgtctttcggatgaattattgaatcaatgaaacttaaaaaatttgacttatttttagcttaggaatgcttttcaagatg

SEQ ID NO: 112178 - DNA, 533 bp, Heterodera glycines
  Promoter: Source sequence=SeqID_19375; Location=1588..2120; Strand=-; Gene=SeqID_84102
ttttttggtactgatgctagttttgcagaatgaaaattcacaacaatataagatttatatttttaaaaatctaagtttggtgtcgtattttcttagtgtcgcattttcttgaaatgaaaaactttctctcagtgtcggattttccgctgatgtcgtatttgccagtgtcgcattttcagggagccctctatttgaggaaatacggaattttatttttcagtaataataaaaatttttattttttaataatccattatttctgggcagaagcaaaattttcaattttgttgctatggtaacaaaataaaattcaaacattctcaaatgtttattgaacttgtgaatctccaatccactcttaaattagcccaccaaaaatataatttttaaataattttaattcatttaaatttcgaaatttaatattttaaataaaaaaaatcggacatccttctctcttcaaagaatcccaaattttaaatgaaattttaaattgtttgaatccaataatttaattttttgcgacagcaatg

SEQ ID NO: 112179 - DNA, 263 bp, Heterodera glycines
  misc_feature (39)..(39): n is a, c, g, or t
  Promoter: Source sequence=SeqID_35228; Location=656..918; Strand=-; Gene=SeqID_64829
cgattcactaaatgttttttttcattgagcttcgctgtntaggctatccctcaatgaaagtctcggaatgccttatgtttcagttcgtgccattgtttctgttctgtggctcgtttcctctaatgcttttcattgccattgaccgtttaattggcgctatcttcccaattaagtaataattaatttgttgcgttttattaaaaaatattttaaaaatttcccttaattttgaaatactttaggtacagatcggttaaaaaatg

SEQ ID NO: 112180 - DNA, 1003 bp, Heterodera glycines
  Promoter: Source sequence=SeqID_9732; Location=2285..3287; Strand=-; Gene=SeqID_46805
ctttgcgatacttaaattttttaggggattttcccttgtaaaaacacaagagccgatctcgagttaaaaactagacaggtaaaaaataaaatgtgattcgatagagggggtcaaaatatgggcctatgcaaaattttaagaaaatctgacccgaggaaaatttttttgaccctagtaaaaatttcaataaatttaactcttttttagccaagtgcgctatttaaagccaaatcaaataaaacttacaatattctccagaattttctctttaaaatgaatataaaattattatatttggcctattattgcccgagttataagtctggaaaatttcataaaattatcgatgatgtacctaaccaacgctttttgaatatgatttttattgacacgaaaacttttattaatggaaaataatttttcctttcttctttaaacgaagaaattgaaattaacacacaacatgaggaggatttgaacctgagaccccccttttggtgactaactcacagaccacctacgaaaaaaccaacttaattatacttggagcccaaaattgaatcgccgtgtccaagcttatctgctatagcttaagcttaaaaattagagaccggaaatttcaaatttgcggattccgctgagggattggaactcaaaattctttgcgggatgggatcccgcgggattaatcccgcaaatcccgactgggacccgcaaaatcccgcgcaggatcccacgccggtctctattaaaaataattaatttacaaacattatgccaatttttattctataatctaaattactaattaatgctacatattgtggattatccggaatcctcggatccggaatgcggatgtgtaggtatgtatgtgctgcaaaaattaaggtttagaaaggaacttaggaaatttccatcttaatgttcgaccattatcaaattacccattttcagcaacatgagtattctgtaaaattttctttcatttttattctaaatg

SEQ ID NO: 112181 - DNA, 212 bp, Heterodera glycines
  Promoter: Source sequence=SeqID_895; Location=1..212; Strand=+; Gene =SeqID_63484
gaacccgaaaacttcgttgaagttatcttttccatttatgtcttaaaaatttggagtaaccatttttatcccttttttccatttgtgcactgtccaaaagtgtgtttgattaattggccccatttacaataaattcactttagaattcgtgatgcttgttctgaacctgcttcaacacgaataaatttcgacgcgaatccatcgacctaatg

SEQ ID NO: 112182 - DNA, 522 bp, Heterodera glycines
  Promoter: Source sequence=SeqID_13310; Location=833..1354; Strand=-; Gene=SeqID_77158
gacaaaataaattgtcagctaatgacttgttaattatttttaattaccctttaactacatttttaatttgtttaatctcgaattcgagtgaaagggattattttggaattaattaccgactaaaacaatgcttcttcgcactatatgcaattaagtgcccattatctttgattatttcattaattattaattgcctcctaatttagcttaacgcgacttctcaaattaagaataattttttgagaattaatttttaattgcattttaattaacaattctttttctcaaatattctaatttttacctgttcttgctcagtccattaatgaattttgtctccctttttagtatcggctaatggtcagtgctttttctttcatttgtttcgccggaggggcgggcggcaaaagttggcgcaaaaagcgcaaattgaaatcgcaaatttaggaagaaattgcccaaggcagttacggcattgtgaagctggcgtacagtgagcaggacaaaaatttgtacgcaatg

SEQ ID NO: 112183 - DNA, 86 bp, Heterodera glycines
  Promoter: Source sequence=SeqID_7371; Location=1788..1873; Strand=-; Gene=SeqID_64632
ggtaatcacccttttatggtctttttttctcctacgaggtggattttatggaataaatttttagagttgggagaacggcacggatg

SEQ ID NO: 112184 - DNA, 82 bp, Heterodera glycines
  misc_feature (21)..(21): n is a, c, g, or t
  misc_feature (62)..(62): n is a, c, g, or t
  Promoter: Source sequence=SeqID_26556; Location=1544..1625; Strand=-; Gene=SeqID_57291
tttttttttgttccaatagcnttgcatcggcccacccttcccggaccgaacccctggacaanaaacggagtattttcggatg

SEQ ID NO: 112185 - DNA, 199 bp, Heterodera glycines
  Promoter: Source sequence=SeqID_7156; Location=95..293; Strand=+; Gene=SeqID_64002
tttgtcagctaaaaaatttaaaaaattaaataaaattatataaatttgatgtcgggcctcgacggataaaaggaaaacgctctctccaaaatttagggtgccattgattgagagtggatgaatatttatcccgaattcgccttgcccattttaaatatttattcgtcagctccgagactctttccaacataaataaatg

SEQ ID NO: 112186 - DNA, 203 bp, Heterodera glycines
  Promoter: Source sequence=SeqID_7768; Location=5020..5222; Strand=-; Gene=SeqID_65880
ttgcttttcaaatggccaacctgtcgcaaaaaattgaattgacggcacaatcaaaacgccaacaatttaaaaaaataagtacagtaactaacacccaccaaaacaatgtcattttcacttttgctggaggccaacagccaatgcgcggtgacgtgcacttgcggcgaatgggccaatgcttttagaggagaataatacatatg

SEQ ID NO: 112187 - DNA, 761 bp, Heterodera glycines
  Promoter: Source sequence=SeqID_2290; Location=3109..3869; Strand=-; Gene=SeqID_47236
tgctgtcgtacttttggcaatacttttacaacacctgactgtataatagagcaatcctaaacaattaggacaataaaatagaaataaaattggaaatgcacgtccaatggaaaatgaaatgtaaagtaataaatatttaatttcttctgggcctaattaggtaacattatttgttatctgggcctaatgattcaatgattttggttagttagtgtatggcgttcttttttctttttctctctcctttgcccagaaggaattttgaaattctatacacacgtgaattgaattcttttccttttcttttcactttcattgcttttcttttttattttctctacaaattccaatatattgatttgttctttcgtacattcgtacaatactaaacaaataccaaaagcaacatacatataactattcaaagaccaaacgaattatttagctaaaattgtatataaacaaattaaacgactcgtacaaaagagaaagttcaaagttgtacacctccgtatgccaactttaaactataaattttcgattcggaattggaatttaggaaaagagttgtccatctccgtgtgccaactcttaaacgattgaaataattctcgaaagttgttgaatttcattgttttccagttcagttcttgaaaactctaacgaatttaaggataaaattcatatttgattacataaatatctaattactttaaataattaccgcttgtttgaagtgaacccaaaaataaaaacaaatg

SEQ ID NO: 112188 - DNA, 668 bp, Heterodera glycines
  Promoter: Source sequence=SeqID_23504; Location=1783..2450; Strand=-; Gene=SeqID_54200
ggaaaaaaaaaagactgaatttttcagaaagttaattaaaaattttaaaaaaattattcgcgttaatttttgcaaaaaaaaatactaaactgaaataatctccattaactagagtatttagtttttgtaatgcaaaatataaaataacattaaaaattaacaataaaaactctttttctctcttcgttcccccgacaaataaaatccctttattttacaattattattattcccccccccctctttttgcgctttattacaccccttccatcccaacggccgactggccataaaaggctttgatttccgcgcgccctggatatataaaaaattttaaatgtgcttgaatttaatggaactttccccttatgtccttggaaattggtataccttccttggaaagggaggttgcccgatcctagccctggcattaacctttgcttcatcgcctttttcccttggacgcaattagtggaaataaagtgaatttaaaagagtgcatttgtttgcgtttgtttttgtatattttcgtttttaattcggtattgggtcaaaatcctaaatatatgaaaaaaattctattgatttagaagggctttcatccaaatgatagaataaacattcgaataaattaattcaacaaaaaatattccgacttgtaaaaaatg

SEQ ID NO: 112189 - DNA, 1003 bp, Heterodera glycines
  Promoter: Source sequence=SeqID_11687; Location=8..1010; Strand=+; Gene=SeqID_75169
gatttcattcatgcagtcggttttaaccaataatattgaaaataagaatgtcaaatttttatagacatcaaatgtttttgtaagccaaacagaaatatgcaagagaaaatgggataaatgtgcttttttacgaaaactaatgaccatttaaccggatcgttaaatcctattcctatgaaagccatttatacaccaatttttgcaataaaaaagtaaatgaagttctcgagtgtgccagaatatgcaatggattattttaaaagatttttaatttgcttattttagaatttatttatttttcaatttgaataaaaataattgcatgtttaaatattttaaataaattcatgaaattattcctttcagcttacaaaaagcttgaccacataaaaaagaaacgcatgtcaagaagttgataatgattagattaattaaaaattatagaagaaaaattctgatgattaatcgcataaaagtttgatcatttttcaatcggaaaatgaaataaatagaacgcatataaaaattttaaaaaattagcttatagttagttcagcaaggtttaatatagtgataataaagttaaataaatagacaaacaaataaaataaataaaaaaagaaaaaactaataaaatgaaaaaaattaaaaaataattacatcaattaagcctaagcaactcaacaatctttttgcattgacattcttttatgaaccagtggtacattttaaagagaaataaccaataaatttttatgaatttaatcatattttaaacatttaaaaaacaaataaaaaaaatagtttaaatgcttaataatctttctcctgcccgaatgtccggaatatcttgcaatatagaatgaaaggtgaaatatattactaaacataaattaaactatcggtattattgggttaaaaaaagaaggtacaaaataatacagatcaacaacgggcaaacaggtcaacaaagcctcaatccgggtgctattgaaacacaatg

SEQ ID NO: 112190 - DNA, 256 bp, Heterodera glycines
  misc_feature (15)..(15): n is a, c, g, or t
  Promoter: Source sequence=SeqID_21628; Location=1..256; Strand=+; Gene=SeqID_52226
aaattcatccaatcnaatggacaatgctaggctcgctcaggtattccaaaataaagcagaaaagagttattcagtttggcaatttatgggtccccagagaataattttcagaaagtatggaaaagcgcttaaggaaaattcatccaaatcagtggaaaaagattcctaggctcgctcaggtaattccaaaataaagcagaaaaaagttatttttggcaatttatgggtccccagagaataattttcagaaagtatg

SEQ ID NO: 112191 - DNA, 153 bp, Heterodera glycines
  Promoter: Source sequence=SeqID_6062; Location=448..600; Strand=+; Gene=SeqID_46177
agtgtgttttttgatttaaatgcattcctttaaaagtatattttatttattttttctaaaagtatattttaatttttttttccttgttttcttttagaaataaccatccatgagcagttcgcattcagttttaccactttgcttagcgatatg

SEQ ID NO: 112192 - DNA, 411 bp, Heterodera glycines
  Promoter: Source sequence=SeqID_2846; Location=4816..5226; Strand=-; Gene=SeqID_81910
tttcttgctagaatctgaattacgctagaaacgaaattataaaaaagtgaaaggaattcttaagctttgattgatccaaaaatggttggaatgaacaaatatgaaaaaagttaggacataagaaatgatgatggtcactgattggacgtgtaaactggaatagggctgtatttgatattaacacagcatttttttactctttttacttttttctttaatttttttaactatttggcgaaatgtcagttggcgaaatgtcagattttggcttagtaggcgaaatgaatgtttttggctgagttggcgaaatgaatgtttttggttgagttggcgaaatgaatgtttttggctgagttggcgaaatgtcagttggcgagatgtcagttggcgagatgtcaagttggcgaaatg

SEQ ID NO: 112193 - DNA, 188 bp, Heterodera glycines
  Promoter: Source sequence=SeqID_16968; Location=1234..1421; Strand=-; Gene=SeqID_81393
cgacagtggctgatttcgacagtgaccgatttcgacagtggatttcgacagtggatttcgacagtgactgatttcgacagtgaactattttcatttattttactgttttccgacattcccgacagtggctgatttcgacagtgacagatttcgacagagaattaaattattattttattattattatg

SEQ ID NO: 112194 - DNA, 84 bp, Heterodera glycines
  Promoter: Source sequence=SeqID_2444; Location=1629..1712; Strand=-; Gene=SeqID_79753
catggaagcgatcctctcgctttggggcacaaagcttgtgggacgctctcatgaggtacggagtttggttattacacccacatg

SEQ ID NO: 112195 - DNA, 519 bp, Heterodera glycines
  Promoter: Source sequence=SeqID_5510; Location=3684..4202; Strand=-; Gene=SeqID_58283
taatctgtaaaaaaaatcaataaattggcttgggtttcactgtgtgtttgaattggcgcccttttgtatctttctctaaccactactctctcgtctatgtgtttgtggatgggcgtggcctatcgattaaaagggatagcccgtctggaggtcgctgcgcgctaacacccctctcactatcaatcaataattacgtgttttttcgcaggttcattttatgcttttaacaattataatcataaactatttcttaatcgtaatggccccgagaaaaatcaatgatcaattggtgtttgagaacaaaagtaatcattttttttgggttttttataataattttaaatttaaagaaatggatgagtcgaaacgggaaaatttttcccctcaaaatgatgatgatgtcatcacaattggagacaacaacaacactcaaacactgcttgacctgcaaccggggccctcaaaaaggggacgcaagcctcgcttggacaaatccatgaggaaattgcttccgcaatg

SEQ ID NO: 112196 - DNA, 155 bp, Heterodera glycines
  Promoter: Source sequence=SeqID_30669; Location=167..321; Strand=+; Gene=SeqID_61077
tgtgcggggcaatgaaaatgggactatttgttgggccagctcattagttattttgtagctcccttcctcattaccgtttgtcggttttgcaacgaaattttgtggcacttgcctccgtttacaccaaactgtggcccctcgtgcaacgaaacatg

SEQ ID NO: 112197 - DNA, 139 bp, Heterodera glycines
  Promoter: Source sequence=SeqID_25812; Location=1291..1429; Strand=-; Gene=SeqID_56575
aaaagaaaatgactcctctgggaaatcaagacaatcttactttaggcgacgcacattggtggcatgggagcagcgcaaagtgcagaacactctcagcgggcacggaccgggcactttcccaaacataacgccaaaaatg

SEQ ID NO: 112198 - DNA, 468 bp, Heterodera glycines
  Promoter: Source sequence=SeqID_15960; Location=1..468; Strand=+; Gene=SeqID_80314
ttcaatgaaatgcattcacataaaatattttctttacaattattttttgaatagtaaaatgaatttgtggcattttatatttataattgtattttttttcataatttatggaaatgaatccggcaaactccgagcaaatttcgatgaaatattcggcggcggatgggacaaaaatgaaaatgaagaaaaagaaatggacaaaaagtcactaaaaattgaacaaaatgaattctcaacggttgatcatatgtgtgaagaaaatggaacagacccaattgatcaacaaaaatgagaattgattaaaaaatttgacctaattaaagaaaagctgaaggaaaaaggaaaatgccaacataaaaacaggccaaaattgagaggaaaattgcaaaattattaggcgcaaatcgccacaaaatatacaaatggaaaacagaattaaatttaaataagattaaaacgaacaaaatg

SEQ ID NO: 112199 - DNA, 687 bp, Heterodera glycines
  Promoter: Source sequence=SeqID_27697; Location=1..687; Strand=+; Gene=SeqID_58369
tgctcaggtccagcctctcccacctgggcctccgttgcctagtaaagccaaaaagcggaaaagcaataaagttgatgaagataccgaaagaaaaagaagcagaattgactctcgaaagagggacttactggcagaggcagcctctgcccctttgccggacgactttgaactctcacaacaacccgggacctcggctcaagtcgagcctctcccacctggacccccgttgcttagcagaaccataaagcggaaaaccaacaaagctgaataaaaatataccgaaagaaaaagaagcagaattggttctcgaaagagattatcttcaccaagtgttaccaaaaatctgccaaaaaggcaaaagaactcgggtagcgatgcactctccgaagagcagcgtcgtcagtttgcagaggatcaacatcttttcagcattccaaattcgcaacttaccaatgagcaaaagagaagacggcttcagttcgtatttaatagaaaccccgccaagtacggtgttcagggtgacaccattttgaacagcgcaggaaacccaataaccgacagcagtgtcgcccaagcattagactatattatcgaacgcagagagggacgaattcctcaattcagacagccaccaggaacaaaattcattcgagatcgaatcaaccgagaacttattttgcgaacatg

SEQ ID NO: 112200 - DNA, 257 bp, Heterodera glycines
  Promoter: Source sequence=SeqID_4246; Location=1221..1477; Strand=-; Gene=SeqID_45753
aaggcagacactaagcaagttgaaaaggagcgcagagaaaggaatggagagagaaccgatgagttagagaaaaagcggggagcgccctttttcaaatgctttattatcgacacgaaaagtcatcgccgtgtgcctgcacttcgcttcccgcgtttttcccttgcataaaacggacgccaagcgctgcattcgcttcactttccttctttcattcgttttctgtctgctttccattcaactaaactgtgctaaatatg

SEQ ID NO: 112201 - DNA, 298 bp, Heterodera glycines
  Promoter: Source sequence=SeqID_39511; Location=646..943; Strand=-; Gene=SeqID_68064
ttaatttctaaaatatgaaattaatatttgaaatatgttttatatttacatactttacagcacaaatttcacattccttgcatcaaaaattggtgaatgaatcgttcaaaaattatttattttttaaaataaattagatttaggtttaaagctcatgtaacttgcccaatttgtagtgccattcaattcattttggttgaagggcgaggtcaaatttattcaaaggcttttttcaaaattaacgaaaacctatttttgtttttttaataaatttatttttaagttgtaccaaactatg

SEQ ID NO: 112202 - DNA, 524 bp, Heterodera glycines
  Promoter: Source sequence=SeqID_10409; Location=1..524; Strand=+; Gene=SeqID_73603
tgcagttgtgcattcaatgcaatttgcaaaactctcacatcacgtgtttcagttgtccattcatttgccaaaccagcagcccgttgtatacagggccttccaactgggtgagtaaagctgaggaaattcagcgcggcgaactcccagagacgccatgctctgcctattggaagcaatggcaaaacgaatggcagcatgttccttcgctcaaggacatgctttttcaaaaagtcccagagcaatttcgatgggcaaaagaccgttgggtcccatataaaaggaagcctaccaagaggcccccaatcggtcgtgttgtacctgtccctccaaaggacattgaaagatttgcactttatgtgctgatgcgtcactttcctggtgatcccgaccacttaaaactggtcaatgggcagcagtacagcaccttccaggaggctgctttacagcatggtcttcttgaagatgaccaaatttggcacaaaacgcttggcgaggcagccttgcatcgctggccggaccagatg

SEQ ID NO: 112203 - DNA, 670 bp, Heterodera glycines
  Promoter: Source sequence=SeqID_11651; Location=625..1294; Strand=+; Gene=SeqID_75105
ttaggtattattttaaatctgagtattttgagcagcaatttaaaaattaccttgggccttagttgtatgtctgggaccccgaactcaggtaatcctgaagaatgggtgtccctaaattttatattttttttaattttgggctcaaacccagtttttagtggttatcgagggtgctgattctgaatcttaactaaaatttgcccaattccgaaccccggaccctaattcgaacaaaaaaattgaatttttttttcaagaatggattttttagggtaaaagcttctaattcatttaacaactatttagtttgatgtaaaacaatgcttaaattgttaattggacaaaaatgcgcaatttgcgtcctaaatttgaccgattttaacgaatactttgcaaattttgccccgccccgactccaaaattgtacaaagttatactcgattgctgacaatccctgttattttttccactcttacacagggacaaaaccattgtttatgcgttaatttgtgtttttgtttgtgcggtttaattattggcgttttaatctattttgaatttattaaaatattttaaaaatcggaaaaatttgtaaaccaaattccaaaccaaagcaaaaaattttattcatcaaattttcttctattacaatattttatccttcacaatg

SEQ ID NO: 112204 - DNA, 544 bp, Heterodera glycines
  Promoter: Source sequence=SeqID_1954; Location=1467..2010; Strand=+; Gene=SeqID_77003
tccgtctttttcttgaataaaatttttgaaaaatatttattaaattgattaaataaaaaatatatagcttaaatttgtttttatttgaattaagccaatcaatatgtcaagcacagttttggtcgttaaaaaaagaaaaatagcaataacattaaagttatatcgcttaaaaatttcaaaaagtttaaaaaaagtatttttataacggaacctttaagtaaatccaagttttaaatggattttgcaatttaattttttcataaaatctttaagtaggcactatttaggttttttaaaatttcataaaaataacctgcgcaataaattagaataacatacaataacaaatctaatccccattacgtcaagggaagaaatattggcatttattacgtaaattagacgtcaaattatgcatatgttaacaaaatattaaaatatttacgtaaatattatttggacgtcattttctgaaaaaatcatataaatatattttaacaaaaataagaaattaaatatcatttaaattcattcgattacgatg

SEQ ID NO: 112205 - DNA, 141 bp, Heterodera glycines
  Promoter: Source sequence=SeqID_7371; Location=587..727; Strand=-; Gene=SeqID_64633
atttttaaatgctaaataataaaagttatttgtttattattaatttttattaataactacgttaatccgacaaaaaaaacaatattacattttctttgtttttttctgtttacaaaaacaaatgacaattaatgggcgatg

SEQ ID NO: 112206 - DNA, 71 bp, Heterodera glycines
  Promoter: Source sequence=SeqID_22624; Location=2232..2302; Strand=-; Gene=SeqID_53298
aaaaatgggggaaaacgcaaaaatattaaatccaaaaaatgagtgaacaaaattgttaatccctaaaaatg

SEQ ID NO: 112207 - DNA, 569 bp, Heterodera glycines
  Promoter: Source sequence=SeqID_14822; Location=1..569; Strand=+; Gene=SeqID_78978
atcggcgaaccggcttcggcgaatagtcatgtacccccccccccccccccccgcaccccggcacccccacatttaacgcattttgcgacggattttgtgaccgatttgaaaggaatgaatgagtaaatgaatgcatgggttggtgtctgcttcaatgcctgaaattgaatgacgagctgacccagcgttgttcccgtaatccctgggaaaatttcggatgagaaaatttaaaaaaaaacgggcaagaaagtgaaatgacaactctaccaattttgatgagatttgctagtagaatttaggaaattgttttgaaaaagtgaaatttgatgtgaccgacgaaggcaaacgcaaccaaatttcaagaaaggtgccccattagccaaattttttaattttttcacctacttggttacgtatgcgtaaaataaacccttgtaaaatgttagggaaatatttattccaatcgctatgttttatttgtgacacaaattcaggacgaactccaccctcagccccaacaacaagaccaacagcaaccattgttgctgttgttggacgaagacgtgatg

SEQ ID NO: 112208 - DNA, 62 bp, Heterodera glycines
  misc_feature (27)..(29): n is a, c, g, or t
  Promoter: Source sequence=SeqID_21431; Location=1379..1440; Strand=-; Gene=SeqID_52043
aatttaaatttaaaatatatttttatnnntatttgcaggcaatcactgctgagacagaaatg

SEQ ID NO: 112209 - DNA, 499 bp, Heterodera glycines
  Promoter: Source sequence=SeqID_18579; Location=1751..2249; Strand=-; Gene=SeqID_83210
atttataaaacctacattatttagcaaatttaagtaattatcaatatttgccgcaattcatctcaacatgtatttacaatcttttttgaattaatattttttgttgttgtaaagaatgtaaatataatgtatgctaaaaaataccaggaatatatatgattataaaagtttattccataaaattctctccctctttttataactttcttttattttctttctctctctctctctctatatgtataggcgcgctgtcaaaatgtccctgcgtcaaaatgtccctgcgtcataatgtccccgcgtcataatgtccctgcgtcataatgtcccccaagctaaaaccagtcaaaatgtccccaattgaaattagcgaaaaaacccaaaattacatatttttatcttttcatactatttgttattgtaaaatttactcatttaggctcaatattaatcgtaaaaagattgaaattatccaaaaaaaaaagtcgtaagcgaaatg

SEQ ID NO: 112210 - DNA, 96 bp, Heterodera glycines
  Promoter: Source sequence=SeqID_12988; Location=755..850; Strand=+; Gene=SeqID_76751
agtgggcaaagcatcaaactgacgcataattatgtgactaatgtgatcaaattgctcaaggatttggaatggggtgagagggcattgtacaacatg

SEQ ID NO: 112211 - DNA, 505 bp, Heterodera glycines
  Promoter: Source sequence=SeqID_4576; Location=3226..3730; Strand=-; Gene=SeqID_54952
ggtcaataaaattaaaaaagcatttaaatttcaattctaaattatttctcataatttaatgctttgatggcgccgacgaattgtgccgtcccatcgatggcactccgttccacgagcagtgccggcactcggcggtggtcaaacagaagggtttcgtgccgcgccatttgcgcccgccatggcttaattcgccgctttttgacgacaatgaactgagcagcggagaaaacacgtgctacgcatgttataaggggacaaaagcgagcaatggcatggcaccgggggaagagtactgtgcgtgtacggtaggcatttcatacggtaaaactgttaagctgtgccatcttttagtacaaaggtcaagtgccgaacgagaaattcggcgtcgtttttggcacattcaatggaagtcggcggatttgtctgagggatttgcaaaaaattgcatttgtaaaaataataaaaaattattttatttatattaatttgatttcttttacagatg

SEQ ID NO: 112212 - DNA, 221 bp, Heterodera glycines
  Promoter: Source sequence=SeqID_37506; Location=563..783; Strand=-; Gene=SeqID_66561
aaaaaagagaaacttccgctaattttaacaaagaacggggatatgcaaacttgagattaaagaataaaaaaaataaatgatatataataatcattttatatttttttattctctatgttccgttttaccttcattgttctttaaactttacgaatcttttttaaccaaataatttgtgttcttataaaatgacgtataacaattaaaaatttatagaaatg

SEQ ID NO: 112213 - DNA, 1003 bp, Heterodera glycines
  Promoter: Source sequence=SeqID_13402; Location=322..1324; Strand=-; Gene=SeqID_77290
tattataacagtcaaaaagatcatttaagctctacatacaatatcaaaaattctgtttaaaatacagaccgtaattccaaatttaaatacacaaaattttgtgcttgttgaacttgtgctcttcaacttaatgccgcattacaaaatcggcagctgtcacaagtcaaaatcccccgccccattcagctaaaacagtgggataacacagggagggagggaccgacgacttaggaagggtacacaaacaaaagaagaagccgagaagataaagcggaggaggagcaagcagaagcagcaaaagcggcagtactcaacaacaaaatgggactaaagttggggtgggggagggggaaggccgatcagtgggcccattccgcttctgatcaatgagagtgggcagaaaagaggggcgtcgggggagggagggcaaggaactgaagcgcagggagggttaagcagttacgaaaagtcgagaaaatgtgagtcggtcggccgggaaaatggattcatttttccgattttgccgatgaatgggccccttcttccgccggggtgggagaagcttcttcatttactcctcagcacaatgcgcacaaagagaaagcagcagcggaagatgttttcgtcgcttttgtgcgggcgattcctttcattttccgcctccaaaagtttgtcacacaaattccgctgatttgtgagatgctctgtacccacaaacctccgacagattaatgtgtgtgattttgttttatatctttttttccgatttattcatttttcacgaaaaaaattttaacgtatttttaggttcccatttcttttttaattcaatggctttgtttatttaaatatgctttgaactttcccgaaggaaacattttaaagcgttttctcattattatagataaatttaaaatcgatagcacaaaagttgttcatcatctcgacaaattgtctttttcctgtgctgttcggcattcgtaacttctcttgaaacaaaatg

SEQ ID NO: 112214 - DNA, 229 bp, Heterodera glycines
  Promoter: Source sequence=SeqID_5681; Location=1..229; Strand=+; Gene= SeqID_58894
ttcccgatgacgagctatttgtcgcatttgttgaagacgtttcaattttgagaaccattgcattgaaacggaacgccagaatttgttggcgcacgtcggattactatcaaagcgaaagggcaaaggcaggtacgatattggagagaccgtacggtatttgaaactacagtatgaagcataccttggcgttgtgcatttgttgaaaaagaaatggaattgtgagaaaatg

SEQ ID NO: 112215 - DNA, 950 bp, Heterodera glycines
  Promoter: Source sequence=SeqID_2378; Location=6861..7810; Strand=+; Gene=SeqID_79424
aaatgggcacttcgccctcccctggtcacagtcctaatcatgttattggcctttgtccatgaagcgcatgccgcgccgcgccctctttcttgtgacgagcaaggaatttgggtgtttcttaaccctaaggccgagaattcgctggtctgttgtgaggggatctgtagtagcaggagccatttaaccccttatttgctcccccttcccccggatttgctagccagtggttttgaatgccacctttcgtactcaattttgggggaaaaaatttcaacgcagattcagtgcgaccccgtggaagggtgtaatctcattaagtgctatttctgttgggagcgggtccttaatccccattgttcacccttcctcctggcctttgccattgggacaattgctggggcaattggtgccgtgattttcatatttctttgtttcttgtggaccgtccaaagaagtgctgtgcggggtcgatggaccgggttattttcaggtattttttggaaaaaccggcgcagtcccgaaccgactgccaaatggaggcggagtcgcgtcataactgaggaagggtcagacgaggacgaagttctatttcagcacgaggacttagcgggcgggatcatccagcagagggaaataggtccggctgaagaaaggccaactcagtcccggactcaaagagacccgactgctcggcctaaactcttaacccgcttcggatatgcactttcccctcctttactcgggctgctattcgccttattttttatcccatgcataaaagcgggactagaagtggtgtccgtgtcagccgacacggaagagtgcgttgtcgatcacggcagcactcagtgacgttttgacagtgtgacttcacttacactgctaccagtcggccaaaagccaatcatccgcaaattaacataacaaaaacaattatgaacaacgacatg

SEQ ID NO: 112216 - DNA, 281 bp, Heterodera glycines
  Promoter: Source sequence=SeqID_23940; Location=496..776; Strand=+; Gene=SeqID_54631
tcacaaagggcgattctcaagggaccgcagcaaaaagttgggaagcgcattactcaacggcagaggcacctttggttccggcggtgtgccccttctcgacaaaaagccttcaaggccatcattccctttgtgtgctgtccgcccacgggggcggcggtggcaacggccaaagggcgggcgcccaagtggccactctttctatgcccacaacggccattgtcgtttattcccgtggcccctatcgtctgccaccaagccattcgttcccacccccgaccatg

SEQ ID NO: 112217 - DNA, 77 bp, Heterodera glycines
  Promoter: Source sequence=SeqID_23691; Location=119..195; Strand=+; Gene=SeqID_54383
taattttttttatcactaaaattcattcattaaaaattataataatttaatatttatttctaaatttagttacaatg

SEQ ID NO: 112218 - DNA, 228 bp, Heterodera glycines
  Promoter: Source sequence=SeqID_31851; Location=1467..1694; Strand=-; Gene=SeqID_62159
tcattttttgactcaaataatatctgatcagaagcgatgtaatgattaagaaaagcgaaaaaatttgccgaaaatcagtcggtatttcgcaatagtcctatgtagatggggaaggcagtgcctgtcggcaccggcgtaaaaatctgaactttaataaaatttgttgacgcaatttatcacgaaattcgccaacttttgggacattgattcgattttttttaaattatg

SEQ ID NO: 112219 - DNA, 113 bp, Heterodera glycines
  Promoter: Source sequence=SeqID_19886; Location=1..113; Strand=+; Gene=SeqID_84645
tcaccttcacttgtttaatgtttattcgcagcaattctcacgcaatatttgcatagaaatttttgaatttttgaaaaactatcgccatattttcatattatttttaggtcatg

SEQ ID NO: 112220 - DNA, 345 bp, Heterodera glycines
  Promoter: Source sequence=SeqID_8547; Location=2120..2464; Strand=-; Gene=SeqID_68481
ttcgctgaaaaatggggggggggggcaattagcacaatgaaaatgcacataacaaaacaattaattacctaaataaactgacgatttaagtggcggtggaggaggacgaataattaagtggatggaatgaatgaacggaatgaacgtggataagcaaaaagtgtgggccttaaatagcaaattttttagtcggaagagtcaaatttttcggataaattcatatataaaaggcacaaaaaattcatttggttgccattattttcatcattcattaattatcggcaattcatcttcatcaatcatcccttctctgtgtacaacgaaaacgacgacaattgagcaatg

SEQ ID NO: 112221 - DNA, 186 bp, Heterodera glycines
  Promoter: Source sequence=SeqID_27944; Location=1579..1764; Strand=-; Gene=SeqID_58606
ttgctaaaaatggtgaaaattttaaataagggggagctttttaaagattttaattgcattttaaaaaattaatttaattccgtgccttaaaaaaaattttttggcgacacttttcaatttaaataatttgcttgtcattaaacaaatttttttaaatttttcagttttcttccgcacgccgccatg

SEQ ID NO: 112222 - DNA, 163 bp, Heterodera glycines
  misc_feature (41)..(41): n is a, c, g, or t
  Promoter: Source sequence=SeqID_38473; Location=1..163; Strand=+; Gene=SeqID_67274
tttttgttttggttgacttggccattttggcttgtcgcttntactgaatatcgaagatacatataaatgtaatagttaaacattcttcatattgccatttttgaagatcatcaccgaattccactaccacaaatcgcacgtgccaacctatggggtgataatg

SEQ ID NO: 112223 - DNA, 856 bp, Heterodera glycines
  Promoter: Source sequence=SeqID_15050; Location=841..1696; Strand=-; Gene=SeqID_79225
aacaaacgactcatttcggacatatttagccgcagaaacgaacgatggattgcgagaatcgttcagttgattgaacagaattcacagaagcgcactttcttcgcttttggaataagtaaattggcaggaccgatcgtttctctctctctctctctctcacccccccccactctcctctctctctccctccctcccactcttcctctctcgcctcaccctctttacactctctccctttcctttctctctctctcctctctcaaatagctttattactctcactcattaatcggtccttccttaccacaaaaggtcatttgctcggcaatggttccatcgtgcaactgttgcgattgcgcggatattccgttgatgaacgacaatttgagccaaatggaaaaagaaaagaaacggaaaatgccatcgtaaaaatcaatgccaatcagcaaaagactgacacagggaaagaagaagagacgaggtaaaaaaggcgaaggcattcctttggagatgggcacagctcttttggccaattgaactttttatttcattttcctaaataaattttacccattttttggcggggagggggggggggggggggtaacgtacccctcataccgtaccgccccctccctgagattccctcccccagcaattctctgttttggacacttttcgccgtcgcaattgcaattccatgtgcatttgcactgtttggagtgatcaaatatacggaggattgtgaacagaaagacaaatcacagcaaaaggggggtacaatgcaagtgaatacggtaaaaaaaaaaggaggaaatcggaaatgctgaacattggcattttgagaagcaaaatg

SEQ ID NO: 112224 - DNA, 333 bp, Heterodera glycines
  misc_feature (32)..(32): n is a, c, g, or t
  Promoter: Source sequence=SeqID_1690; Location=1227..1559; Strand=-; Gene=SeqID_75337
gacaaacaaactatctaccgcgaccaacgccngattgtccatgacaacagtttctgaaacaacaataatcgtgatcggcgctcttttcggcacgaggatgtcaaaagcaaacgcagaaccgacaactcgaaagatgagcggtcggacaaagaccgaacattttctggtaggtaaatttaaaactaaaaaataaatttcatatgaaaagttaccacttttggatttcaaatcaaattttgggtaattattagccaataattaaaagaccaaacccccattttttgacgaaattttgcataattcataaaaatgcagcttcagaaaaaataaatg

SEQ ID NO: 112225 - DNA, 1003 bp, Heterodera glycines
  Promoter: Source sequence=SeqID_209; Location=101..1103; Strand=+; Gene=SeqID_77791
tcttatcactcacaaatcactgggggaaaattaagatgatactgatgattagcgttcttgttcgattttggcgctagtgcgatatttattctcatggttcttggaaagtactcaggaagtatttcgatttttgtaaataaaccatcagctgatataaagaaaagcattcttgtctgtccttttccaattatattgccatttcggcatcggtctaacaaagctgcgcatggctttgggaaattcctcaggaattaattttcgttgtctaaagaaatgcactagtgtcgggcattttgacattaaaatgccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacactaaaatgccattaaggcaccgttgtagcaatgatgcacgtggtccttggaaattcctcaggaattaatccctgaatttcttctattttcttatcactcacaaatcactgggggaaaattaagatgattctgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatg

SEQ ID NO: 112226 - DNA, 697 bp, Heterodera glycines
  misc_feature (613)..(613): n is a, c, g, or t
  misc_feature (655)..(655): n is a, c, g, or t
  Promoter: Source sequence=SeqID_31533; Location=291..987; Strand=+; Gene=SeqID_61868
tccctcccccatcatcgccactgttgggagtgggcaaaagaaatttttttctcaatttcgttggatgattgatagggaaatttgaatatgcctttgcatttcggtgcgcttctcccctgccaggcaccactctgttattgcccactgcgatgggagggcaaaaatggactgaaagaaaatgaaatttcttcgcgagtttagttttgattgacagttcagtgtcataaaaaaagaaaatttgaaggaccaaacggaattgtcataaaaaattcaaatgcgaaggacgaaagaattgcgattgcaaaaaaaacaaaaatagtaacgatggacaaaaaatttttgtgcgtttgtgcacaatttaaatgagaagaaaaaacttgtgcgtttgtgctcaaattatgttgggcaaaaaatgataactgaacaaaaaactttgtgcgattgtgagcaattatgattgggcaaaaacatagcaaaaaacttgtgggtgcgtattttgtggaagaaatatgatgaaaaaccagaataaatagagatgatggtcgactatcagtcaaaatgggcagattattaaccaaatgagcattagtttttgtgtaaaaaaacatgtttnttgtgagcattttggtttcggtttgccgtttgtggggctatntaagacggtagaaagttattgtgatcgtcattcgagcaaatg

SEQ ID NO: 112227 - DNA, 1003 bp, Heterodera glycines
  Promoter: Source sequence=SeqID_17221; Location=1036..2038; Strand=+; Gene=SeqID_81687
gctcttttttatatgaaataatttcagactaaggcaaacaatctatttttgaaaaatttagtgtcgattcataggggtatatttttctgaaaattttttggttgattcttaggggtatatttttcgaaatttttttgagtcgattcttaggggtgtatttttcgtttttattgcattttttaaataaattttggacaaaacgccaaaataagggcaaaaacttattttaagggcgaacaactaaaagttgtaatttacataaattaaaccaacaatttattcctctaccacttcattaagttctatttaaaccatcaaatgctcgaaaaccaaagttcaaaattaataatgatgggggggggggggggaaaggtcaatatatatgtacgtaatataggtaataattattatgaaattttaaattttaactcattaaatttagaggaaaatgtggcgtgtgtttgcttaaaattgttgttgtgtaagagaagagcgagagatagagagagagggcgaaaggggagagagagagagagggaggggaaagaaaggaaagaggagggtaagggggagagagagggaaaaagaggagagagggggggggagacttgaatatgttaatgtaaagaattactgaatgtacggctaaaacctttccttttttaatggcgagtgcgtcatcatatgaagcaacgtgtgaaccgtgggccaaatgggaagcaatttaattcatgtttttttttggaaaaaaagaaatgtattttggtaactgtttgtttttttgcctttctttttattcttggccaaatatttctaaatttaccaaaaacacgacgagattagtacaaggcctttctttgcaaacggaatggagccaagcaaataccaaataatacacgcaaaactaacacaaactaaaacattgaaatttagccatgccccaatatttaaaaaaataaaatagttaatcgaaataaaagcatcacaagacacagcgacaatg

SEQ ID NO: 112228 - DNA, 312 bp, Heterodera glycines
  misc_feature (41)..(41): n is a, c, g, or t
  misc_feature (55)..(55): n is a, c, g, or t
  Promoter: Source sequence=SeqID_19194; Location=1484..1795; Strand=-; Gene=SeqID_47569
cgcaacggaaagaagaaatgtggcacaatcctttaaaccgntagatcatttgggnttattttaatttttcatcttaacaatatgccataaattttcgctgttactataatgagctttttttggatgatgaaaaatacttaaactatttttcggaaaccctaatttactgtttgccttattatttttatttttttaaattttttgtattaaaaacaagctgatgttattttcttactcgtttttttaatcgtttgtaaggcgttttttgttcgtttggtctgacttcattcatcagtggttttttaaatcatg

SEQ ID NO: 112229 - DNA, 638 bp, Heterodera glycines
  Promoter: Source sequence=SeqID_9092; Location=2876..3513; Strand=-; Gene=SeqID_70215
aaattcccttttagcatcattggaacaaactcagagaatcgataaattcggcggtgagtcaaacgatttcgatttgaatcccgaaatgccatttgcatgccgttgggctgtgccgtgccccacccccccccttttccaacattgctccctgccttccaccgcttcagttttcctccgctcatccgcaagcggtccgcccgtcgccgtccatcgtcgtcgataggctttcgcccaaccaccgcgcccctttgtcgctgctttcgcccttctcgcgtctccgctcgccggtcgctgcctttgcgcgtccctctgttttcgtgccgcgcctcgtctcgcgctgcgcttccaataaccaatgcactgtctcttccgcttcgtccaccgtcgcgcctcccctcacccattcgtcggccgccttttcctcctcctctttctctgtttcccgagtttcctccacctttttggatgccatgcgatctcagctcagagtgggctttggcattttcaatggccaatttcacttccaactttggcagagagtgcagcgttctctgttggatgagctgttgggttggaatgcgtttcgcgcccgtgcccaaatccttccatcgcttcaattagtccttaaccgttcaatg

SEQ ID NO: 112230 - DNA, 225 bp, Heterodera glycines
  Promoter: Source sequence=SeqID_31705; Location=559..783; Strand=-; Gene=SeqID_62008
ataaaaaaatgattatgttttaaacttctaataaattgtgtgatcattttttattttttatttactggatatatgtatggaaagatttttagaatgggtccgttcactgaatatttccgagaggagctcgaaaaggtattttaattttgcgtcaccaatcacatacctgacgtttatgagtcattttattggaataaaactcgtaaagacctcaaaaaacgaatg

SEQ ID NO: 112231 - DNA, 277 bp, Heterodera glycines
  Promoter: Source sequence=SeqID_43519; Location=1..277; Strand=+; Gene=SeqID_71158
caaaaatgccaaaatatgtacaacttatgcgccaaaaacacgaaatatgtgccatatgtttttatgagccaaaatgacaaaaaatgtgtatttaggacaatatgagaaaatctacatcaaaaatcgctcgcagaaaatgttatttttgggcttctctcgacataactaagccacataacaaaatatgacaaaacatgaaaatcccatccctaataataataatagataaaccgaaaaaaaaaatgaaaatggaaaggacaaaaacaaagtaaaaatg

SEQ ID NO: 112232 - DNA, 427 bp, Heterodera glycines
  Promoter: Source sequence=SeqID_4125; Location=2748..3174; Strand=-; Gene=SeqID_53276
ttgcgggacaccaatattgtctttttatttttcttaaattttcacatcctccttaaaaggaattttacaaattatatactcaaagtgcttatcagtatttttttgtttagttttttgaaaaaaatttaaaatgctaagattgatccaattcaggttgtccaacacggagcttgtattaccagccgccgctgtccaatttactgcgccataggcaattttaaatgagatacttggagtgcagcatgtgttatgcttctttgtggttttatgatgaatttgactttttaattaaattttgattatattatttcgttcatttacaagcattatcttttatgcgttttttcgtgttatctgttttgaaaattgatttttaaatcaaatttgtttagaaacagatttatatttgcaataacattgtcaaatg

SEQ ID NO: 112233 - DNA, 222 bp, Heterodera glycines
  Promoter: Source sequence=SeqID_12280; Location=1..222; Strand=+; Gene=SeqID_75873
ttaggcaaacttatgtttttttacaaaattgttttgactttatttttttaacattttttgaatttttgcatatattttggtattttttgaattttagcgcatatttttacattttttggatttttaacctcatattattatatacatatttatgttattgttttacaaaacagactggctcaacttatggcgaaatgttttcaattgcgctcaaaaggcatg

SEQ ID NO: 112234 - DNA, 1003 bp, Heterodera glycines
  Promoter: Source sequence=SeqID_17777; Location=350..1352; Strand=-; Gene=SeqID_82318
aaattaaatttaaaaaattacgcttttttattttgaaatggttttagatttagccaattttagatttttcagaaattattcgctaaggcgattcaggtgtaattaatgtctgtaaatttatcggtttttatgatttggctatatgtatttaaacattccctttttattaagcaaaacatttcaaaattttaattcttcggcaaaatgtgcaaccgatggctgagaactgtgcaactgttccttctaaaactaataaaatttataattataatttgaaaccaatcgcttagtcaacagatattcatcatgaaagcaattatttttgaaagaaaaagccattaaaataatttgttttagacaaacgctgatcacgggcaataagaaaaataaaaaatttaagtaggaattgaaaaggaagaattttcattttaggttattctcgtttttctatatttaactttagtttaattattcctttgcattttctccaaatttcattaattggttaagcacttgatttagagaaaaatgaaaattaatgttcgaataaaaatgcaattatcatatttaatccaatccctgcttatgaaaaatcgtaaatgattaattaattgatcaaacagatgctgatttgatagtcaatggtcaattgaactaaattaactcttccaatcagcagatgctcccccccccccccaattagttaattggaggaaagagcacgagcaataaaatgaataataagacggaccaaccagttatgtgataactttgattagtttaacttctgatttgctttctcccattaattttatcctaacaaagaaattgccttccccatttcctttcttaaatagttaaattataaatttatttttaaatttttgtgtaaatttttatttaaacgaatttctaaaaatgcctctgatttgattacttttgtatttttttggttcggaattgcttgtcagtaataattaaatgataatccagtaacaaaatg

SEQ ID NO: 112235 - DNA, 234 bp, Heterodera glycines
  Promoter: Source sequence=SeqID_4201; Location=2326..2559; Strand=-; Gene=SeqID_53571
tttttctattttccttcatgtcttttattcttttcacatgtaaacaaatcatttgaataaacaacgatttttctgaccttaaaaatattgatcatggaattgcatttgcatctttttaaaatgttttccacatttttaattattaaaactttttctttgaaaatttgttttgttttttattgtcaaagttttttaataaaatatttttttttaattaaaagcacataatcaatg

SEQ ID NO: 112236 - DNA, 1003 bp, Heterodera glycines
  Promoter: Source sequence=SeqID_8019; Location=2396..3398; Strand=+; Gene=SeqID_66713
gggctataaattatatgcactatccctaaaaatatgccccaaaaccctgaaaaatgcataaatatgcacaaaaatatgccttaaaaaatgaaaaaaatgttttaaacctcaaaaaatgccaaattgtgtaaaaaaaaaatacagaattgactttaaaaacatcaagagaataggttaaggagtcgaataaaaaattttgatttcaaaatttgtatatgcaatttagaaagcatacgtgcttattatgtgcttctttttgaaaataaaaaattcaaaagagctgtgtttgtttttgagccgcttttctaattaaatagatatttttcaaaagttggaaaataattttttatgcaaataaaagcaacaaaaaagatagttgaaagaattgtgtggctttggggagggggtaaaatttgtacaattgaaaagaaagataggtagccaaaagtggaaagattttctgtttggttatagcaaatgatcaaaagcaacgggaaatggataggttggttcatttgagatgctcggttctcgaaataagaaatttctcggaattcttggtttaggaggggtctgtcgccaaagcgactgagaaaatggaagaaaattgaggaagagaaatttaattgatttaaattggataattttaaatattgtgattaattttattatttaatttgtgatctttgaaattgtgattttgtccctccattgaacattttgtacatttttagcattagtcactctttttgttgttgatcgctctgtccaaattgctccacctacgctttttctttctatttaaacacgcacatttctcactcctcacatcttatacagacatcttattcattttatattatatttattaaataaacttctttcttatttgggaattattttcccccttattccaccccgccctctctccctcgcgccttcccatttttgcccccatctcgccgtccgagccaacaagtggtgccgctaacaaacaaagatg

SEQ ID NO: 112237 - DNA, 62 bp, Heterodera glycines
  Promoter: Source sequence=SeqID_1813; Location=5285..5346; Strand=-; Gene=SeqID_76122
cgtcgaatcagccgttttgtgggagcagtcccatttggattcccaagcaattgctcaaaatg

SEQ ID NO: 112238 - DNA, 66 bp, Heterodera glycines
  Promoter: Source sequence=SeqID_15742; Location=2165..2230; Strand=-; Gene=SeqID_80069
ttctattctcgctttacgcacgagaagcgcaatgccaaagcagcaaaagcggtttcggcgccaatg

SEQ ID NO: 112239 - DNA, 242 bp, Heterodera glycines
  Promoter: Source sequence=SeqID_28259; Location=1174..1415; Strand=-; Gene=SeqID_58893
taattattttgacaattatttcaattttatatataaagttttcaccaatcggaagaggatacaaattaataagccgaaatttaattacaattattatttcttttttattaattaacgacaaaattttctcggcgagagggtcacataaatgtgacaaaaattcatatgaaatttctgatcagcaaacgccaaaatttaatgaatcacaaaatattattgttcataaaatcacaaataaaatg

SEQ ID NO: 112240 - DNA, 249 bp, Heterodera glycines
  Promoter: Source sequence=SeqID_1899; Location=4178..4426; Strand=-; Gene=SeqID_76639
ttcagtcaaccagccctgaaatatgttttttcataaaatttctcaggcgccagcttcgaaacgaaattctcagcttattaccggggccgataggcgcaaccttttattttgaatttgataaattaaattaaatagaaattcaattttaatcattgaaaactctaaaagcattcaaatttttaaatttttcagcgttaaaactaaagcattcaaattttcaaatttttaagcgttgaaactcccaaaatg

SEQ ID NO: 112241 - DNA, 372 bp, Heterodera glycines
  Promoter: Source sequence=SeqID_351; Location=1718..2089; Strand=+; Gene=SeqID_83877
aatatgtttgtctaattcaccgcaattatgtacataattaattaatttaaatatttaataaattataaatgattataaatagggatgatatttttaggcaaatgcctattttttcctgagctccccgtggcctgaaacgcacgaaaaaatatgtttttttgggctgttgttaagctacttttcgagttattaacgcctattttctagtcttttatcccctatactaatttggtgctgtatgtacgtaagtttttaaaattgttaacaccaaagttcaaaaaccaataatactaatggtatatgattaactttaaaagtgccggatcgatggcagttgtgccaactctcaaaaattagattggtttaaaaatg

SEQ ID NO: 112242 - DNA, 244 bp, Heterodera glycines
  Promoter: Source sequence=SeqID_16114; Location=1..244; Strand=+; Gene=SeqID_80472
acttaccaatggagcaaaaaagacgacggctgcagttcgtatttaatcgaaaccccgcaaagtacggtgttcacgatgacaccattttaaacaacgcaggaaacccaataactgacagtagtgtcgcccaagctctcgactatattatagaacgcagagcgggacgaattccacagtttagacagcccccaggaacaaaagttattcgagatcgcattaaccgtgacctaattttgcgaacatg

SEQ ID NO: 112243 - DNA, 1003 bp, Heterodera glycines
  Promoter: Source sequence=SeqID_6756; Location=250..1252; Strand=+; Gene=SeqID_62757
atgctaaacgatttgatgaattcgaaaaaagatatgaacgtttgaaaatttgtttttcttataactcatgaaatataatgtataagccaaaaaatggctgtattactgaatgcgttatatttttctctatcgatatgcaaaatttggtgcggatttaacgtgcaggaaaaaagttaaacgtcacgaagtaaatccggtttttctctattaacagagataaaaaaatagtacgccaaaaagagaaatgtttttttctctgcactctctatttattggtccatgtctcattttttgaaacggtgtgtaaaatgggtaatacagagaatacatgtcaagagggtcccaggtatgtgaatttccgacatttctgggcccgaaattccgatttcgaaattttttgggccgccggaattccgattgacgctgccgaattttttggtaaagacaccaaattttcggcaatttgttggagaatcggcaatttatttttggaaactaaaaaaatggatttcgcctatagagttggggaaaaaaattaatccgggaatggggttctcgcctttttcccgttcccgtaaaagtcccatccgggcaaaaaagatgggaaggttatttccggttttcccacggaaatcccgttcctgcccaactctactttattctcagaaggcggccttatctgttccggtttgacctaactgtgaggctttagcctcttattttttcccgataaggctaaataaaaacgaggctttttatggctttttgaaaattttgaagctttttatggctttttggggaaaatctcaaaaattgtcattatttgccaaaatatgttaacaatcattccaaagatttctaattttattttggcagccaaatttaaatttttcactacctaatttttttttcttcttttcttcaacttatccgaattacatctttataaaatgcaaaaataataaacaagaccaaacgagataaattggtaaattaagaaatg

SEQ ID NO: 112244 - DNA, 469 bp, Heterodera glycines
  Promoter: Source sequence=SeqID_3225; Location=1..469; Strand=+; Gene= SeqID_83767
ccagattttttaaaaaaaagagcaattttggagatttgaattttttaaatttaggattttagtttcgcgatcgattatttcaataaaattcttatttcttccaatccaaataaataatttctctctgattacatcggtgctaggacaaagaggattttctaaaatttaccatagttataaaaaatttggacaatatttaatcaatgcgtagcaaatgcaaaattcatcaaaaccaccctataaatgaaagtgattcagcggcaggtgctccctcccaattgtcactgcccccagggtaagtaccaattttcttcacaatttcgatattttttcaaattaaatcattgtgcattttgtcatgtgtcatgtgtactcagctgcaaattaaaattgaaatttcttaataaatttgccaatgctttcattaaatatttaattcaacttccatttgggaaaaaattcaaggatg

SEQ ID NO: 112245 - DNA, 234 bp, Heterodera glycines
  Promoter: Source sequence=SeqID_10210; Location=2155..2388; Strand=-; Gene=SeqID_73334
actaggaaacgaaaaaattttagcggaattgatttaatcctttggcttaagagcagagaagcatttcatattgttgtataaaaattttgaggagagaaagcagaattatccaagttccactttttcacgaaaggggaagaaaattcgaaaacactgtctattacaaactatggaacatgaaattctttgcaagaagttgattaaaatagtgaggcagcagaaaaacaaaccatg

SEQ ID NO: 112246 - DNA, 199 bp, Heterodera glycines
  Promoter: Source sequence=SeqID_8073; Location=939..1137; Strand=-; Gene=SeqID_66896
ttcgggttcgggattcgaaataacacgaccctgagttcagattcgtgatcagcgaccccgaaaatctataaaaattggttttaaaaaatttatatatataaaaaaaaattttatgggatgtaaactgcacaagtaccccaaatttttccatttgttttttcagcagcaatttcactattttttttttgtttgattaatg

SEQ ID NO: 112247 - DNA, 331 bp, Heterodera glycines
  Promoter: Source sequence=SeqID_4547; Location=1..331; Strand=+; Gene= SeqID_54851
atgtattttcccgaaaaattaatattttaattatatgtaattaattcttaacaggaccagttcgtcaaatctgtcaattggcgcctgataatgtgtatgatttaccaaaatatttattttatttttgtatatcagtggaattaaaatttcctattttgcctataaatccggagacacaacatttattacggctttttcagtttatttgccacacaaaaaaatttccaataaaataattattttgttattttttcacttatttttggaaaagtttgtatttattggactttgatcattttagaattttatttatttgtttagcaatgcgatg

SEQ ID NO: 112248 - DNA, 803 bp, Heterodera glycines
  Promoter: Source sequence=SeqID_29226; Location=1..803; Strand=+; Gene=SeqID_59756
aaagaaagaaaaagaaacatttttaagaactgttttttactcaaaatgacaaaagaaaaaaaatgtaaaacaaaaacatttcatttttcaaagcatttatacaacacaacacaatgttaatattatagtattttcttagtgaacaaactaaggagtgtcctctttcttttgttaaatattttatacaataaaaaatgggttataagtaaggaagggatgcgagagaaatttcccattatctctccctttcctttcttttactctcttttcttttccattgcaatttactctctttttttcccactccctccttcacccacacacacgcacgcgtccaacagactgctgctgcacagcagcacgcgtctgttcactgtatgcccctctcacccgccgctgcccgcgtagacagacaatcaaacagtgcactattttcccacctttccctcgctctacatttttcaaatacattttttaacgcaaaacaatttcaaaacgccacacaacattcaaaagatggcagatacaaacagacactcaactttaatatgtaggatttttccgaaaaatgccaaaaaggcaccaaaatagcaaaatgccaaaaaggcattaaaggcacaaaaatcctgaaaaaggcataataaaattcagccggtcgcttaagatttgaatttatgttcaaaattgtttaaaaaacctcataccaagctaatatatccacattatccgtttaaaatgaatttaattcctaaatcaccattttttagtaaaattcttgcatttttcgtctcaacctaatcatg

SEQ ID NO: 112249 - DNA, 282 bp, Heterodera glycines
  Promoter: Source sequence=SeqID_2600; Location=1..282; Strand=+; Gene= SeqID_80641
gataggttagaaaaaaagcaaacataagcttaaaaattttttagagatttggttggaacatgggcactactctatagactcccgccctcactttttgacacttcacgccgagtcgttgcaaagaagacaatggaggaatttttaaaattaccatctttttttcgcatgattttttataataaatattaatttgaaatgcctttttaaaaattggtttatgctggccaaactattcattcgatcctaatttgctattttttcgtagaaattcagaaaaaaatg

SEQ ID NO: 112250 - DNA, 65 bp, Heterodera glycines
  Promoter: Source sequence=SeqID_5645; Location=3703..3767; Strand=-; Gene=SeqID_58753
ggtgagtcatcgtttcacgattgctcgaattttcacttataattttttacaggtccctggcgatg

SEQ ID NO: 112251 - DNA, 78 bp, Heterodera glycines
  Promoter: Source sequence=SeqID_45453; Location=391..468; Strand=+; Gene=SeqID_72753
ggtacaagggttcttttctttgttttagcttttttctcttttaagcagggacatggaaagaaagactgcagtcagatg

SEQ ID NO: 112252 - DNA, 1003 bp, Heterodera glycines
  Promoter: Source sequence=SeqID_9045; Location=406..1408; Strand=+; Gene=SeqID_70092
aaaacacataaaaattttcaattgtaaatgaaattattattagagaccgcaaaaaaaggcaccaaaaatcgcgaaaaagacactataataggcacgaaaaaattgaaaaaaagcacgaaaatcccgaaaaaggcatttaaaaaattttttctaaggttttagggagcaaaacacgtaaaacttaaccaaaaacttaattttggtcatttaaatggttattaaatattttataatgtttttcgaataaggaaaatttttaaaccgagaattttttttatcaagaaaaaaatgaatttaggcgatcaatttttgagaaaatttttcaattcttaggggtgtattttctgaaaattttcaagtcatttcttaagggtgtattttcccgattttattctatttttaatggaattttcggtaaaaacgccaaaaaaggcatttaaggcacgaaaatcctgaaaaaggcaaaaaaaggcataataaaagtcaacatagaagcctcaaaccaagtggaaaatgtgttatttatgcttaatatatcgaaacaagtgcgcagaaaaaaaggcatatgcctcaaaatgcggtctctaattattatatattttagttttttttcagaaaagaacaaatttgaaaaccaaaattttttatgaaaaaatattaaattttgtgggtctagttttgggaaaaattttcaattcttaggagtgtattttctaaaaattttttcggaccatttcttaggggtgtgttttcgtttttattgcatttttgttaaggattttttcaaaaaccccaaaataggcattataaaagtcatcgtagacaccccaaaccaagcggaaaatgcgtttttcaagtgcgcaaaaattttggcatttgcctaaaaatggagtccctattaataaaagacaaaatgaaaattagaaatttttaaaaatttcaaataaaataataattaaaattattcccgttaaaattttttttcagaatttattaaaaaatg

SEQ ID NO: 112253 - DNA, 84 bp, Heterodera glycines
  Promoter: Source sequence=SeqID_21132; Location=1..84; Strand=+; Gene= SeqID_51717
caaaaaaaaattatagaaaaaactgcgggttttaatattttttgttcacaaaactcacctggtgaagaaatgaggagataaatg

SEQ ID NO: 112254 - DNA, 74 bp, Heterodera glycines
  Promoter: Source sequence=SeqID_39936; Location=883..956; Strand=-; Gene=SeqID_68389
attttgctacatattataaatcaaatgacaattatttatgtttcctaggaattccatttacactgctcgcaatg

SEQ ID NO: 112255 - DNA, 292 bp, Heterodera glycines
  Promoter: Source sequence=SeqID_9610; Location=357..648; Strand=+; Gene=SeqID_72080
aatttttgaagaaatcataataattacaaattaggcctaattaaatttttaaatgccatttagcttactgatctgctacccgggcacattgatgcgcaatcatatgatcaacgagttcaaaaagatgtccgatttcagattgaaacggacattccaagtcggcaacaaagaagtaatgggaattttaattaaaaaatttatttaaaattttttaattttcgaacgattctctttcattggagtgcgcccaaaaaacggaacaatttgttggcatttcaaacccaaaacaatg

SEQ ID NO: 112256 - DNA, 713 bp, Heterodera glycines
  Promoter: Source sequence=SeqID_31952; Location=1497..2209; Strand=-; Gene=SeqID_62274
ccccaaacggacacttgaaaaaatcgatttttttgtttcctgggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 112257 - DNA, 280 bp, Heterodera glycines
  misc_feature (190)..(190): n is a, c, g, or t
  Promoter: Source sequence=SeqID_8465; Location=4706..4985; Strand=-; Gene=SeqID_68163
tccgtcgccgtgccgccctcgcaactgttcaaaaacccttttgacatcccacgaaccaatctgtgcgcccagctggacaaaatgcggatcaacttcgagcagcaagtgcgcagcagcggcaacgggtgcggggcggacgtacacgtgttccaaggcggacccccgggacagaaagtcaaactgcaacatngtcggtgagttgtcccacccctgtcgatttgaatccggtgatttctggaaaatttaagaggatttggcctgcttgccgatcagcaaaatg

SEQ ID NO: 112258 - DNA, 222 bp, Heterodera glycines
  Promoter: Source sequence=SeqID_9478; Location=5486..5707; Strand=+; Gene=SeqID_71565
ccttaaattggcatatcaattagtaccatgaaaagcgccgaaaaaattaataaattttcattttgtgtgaaatgaataattaattagtgccaatcaaaagcgccaaaaaaactaattaacctatttttaatttgaacataaaatgagaattatttagtgcagtcaaaaacgccgaaaaaattgattaatttacttgtcataatcaaatttgtagacacaatg

SEQ ID NO: 112259 - DNA, 667 bp, Heterodera glycines
  Promoter: Source sequence=SeqID_4057; Location=3423..4089; Strand=+; Gene=SeqID_53005
agcacttgtccattttttccattgtttttgttcttgttctgatggattacccaagaataatcgaaagtgaactcgcttttcccatcccttcggggattattgtcagcgggccttcctcatcaggcaagacccagctggtccttcgcctgttacggcacgccaacgtattgtttgatccccgccaaaggcaataggcatgtgtaaaagggttttatgtgcagtcatttttgtgtctagtgtgggcatacggtgagtactcgacgcagattcccgagctagagcggcaggaagttgtccctcacgcaggtgcgccgtctgacgaaatgttgaaaaaaaagctgccaaagccttgtctgattgtgtacgatgaccttatgggtgacattgaggccaagaagcaggctgacctgtacacgaaaaaaattgtaccacaacaatttttctgtgattttcctcacccaaaatttgttcgataaggcactacgggtgccaagatccaacgcccagtacatcttcctgatgcagccgcccaacgccatgttgagcacacgtaatttggccagtcaaatgttccctcgggagcagggcattctgatcgaaacttaccgacatatgtgtgctctaccgtacggctacctgttcgtgaaccttcactgagccaaaaatg

SEQ ID NO: 112260 - DNA, 1003 bp, Heterodera glycines
  Promoter: Source sequence=SeqID_25398; Location=333..1335; Strand=-; Gene=SeqID_56144
taaatcttaatgagggaaaatagtttactcaaaagtaatttcgaaatcggaaggaagacatggaaaagtgactaatagcagagagaacataagagaaaccgtcgatcagtcagagtcagcagatgggcgagggggaggggaggaaatgcgagggtcgcatggagcggcggcagggaaaaaggaaaggatgagtcatcgcaaaatggcgtgtcgccttcagcagacagagaaaaaaaatgcagcgaagtaaatctccgcggcacatcactttcttctttgtccctttcattcacttcaaactatttcttttttctttctgtggtgcactaatgagaatatttcgaaattctgccttttttaataacttttcgccagattttgaattttcttgcagaaaagtaagaataagagaagggatatacgttctatttgttttcctgacctctatatggtctgaaacggacgaaaaacatgctcaatactgaattggcttaatttttacttttttgaatacgttttgtattttacacccctaaattgaggttttattaggggttggggtcaattccctaccgccaattccgagggcacctcgtttcccccccgccgattccccccccgcatcgtttcccccccgccgtttcccccccgaatcgtttccccccgagaaaattttttttttaaaaattgctaacttagaaatttttcaagaaaaaaatcttagaaagttttttcataagaaaattctaagaaaaaaaatttttcgagaaatttttatggtgaattactaagatttttcaaaaaaatttccaaaaaatcgctgaaaatttctcgaaaattttttttttcttagaattttcctatgaaaaaaatttctaagggggatacgatgcgggggggggggggggaaaatgaaagtcaccgatacggagaggtgcggaacgagctgtccccatcatttatgtgggttccaattttttaaattggttcaggcgatgacatg

SEQ ID NO: 112261 - DNA, 1003 bp, Heterodera glycines
  misc_feature (52)..(52): n is a, c, g, or t
  Promoter: Source sequence=SeqID_31128; Location=25..1027; Strand=+; Gene=SeqID_61510
aggacggatcccatccctgctattaccacataaaatttatataaattaatgnaatatcattagctttcaattgatgtcgtctttttccgttttttaattaccatgacaacaagcactattcaaccattcacattccattcatcattctcaacaacacttacttttacccatttattttccattttgccactgatttggtgttaaagaaatgtttgagccggcttgtgaattccctgtcaaaacgggtgcctcttttctgtccaagaatttgtccgtttttcataacaaggcaaaggggcacacattcgctgcgtatttgggcaaggattcggtgggtcaaagaaaacaattggagaaaaacctcgaaatatttaatagtacaaatcagggtttgccaattcgaaattgattttttgatggtgtttaataagcccggacgggacttttggtactgagaccggctttttctctaacaaaaatttctcaattaaaattttggaaaactttcaaaaaatccacaacattttccgctactggccttataatttaatttgaatgaaaacgccgactggcaatggcattcaaaaatgcccgtttgtgccatttttagaacgggcttttcgttataactttctttaaacgaatcgggtattaatcaaattatcaagcattaatgttaatagcagagatatttttgagaattttttcaaaattcccgtccgggctctagtgtttattaatgtaaaaattagcacaaattccaataaattgatatttttctgtgcaaagtgttaacaattgcattaatatttcactaaaagcgatggtacccaaaaacccgggtccataaaaacagttgggatgatccggtctcataatcacaatctggacctgtggattcattcacattagggtttgtcctgataaaacagttttttaaagaaaaataggaaatttttccaatgaatgggttttgtccattttggcgcagattcaaatgatg

SEQ ID NO: 112262 - DNA, 187 bp, Heterodera glycines
  Promoter: Source sequence=SeqID_35096; Location=1..187; Strand=+; Gene=SeqID_64733
ccccattataaaaaaggtgttctccaaaatgattaaatatttatttaggggcgattaaataaaccatttcccttattacgacgaatatcgcccaaattagtcccaaattatgactaagtgcgccgttgagaaggcgtccccctcctccgcctcctcccccccgccggcgttactctctccgatgatg

SEQ ID NO: 112263 - DNA, 696 bp, Heterodera glycines
  Promoter: Source sequence=SeqID_1338; Location=5336..6031; Strand=-; Gene=SeqID_72880
tttttgtaatctattttaaataattagggattaactttggttaaatgagtaaaatagctagacttgtggcattttataattgacggataatggaaatggaaaaagcacaaatgaaatgaaataacataattttaattattttattaaaaaatcatattttttaatggcaaacaaatcttggcctgatgagctgcgcactgccatatgaagcacaagacgacagggcacctaaacggctcgggaaattagaaaagtttattgatctaccatgaagagctaaaagagatgctgtcaggataaacggagaccaggatttgatcaaccgccctgattaacagcaaaaatgagatagttattgattaaaaaaaatgcaaaatgttagccaaattttaaaatgaatagtgagaattagcagatgtcggatttttggggtgttcgcaatttttacttagaagcataatttatgaccttgacctatggaatatccgcttattcgactcatttgcatgtgactttattttaaattagcaggtgtttgatagaccaaagcatcaaggcatatcaatgtgtgcttgaaatttgggcatttaattgcgtcattttatgtcctgcgacggcaatttcggtgcttgtgccctttttttctccttcgttcattatgcattcattattccatttttaaatataattcaaatg

SEQ ID NO: 112264 - DNA, 298 bp, Heterodera glycines
  Promoter: Source sequence=SeqID_22244; Location=1..298; Strand=+; Gene=SeqID_52918
ttattcaggtactctgccaaattctcagctttacagttcattagcttggataaggctgttgtcagtgggggcatctaaatgactgacagggaagtgaatgataaggggcgtggcataggagggcatactgtggatggatttcgaaatcctcccgtctggaggtccctgcgtgctctcacttgagtgggcgtggcctattccccacgtgacacccccctctccatcacgtcacatacagtacccccacacttttcccttctcattttcatcttaacacacaaaaatattcctcgaaatg

SEQ ID NO: 112265 - DNA, 431 bp, Heterodera glycines
  Promoter: Source sequence=SeqID_24267; Location=1..431; Strand=+; Gene=SeqID_54981
actgcgctgcctaacggcggtgcttaaagtgcgctacccccccccgaatgattatcaatttttatttttcttaattccaattcgaattcgaaacgcaaaaatttaatcataattcatgtggtaaaaaatgcatttaaaaataaaaaaaattcttgaatttgcttctgaattttttaattttaaatagaaaattactttttcgaaaattttgcacaaataagaggcggagaaattcaactaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatg

SEQ ID NO: 112266 - DNA, 78 bp, Heterodera glycines
  Promoter: Source sequence=SeqID_21896; Location=1160..1237; Strand=-; Gene=SeqID_52533
actgtaatttgttgacaatatttttatattgaacctatatttataagtgatgctatctcaacaatttatgatgaaatg

SEQ ID NO: 112267 - DNA, 981 bp, Heterodera glycines
  Promoter: Source sequence=SeqID_13037; Location=2677..3657; Strand=-; Gene=SeqID_76818
ggtaaaaaaaactgaatttaaaattataaaaatggtaatttatggagaaataatacgaaaatagaaaagcataaaatgaaagggctaaaagtaacagaatttgataaataaaatatatttactatacaattattaatcttaagactaaattaataatttgggtagcatattaggcacaaaaatcataaacacttaaaacggcagagaaatagcaaaataagatttaaaagggcataaaacgcttgaataggcacaaaaaaagcaaataaatttttacattgatccaaaaaaatctttgaacaagcatgaaaaaccatttcaaaatgctcttaaaaaatctgtaataataattattatgctgacttaattttgaagctggtcaaaagtattataaaacaacttgatcagatcactccttcgtgttgacctggacactaaaaaatatattgaaaatcggaaatttaaaaaaaaacttttggtaaaataagcattataaaaatcatatacaaaccccaaaccaggagcaaaacgtttgaaaaacattctttttgacttcaataaattatataaaaaatcaattcatttgtatttgctcttaaaatctattcatagaacagggattttttaaatttgtttgaaattcactttttttttgcgatttgtttgcggttgattttgagtgatggtagcgaatgaatggccgtcccatttgatcattaagtccccccccccctctcaaccgatcactcatttaaatgaaattcgatccaatatttccccttttcgtgtttttccttccttcctatgactaattgctgcttttgtgtggccattcacatggccaatcgaacaatcaaaagcatcgcttccccccccccccccgcaaatcattcgcccattgatcactcattctgctgatcagctaattttagtgatcattcaaattttatgtcgtttccgatcattctaaaataaaaaatg

SEQ ID NO: 112268 - DNA, 106 bp, Heterodera glycines
  Promoter: Source sequence=SeqID_1362; Location=2684..2789; Strand=-; Gene=SeqID_73035
tcatctgaaacaacagtttgctttttacggctacacaagcaccccgtgctgcggcgatttccatctgagatgcttcgaaaaatggtcacactttgggttttgcatg

SEQ ID NO: 112269 - DNA, 1003 bp, Heterodera glycines
  Promoter: Source sequence=SeqID_1052; Location=3364..4366; Strand=+; Gene=SeqID_66963
cccggggcttctattgttcaaccccctccaaagggggcttatattcgagggggggcttccaatcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacctttttagaattttctatcttcaaaatgaagaagttattacataaattttggaaaaattcgttttttgagaaaaaaaattaatagcgctgttctgaaaaggttttttgaaaaacatgaaattcttcctctataagcttctgtttattctatatttttataagacttttgaaaaaaagtacaaaaataaactgattttggaattcgggatcatagatggaagcaactgctttttttgagccatgggttaagatccacttgcctgtaaaaatgttttttagggtttttgggaccactaatcaagaacttggcatccattttgcccaattccaaagcattgatccgaactcgaaaccccaaaaataatttttaaaaaatgttgcaggcatgtggattttaacccatggcccaaaaacccatttttaacaaaacaaaaatatattgggtataatatttctatatttgcttgaaaattttttagtgattttcatcaaaatcttttccagtgcaatttattaacagaaattttttctaagctattgcttcgctattagacaatttccaaaaaagttatacacgaaaattgcgaaaagtcgaaatttttgaagttttttcgtaataaaatttttccaggcttgaaaatcttttcgcttttggtaaggctaatagagcatgttaagagctttcgagtgataccaacaatg

SEQ ID NO: 112270 - DNA, 68 bp, Heterodera glycines; identical to SEQ ID NO: 99057
  Promoter: Source sequence=SeqID_37684; Location=497..564; Strand=+; Gene=SeqID_66692

SEQ ID NO: 112271 - DNA, 61 bp, Heterodera glycines
  Promoter: Source sequence=SeqID_6141; Location=1090..1150; Strand=+; Gene=SeqID_60490
tgggactcaattcattagcattacaatcatcggaactcaatctcaccgattcttttacatg

SEQ ID NO: 112272 - DNA, 395 bp, Heterodera glycines
  Promoter: Source sequence=SeqID_25251; Location=1135..1529; Strand=-; Gene=SeqID_55998
cgtgccgaaaaaaggtggtttgtgaccgttttaagatccccaggattgtgtgaaatttgttgcatataaattgcatatctattatttatttattattaacattattatattattattattaaaaatgtatacaagctatatttctaatctacaacttatatccggatgttaatgaatggcatatgtttataaaaaaattattatcttagcatagaccggatattccatgcatatgattacatcattgacggaaatgaatttttacgaggaaacaaagtaggcaaaatatattataataatgtaaacaaaaattttattataaaagcaaacgcaaatttaaataaaatattattctaagaaaacaaatatattttttaaatatttttgccaaaatg

SEQ ID NO: 112273 - DNA, 1003 bp, Heterodera glycines
  Promoter: Source sequence=SeqID_9285; Location=756..1758; Strand=-; Gene=SeqID_70867
caaaatatttccttttgctctcaaaatgatttactcttgagtcttatgaaatcaaccttttaatgcttcctataacaatagggtgataaaaatcacaatcattaaaagctcaagattgttttaattccataatatgaccaaaaagctcgattgatccatgaatttaattcccattatttttcgttgactgccttttccaaataaggatattaaaccgaatcttagttttgttgttatcgcggtgatgctttataataggttttggaatgaagctagaggctgcttctgacattggcagtgggcatcacaagacgttgtagcccattcggcttcttctccagtagatagtaaaatttagaatttttttaaaaattttgttttgtttgcctgaagaaatacgaaactcaccaaattctaaagatcgccgcaaaatcccatcaataacaaaggatacagtcggaaaagtcagcatcatgaaggtgttaaaccaataaacgaagcatttttaaaatttaataagacggaatggaaatgcagggaaaatgttgcaatggctaccaagaaaatcaatttcttttttctttttttttgttacggtattttattaaaaaaaacattaagccaaatataataatctgttcatattttaaacgagcactacgggtcgggaccagagcgtttggacccccgtttttgggccccggggtcgtttgggcccccgtttttggggcccggggtcgtttgggccccaacccaaaaatagaaaaatgtgcttttttaaaaattaagattctaaaaactaagcctgagggatccctcgccacttggcataagttaggtttaattaacattgctcattttttacaattttacttattccaaatcctattattttttaatagttaaccaatttgatgtacattctgatttggacatttttcagttcattagttttaattttcaatatacctttagatatttgttaaaaacagtttttataatg

SEQ ID NO: 112274 - DNA, 237 bp, Heterodera glycines
  Promoter: Source sequence=SeqID_23327; Location=1162..1398; Strand=-; Gene=SeqID_54038
tttatgatgattactgtttttctcaaaattttcttaaaattcactgaaaaaattttcaaaaattttttcctgaaacttccttataaaaaaatttctagtttttcgaacttttctttaaaaaactatccggtaaatgattgatgtgatttatttaccaaaattctgtagcagcctcaacatctgctgccacagtacgcctaccaccaatatcccaccgtagtcgaaaccattccgatg

SEQ ID NO: 112275 - DNA, 138 bp, Heterodera glycines
  Promoter: Source sequence=SeqID_27393; Location=1..138; Strand=+; Gene=SeqID_58088
gatcattgttgatgatcaaaaatacgagctttttaactctgaagtccgttgcaattcattcccttttttaatttttttttttttttaaatttttaattttgtttttttccattaaagttttctccggtggacaaaatg

SEQ ID NO: 112276 - DNA, 508 bp, Heterodera glycines
  Promoter: Source sequence=SeqID_16194; Location=431..938; Strand=+; Gene=SeqID_80558
tcgaatgtcacaaatccaatagactcgtgtatattggtctataggctagcgggggcacgcagtgatcccatagctaaaaaactgtaatcggaagggactttctctttctctcccattttccctcccgccccctccctccctctctctcccctgtcactctctctcctctctctctcctctgtcactctctctctctctctttttctctctctaactgttacagttacagtatgccgttttaaggttgcatggactcggcttcgtgacgatgctttgctcgcggtcggcaccagcacttttaccttggacccgcgttttcaggcatttattttgcgtttgagaaggcttgcttatccgttgttaaggtgtccaaaccacggcggaagaatgaatcggattgggtgttaattcttcggagaccctcgtgacttttaggggggaatttggagaataatgacgataattaaggcccactgatcagggctgttatctttgtggtaagaaaatg

SEQ ID NO: 112277 - DNA, 578 bp, Heterodera glycines
  Promoter: Source sequence=SeqID_928; Location=1239..1816; Strand=-; Gene=SeqID_64288
atccttttttttaatattgaaggaaagggattgtgtttttagtggactaacccttaagctgcttgaatttaattttgcggaaagaattccttttcgcaatggcacatccgcgcccggcataaaccttttgttggaaaatgagcaacatttgcgtgttcatatttgtgctagagaggccagggctacccttttatcaaacactctcttggttggaggcacttaccggttcatgcatttgaatgtgagaccgaagcgcgattttggacaatctgtgaactacactttatctttcgcatttggaagttcagttcacttgattcgggttatcctgttttatttatttatttgtcattttgaatttaatgagtttaaggggccgacagtagcatttaatccattaactcttcgaagtccgagcgaccgggttcctcaatttgtttgtccaaaaaactaaataaaataaaatagtcgatggtcaaaaaaattccctaccccctcaacatcagcagcacagtggaacgatttcgcacaatgatcgtccacataatcagcaaccaatgcaaggtagagacacaatg

SEQ ID NO: 112278 - DNA, 52 bp, Heterodera glycines
  Promoter: Source sequence=SeqID_15476; Location=1..52; Strand=+; Gene= SeqID_79749
ctctcattgcatattttgtttgtagacctctgagcacacttactacaacatg

SEQ ID NO: 112279 - DNA, 1003 bp, Heterodera glycines
  Promoter: Source sequence=SeqID_1576; Location=3459..4461; Strand=-; Gene=SeqID_74561
cactggaggggatgactgttgttatggggacatctttccttcattttggcccctgttgctttttgctcccacagcactttgagctcccacagctattttcgatcagccattacacagggtttcaatctcaaaattttaacagtatacacaccgtttcaaaaaacgagacatgaaccaataaatagagagtgcagagaaaaaaacatctctttttggcgtactatttctttatctctgttaatagagaaaaactgaatttacttcgccacatataactttttttctactcatacaatttacaccaaattttgcatgtcgatagagaaaaaaattacgaacaaaatgtaagggtttttaaaagcaaaaaaagggttaactaaaaagttattcgagaaacaaaatttcgaaccctcatatctttttcctaatcaatccaattgcttagcatttgcttagaaaaagcttctccccatcaagggctttcgaatgatgtcaagattgtacaatttggttggtaaaaacctccaaaaataattcccaaaaatggtcattttttaattttttgcacaaaaataaataaaaatattcatgttgcacaacggactcgaaccaacaccctttgtccctttactatcttacaaaaaccactgagccacacatgcaaatcttcttggaactgggaggccaaaattgaaacggtgtgtataagaacagttaattaacatataaataggcgccgctggagacaattaaaaaaatgtaacagattcataacatttctgacaattaagcatataaatttttaaaaaaaatctgttttaaggtgcattcgaatttccgtcaaaattgttgggaagaaaactcttatcaaaatgatatcaaaatcaaagatggcaaaagtttgacggtccattgcacgggaaatgcttggggtaattttttaattatttaatataaaattaatagttttattttaaaagtgtttcgttccatcttcgcaatg

SEQ ID NO: 112280 - DNA, 341 bp, Heterodera glycines
  Promoter: Source sequence=SeqID_35411; Location=495..835; Strand=-; Gene=SeqID_64963
agatataataatatatggtatatctttaaaaaacaaaattaaaatgaattactcacattcattatcaatgacaacataattcttgtaaatcaggaatttataaactaatgcattgcacaagttgatcagatcactacttaaggatgatataaagtgatcaaaatttttagcaccaagaggaattgaaaaatgaactttttggaaaaactttataaatttttcatattttcattcgcattaacttgcttaactccgaaaaatcacatataaaattcaatattcagatgatcatccaatttaagaaaaaattttttttttgaaaattaaatccagaaattatg

SEQ ID NO: 112281 - DNA, 313 bp, Heterodera glycines
  misc_feature (27)..(27): n is a, c, g, or t
  Promoter: Source sequence=SeqID_41109; Location=855..1167; Strand=-; Gene=SeqID_69304
gtcaatggtcttcggtctcgttactgnagtaaatgaaaatttcaactctcgagcagctctaatgggtgttactcaaaaaacaaattgaaacccctggttttttgaatcatttaagtcatacttttctttaaaaattacaaattaatttaatccttaataaatatttaaataaaatatttgtttttattttatcattaattgtttgcttaggttgaattgaatttggtgcccagcttcgacgtagtcaactatgtgttcacggagttgaatttttatttgtttgcattttaaaaatggcagtgctttcagaatg

SEQ ID NO: 112282 - DNA, 1003 bp, Heterodera glycines
  misc_feature (2)..(2): n is a, c, g, or t
  misc_feature (5)..(5): n is a, c, g, or t
  Promoter: Source sequence=SeqID_7803; Location=32..1034; Strand=+; Gene=SeqID_66015
anttnaaacttttctcggcggcgcctatcggcaccgccggcccccccggttccccaaaagcttttggaaaaagcgccgtaaaaaaggcagtttaaagaagcaaaaattcgtcgcttggcttaaaagcgcaaaaatttggcaatttttggtgaaaatctgttatcaaacttcactcaaatttaaaaaaattttacccggcggcgcctattggcaccgccagacccctgctcaagaatttactttgaaagaaaaagcgcgacgcagaaaatttttattgattttttcatatgaataaaaaaattttttattgatttttgaatatatattagagtgccacgggaccgggacctggtagcggacaactgagttcaactgagtaccaaggtcccggttttgaccgggaccgggactagtcccggtttttcccggttttcccagccaaaaattcccggtttttcaacccgaaaaggtcccggtcccgggtttacccaaaattcccggtcccgtggcactctaatatatatttaaaaaaatttaattattaacctgaatcccgaaacccgatatttttatcgtcccgcggcaaccctgctgcacatattaacatccgtaaatatacctttgccctaaccaatatccaaagacaacccgagaccgacacacataatatttaatccacaaattatggatttaattttgtttctttttttatttaattttgttgaaaaataaaatatatattatgtgtgaaatgcgtaaacatcaaaattttatttgtcactggtggccctgtccctttttattttttctttgttgtcaacattcttttgggagtaaacaactttataaacgaaaagcactcgcggctaatttccgcagaaagtgcattacattgattaggcaattatttttgaaaatataactcgcttataataaaatgtattttaatttattagcccaatttaattattttttgaattttcaacttaacttcatcaaaatg

SEQ ID NO: 112283 - DNA, 237 bp, Heterodera glycines
  Promoter: Source sequence=SeqID_6103; Location=4247..4483; Strand=-; Gene=SeqID_60344
tgtatgaaactaatattttttataaaattttcaaacatttgaaagtacaaaaaaaaaattcgaaacccacgggcatggaaaattctgatcaaattcagcattgaaaaacagcttcaactgcccaacacggagcagttcggcacgggcaatgagcaggcgatcaaccaccagctgagccaagtgcagatcacactggacgtgctcaccaacgtcacgcatcatctaatgcccaaaatg

SEQ ID NO: 112284 - DNA, 1003 bp, Heterodera glycines
  Promoter: Source sequence=SeqID_3843; Location=2410..3412; Strand=+; Gene=SeqID_52100
agagagagagcgagagaagagaaagcaccatcatcaaattaccattataaatgtttttccgcacccaaagaaatcgaaaattggaaattaaaaaaaagatcgactcatttgttgccatgatttctgttgaaaatgattaggacagaattaatctatcgaacgataaatatctgaaatttagttaattagggagtcaattatagctaattataataattttcttaaagaaaaaataaataaaatctaccacattggaatggattcaaaaacctgctaatttcattaatattaaggaaaaatttttcaaacaaagacaaaaaaaaccttgcttccatatgtgaggcttaagaaatggacgaggctttgcctaattttctggctttttgagatgaagatgaggttaactttttttttaaaaaagattttctgcaaattatggcttttaaattttcatattggaggttactaatttgtaagatgagctgaattggttacgatttttatgaatgtcaataacttttttggattaaattaaattaaaatatttgtgtcgtggggcggaatcgaacccacacctcttttacattgaccatctcacaaaaaccactgagacacagataaaaatactttctgaaccgggagcctaaattttcgatgttttttcaaacaaacaaagcttacttctttattaaattattgtaattatttttgatcaaaaagaattaatggatctatatttttgaattgtttttccttgggaaaaaatattttaaaatatagtttttttagatttttattttattaatttattatttaaaaaaatttgtctgcgttttgtttgcgatgcataggcaattaaataatatgaataaataaacgtggattatcctcccataattaagaaaataaagaaaaaattcattttgactttttaaataaacaactcttatttaaaactaattcaattattattgaaaattcattttaaaaaggcattattatg

SEQ ID NO: 112285 - DNA, 562 bp, Heterodera glycines
  Promoter: Source sequence=SeqID_27536; Location=1..562; Strand=+; Gene=SeqID_58234
tttaaatattgacactctgaaattaaataaattggcaatgaacctattacattatttgaaatccaatataaagggcaaatgaactcttaattaaataaacagatcctttcattctttgacaattactatattaaaagataaaatttttaattcaaaattagtaaaatagataattaaaaataataattagctccactgactcaaaaaattttttaagaataaaaagaaaaaaattcatattaaaaaaattttcaagcattttttaaatttttatacttaatgataaaatgttaaaaatgacgactaattttgggcgtttcgtaaaatccgccattttagcgatttttttcgacaaaacatggcataactttgcttaaatgcaaccaaattttacattcttgataccatacgatagccaagctttttctctattagccttcaaaatttaaaaaaaaatttggtcatctttgtaaaaacttgtatgagaatatgtactatttctgccataacctatgctaaatttaataattttatgacttccattttttgattctaaaaaatg

SEQ ID NO: 112286 - DNA, 916 bp, Heterodera glycines
  Promoter: Source sequence=SeqID_21640; Location=853..1768; Strand=-; Gene=SeqID_52238
ttttattgacttcattgttttgaaacaaaacaaaattttttttactatttctgcgtttctgatttttggcgccgaaacgaccctggcgccgaaacgaccctggcgccaaaactggcggacgtctattcgaatcctacccaaaataatgaaccaatacattatgaaatgatttcaataaaagtctcgtttttaattaaggatgtttgcatagatagccttcataaaatgtggattatttatttggattccttcagattcgagttgttttttaattataataaaatttacacgaccataaaaatacattatgataattagaacaaaaaataaacaaatttaattttaggagttaatttaatattttgtaaaaaatttaactgaaacccaaaaattttggaaacgaaataagctaacaaagaaacttttagcgcttgataaactggttttttctttgcccaggaaaagcatgtccggattaagtccaggccataagcattcccaaaattaaattttcaaaggaaaaactttaaatttttgttggtctacaattttggaagatttttttccatatcttctttaattttttattattttttaaagtcggataaactgcaaagagccatactttaagcataaaacaaaatgactgtgataatttacaattatttttcatcagaaaccaaaagcaggcaaaaatcagctgattttgtcattggcattatcaagccaaaatattcacataaaacagaaaattcatgtgaccagtttgggccggattttccgacccaaccactcttaaacataggaaatgcaaagacgtgggaaaaccattttttatacttttatttatttttttgaatttatgttttcttaattaaaccgtagtaaaaggcctatttttcagagtttattcatg

SEQ ID NO: 112287 - DNA, 215 bp, Heterodera glycines
  Promoter: Source sequence=SeqID_2890; Location=3288..3502; Strand=+; Gene=SeqID_82205
tgttcgatttttggcactaataaaattagaaaataaaataaaattgcacttacaattaggagattaacagcagtgagttcgccgcttggtccgccattctctttggagtcatttgtctgctgctaaatttggcaacactttttgcctacaaattgtgccgttgtcaaaatgccggtcttcaaaatgatgccagttcaaaaattgagcgcaaaatg

SEQ ID NO: 112288 - DNA, 1003 bp, Heterodera glycines
  Promoter: Source sequence=SeqID_4989; Location=3326..4328; Strand=-; Gene=SeqID_56459
ttttgaaatttaaaaagcgcgacaaatctggtttccgcattttaatgtatacataatgagttttattaaatataaattttttccatttatttagctgacaatttttaacgtgatgaatagggcaaataaagaattattttaaataaaaataatatttatgaagtattaatttttcatttaaatttaaatttggatgactaaaataattattttaattatcaatcatataattctcaaggattcattgaagaaatatgcaccttctttcacttaaataatacacttttcttaatttcgtattaaaacattgttgcgcattggcaaagaaattcagttaataaataattttttaaaagccaatttattccgatattttttaattttagattgttttataaaatgtaaatctttgtttatctggctattcttctgtgcataattcgactattttttattttataattccatcaatcattttgaagtgattcttgagcccatcaattgtaaaattatgcagcggatatcattcattcgcgataaattatttttattttaagatattttattaaatgaatttatttattaacgcgcaaatatattttaatgtatgatgaaaagaaaaatatttattacctaaatttaaataatatttaaaaaaaattctatgtattgtaatgaaacattgattaatagggatgggacatttaaattatttttttattaaatttaattatttgcactatacgtgcttaaaaaaatataccttaaatttggaaaaagaaaaaagtcaaactgtcaaaatttcgcctcagatacaactgaacaaatttaatattgattatataccataatctgttagatttttcattttttcataaacaaaagtttttttatgctttaattattacgtccattaggagccaaatatatattaattttctgcttcatgttcgtttgctgcattgagcatttaatttgcttaagctaaactaaagctgaaatg

SEQ ID NO: 112289 - DNA, 54 bp, Heterodera glycines
  Promoter: Source sequence=SeqID_12873; Location=1604..1657; Strand=-; Gene=SeqID_76607
ttgaggttttttggcaaaatgccaacaaaattaagtttttatttttgaaagatg

SEQ ID NO: 112290 - DNA, 979 bp, Heterodera glycines
  misc_feature (962)..(962): n is a, c, g, or t
  Promoter: Source sequence=SeqID_16984; Location=1489..2467; Strand=-; Gene=SeqID_81406
aaaaaatttacgggaacgggaaagcgaaaaaacggggctggatccacgaacgggactcccgcctatttcccgttcccgtaaaaatcccatcaggcaaaaaagacgggaacgggattcccgtgttttcccgccggactctactgcaaatccataaaacattttttttctaaatttgaacttgttagttttgttctttcttgtcattttcctatgaatctttgtttgtttctttgacccattcgaatcttcattgtcttaaaatgtcttggtgtttgatttgtttgattgttaatgcaatccattttttagcttcacacattgaattatttatttccatataaaaaaggaacaaaatgactgatggacaggaggaaaaccagcaggtcactattatttatcattttgtcaatttgaagggttaatgggtaaatttgctgactataatagctgttttaatgggttttcttggtgtcgtctttttgggcatggtcactgtatagaaaagttgtgtaagacgtggtcattggttcttttttcgaagtttttggtttttcaaaaatccaaatccgcccttcccatttacgttttgcggagatggttctgtcatcacattgccccggcgtttgagtggggtgggaaggttaacgtgggcaaaacagaaacaccgtaaaagctccgtgggaaggcgcgtccctccatttgccgtataaaacaacggtattcacattccctgactcattctaacccaaatcaaagtccatcccacgactgattttgctctaatgacccctaaaccactccccactgaacttctttttgaaatggtccattttacaaaccctaattatgatttcactaatatttgtactcctcttgggttgtccgtttctttatgcttccccgcgtcgtcaaatggagaaaatcttattttgtggtaggaaatagagatttagctaattctnttattccttttaagatg

SEQ ID NO: 112291 - DNA, 440 bp, Heterodera glycines
  Promoter: Source sequence=SeqID_2913; Location=1..440; Strand=+; Gene= SeqID_82307
cgagacggagcagcgacgggtcggcgagctcggcggaattccgctgggacagaaaacgctgagtctgcgcaatttaacaagcgccgggggcagcaaacgatttagtgccattgaggtactataaaggaaatgagtacgctaaaaagaggaagagagagagagagagagaaggtaatatgtagtgagagggtgagagtgagagagagacagcatggtagagagagagagagagagagagagagaaagtgtgtgaggagtgggagtgagaaggggacatggtagttggttgagagagaaagagagggagagagagagagaaagagagggagagagagataagggaatatggtagagagagagggaaggcgattacggtagagagagagtaatgcgtaagagtgcagagaaaaatttattgcttatttcaggacgatgaaatg

SEQ ID NO: 112292 - DNA, 792 bp, Heterodera glycines
  Promoter: Source sequence=SeqID_23666; Location=959..1750; Strand=-; Gene=SeqID_54359
cagtaagagataatgtcacaatttttcaagaaattttaaggtctgccgcaaaatttttttgatcttttgatcccgaatttactgaaatttataattttgcattttcctctccaaaatatcaaaattgataatagaagactaaaaatataaaatttgatcgaataaattggaaaaataactgatagaaaaatgttcatatttttgacactaaaatcttattttggacttggtgtttatattttgaaaaattttcgatggaagccctggtttaaaaatacgtagaaaggagtggggttaaacagaaatttttgcgaacccgtctcaacatcgaatttgaccaccattttttgcggcgctctttttcagaaaaacttttggggaacaaaggggtgatgagggcgacggtgttaggagccgcgaggaaaatttttttttgaaaatttgaaatttgttaacagatttttcctaaaaataccaatttttgaaattttgggacattttttacaaaaaaaaaaaaaattgaattttggggggggccggcggtgccggtaggcgccgccgaaaagtttttcggaatttttaattaattaatattaagaaaattgttcaaaatttcataaattttcaacctttccccccttcgttgttgaattaacttttttaatttttacaacgctcggagtccccaattccccgaattagtgtcggggagtcggggggcaaaatgtcgggggccggggacctcggggggcgacatgtcgggtgtcggggcggggaataggcccaaaaatg

SEQ ID NO: 112293 - DNA, 1003 bp, Heterodera glycines
  Promoter: Source sequence=SeqID_21263; Location=182..1184; Strand=+; Gene=SeqID_51858
aggccaaaaaaactaggttgcctaaaaaactggacttggacaggaaaactgaggcctgaatccagaggtccataaggagtttaaaatgaaaattaataatgaaaaaataaattgataaaatatttaatgaccaaattaaatattggaaataaaaataaaaattaaaaaatataaattttaattattttaaattaaaattgtaaatttttaaattatttttaataaaataaatatttttcattcattccttcaccttcacattaaaatagccagcaattgtcagattcgattcacacaacaccgggtcatattctgatcggcactgaggggaattccaactgatttttaaattatttaaaattattttaatagtgtaaagcgcaatttatcacatccgtttaatctctttctcacaccatttatccccgcttttccccatctttattccgttccataagtccaactatttaatcgggagcattctctcgataaggagtcagttgagcgggcagttaatcggcgagcgagagccgagagcagaacgcggaggaattattattaatgtaattggcaaatatttatattattattttgctccttctcacccatccccgcacgcgtattagatctagtaggcgcccatgggattaccaatttagggaggtcatttatccagggcccggattttggcttattccttattcccccaaatccaatcctcaattttcctcgtcccttcctcatattttggacataattttccaaattgagtgtataaaatttcttcatatttgctaaatgtaaggttaaatatgacctcaaaaatattaatattgtcttcgtttcagggtcttactaatcagaaagatttaatcatattcgtaatattcttaaattttgaactaatatttcgtgattttcttttaaaaatatttcttttttttgtttataatttaatattttatttaaaaatatcttccatttcttttattaatatctgatg

SEQ ID NO: 112294 - DNA, 138 bp, Heterodera glycines
  Promoter: Source sequence=SeqID_13906; Location=2133..2270; Strand=-; Gene=SeqID_77854
aagtaaatttaaaaaatggaaaaataaaaattaacgtacatttacaatagtacgaccatttcattgtggtcgaatgcaaaggcccaactcataacgtggacaaattctacgattttgttggcaatcgcttgcgctatg

SEQ ID NO: 112295 - DNA, 1003 bp, Heterodera glycines
  Promoter: Source sequence=SeqID_12744; Location=732..1734; Strand=+; Gene=SeqID_76450
ttgactcttatttaaatcagagttcccaagtgtcctttttttaaagattgtcctttattttaggcttccccaaattttaaatttttttgtgcttaattatttatttcgctgataaaaatgctacaaaaactcccaatttcaaaaaattttcccggcggcgcctttcggcaccgccggcccccaaaaacttattttttgtttttttaagaaaatggcttaaagccgtaaaaattggtcatttttggtgaaaaattgttaacaaatagtgtaactgcccaaacacaattttacaattttctgaaattttttttcctaaaaaatcacaaaatttggacaatttttgggcaaaatctgttaactaattgcttcaaatttttctaaaaaaatttcccggcggcgcctatcggcactgccttcccccccccctatctccaaaagtttttttaagaaaagcgcgcctcaaaaaaagcgttttttaaaaacaaaaaaaggcgtctactggctaaaaatcgcaaaatttgtcattttttagacaaaatctgttagcaaatcgcatttaaatattacaaaaatttctcggcagcgcctatcggcaccgccggcctcatatactctactttcttttttggaaagaacgcgcagcaaaaaaaaacatttttattgattttttaaattttgagtaaaattttccaaaattattttttgtcggcaaaatgctgattttgaaaattttcagttgacaggcaatgtttttacgctaataaaatgttgttttaaatcgattttcatgtattttattgcgtttctttcgcgctaatattagttttagaaaaaaatctttttttgagggtccaaatcttagttttagtatcgtttgtcctttttttgaaaaaaaaacttgggaactctggataatcttacccaaagttcaaaatccaatttctcttgtgtcttccctttgaaggattctttcaaattcccgaattttattcagaaaaatatg

SEQ ID NO: 112296 - DNA, 92 bp, Heterodera glycines
  Promoter: Source sequence=SeqID_8139; Location=1..92; Strand=+; Gene =SeqID_67100
gcgagaagtcattgggagtgaacgtaaaagcgaaactgtgcacatcaaaggattgccatggaaaatattggcacaaattgaaaagaaagatg

SEQ ID NO: 112297 - DNA, 79 bp, Heterodera glycines
  Promoter: Source sequence=SeqID_18370; Location=1..79; Strand=+; Gene= SeqID_82970
tttagcacattcttttattacatatttaagattttagccccttttaattccagctcttacatcctacatattacccatg

SEQ ID NO: 112298 - DNA, 128 bp, Heterodera glycines
  Promoter: Source sequence=SeqID_21008; Location=1..128; Strand=+; Gene=SeqID_51582
atttaattaaattggatttttgaaaaaatgtttatgctttatttttctcttgtttaggcattgacacctatgttgctgatgggcaaccaagttgtagaggagtaccgcgaggcattccacgaagcatg

SEQ ID NO: 112299 - DNA, 60 bp, Heterodera glycines
  misc_feature (18)..(19): n is a, c, g, or t
  Promoter: Source sequence=SeqID_3488; Location=1..60; Strand=+; Gene =SeqID_47632
attgattggactcataannactcaatagagccaattattttacctagagcggacatcatg

SEQ ID NO: 112300 - DNA, 351 bp, Heterodera glycines
  Promoter: Source sequence=SeqID_19211; Location=1..351; Strand=+; Gene=SeqID_83956
gtcataatcccgacgcgtcaaaatcccgatgcgtcgaaatcccgacgcgtcaaaatcccgacgcgtcaaaatcccgatgcgtcgaaatcccgatgcgtcgaaatcccgactaagccaaaatgagtcataatcccgacaaattaaaaatataaatttatttatttttgtacatctatttacatgtatattatatattatatatataaatatatcataatagccttataaacaaaatgaatcgaaaaaaaattgaaattcttcaaaaatgtcgtaaaggcaagtttctgaacaacaacgacggcaaaaacgcgacaacttctgaacaatgtgagcataacgacaacaacaatg

SEQ ID NO: 112301 - DNA, 200 bp, Heterodera glycines
  Promoter: Source sequence=SeqID_17150; Location=2034..2233; Strand=-; Gene=SeqID_81587
ctttaacaaaagttgtgacgttttttctgtcgaaaaacagtacgagttgggtttttcccttcggttatcatgtaccatatacttatgtttaataagttaatctttaaatcctttacataattattgaaataatgattaatttatccatctcaacaaataaaaccgaatttccttatttggtgcgttatccggcaacaatg

SEQ ID NO: 112302 - DNA, 159 bp, Heterodera glycines
  Promoter: Source sequence=SeqID_9407; Location=3232..3390; Strand=-; Gene=SeqID_46751
ctgtaacggaaaggatcatactttggcgtggcaggctatttccgtgacagtgacccgaccaaagtaaacgatcgaaggaaaaaggcggtggaggagagcaagggctttcaagcgataagcaagcttagcgccgacatattcaaccaggacttgtacatg

SEQ ID NO: 112303 - DNA, 943 bp, Heterodera glycines
  Promoter: Source sequence=SeqID_23773; Location=1026..1968; Strand=-; Gene=SeqID_54475
tacagtgcactatttcccaccatccctccctctaacctctacatcctaggaggagaaatcttttaccttctttttctgtgctatttcttttgccttcttcttcatcttaactatttattttcgtctcttttctttatattctcttctttttcaaaacaatttcttttcatttcttttcaaatcattttttaacgcaaaaaacaaacaaaacgccacacaaattcaaacactggacacacacatacagacactcaactttattatataggatttcaaggttggctttttttaaactgtttcaatgactgattcaattcttttaatattgttagtgttgaaaataatttctaatttagttaagcatagatttaaaaaaaagaaaagaaaacatcagcaagagaagcaaaaatgactgcatatttccaaaagaaatacagtatatttcaggggcgtagtcagacccttggctttgggggcggctcaaatcggtttttaaggcgtgtatttttcttttttcgttcaatttttaagggttgtatttttctttttttggaatcccaaaaatttttttttaaattggtcgcatatgtccaaaatttaaaaacagtgaattattttttacggtttttaaggcgtgtatttttcttttttcgttcaatttttaagggttgtattttttttttttggaatcccgaaattttttttttaaattggtcgcgtatgtccaaaatttaaaaacagtgaattattttttaatgaatcatttctcaccaaaaacagtttggtatgttaagtgtttggattacacattctgtttgctgataaaattattcacttgtacaataaatcgttttattttcaccattttcacactttatttttgaaaattattctcaaattattgaaaaaacccaattaaatttagataatagtcgaaaaaatg

SEQ ID NO: 112304 - DNA, 707 bp, Heterodera glycines
  Promoter: Source sequence=SeqID_12305; Location=1349..2055; Strand=-; Gene=SeqID_75893
gctgaagaacaaataattgaaagtgttttacacagtccccacaaaatttagtttaattttggggggttaaaaataaatttccaaaaataaaaatgaaattgaaaatgctcttcaaattttttatttttgaatgagtcgccgaaagggaaaacatttgatcaatcagaagcaattatttatttatttatttatatttgttaatgggttggccattgccatcggacaatcggagaagcatttgaacagcagcagaagaaaaggaagcaacgaccaatgcaccaccacacattaaggtggaataaatgataattaaattaatttaaaatatttgtgtaattaacaaaaatttaaaaatttacgaatttacttttattatataattaaaaaaataataaatatttttttaataaatttatatagaagtagtgaatcatttaaaagaattattttaaagaaatatttaaaatataaattgatgagagaatatataaataattcaaaatttgttcggtaataacaattttagaattagaattggagcctaaagattaaatttatttatttcaaaagttattaaatattaaactaaatgtaaaaagtttcttaattatgcaacaaaacaacaatcttttataaattcaatcaaaataattaattgtttttttcaaattggtcttttagcgaaaatttgtcccttgccaccaatg

SEQ ID NO: 112305 - DNA, 163 bp, Heterodera glycines
  misc_feature (43)..(43): n is a, c, g, or t
  Promoter: Source sequence=SeqID_31163; Location=1147..1309; Strand=-; Gene=SeqID_61539
atgggattgaaaattcgcgcgctgtttcactgagcgttcggcntgaatttttgcctgaaatcgccgcggaggtaacttattttttattcttaaatgaacggaaagacccatatataaaattcatttttgtacattttaaatacatggaaatttttagaaaatg

SEQ ID NO: 112306 - DNA, 129 bp, Heterodera glycines
  Promoter: Source sequence=SeqID_18593; Location=1..129; Strand=+; Gene=SeqID_83226
ttttttgaaaaatctccaaggatttttgggttccggaaacatacataggtaagttaattaaaatgctgaatccaatcctccaaacttttgtgcccatttaaaaaaagttttccccattatccagggatg

SEQ ID NO: 112307 - DNA, 284 bp, Heterodera glycines
  misc_feature (211)..(211): n is a, c, g, or t
  Promoter: Source sequence=SeqID_4608; Location=2285..2568; Strand=+; Gene=SeqID_55070
ggctgcatatttcattcttaattcaaaaaatgttatacctagaaaaatgatttggaatttttgagactaaactttttcgaaaatttaatttaaaattttgcaaaataattgaattgagataaaaaatttggtgaaatataatattcaaataattctttctgaaaatttgctaacaaataaatgaaaatttaagccacttggaataaatgcncaaaaatagcagaagacaatttgtcaaaaatttcgcagaaaatttggacgagttggaccccctgcggcaaatg

SEQ ID NO: 112308 - DNA, 145 bp, Heterodera glycines
  Promoter: Source sequence=SeqID_2421; Location=1..145; Strand=+; Gene= SeqID_79638
ataataataataataataataataataataataataatcattataataataataataataataataataataataataataataataataataataataataataataataataataatattattattattgttgttgtcagatg

SEQ ID NO: 112309 - DNA, 1003 bp, Heterodera glycines
  Promoter: Source sequence=SeqID_413; Location=423..1425; Strand=+; Gene=SeqID_51754
tctctttctctctctctccctatctctctcccttccttctctctttctcctctctctctcactctctctctctcattctcgctctctctttctctcttccccgctctcaccctctccctttcacttctctctctttgcccctctaactctctttttctttctctcaccccaactctttttccttgccctcctccactatctacttcctttctctcttctcttccctttcctttgtctgttctcactattctcttatctttttctttcctttctctctctctctctctttattctctcccaacttctctctatgttttgtgctttctttcatctcccctcacaataaaataatttcataacaaaatctttcgtgtcgataaatattccatttttccgttcaaaaaacgcaaaaattttaggaatgacatacccaaataatataatagatcataggaaaatgagggaaaatattgatgagtagggattggatttatgtttttacttattttttctgcggctttaactcgacgagaaatgcacgaaaacaattttttttttgttcgaaaattttgcgttttatcgcccttaatcgaccttaaaaatccttattttagatgttcgctcttaaaataagtttttgcctatattttaacgtttcgtccctattttcgcccttatgtcgcgatttttgaatttttttcatgtaaaatcagggttcgcaagtgtccttttttggaggggccggatctttaaaatatcctttttttaaagattgtcttttattttaggcttccacaaactttttaaattttttgtgcttaatgatatattttgctgatatttatttattttattttcgttttaatactattttctcttcctctctttccctctcaccataactttttgttttttttgtgtacacaacctattgtcagacgcttcagaaagagggagcgcttttttggtgctgaccttggcttagcaaaagtggaacagcatg

SEQ ID NO: 112310 - DNA, 133 bp, Heterodera glycines
  Promoter: Source sequence=SeqID_4628; Location=2056..2188; Strand=-; Gene=SeqID_55138
cagaattttaaaaacacgagttaatttcaaaaattttgcggtccggcgattttgaggcgctatccacgacttttttcaaaatgtctagctttaaaaatttatattttgttgtttagctttttttgttgacatg

SEQ ID NO: 112311 - DNA, 62 bp, Heterodera glycines
  Promoter: Source sequence=SeqID_4842; Location=1..62; Strand=+; Gene =SeqID_55922
tcgatgaccgtgccaacaactaccccgtcttctacgacctgggcccgtattttgacaccatg

SEQ ID NO: 112312 - DNA, 64 bp, Heterodera glycines
  Promoter: Source sequence=SeqID_5537; Location=2175..2238; Strand=+; Gene=SeqID_58377
ggtgggaaacaaaaattcaaatcgttttaattttttttttccaaagattggcgattcgtttatg

SEQ ID NO: 112313 - DNA, 249 bp, Heterodera glycines
  misc_feature (26)..(26): n is a, c, g, or t
  Promoter: Source sequence=SeqID_19898; Location=1..249; Strand=+; Gene=SeqID_84659
tttaattactattttaaaaatataantcatttttaaaataccgtgggccatggaactgcgttatttcggcaacctatcgaattgtgtcagaaaagaccgaagcggagaattccattgggacattgtgtgactgggttatcaacagatcaaacatcagccggggatttggattttcattacttttgctgtgagtaataatttaacatatttacttaattgatataattacggttaatcaaggaactgatg

SEQ ID NO: 112314 - DNA, 137 bp, Heterodera glycines
  Promoter: Source sequence=SeqID_15071; Location=401..537; Strand=+; Gene=SeqID_79243
agggagcggttgggttcagtgggcttactgtacttcttttatcgatcaaaataaatattttttcttctttttaactcatttcttttcctaattcccttatcattcctcgctttttgcagatgttccttatcaaaatg

SEQ ID NO: 112315 - DNA, 1003 bp, Heterodera glycines
  Promoter: Source sequence=SeqID_10931; Location=1433..2435; Strand=-; Gene=SeqID_74235
aataatttatagaaaatttacttatatttagaggtatgtgattggttgattaattatttatttattttaatacccaaaagtgtgtaaataccctattataagtaaaataatttaaaatttatttaagttaaaacatgtttgaaaatgtccaaacaatctttagtagtttcccatttttagctatgtaatttgactttatatatttatattatttaacttcatccgaaccagcatttctatcttgttgttgagtcattgttcgttgttgcagagtattaaactgattttttcaccttttattttaattttttaattttttttctattagttgtagtatctgtgaaagtaatttatttttctgcttttatctctttcgaaataaataatttttatttaatgattattttagaaaagaaaatattattgttttaaaagtacttaataattattataaatttattaatctttaatattttgttcagtattttagttataaaactatagagctgatcctttctcaaggatgttggagttatatttatttttatatattagtttaatataataccaaatacttttcgcgttcatattcttacaaaaaaaaatctcgtcttatataggagtttgttacattttaagcagaaaaactttggtttttgaataattttattcaaattgttttaaattaagttttttatattaatgtttatttcttgtttttattgtattaggataattttgaaacaagataaatattatttggttaattattaatttgtaattctgtccttaaacatttattttatgtaattattaaattatcttttaagtattcaattccttttttaaaaaactttttttttcattatttatcaactcaatatcgtatttatttgtatggtattattcaaatattatctttttctttattttttttcacaaaaatctattaaaccaccatgaattattaggttaaattccagattatacattcaaatacatg

SEQ ID NO: 112316 - DNA, 287 bp, Heterodera glycines
  Promoter: Source sequence=SeqID_29814; Location=1..287; Strand=+; Gene=SeqID_60270
ccagcaatttctgataattttccgactgaaagcgagcaaaacgaagatgtgtttgttggcgaaaatgaaaacaacatttcaaagcttgacttaacagaacctgatgcatcatttttgcgttattaccaattcaataagggagacaaaaacgcaaaatgtcgaatttgtggagttaaaatctcacgcaaagggcgaaacactacaggaatggacaagcatctgacacaacacaaaaagtcttaaaattttctttcatttctaagttgtttttcaggtatcacaagatg

SEQ ID NO: 112317 - DNA, 112 bp, Heterodera glycines
  Promoter: Source sequence=SeqID_31544; Location=1086..1197; Strand=-; Gene=SeqID_61877
cacttctcactgatcttgttcaattgtattcaatcacttcctatggactgtgccccgatggaatttctgacgatgggccaaatgcaactgccggccaagcgttgtccaaatg

SEQ ID NO: 112318 - DNA, 126 bp, Heterodera glycines
  Promoter: Source sequence=SeqID_24941; Location=211..336; Strand=+; Gene=SeqID_45900
ggtggccattctgagcaaagtcacaattttgtctactttcccccctactttttaaccttttagcatggctctgatgccgactctgaagtgagggactcctcttttgctgcgttgggtgccattatg

SEQ ID NO: 112319 - DNA, 369 bp, Heterodera glycines
  Promoter: Source sequence=SeqID_35512; Location=430..798; Strand=-; Gene=SeqID_65056
ccattttgttgcgacgttttccagggaatgagagggccccgtcggtgccaacaagtgtcgtcgggggaattttttttttagaattttggccacaatttgcactaaaatgataattttgtagatttttttaaaaaatagcatatttttcgggacatttgggtgaaggaggccttggagagggtaccaatgaggaaaagcgaaaattttgatcaaaaacaattcttaaatgcgcatttccaaattttaacactttttgccatttttaaattttaatttgaattgcattttttctctggccaggctgaggaatgggccaagtcgcttgcgggtgcgttcgccaacaccgccccgtcagcaatgcccgacatg

SEQ ID NO: 112320 - DNA, 650 bp, Heterodera glycines
  Promoter: Source sequence=SeqID_17237; Location=2785..3434; Strand=-; Gene=SeqID_81706
caatataaatatgacattagtgtccccaaaaaacggctccgttaaaatgcttcagtgcgcctctgttcaggctgtaggacaaaacggaaaaagtgcctcatatcctaaaaaataatatttccacaggtttcaacttcgtttcttacaaatttatttcgcatgaacgaccaatttcgccggatttcggtgcgtaaaacatttattttgagacatacaaattttgttcagacgcttctgctttggagtgaagaaaacgcgttgttctctcaaagcgaattttccaaaatcacagagcaaaatgtggaaaagctttctcatttggacaacatttagtaaattatttttaggggaattttttagatttaagtcaattttaatgtttttgttgaatgaatttgtttagtgcctgcacacggattcgttgtttcgtccacatcgattcgcgctttgtcgatcgaattgcggcggaggatgaagaagccgtccaaactttgaatcgaatgattttctccctcctccgcacgggtcgtcttgaagatgctaaaatattgctggccaatgtcaaattgcccgcattcgctgcttttatttctattcgggaattccttaccaatccgagtctttctccgactgatatttttgatgaaatg

SEQ ID NO: 112321 - DNA, 141 bp, Heterodera glycines
  Promoter: Source sequence=SeqID_3820; Location=981..1121; Strand=+; Gene=SeqID_52007
gctaaacaaatacataacgatgcggtaaattgaatattcagacattatatttttgcaaaaaaccggacagtcgacctgtctgtccactcgcgtgtacaccacgtgcgcattacgtggtgtcagtggcgtgccacccaaatg

SEQ ID NO: 112322 - DNA, 1003 bp, Heterodera glycines
  Promoter: Source sequence=SeqID_547; Location=1569..2571; Strand=-; Gene=SeqID_55913
aaatctaacaagggaaccgtcagaactgtgtcagaaaatgcatgtatcataactatttgatagtgcagggccggctactctgaatttttaatgttagcggtgtgttgaagccaaatagaaaagttattggacctcaaaaatcaaaattttgactgtgttttccccttcagggaaggtggtgaagtggggaaaatttaaaaaaacggtggatcagtgggttaaattcctatttttcggaggtccaggttcgaacccaacatgaaaaaaatacattttaattaatgtgcaacaaagttaacgattaaaaaaaccattttttatttaaaaatatacataggtaataatttttctttagtgaaagtaaaccaaaagtcgactaaaaaagtgactgccccatggggaccaatcgtaccggggcccaaccggcggggcccaatcgacccccaccgtcaatatttgaccctgttcgcccttgtccttttcttttgaataaatattattttattcctcttcggactttggggcgtaataatatttttttccatttcaacgaaatattttttcaaaaaatgataaaataaaatgatgattatgatgaaactattaaatgatgtaattcacatgatattttctctaaggattacataatctttttaacatgataaaacatttgactgtcacaaaacatcgcataataccaaatcagcaaaaaataaaataaaataaatttaaaaaataaaataacaatgtttagaaaaggaaaaaaatcaaatcacaaaatacaaaatacaaaaatggaaacatcagcgaaaaacggaacattcgtcgaattgataaaatgtgataattgtggtcgtccgttcattgccaagaaatgtcagtgtcaatcagcaaatatttcttttgaaattgacaaagaaattttcagtagaactaatctcgaagttacgaaatgttctcttccaatttgggtcttttgcttctcctcttcgtttcaacaatg

SEQ ID NO: 112323 - DNA, 341 bp, Heterodera glycines
  Promoter: Source sequence=SeqID_19016; Location=1547..1887; Strand=+; Gene=SeqID_83751
attggtttaattgtagaaaaattattaaaaaaaaatacttgaaaactcattttgactgttttctcgacagctttagctttgattattacgaaagttttaattaatgcgtaaaataacagcgacagaaattacgaccaatttgcgcatatcatatccaattaataactcacatatccaccacaataataatgtttagcccattaatagttgttaaattgtaaagaaattttttgttggttgtcaaggtgatggaagtcgggaaatattgtcaatttcaaaagaattcaaatggtaaacttcgaaaaatgcattaaaagagaaaattaaaacaaacaaatatg

SEQ ID NO: 112324 - DNA, 121 bp, Heterodera glycines
  Promoter: Source sequence=SeqID_3647; Location=169..289; Strand=+; Gene=SeqID_51275
ttccgtcattttgggcgacgacgacacttccattcccattgaatacgttgatgaacaatggcacgattgcgacgattcatttgtcccggttgaacttgttgatgatctcccaaacgaaatg

SEQ ID NO: 112325 - DNA, 1003 bp, Heterodera glycines
  Promoter: Source sequence=SeqID_12375; Location=871..1873; Strand=+; Gene=SeqID_75981
aaaatccaaatttttttgactccggatgcttctttcataggtctttattttactgcacaggtggtcacgttagctgccgtattgcgcgcccgaggcgttcgcgctggtgacgtagtgtccatctatttgccaatggttgtcgaattgccggtggcaatgttggcatgcgtccaggtggatggtggcaaagtgattgggattttgctccgagaataattggcattgaatattgatcgaatagagaaaaccaccctttgtcttttttttgcagctaaaaacgcttgcggaccaagcggccgaaatgtgtgcggagaagggccacttgcttaaaatttcaaaaaaaaattactgaaaattttcatcaaagagtcgttcattgtcaaatggataactgtaccgacgactcgaccgttcaaatgaaaaaccccagcaaaaaatgtcaatttgattcagtttttcctatttaaatttttaaaaaaaaacgaatattttgctcaacaaattttcagttttgtaaatttcactttacctttaatgagtagtaattaattaaattgtttgaattttactcctttataactagggcttatttttttggtttttatctattttttctgagctcccagtggtctgaaaagcacgaaaaacgtataacttgaggttgtttttatgctacttttcgcgttattagggccaattctatgtttttccaaaatttttagaacataaaaattttaaaaatttgaaaaacctattttggagcgccacgggaccgggacctggtagcggacaactgagtaccaaggtcccggttttgaccgggaccgggactagtcccggttttttcccggtttttcaacccgaaaaggtcccggtcccgggtttgcccaaaattcccggtcccgtggcactttaattataactttttttcttttctctatttttttgccaatttttgtattattttttgctctttttttcactgttttcctcctccaaaatg

SEQ ID NO: 112326 - DNA, 123 bp, Heterodera glycines
  Promoter: Source sequence=SeqID_14621; Location=2708..2830; Strand=-; Gene=SeqID_78703
aaattggtgttagattgagtacaatttataaatggaagaaaaaatttgacctatgcaaaaaaggtaaatattttaaaaattctacatttaaaaaaatctttaaaggttatcaaaaattcaatg

SEQ ID NO: 112327 - DNA, 656 bp, Heterodera glycines
  Promoter: Source sequence=SeqID_5808; Location=4228..4883; Strand=-; Gene=SeqID_59301
cctgaacgctgcgattttatatattttagcttcgttagactttgtgctttcgaatgataccaaaaagataggatttgttcgaacatgaacaaagttattgtataaaaacacgggattgtcaattgattggactcataaaactcaattggactcataaaagtcgattggactcataaagtgcactagagccgaaaatttttattgatttttcattcgataaaaaaaattcttatcgattttgaacatattataaaaatttgtcaattgacccgaaacccgatacctgaaacccgacatttttctcgacccgaaacccgacccgataattttctgccgacccgacccgaaacccgacccgatatttttttcgacccgcggcaaccctgatagtaatgtaagacaagcagaatttcttacagtgatatttggttgaaagcactgattaatattttgataattgttgtttaattttattaatcacatatatcatacattatatttgcttatataatgaaaaatatttagtttttaattaagttaacaacatttaattttttgacgcaaaaaatgccgaaaattaatcttatgattattttctttttatttttaatcgtactaattggtggaattgatgaagatttatttgatgatttatg

SEQ ID NO: 112328 - DNA, 327 bp, Heterodera glycines
  Promoter: Source sequence=SeqID_20741; Location=472..798; Strand=+; Gene=SeqID_51308
ttgtaaaccgtggtggcccacaatgttcaaaggaaagttcatcgtgctacaatcccaagaaggggtaggacaagttgaccacaatcccgtgatgggcaggacatgttggccacagtcccatgaagggcaggcaacgtttaccacaaatgtgacagatgcccgaagggccagtcagtgaatcgcaaatggtgcgacgcatgccctgaagggccagtcagcgaaccgcaatggtgcgacatatgccctaaagagccagtcagcgaaccgctttggcgcgacacatgctcagaagggccagtcagcgaaccgcaaatggtgcgacacatg

SEQ ID NO: 112329 - DNA, 1003 bp, Heterodera glycines
  Promoter: Source sequence=SeqID_11260; Location=861..1863; Strand=+; Gene=SeqID_74623
tgaaaacaaacggaaacgaaaacgaactcaaagctcattttatgcgtctgaaagcccaaaattgtatccacgagaatagctgtacagagatctaaaaacggtccaagtggagtttcaaaattcaaaaaacaaattcatccgaaccatcattttcacataattccttgggagtcatttggtggctgcgacttggacgcaatttcagtaaggaagaggcagcagcacaatgggtacgccccactgtgcagagaaaagcctagtactatctcgtcgtttctctttttctttgtaatttctctcactttggcgtactatctctttatttatttatgtaaaaaacaacttttacttttctatgtgtacctttttttccttatgttaaatctgaactaaattttgcatatcgatagagaaaaaaaatctgcatccaaatggacatatactaaaattggaacaatacagagaagattagcatggcccctgcgcaaggatgacatgcaaattcgtgaagcgttccaaatttttttgttcattccaaatggacatatactaaaattggaacaatacagagaagattagcatggccattgcgcaaggatgacacgcaaattcgtgaagcgttccaaattttttttgttcattccaaatggacatatactaaaattggaacaatacagagaagattagcatggcccctgcgcaaggatgacacgcaaattcgtgaagcgttccaaatttttggtttaattacccaagtttgagctcaatatcgcagtcctttctgaaacgccccttaatttctaattccccgaatcaaattccgcaaaaacgtcatttcctcaacgaagtgacttcaacaaatttggccattgacacacttaacgacgacccgtccatttctcaagctgcccgtgtcatcatttcacaactaagcaatctcctcaaaatcgccgtctccctcgtcgacaattctgtctcagacattgactatgctgcggagatg

SEQ ID NO: 112330 - DNA, 115 bp, Heterodera glycines
  Promoter: Source sequence=SeqID_1250; Location=2490..2604; Strand=+; Gene=SeqID_70794
ggggggggggacgtgctcctaccagtccgtggtagtagacttccattgaagtccgcttcgtgtgtgatgaagtgttgtagacgatggacgataataataataataatataatatg

SEQ ID NO: 112331 - DNA, 111 bp, Heterodera glycines
  Promoter: Source sequence=SeqID_31716; Location=155..265; Strand=+; Gene=SeqID_62021
ggtcaattaaaatttcttgacagtaaactatttatcaaatctaatttaatactaaattaacaaaacgcagccggttgggacttattgtgcttgaacgttggtaatacaatg

SEQ ID NO: 112332 - DNA, 227 bp, Heterodera glycines
  Promoter: Source sequence=SeqID_10786; Location=1191..1417; Strand=-; Gene=SeqID_74044
tagttggtgggtatgccctccaatgtgatggctttgggccggaaggttaaaaacacgtgtaggggcggacctatgcgcgtttttggctctccaaaaatggcccaaaacatcgctcaggggacgggtcatgcccgatttttttttgatcggccattttctttgacatttttaactaaactcaatggttgaattttcttttttttttaaatttaagaaagaaaacaatg

SEQ ID NO: 112333 - DNA, 650 bp, Heterodera glycines
  Promoter: Source sequence=SeqID_15873; Location=1..650; Strand=+; Gene=SeqID_80203
tcaataaaaatatcactcacggtgcgaaaaatggggttttacaagtttattggggaaaaaaaccctttacaaaataatacccctgggagaagggagtgggaaacatgatttcagaattttcaattttttatagtctaatctaatcaaaccggttcagaattcaataaaaataacattcacggtgttaaaaatggggtctgaaaagtttattttgaaaaaaagactttacaaaataatacccctgggagaagggagtgtgaaacatgatttcaaaattttcaattttttccccaagttgcaaatccccaaaagtcgcaccacgtatgctttttcagcatttgtcactgatttaaaaaacctagttaaaaattagggcaagaagaatcatcgcattgaaagaataaatcagttagagtttttattttgcagtttgtacataacagtcataaaaacgaatgaaaaagcaaaatttttggcctatggtgaacctaaagaaatgagaaaacagcaccacgtgctaaagaggtgacaaaaacgggctgatctttgatcagagagaaagcagaaggaaggcaatcagcaaaaaatggtcactaaatagcataaaacagagagagattgcctgtggggacaattagcagctgaaaatg

SEQ ID NO: 112334 - DNA, 446 bp, Heterodera glycines
  Promoter: Source sequence=SeqID_3435; Location=554..999; Strand=-; Gene=SeqID_84674
ttctgcgataattgaagaaattgagtcggaactgccaatcatttattgaaaatttcagtgaagttattttatatctattatataatttatttttacgcccctaaattcggaactttttaacaactatttacccatttttgcaactattttgggggttttttagaaaataaactaattattttggcacttttatgggcagaatacgccaagtacctcaaacttgggtaattaaaccgaagaaaaaggtgcattgggggaaaatgacgcctaaaatgaaggaaatattccatgctgttttcaatgggttttcgaggtcgctgatcacgaatacagcatccatttcgaccaattcctagaaatgaacttaatgtcacataaaaactgcaataaaagtttgtttagctcattttgaatcatatatgtgaaattctaaatttctacagatg

SEQ ID NO: 112335 - DNA, 895 bp, Heterodera glycines
  Promoter: Source sequence=SeqID_6351; Location=1..895; Strand=+; Gene= SeqID_61237
ttttcactgacgaaatcactcactgacgaaatcacttcctttcaaaatcactcactgacgaaatcacttaatgacgaaatcaccgggaaccgcggcgatatttcggcggtgatattttgtctcgtccccatatccgaccaaatttgatttttcttgatgaaatgttcattggatccgatcaccttgcatcttcaacttttcttttaagaaattttgtttttgaattttattgttatactttaatgttagaaacaaaaacaaagtgctggagtcaaagaaaaaaatttaaataataataaaatattctttagaactaccaattttgcaaatggcctagtggctagtctccttgactttcccttcttctttctcttggtttaatctagagatcggaccggtcggtttttttcggtatttttcgattttcggtttcggtttttaaccgaaaaaaaccgaccgagaaatttttgagtttttcggtttttttcggtttcggtttttttcggttttttaaccgaaaccgttcgaccgaaatatttaaaacgtcatacgagtgcggagacccttttgacattattttcatcatttattttaaatttaaattatattttacatttcgccaattttatctttttattttgttttgcattttcatttgtcacacaattttctacaacttcgtctttgatcttttaaaaatgattttatattttgtcttctcttctcggcaataaatttataaaaatctatcgcttcggacccttttggtttaattgtttcagtctgcttttcccaaaagagcagtacttggcgctcctggtctacaaaccctcccaacttttggaacggccaacaagaagcactgactgaggattttgttttggatttggaaatg

SEQ ID NO: 112336 - DNA, 84 bp, Heterodera glycines
  Promoter: Source sequence=SeqID_25087; Location=468..551; Strand=-; Gene=SeqID_55822
ccttgaaaatgatcttttaaattttcaaaataaatatttatttaaaatcattatttttttgcctttgcttgggtgtccaaaatg

SEQ ID NO: 112337 - DNA, 780 bp, Heterodera glycines
  Promoter: Source sequence=SeqID_16141; Location=974..1753; Strand=+; Gene=SeqID_80505
aaaggcattcattcagtcggaaggattcaattatttgttctaaaaaagcactgctcgaatattcgaagaaggccattgagagagatcaattcgcttcggatgacttacgcttttgctgggattggctttggatgcaattccaatcggcagatgctaacgaagtgcagaagaattacgggaccatgtgcgaagcattgtttggatgtcctcaattaatttactttcattttaaggttcgctggcattaaacacattttgaagggcacaaagtccagttcgaccatcaaacaggacgaaattacttacagaaaccgagtgagtggaccaacgagattttttggttacgtaaatatttattttcttttcggatttttgtcaacgaaaaacgactcaaaattttgcgtatgtgcaattggcccaactgcgccgtgagggacgagtgcaaggcgcggtttgacgaaatcgcggctcaaaacggagtcttcggtatcactcgcgcggcggcgttggcacttttttcagtgcagggaatgctcagcaaagaggtggccacagtcgagaaaggctttctgacaatgagcagaatcccccccccccctccccccttaaaagcaatttcttatttaatgccatttgttttaatttctgttttccgctccaactttttctattcgggccctcttttagtatttgactcatttgagcgagttcactcattcgcgcgaatttgccgaaacatggtgccgttccccctcctttgtgaccaattatcaacgaatg

SEQ ID NO: 112338 - DNA, 119 bp, Heterodera glycines
  Promoter: Source sequence=SeqID_2157; Location=1..119; Strand=+; Gene= SeqID_78142
aaaatttttttcggaacaaatttttttttctagcttaatgatctaaaatttaaatcattcaatttgtttgttcgttttttaaaatttaattttattattatttactcaaaaggtacatg

SEQ ID NO: 112339 - DNA, 1003 bp, Heterodera glycines
  Promoter: Source sequence=SeqID_3239; Location=4575..5577; Strand=+; Gene=SeqID_83844
ccagaaattatgtgaaaatttgggttccctttatagaaaaaaagtctatttataatcaggctccccctgattcaatttcaaaaaaaaagaatcaatttttgtcggccaaaaattatcatttcgaaaaaatttatttaagagcaaaacaaataggtaaaaaatatcacttttgatttgggccaatgatttcactgattccatcttcaatttttggtcatttgttttttaattatttttttaaatgaagctcagttaagttttggctggaattttattaaattaaagtaaattgtaacagattttaacctaaattaaattaagatcatttttgtaattttttcttctaaaaacaacaaaaaacatcaaaatgatagttaatgtaacacatctggtaggcttttttataatcatttttttaattccatttgataaaaatatttttattaaaatgtttcaattaagttttttttgcattttcgataaaattattaagaaaaattctttttgaatattttcatcgtatttaaaatttaggaaaatgatgttattttgattaatcaattagtttccgctgtgattttattattttgtatgtgcatatgagcggaaattggtcaattttattgaagtgtaaacaaaaaataaattcagagaatattttaattgaaaaatatgcacagaaaaatatttttctccatttcacagttggcataatccacctcgttttgcattgggcgtgcgtaaaattgggctgaaaatttgttggaaaattccttataaaaggggcatccgccggaccattcgtcatttgaaaacccattaacacaattaaatttataattaaattttttttttataattatgctgaaaatgatttaaattgtttagaaatttgattaaaatttattttaaaatttctggcgtattttccaacaatttgggctcataattaattcattttttagattagtgttctttctaattaaacagaaaagtttcaatg

SEQ ID NO: 112340 - DNA, 478 bp, Heterodera glycines
  Promoter: Source sequence=SeqID_10628; Location=1497..1974; Strand=-; Gene=SeqID_73862
ttatgtttgcatatgtatttacgtctatcctgccttttggatggtttttggtgcacttcatacataaagagaatcagagcctgtcgtccactttgacgggcaaaacagaatatcgaattttctaaagaaatcatccaaaactttgagtattgtcaaggggtagtgtttatcttccgggtatttaactcgacttatgtacattggtttaccaatcgagtagtgtgtagtaaaattaacaaaggggtagagagaaatgaagtcacatagaaattttttcattccgtcttcaaatccgctcatttatttgttgctcattaacattttagcgatctcgtagcctaatacacttacaactggatggacaacttgacttcgtataaattcataacgttttacattcctctcccgcactttatcagttatttttttcaattagacattaatatacatcttctaggtagcgctaattgcaggcatg

SEQ ID NO: 112341 - DNA, 171 bp, Heterodera glycines
  Promoter: Source sequence=SeqID_12627; Location=1967..2137; Strand=+; Gene=SeqID_47060
acctattgtttgttttagttgttgatttatcatttcttttaacttattgcctcatataaatcttcgttttcttttttttgttgctttgttttttacctttaatttaatatttaagtttcatcatttttcatatcctttttatatttctccgctcttttggtcctcagaatg

SEQ ID NO: 112342 - DNA, 1003 bp, Heterodera glycines
  Promoter: Source sequence=SeqID_6777; Location=510..1512; Strand=+; Gene=SeqID_62869
ttccgaaaatcgaaattcctacctcaaaaattttaatggaaatcggaattcagaccacaaaaatatcaaatcggaacttcgtgccatccctagtatacacctttataaagtaattgtctctattagacttaaaaataaatagattgttttccacttttgtattttgaactatggatcgaatacgagtggagcacgtatacggacggctttacggaaccgtagcgtagaaaatccgtgagaggggcgacggcggtgccggaataaattgggcttttaaattaagttttttaaaaaggattagggaatttcatttcatttcatttatacgcataagcgtgacgccgaaaaataagaaataatgaaacaatatcaaataaaacaaacaattggtcacttttggagctggggtggcaaagaaatcaacaaattcagatcagatctttcaagaagtttggcaaactcattagaatttagtaatctcgtctctttaggtaaaagtctatagagacgagaggttcgaataaagaacgaattgtgtctatcattggttgagcaataagctgttcttatggtgaattcattttttacagggtttttggaaaaagaaaaggattcattattttgtaaatttattttacctaaaattatttcatgaaaaagttttaagtctatttttaacctacgactctcaagcgacttttgatcataaatgtttaacaattcagcataattaggtaaatcagcagcataattgttacgtctaaatattactctcaaaaaagttttttggacattctccagtttttcaatatccttttttaaataaggattgaaaattggagatccaaattctaaaattggtctgcaataaatattaaacaaatttacaagtattttcgtatcacgagttttgattgactttagtatagcgaaagcagatcgtaatgcttttttcgagataatgtcaatatgtgcccatttcaaatcattagtaaaataaatg

SEQ ID NO: 112343 - DNA, 233 bp, Heterodera glycines
  Promoter: Source sequence=SeqID_17330; Location=995..1227; Strand=-; Gene=SeqID_81810
aaaatgaggctttttgacccaaaatgaggcttttgaaaatttcatctgcgaaccctggttgtaaataaaaatgttttttcattaatttacatattgtttgattttaatattttgtaaatatttaaatacagattttgcacttttattaaatccccaacatgcgtaggaaatttttatttctttatattttggtcattatgcataaacatttatttcgttcacaatcagatatg

SEQ ID NO: 112344 - DNA, 73 bp, Heterodera glycines
  Promoter: Source sequence=SeqID_4007; Location=1279..1351; Strand=-; Gene=SeqID_52781
tggcagggataaatgcattttaaatttcttccattttaagggtccaaatggagcgcgcaatcagatcaaaatg

SEQ ID NO: 112345 - DNA, 65 bp, Heterodera glycines
  Promoter: Source sequence=SeqID_20922; Location=861..925; Strand=-; Gene=SeqID_51504
ctgctggtgccggcggaggaggggagccgttgctgaagaagaaatatttggttttcgacgccatg

SEQ ID NO: 112346 - DNA, 212 bp, Heterodera glycines
  Promoter: Source sequence=SeqID_9183; Location=1481..1692; Strand=+; Gene=SeqID_70517
gcaaattttgccatttcccccgggggatttttttgttaattttaatgaatttttattgcaattgggtaatgttttccgctaatttagtacgaacatttcattgtggtcacatgcacagcaagccaattccaaattgagcagttcagtgatttcgttggccaacgcattgggacggagttaaccgaaattgttgaagaccctctgaaaaaatg

SEQ ID NO: 112347 - DNA, 130 bp, Heterodera glycines
  Promoter: Source sequence=SeqID_9259; Location=1437..1566; Strand=-; Gene=SeqID_70781
tctgcaaaaagaaagaatatttttttaattaaagggcaattggactaaaagaaaacgccgaatgctaataatttattatttattgttagtaattttattccctattaggtatttgcaaattaaaaacatg

SEQ ID NO: 112348 - DNA, 497 bp, Heterodera glycines
  Promoter: Source sequence=SeqID_30996; Location=1..497; Strand=+; Gene=SeqID_61350
ttcattttgctgctgttcaccatccttctgccgactgctgatgcgttttcacttcgcatcgttttcataaatttgccttctttaccatcttttatattcattcatcttttgtacattcgtcccactttctctttgtttatttcatctttaaaaatttttttattttgaacaaaaatttattaaaaagatcattgtcgatttactaaacacggattctgacataagactttagagtcaattaaaataaaatttggcaaatatttcaaaagtattattaccctgaggatgaatcttgatatctaaaagctaaaacctattacaatatatgattatttgatcattcaatattaaacgtgattttgtgtaattttaaatcgtatgaacaaactcaatttaattcacctaaatgtttaggggctccgaattatacgggttttatcctacatatttgtcagcaaatgtttacccatggccaaggcgtgctggccccacaaatg

SEQ ID NO: 112349 - DNA, 60 bp, Heterodera glycines
  Promoter: Source sequence=SeqID_14732; Location=1..60; Strand=+; Gene= SeqID_78861
atttcttctccacatttaactttttacttctcattttttagtctgtacggcgtgccaatg

SEQ ID NO: 112350 - DNA, 101 bp, Heterodera glycines
  Promoter: Source sequence=SeqID_29237; Location=225..325; Strand=+; Gene=SeqID_59760
ggtcagtcctcaaacacagttatttagaggaaatgggtggtcaaacctttaatctaatttgactgcataacgctaagcattttcagatctctgcaaagatg

SEQ ID NO: 112351 - DNA, 581 bp, Heterodera glycines
  Promoter: Source sequence=SeqID_17580; Location=1..581; Strand=+; Gene=SeqID_82090
ggacataaatggcaaaaatcgcaaaatatggacataaaatggcaaaaatcgcgaaatatggacataaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatgccaaaatatggacataaaatatg

SEQ ID NO: 112352 - DNA, 1003 bp, Heterodera glycines
  Promoter: Source sequence=SeqID_12118; Location=685..1687; Strand=-; Gene=SeqID_75685
gagagaaaggcaaaatcaacatcatttttaaaatttcgataatttttgaaattttaaagcaatttttttcaaatgacttttggcggaaaaataaaatggggaaagagataacacaactcattttttcgttatctctctaaataaaattataagcagggaacggatttatatgtttttacatgttttttttgcgcatatgctatcacatgaaaagctcaaaaataacatattttggactttttgggaataaaaacatattttggggtttcggcagtttttgtcataaattttagcgatttttcgaaaaaatgtcttttttggcaccaaaattcttggccaaatgcccaaaaatttttcaaaattttttcaattttttgacgcttttcatgactttttttactttaaggtaaaatttgatttttagcgaagaaaattccgaaaattagaaaaaatttacgccaaaaagcattatatagtttttttttctgtcctccttctctttctctctctttctctctttttcctcttgtatttccttttttctcttactcgccaaaaaaatgtctaaccaaattctcaattttgattttgttcttctattccttcacatgcctaattttcaacattgatgagaaatcaaaccgacctaaattttgaaaagaaagggactgacacctaaacaaaatgaaatgaatgaatagtcagtcatttattttagagttgagcgggaccgggacctgaacacggacaactgagtaccaaggtcccggttttgaccgggactagtcccggttttttcccggttttcccagccaaaaattcctgggttttcaacccgaaaaggtcccggtcccgggtttgcccaaaattcccggtcccgctcaactctaatttatttttatttgtctttttattccctgtcatttattcaacaacaacaacaaaattctttcgaggaaatttaaaatccaagcttgttttattggtatcaaactcaaaaatg

SEQ ID NO: 112353 - DNA, 71 bp, Heterodera glycines
  Promoter: Source sequence=SeqID_7122; Location=153..223; Strand=+; Gene=SeqID_63898
ggtgccatttcaaactttgatttgcatttattacgctaatgactttatatttccattttagcgtcattatg

SEQ ID NO: 112354 - DNA, 212 bp, Heterodera glycines
  Promoter: Source sequence=SeqID_1250; Location=2391..2602; Strand=-; Gene=SeqID_46721
tattatattattattattattatcgtccatcgtctacaacacttcatcacacacgaagcggacttcaatggaagtctactaccacggactggtaggagcacgtcccccccccccccccactccacattttaatttttgttttcaacattaagctgccgcgcgaggacgtagtggagctgctgccgaacgacggggacttcctggtgcgcatg

SEQ ID NO: 112355 - DNA, 1003 bp, Heterodera glycines
  Promoter: Source sequence=SeqID_20066; Location=384..1386; Strand=+; Gene=SeqID_84850
gtcgcgggttttttacccagaaatatgtagagaaaaccgcaacaaacgaaaaacacactcctataaatcgaaacaatttcagtaaatttactcctaggaattgaaacattttcttaaaaattcaaccctaaaatttgtttttctcttgggaaaatttttttcgattttaaaaatcttcgaaataggtatttaattagttataactggaataatccctactattgattatgttttttgtttattaatacagaaagaacaaaattccacttaaaagaatctgtcaccccaccaaatttggctgggtttgtggtggaaggcgtccgtccgtccctcactcctttcgtttgaaaatgcgcagatttatgttttgctaattttctgttcataaaaaacgggccaagaatttgactttgctgagcgaatagcgcaccattccgttcattccgttttgtaatcggtggaacgtttttcactttgttaaattactacacatactttacctttaaattttccaacgctggagagaccgcagaaatcacaaaaattctcattaaactaaaacctatcaaataaaacggggattggataattaaagaatatttccgatttcctcaattttttttcattagaacaaaggaaaaacctaaaaacattgggggagggaccctcttgatttacaaatgttttaattatatttttcgcaaataggatttttgggggttgctgaacacgagcttgatatttttcgatgaattctcgattttttgttcgagttcaagtttggagttcgaatttagtcgaaataaatatcaaactcgtgttcagcgatccctaaacccctagtaactaataaagaaccctgaaaaatagttgcttttctgtttaaaaatcgtcccacctaaactacatataaaagtaccgctatacttattgtcatttttaccaaaaaattacagaggtcctaaatatttataaagattttttttaacattggccactaatg

SEQ ID NO: 112356 - DNA, 907 bp, Heterodera glycines
  Promoter: Source sequence=SeqID_15007; Location=1..907; Strand=+; Gene=SeqID_79160
attcaagattttttttatttttaaatgcattttttaccacatgaattatgattaaatttttgcgtttggaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcctaaaatgaaggaaatattcgatgctgtgcgaactctttgtgacccctctctgactctgccaatgcagcagttgaccatttttaccactatttttctctcactcatcgtctgctcgtctctcctttattataagctatttttccaaagcccacgcctttctctcttttttctgtttgttatttctcattgctgctgacggtgtcttcctattttgccatttttggtgcttattttttctcacctaatgcatccatacttttttcattaacctctggaagccatgaaacgcacgaaaaaaatgtttttttggtttgacgctattggcttttttaaccgtaaagaacgtaaatactcggaaaaaaactttttcaatgttttttttctcgggaattttgtttaaaaattttgtgaagataaacaaaatagcaaaaaaaaaaaaattcacgtcatttttttttcttttgaaatcattttaatatcgcatttagccattttggagatgtttttaatatttattgcttaatttgttaaaatttagtgtgtccatatttcgcaatttttatatcccctacatacatattgctctgtcgttttatttttatttatcattttatttattttttggatcgaaacaatttctaatg

SEQ ID NO: 112357 - DNA, 206 bp, Heterodera glycines
  Promoter: Source sequence=SeqID_12690; Location=2704..2909; Strand=+; Gene=SeqID_76373
atgaaatggtgcagtgccaacaccgactcgccattcatgcgcaatttgtcgccaaccaaagtgccaaattgtgagatttctgtcgatgagtcatccgccgaaatcaattggccaagtggcgaattttggacaatgagtgacaattcgttaaaggaatatccgtcggatgcgatgggcggggacaataagtgaaagttgcgcgaatg

SEQ ID NO: 112358 - DNA, 962 bp, Heterodera glycines
  Promoter: Source sequence=SeqID_16507; Location=1227..2188; Strand=-; Gene=SeqID_80912
gctaaaaatgtaatttaaccaaacgaaaatcaattaatggtttgtttttgtttttttacttccattagcacaattctgaggatggtgaaaacaggagaatgtcagagttgtggtcaaattcaaaatctggccaaagaccatttagggctcggcttattcagtttagcaatcatacagaattgcagttttaaataattacaaataagtgctgcttaagtgatgcgttgagtttgttttgccatttaattcaaagtgagtcatttcgacctccaagtaaattactttcctcaagcgaatggtctgaggggagagatgtgctgatgagaggagaaatttatccgccgccccaagagatgatctcccacttccatcccatggaataccaccgccgcctccaaccccttttggtcatgcgtcgaccatctccggtcggtcgtccatcgaccattttgcatgccttttgcctcgctccccgccccgccacattcatcatgggaaggggagggggggtcgggtggaccaacacagagagaggattaacaacagcagcgaatggaggcatttgggcaacaaaaattccctgtgttccccccgtttttgtggttctgtccggtttgattgatgtgacggaaaatgaaaggaaatgcgatggtacaaaaggcacaattggcaaagtaaagactttgattgggcgtttggagggacgacatttgcgaattcacccgaataaattcctaaacggacaacacattttcaagagtatttgagcaaaaatcattgtggccttatttgcacttggcattaaatggcaaatatggagtcattgcaaaggcaaaagtgtgagcaaatataacagtagaaaacatatttaagatttaatataacacaaaaaggtgaaaggaatagaaagagtaatttgtaaggaaaatggcataaacgagaaacagaaaataatcagaatg

SEQ ID NO: 112359 - DNA, 289 bp, Heterodera glycines
  Promoter: Source sequence=SeqID_4923; Location=1264..1552; Strand=-; Gene=SeqID_56205
ggtgaaatagcagacaaaacgccaacaaaatatcgacaagactaaatggtccaattcaaaacgacagccaaaactgtactttttggaaaagtgtgatattttgtcgtttgaaaatgggatttttcaaattcggaaatgccgttttaattcattgttctccctccatttcagtgctgctctccatctcttcgcttctctgtgacccgaatccggacagtgcgctgcggcaggacattgcgactatgtaccgcgacaaccgcgaggagtacaaccgaattgcccgtgaatg

SEQ ID NO: 112360 - DNA, 569 bp, Heterodera glycines
  Promoter: Source sequence=SeqID_13055; Location=1647..2215; Strand=-; Gene=SeqID_76835
attttgtgaaattaatccatgtcaatttactttttttgtcccggtgtttagatacacccatgttgaattgaacaaagcactggagcttggctataaagttattgatttattttaggtaaaaataacgtatcgtttattgcacataaacttcaaaaaaataaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcaggttgaaggcattcagttggaccacaacaaaatttcaaacaaccctggacttcggatggtagcggtaaaaaaaatacagaattacaattttttaaacttaaaaaaaacacacagaaaattcttgcaaactccctctagggaaaacttgcgcaacgagtcggtggaacggaagttcgttatacccgaactccagctgagtttcatgcactgctcgagaatcgcaacatcgacattattgactttcatcacgtctctcaccatatg

SEQ ID NO: 112361 - DNA, 168 bp, Heterodera glycines
  Promoter: Source sequence=SeqID_12627; Location=186..353; Strand=+; Gene=SeqID_76295
attatgaatggaattttaaatgtgttaattgtacgcggtgattattcatttatttctttatttttttgttattttaaatcatatttttttcaatttttggtttctattccctttatttattttattgcttccttggctttttcaaatacaactttttgccagtgaatg

SEQ ID NO: 112362 - DNA, 623 bp, Heterodera glycines
  misc_feature (77)..(77): n is a, c, g, or t
  Promoter: Source sequence=SeqID_15234; Location=1..623; Strand=+; Gene=SeqID_79438
cattaaattttttataaaacccaaaattaaattaaaaactttgaattaaagtcaatttaatacataaatgccatggngacactaataaatgataatgaaaagcataattatgcatcccgttacattttatagccccattaaatttttttataaaacccaaatttaaattaaaaataatgttattaaagtctatttaattaaaagcataaaatgccatgggacactaataaatgataatgaaaagcataattatgtatcccattacattttatagccccattaaatttttttataaaacccaaatttaaattaaaaataatgatattaaagtatatttaatgaaaagcataaaaatgccatgtgatattaataaatgataatgaaaagcataaaaaatgccatgtgatattaataaatgataatgaaaagcataaaaaatgccatgtgatattaataaatgataatgaaaagcataaaaaccctgggataatataaaaaggtaacggtacgcgcatataaccgataaaaacccattaattaactaatcgccaaaataatttttggaaacaaattttaaaaattcataaatttaagcattaaaatcggcatggttcaaacttatg

SEQ ID NO: 112363 - DNA, 1003 bp, Heterodera glycines
  Promoter: Source sequence=SeqID_11463; Location=1265..2267; Strand=-; Gene=SeqID_74866
aaatccctgggtttcctgcctattaataaatgcccgatcaatttcaaataaaatatctgatttagaacatatagcacaaaagtatgatccatcaatattcatcatcaatgagacctggttaaaccccagaaatacaattgaaaatgaactatctataaatggtagatatagagtaatgcttgcgaaccgaaatgagaaaaagggcggtggatcagcaattctaactaaaacaaatattccttatcagacactattctctgggacaaaattccaaagcgaaattttacacattaaattactttttaaaaaaccaatccaaatcataaatatatattgtccaccgaattgtacagttcagaatactaaaaagctactcaaatttatttcggaccagagtaattctgaaaatatcatatattgtggggattttaacatcccaaatattttatgggatgaaaataaggtaaaacatataaatgatcctatgtcaaatatgctgattgagtttatgaaccaaaaacaattgaaacagcatgttaaagaaccgaccagagaaaatacgattttagacttagtaatgactagtgaatcagaattaattaatgaattaattgtattggaacatttttcaacttccgatcataaaatggtcggatttaaaataaaagaaaaattccggcgtaataatcccagtgtttatagaagagattttaaaaatattaatttttcgaaattaagtcgggcgatacttgaaaatcgaattgatttatcaataaaatcagtgtacaccgttgatcaaaaatataaagaattcttaaataaagtactgaaattatatgatacttttatacccaatagacctctaaaatcgataataaaacaatcgtatcctcaaaaaataagagatttattttcagagaaattacggttacataagcttgtaaaaaaattccctgaaaaaagtgatctctttttaaattacaaaattatttctagggaaatg

SEQ ID NO: 112364 - DNA, 349 bp, Heterodera glycines
  Promoter: Source sequence=SeqID_3052; Location=2383..2731; Strand=-; Gene=SeqID_82982
caacaaacaggcggagcacaaattgaaggtgggtggtggtgtggttatttacattcagaaacttgggagcgttccctccccgaaaattcaaaaaaatattgggcgtccgaatgattcaaacgaatctcacgggaaacctttaattttaatgagatttgttaacagttgttgccctaaaaagttgtaagagttgaaatttaaattttgtgaaaatcctaaatttaaaaaaaaaataaattttttacccaattcaaattcccattttttgcagaaacttgagcagattgtgaagcagaagttggtcatctgattctgtgtgagcagtggagtgaggaggaggaggagaatg

SEQ ID NO: 112365 - DNA, 750 bp, Heterodera glycines
  Promoter: Source sequence=SeqID_1189; Location=3115..3864; Strand=-; Gene=SeqID_46661
tagcataccgaccccgaccggtgttagacaaaattatcatttcgccaaatagcgtaattgacgtaattttttgcgcactaatttaaaatttacactggtaaatgccttttttgtatttttgattttgatcagccataactcgcttcattcctaacaaaaccgaacaattttagtatctaaaagaagtttttatgcttgctttttttcttgactcgaaaaaatgcttttagtttttctttctgtttattacgatagtaaatgaattgtgatcatgcagaggctgcagaatactcaataaagcagcaaaaaaggaaggatctattcgcagattaatttacgagagcaaattgaaggttttttaattaaaaagggggcaacaatggcaaattgtataagagataatcaagtaacacatgtatttcacttaatttgttattacttatctatattacttttttttgtaatttgcaaaatttttacgattttgaattgcatttcgttaaaatttttcaagaaaaattttaaattagtgcgcaaaaaattacgtcaattacgctatttggcgaaatgataattttgtctaacactgcattggacttgacccatagtgaaaacggaaataatgtatataaaaggagcgcatttgcagtgtttcatcacataattcattgcccacatattattgttattatatattgctcatcgtctgcatctttaatcccacgaagcgacgtgcccggcgcaacaatg

SEQ ID NO: 112366 - DNA, 164 bp, Heterodera glycines
  Promoter: Source sequence=SeqID_27404; Location=1..164; Strand=+; Gene=SeqID_46043
ttatcctttggacacagcgtcgggaaatgagctctgtaccaaaaaagatttgcatgtgtggctcagtgtttttgtaggaaagtcaagggacaaaggcgggaggttcgagtccgttgtgctacatgaatattttcatttatttttgtgcaaaaaattaaaaaatg

SEQ ID NO: 112367 - DNA, 184 bp, Heterodera glycines
  Promoter: Source sequence=SeqID_3756; Location=1184..1367; Strand=-; Gene=SeqID_51757
aatggctaatcaaaaaattgtaaaacagtcagcgggaagctttttgtccatttcagatacgatggtgagcacaaccctttttgaacgcatttgccaattgttgttaaaccggagcgactcggagcagttcaaaaggaccaaaattgtcttgttgaccgcgattatgatcagagagatacggatg

SEQ ID NO: 112368 - DNA, 574 bp, Heterodera glycines
  Promoter: Source sequence=SeqID_19404; Location=1424..1997; Strand=-; Gene=SeqID_84131
ttttgaccctttgtttcatttgtatttcccttctcccttcgttatgtcacgcccacttttccgcccataaatacccgcgatgttgacccttccccatcattcttttgcttcttctccatttatttgttccctttgctcccaatcgatatttgaccccgttcgccctgtcccttctttttaaataaatatttattttattcctattcggactttggggcgtaacaattggcgacgcccgtgcagacttttgactgtgggcttattgatctgattgtggaggaagaggtttgacagcaaccgagttttgctgtgtcatcgctgaagactgcctgcatttgctattatctaggcgataataacaactttttgttggacctgctaacagtttgacactgttagtagtgagaaattttgcgccgctgattttgtgtcttggcgacacatttcagttcatccacgcgcacccactctgtctagtagcttggcgctgctaacaattgagtggtgaacgacacgtcatttaaaacgagtactctcgagctgaggggaaagtccacgagctgtggttaagatg

SEQ ID NO: 112369 - DNA, 915 bp, Heterodera glycines
  Promoter: Source sequence=SeqID_12704; Location=1..915; Strand=+; Gene=SeqID_76386
tctcgctctcaattctcgagctgaaattgctcggcttttgaagaaaattaaattgacatgaaatcttaaaaaatataaaagcactctctaaaaaaattttgctggccacaattttcatttggaactttattatacgattatttaattgatagataaaacgtgtccccagacaaacaatttttcttttatgtttttgatcttaacattttctgttgcgtattttattatttaatataaatattattttattacaatttagaaatgtattctttttatacaaaaaaaattattaattaatcatactgaaattttataatttaaaataaatttaaattttataatttaattagaaacatatgataaaaaggtattttaaggttttaagataaccccaaaaatactcttcattattttcatttttgttaattttttttttatttgaggcgccaaagattactctaaaatttctttgtaattttccattgatttattatgctagagaattttaatattatagctttctattaatttatgctattgcgaaatttataaatttttagtcttttcttggtcttataatttttacggcattgtttatacataaaaaaccataacaacttactaatatcattatattggttcacggatttttaatctgattgtggaattgggaattttacaaaaaaaaagaaaaaacaaatttcaaatctgatgccaattaaaggctgaccgagattctcgaaatctctggattaattctcgctctcgattctcgagccgaaaatggctcggatttactttctcgttagcatgttcggaaaattttaactctcaagcagccttattaaatttagtaaattttctaaaattaaaatttgttttgtaagtttatttcttatttaagcgattcaaatg

SEQ ID NO: 112370 - DNA, 113 bp, Heterodera glycines
  Promoter: Source sequence=SeqID_9201; Location=3443..3555; Strand=-; Gene=SeqID_70573
tccggcaaagtttgctccgatttcgacccacaaaaaagggtgccgttggcggtaccgtctctccggtcggctcttcctcctcctcgtccggctcgtcctctttgcttatgatg

SEQ ID NO: 112371 - DNA, 134 bp, Heterodera glycines
  Promoter: Source sequence=SeqID_5083; Location=3297..3430; Strand=+; Gene=SeqID_56835
tgataaattgaaatatttgctaaattatgacagataagatgatgttaaatatgtcaagtgtctcctcatgagataatacaaaataatatagtaaaaaaaaaacttaaatccattttcagagaaaagaaaacatg

SEQ ID NO: 112372 - DNA, 1003 bp, Heterodera glycines
  Promoter: Source sequence=SeqID_6279; Location=31..1033; Strand=+; Gene=SeqID_60994
gctgttctaactatgtcatttttcactgttctttgaaatgccgtttaataaatatggcccttccaagatatcattaggaaatttaaataattagaagcaattagcaaggattcattcgaataaacttattcgaattcattaaaaatgacattgtaaaaacataggtgctaagtgaaccgaaaaaaagtatcattgcttaaatggattaaccagggaacattaactgatggaagtttccgagaagcgctttatgctcgtcaattcgcggattggatgtaattagagcaaaggggccaagtgggagagggaggccaattaagggcaatttgaggacagcagaacttaattagcctgtattaagaagacgaagacatatcggcatttaaagcctcaggcgcaaaagcgcggataaaattaatttttcttttaatttatccatttttttttttgatcatctgcctttttgaaatttatatgcaattttttttataaatgcaaataaattttgtctcaataataaaagcaaaaaattttggggacaaactacagaattacccaaaattcattaaaaagcctaaaaaattgtttattattttttaaatcaaaaaattatttcgctaaattatttatttccctttctccgaatcacaataagtcacccattttaatcagataatgtgaagcaaaaaatcattggtgcatttttacattaacattctttcatattagtagtcagcttgggagtgaatattaattcatttggctctacggaaaaataaaaattctgaccttttgcgttttcccgagttgaagctttttataatttttttttcacttcgtaaaagcttatcaatagcttttcgacatgtgtagctttcgaataacttcaaatttataaatttggacaaccaagaaaaaagttatgatgctttaaatttggctcagacggaatgacctcctactgattccctaatgacctcattaaagcagattatatataatg

SEQ ID NO: 112373 - DNA, 140 bp, Heterodera glycines
  Promoter: Source sequence=SeqID_3128; Location=1..140; Strand=+; Gene= SeqID_83321
cactctatagttagcactaatttaaattaaaacaaaacaccatatttaaattttgtattttttcaaatttccttttcccttacattaatttttcacgaaaaaattcattttctttattaagttttgggacttttatcatg

SEQ ID NO: 112374 - DNA, 378 bp, Heterodera glycines
  Promoter: Source sequence=SeqID_41120; Location=1..378; Strand=+; Gene=SeqID_69316
tttaagagattgccttgtagaaaatgaccagtcaaactgtccgagtgacgtgtgaaagtccggaaaaattgcacaaaatgcaaagggcgaagaacggaattcagacgaaaatgacaaaaatgaaattatttggaagggattacaggggaattgatttggagaaataacgaaaaatggggaaatgtacgccaaattgaaatgggtgggggagggaatgccaaaatgaatgagggggggggggcatttgccgaaatgaccgctgtcacagtcactttttacgatcacatttctgctgctaatgttgcctttctgctcccatttaaaagccgtgtcgccctccgtttgcccattttccgtgccattctctctctcccgatg

SEQ ID NO: 112375 - DNA, 964 bp, Heterodera glycines
  Promoter: Source sequence=SeqID_338; Location=4001..4964; Strand=-; Gene=SeqID_83077
catgttctgtagtaaaggaagtgatgaaacaaaaaaaccctggccaagatgggtcagcataaatcgggagacccaatgaaatggaagaattcaaagaaaccagcccctacttcatctgcaattaaagacaattagggttttgccaattaattattttgggattcccctttgacattattatattgggttggtaaataagtcctgtccgttttttacattttcatttaaattactgttcttacaaatcgaagaattttgctaatattttgatatatagcctcaaatgtgctctacaaaattgcattaaaagattttggccgactttcaaaattgacgagaaaattttttttgaaccggtttggtcaaaaatggccagtaccggtttttccggtcttaaaccgttttaatacaaaaaattgttagttctttaaagcatatcattgttatgaatttaggccgctaaaatatatggatttttccggagttgtagcccccccaaaacggtaaagtacccggggtttggtagattttgtgcaacaccttatttatgctaggggtttaacggcatcgcataatgactactatttatttaaaatagagtcaggtgtaaaactaggtagggtatgtcaaaaaatctttgaaatttcgtcgactcgacctcgattttcgcgtttcggctcaaaaacgaatcgagtaataaaacgaaaggaattggtactttttcattatgctgaaacactccaaagtattgggcttttatgcctcttaaatagttttttgcggcgttttaaacgacgacgacggtccattcgatggtattgcagctcaaattgcggcttttatgcctcctaaataatcgttgcgcgccaaaaccgtttggggtgtatctgcatttccatggccgattttccgcatttgccgaatttttgtttcctccatatgtcctaaatactgtcgcccaatg

SEQ ID NO: 112376 - DNA, 388 bp, Heterodera glycines
  Promoter: Source sequence=SeqID_961; Location=1196..1583; Strand=+; Gene=SeqID_64975
ttcacgattcagttaaagtcataaggagggctgggatttatatttacaaaaaatcccaaaataattaaataaattgaattaataatgtttttcgtgtattttctcagcaaaacaaagctgcaggaagaatatttaattacaaattaaatcccagccttagtcataatatttactgtaaagttcgctggcaaatgccaaattatgagtacaaatgattgatggatggatggccttttaatgcgtttactatctgagaaaacgcccccccccctcccctcacaaatttctcttttaatttttcatttaattaaatttatttttgcattccaaatcaaatgatcagaaaaataaataatcatagcaaaaagcaatcattcatctcaaaatg

SEQ ID NO: 112377 - DNA, 187 bp, Heterodera glycines
  Promoter: Source sequence=SeqID_11730; Location=1583..1769; Strand=-; Gene=SeqID_75215
ttttacaagcctaacaataagcaaaatttcacaatttttttttctttcatttttgagttttcaaattcttttaggaatgctttccaatatcttgtttgttttcccaattctcatttttctaaaagtttttttttcgtatatttttccaccggaataatttcaggattacaagctaaccatcggcatg

SEQ ID NO: 112378 - DNA, 73 bp, Heterodera glycines
  Promoter: Source sequence=SeqID_21651; Location=1986..2058; Strand=-; Gene=SeqID_52248
tgtgagttttctttttaattttttttgttcaaaaatctgctttgccaaggtgtctctgtacccgttctgcatg

SEQ ID NO: 112379 - DNA, 65 bp, Heterodera glycines
  Promoter: Source sequence=SeqID_426; Location=992..1056; Strand=+; Gene=SeqID_52250
tttaaaatctatgaaaatgaaaaactataaataaaaagaaaattccattaaaaaaaagtaaaatg

SEQ ID NO: 112380 - DNA, 1003 bp, Heterodera glycines
  Promoter: Source sequence=SeqID_8602; Location=112..1114; Strand=+; Gene=SeqID_68661
aaaaaagctgaaatttaggcgtgtaaaacagggcttccatcgaaaatttttttaactcaagacatcgggcccaaaaaatcagattttggggtcaaaatcagaaaatttcacgaaattacttcaaaacagttatttttacaatttatcctatcaaaaattgatcaaatattatattttcgcctcccattatcggttttaaaaattttggaagggaaataagcaaatcgtaaatttcactgcattcgagatcatgaaatcagatttttaacattttttgcggcacatttcgaaaaattgtgcaaaattttgtgattctaagacaaatctttaagaaaacaaagaatcggaaaaatttttgtaattttaatgcgatttgttaacagatttttgtccgaaaaatgagtaaatttgccacaaatcttatattttcttataaattaatgccattttgccataaaatttcaaaattatgattttatttaagaaatcagaactaattttggtcgctacctccaaatcaggacaaatctgacatttttattttatcagatttggaccctacaaatcaggacaaatctgataaaacaggacagatggaagccctggtgtaaaatgacaatatttattcaaaaataaaacaaaattaagccaaatcagaattgaattacattatttttttaaatcaaaaatttgtcaagaaataaagaaataaattttggagacgaatttttgagaaaattttcatttcttaggggtgtattttttgaaaaaaaaatttaggtcgatttttaaggggtgtatttttcgtttttattgcattttttaataattttcggaaaaattccaaaaacaggttatttcaaaattttttagtctttttaaactctaataaataaaaacctaaaataacattaaatgaaatagtaaatgaatatggtttatgaaatgacgatgttcctcatttgcactcaatttttaaattcattttagtattcgtgggatg

SEQ ID NO: 112381 - DNA, 196 bp, Heterodera glycines
  Promoter: Source sequence=SeqID_13856; Location=488..683; Strand=-; Gene=SeqID_77803
tttcgcggatagttgtttagatttataaattcaatgacacttaaattcgtaggaaatttatttttgggggcttgcattggacaagtctttggccaaaggattggcgcattcattcgatgccaaggcaagccaaatgattaaatttacctacatttttgaatttgaggtgattccatgctgccgactttctataatg

SEQ ID NO: 112382 - DNA, 67 bp, Heterodera glycines
  Promoter: Source sequence=SeqID_25834; Location=147..213; Strand=-; Gene=SeqID_56598
cgtgacgaaaaatcctgagaaaaatggcgaataaagtggaaagagtgttgggccaaatgatcgaatg

SEQ ID NO: 112383 - DNA, 535 bp, Heterodera glycines
  Promoter: Source sequence=SeqID_1312; Location=4477..5011; Strand=-; Gene=SeqID_72328
attggcgacggcaccggcaaatgattgaacccaaaaattaatcatgcaaaatatggtcttaatgatgatgaagaagatgaacgcttcaatctcattgaagaccaagaatttccaccacgggatggttttgatttggaccaattaagcgctgttgatcggggtttactcaacattgcctctaaactattcaaatttctgccaagaattgctggcaaaattgggcagcttttttccaaaaatgttcattacatcgtcgactcggcgtccaatcttgtgattttcaaattgaatgaggaacaacaaaaaaagtacaatttgccggaacgattagaagtgccattgacaccgggcaagttttttattgcattattggcgaaatgttcaaaaataaatcaaaaaaagaaaattgaaaaaatagaaaaatatttttcagtgtttcaaaaaaaaggaaatttgattctcttaaggattttgtgttttcaattattcaaaattatgacctaatttgaataaatcattcattttattagaaatg

SEQ ID NO: 112384 - DNA, 86 bp, Heterodera glycines
  Promoter: Source sequence=SeqID_36389; Location=128..213; Strand=+; Gene=SeqID_65708
tcatcccccaccttggctacgagaagcgtgggaagcagagtgccatcgcccgcaagtacctcaagtggcgtgccgaggaagagatg

SEQ ID NO: 112385 - DNA, 61 bp, Heterodera glycines
  Promoter: Source sequence=SeqID_2952; Location=1318..1378; Strand=-; Gene=SeqID_82479
ttggagcaccgcggatgcgacagggccccttgcgcgtccaacacttccactggcgacaatg

SEQ ID NO: 112386 - DNA, 56 bp, Heterodera glycines
  Promoter: Source sequence=SeqID_33417; Location=1..56; Strand=+; Gene= SeqID_63481
atttgttggtgatccgcacggaaatcaacaaattgtttggaaatttagaaggaatg

SEQ ID NO: 112387 - DNA, 413 bp, Heterodera glycines
  Promoter: Source sequence=SeqID_25513; Location=1..413; Strand=+; Gene=SeqID_56259
aacatggtaagcttttgcgattgattgataccaagctctccctgattttgtccataactaaaaaaaagttatcgtcctacaaccgccggaacgtcggcgccgccaaaacacgacccacactccaatattcacgtcctttttttgtaccaaaaccctcattcaaatgtggttttcttggttccattcaaaagcttagtctcaagaattatttttaaaaaagcaacagacaataagaaaaaacacacacacagtgacaaaactacaaattcaactcttacgaatatactcaagtacgactttttgtctgttgttatgagaacccaaaataagttagacaaaaacttctaaagccaaagccttttcgattgatacccaagatttagataccaaggattaatttttctgtaaatatg

SEQ ID NO: 112388 - DNA, 314 bp, Heterodera glycines
  Promoter: Source sequence=SeqID_28448; Location=525..838; Strand=+; Gene=SeqID_59065
aatttgcgttggagtaccggacgagcaggtcgaaaaccaaaaactaatggcaaaactcaaatcgttttaatcgcaccatttccagggacaaaattctgcaaacgcggaaacgcctgcaggagaagcgagagcggaacaaaacgcgcgggatgatgatcggcgcggcacagaacgcggcggtgcagcggaaacggtccggcggtgtcggacgcggcggcggcggtggcgaagtgccattgacagacaaagaggcaaatcggggcatgaagctatgacaattgggtgttatgccattatagcgtcatcaagaaatg

SEQ ID NO: 112389 - DNA, 67 bp, Heterodera glycines
  Promoter: Source sequence=SeqID_13791; Location=42..108; Strand=+; Gene=SeqID_77719
taacaattaatttattatttttaattgtttattttttaaatttacatgttactttgtgctgtagatg

SEQ ID NO: 112390 - DNA, 181 bp, Heterodera glycines
  Promoter: Source sequence=SeqID_40500; Location=1..181; Strand=+; Gene=SeqID_68812
ggcgaataaatttttactcgttcctcaagaaatttatcgtggtctcacctccgtgtctgacacgggtgacctcaatctggatgctgttcgacacgatttgaaccgagccaggggtgagcgaacaaatccctcaacaaaaaatgtccactacaaccaacagctaaggcgctatttgaaaatg

SEQ ID NO: 112391 - DNA, 59 bp, Heterodera glycines
  Promoter: Source sequence=SeqID_4149; Location=1037..1095; Strand=-; Gene=SeqID_53374
agaaggacatcgtctgcgtacatcaaaaaggagtttgaccatctgttcaacccgacatg

SEQ ID NO: 112392 - DNA, 128 bp, Heterodera glycines
  Promoter: Source sequence=SeqID_12328; Location=1188..1315; Strand=-; Gene=SeqID_75922
ttttgcaaaatccaccatctccatatatgtagataccaatattatttgaattattaattctatattacgtttctattactttttttctgaccagattaaaaagaagtgattgaatagaagaaaaaatg

SEQ ID NO: 112393 - DNA, 942 bp, Heterodera glycines
  Promoter: Source sequence=SeqID_384; Location=1455..2396; Strand=+; Gene=SeqID_50940
tcaatgggaagtgagaaatcactttttattccaaaaatatattttttttctttttaaaaattgtttggaaaatgttatagcggcccaacgacaaattatcccatggatctaaatcccgtaagtacaggatagagtcatcagcaccgccgaaattcccttaactcaaaagtttttttaagagaatggtaatatgcggacatgaatgttctcatattattggaaactgtctgggctctgatggatttgaatttgatagtgtgcgtttgactttgaataacttacgataaatttttttattttctgccaataagtaagagtgccgagttatgacgtgccaaacttttttagttaataaataaattaaatatttatttgcatttactttgagtgcccagtggtgtagcggtattgcgccagtaggcgtcttttaatccccaggttcggttcccccacatgcattcttttttttttttgctttttggtcaaagtaaattatcaaattagtttataatacaagattttatttttaattttttaattcatttttatacataaaatactcaataaaaatattagacaaaaattttttttcaatcgacatgatatttgtgcatttattgcatctttatgtttaattacattttttaattttaattaacaaaattaaaaaagattttgttttataaaaaatatatttaataatctactttgcataaaaagcaaaaataaaaattgtaaaatgtattagcatgtaaaggattcgaacctgagacccaaaaaaagatttgactaacgcactacccctacaccaataaattcataatgcaaagaaataattatttcttttctttaattataaaaagatgaaaagtttggcatgtcataacttggcactcgtgcttatttggcagaaaataaaaacatttttcttaagaacccatg

SEQ ID NO: 112394 - DNA, 1003 bp, Heterodera glycines
  misc_feature (660)..(660): n is a, c, g, or t
  Promoter: Source sequence=SeqID_3903; Location=2770..3772; Strand=+; Gene=SeqID_52364
tattcatgttgcacaacggactcgaaccaccacccgttgtccctttactatcttataaaaaccactgagccacgcatgcaaatcttttctggcacaggagctcatttcccggacgctgtgtgtaactaatggtccagcagaagccacaaatattttaaatgaataaaacttcggctctactgcagtttacgcgtcaaatcaatgaccacataggccataacttatttcttacttggtatcaattgaaagcttaaagcctatgttttttataactaattattgtgctcaagactataaacaaaaaattttccaaaatattgttgaaaaaaactgaatttcggatattctcattgtaattctttcttaatgtctttattttctcttttcttgttatagattcccgaaatttcaagcttttgtttgataccaagaatgtaagatttgactaattgtaagttagaaaaaagttgtggactaagaaaataaggatggtcactgattagacgcgtaaactcagtagagccaaaacttctgtgtaggttaataaaatcggtgtgtaagaaaattaatacatttaaattgcattttttaaatttattttttatgctttcttttccagtcaaaattccaaatagtctaaaacaaggcacgcaacctttntaaaatttaaggtaaaagaacaaattacccatccaaaaatattttcaccttaatttgtaatgcttattgttgctttaattttccagtttttagtgacaattatccattcagttaataggggtcaatgatttagtatttacataattttaatttaaaatgtaaagttcaaattatcagagtttacccgtccattggcctcggtcaactgattcggcgccatgcatgttgtgtccaaaggaataatgaacacaaatatctatcgacaaataaataaataataaatctgaggagaaatgaatgaaagagagagaagcaaatcacgaatgaacaaattgtaggaatg

SEQ ID NO: 112395 - DNA, 400 bp, Heterodera glycines
  Promoter: Source sequence=SeqID_14462; Location=926..1325; Strand=+; Gene=SeqID_78507
ggtgtggcatttgaaattattaaaaagggaaaaaaataaaataaagcaaataaaaatagacatttgaattgatcaattttgtatattcatatatgctaagaaaatcaattaattttttatttattcattcatttcttttcatttttatattattttttaaatattaaaaattaaatttaattcaaaaagttttatgtaatattttagaaaattgaaaaaaaatatacgaaatgaacttaaaaattgtcaataaattctcaaaaaagggaattatccgaacaattatcaaaaattatattataaatttattttcaattttttcccacttaattaaggcaaagggatttttaattaactaattaagtatctttttttaaacgatgtactacatttttacatg

SEQ ID NO: 112396 - DNA, 123 bp, Heterodera glycines
  Promoter: Source sequence=SeqID_232; Location=5969..6091; Strand=+; Gene=SeqID_78831
acctcaattggaagcctcttggcatatatcaatgtgttagtttaagatcaggaacccggacaggcaaaatttctgtctcttctatgcactgcaggcgacaatggttgccaagaccagaggatg

SEQ ID NO: 112397 - DNA, 188 bp, Heterodera glycines
  Promoter: Source sequence=SeqID_20370; Location=916..1103; Strand=-; Gene=SeqID_50892
aacgaattttcactgaaactctgggctttttttttagtaaaactgttggcccccccgtgttaaatgttggcggaaaagttgtccaagcgacgaaaccagtgttgatggctacacataataatgcatttgtgcccgcagcacaaggcatggcgtacgtgacgcgaaaaatttgaaatggtaacgaaatg

SEQ ID NO: 112398 - DNA, 174 bp, Heterodera glycines
  Promoter: Source sequence=SeqID_26999; Location=1343..1516; Strand=-; Gene=SeqID_57729
ttttctgtttgtgtacaccgcattttctggacagaatttcattgagaatcgtctggcagcaaaaattcttttcatttccacgattggactcggtaatatatgtttaaaaaattaaccataataattcaaaaattatattaaaatataaattcaggtgcaatcactccaactatg

SEQ ID NO: 112399 - DNA, 319 bp, Heterodera glycines
  Promoter: Source sequence=SeqID_38323; Location=699..1017; Strand=-; Gene=SeqID_67173
tatgatcagctctgtttctgtgatcatttaatgggcgaagcaatttttggtaacagctcaaacaatgcacaaaaaagcatagcaattaaacgaaaaatgccatttaataataattaatcaattatttaagaatcacattccatggcgtaatataatgaattattgcttattaaattattttttttaattaagaagaattacaatttgtgttacccgatgagctcgaggctattaaaacactggagagtcagatacgcaattaattaattaatttaacaactagttaagatgccctaaatgcaattgtgctgttgagatg

SEQ ID NO: 112400 - DNA, 405 bp, Heterodera glycines
  Promoter: Source sequence=SeqID_10032; Location=2090..2494; Strand=+; Gene=SeqID_73084
attcgaacaatttttaaatttattttttatttaaaaataaattatttttaaaaagtcatcgaaataaaagtctttcctgaggttttcaaggtcgctgatcacgaatcagatacgcagaaaataaatcacaggcagtgttaacagcaaaaataagtcattctatgcggatattttattgtacgggctgatcttgatccaattccccccccccaaggattcgaatagatgcaataattagctggaaatattctgattagcagagtgattgaaattattctgatggaccctaagagcggttatgagacgcgcaagattatgggtaattattctgatgtactataattatcggaattatatctgacgagaacctgaaaaatagtaattattctgacgtgtaccagaatg

SEQ ID NO: 112401 - DNA, 572 bp, Heterodera glycines
  Promoter: Source sequence=SeqID_14029; Location=1..572; Strand=+; Gene=SeqID_78006
ggaacgtactcgggtttttttcgctttccggtccccgtgggaaattccttttccaatttcttcccccgaacaatatttttcagtttattagaattcaaaaatttaatcgaatttatccgaaataatttttaggtttttggctaaactacaattcgttataataaatttgaatattattggtaattcttgtagggataaaaaaggaaatgaaagtgatgatagcgtaaaaaataaggcgaatttgctgttgccggtcgcttaaatagttggcatgaaattttggcaatgcgtgaattgcacaaaactctcgccacctttgggcttcgctaatgcacgcgcgcggtgatctccagtactttcatgggtgggcgtggcacccaaaaatggtctacaaaaaggcagcaattctacgagtttggcacacttcggatttcctgctgaatcttgttgctttctcccacccttttcaacttttcaaaaatctcacttaactatttggtcattattctgctttctcgaatgacttccacccccccccccccttaattttttttttgtaactcagcaaaatg

SEQ ID NO: 112402 - DNA, 191 bp, Heterodera glycines
  Promoter: Source sequence=SeqID_743; Location=2436..2626; Strand=-; Gene=SeqID_60285
gttaccatatcacggtgaactgtcatgatgaacatgctactgtagctaagaccattgtacaacacaaaagtctcgcatcagacaattcgatggcctttttaggagaaaaacaacattttgaaaggaatttagttgattttaatgagataaaatgtaggcactattcagtttttatccgaatcagcagaatg

SEQ ID NO: 112403 - DNA, 305 bp, Heterodera glycines
  Promoter: Source sequence=SeqID_12063; Location=1256..1560; Strand=-; Gene=SeqID_75608
acatttacgcctcggacatttgcgcctatgtccaaaatcgggttcaaacttgtttttcaatcttacataatataaacggcattaaaataattaagaaaaatatagtcttcaagtttattaagggccttaattctgttgttaaaaatttgtgatttaaaaaaaattacttataataaaattatcatacattcaatcagtttctatcacttaagaattaaataattaagctagaaaccattttatgctgtaaatgaccacaaggattgcaaaaattttaaacccgatttttgacattcgcgcaaatg

SEQ ID NO: 112404 - DNA, 482 bp, Heterodera glycines
  Promoter: Source sequence=SeqID_38495; Location=1..482; Strand=+; Gene=SeqID_67285
ttagtctgccctctgccgcgctctttgccgcgcggacccccccacataaaaatgtttttttttggaaacaggcgggcccggggatccttccaaggccataaaaaatttttggacgaaattttgtgcgcaaaagacagatcaacgaacgatcataaaaatttaagccggcccaatttagcctgataatagaagggcacaaatctgatgtttgattcgtcgaattaaaaatatatttagaaagcctaaatttggattttctttaaatttcaaaatttttaatctttgaacccaataaaaaaaagtaaatttctaaatttaattttagttagatcaaattggtctttgatcatttataaaagagcatttaaaatggtatttaaggatgtcactttcctcaaataaatgcataaaagaattaataaatatattctaaatttacttacttcacccttaaaatttaatttgctcttattttaatgatg

SEQ ID NO: 112405 - DNA, 54 bp, Heterodera glycines
  Promoter: Source sequence=SeqID_44193; Location=247..300; Strand=+; Gene=SeqID_71718
cctaaacaatcaaaaaaatgagggtagaaaatatcaacaaaaatttaaaaaatg

SEQ ID NO: 112406 - DNA, 138 bp, Heterodera glycines
  Promoter: Source sequence=SeqID_10953; Location=2139..2276; Strand=-; Gene=SeqID_74260
ttcgcggaaatttttccactgtttttattggtcattcattttatgatttaccacattttcaattagaaactaatatttttttttgttgttaagcaatcgaaaacaattaattgtactctctccccaactaaagcaatg

SEQ ID NO: 112407 - DNA, 331 bp, Heterodera glycines
  Promoter: Source sequence=SeqID_18788; Location=1934..2264; Strand=-; Gene=SeqID_83464
cccggtagccccccgagagaattagagtgaacgaaccgcgaaacatttttaattcctcttatttatttgacctatttatattttcatagggaacatgtttcgcgcatttggggcatagccagaaattatcaaataatgatgtaccgaaatgcaaaagactgtgttttttacatctgttacatatctcgtaatgacagggacagtaatgacaacacttaattttatgtgggcagttcatttttcaatttaattttattttgggttgctatttatagaaggggtatataaagggatgaaaggaccatttgattgatacattgtatcaaaaatg

SEQ ID NO: 112408 - DNA, 1003 bp, Heterodera glycines
  Promoter: Source sequence=SeqID_9860; Location=2657..3659; Strand=-; Gene=SeqID_72888
attattaagggatttattgtactttttggatgagtcaaatcattcaaatttaaaaatctttttttttcaaaaatgggtcccttttcaatgtgttactctttttgcacttttacttcaattttggaataggtaaaataaataaaaactttctgtggtgctattgagcgggaaaaattgcagctaaagaaattaagaaacttgatgtaacatcaagtcaagtcattaagattttaaagtgtttatgacttaaattcccagctctattcatttgccagctgagttgcttttggacctctatttttttaatttacagatgaaacaattaggctgccgagagtttcaattttctgagacagaaaattgcttccgggaacaagaccgagattgattgttcaatttcccctacttgagaactggcagcgagacttattaaaattttttaaaatatagataaattaatcttttttctcaaattttctcattagtccattttttgttaatttaaattgattttttcgaatatattttttgttttatttcaatattatttatgtaaatcccatttttgtacttagacgatcaatttcctcccaattgcatatttaaatttaaaatctagcaagaatgaatgcttctttgctgctgctttgcaatgattactttttatgctcaaaatattttcttggaaaatggcacaacgaaaggcaaaagaaaaaagtaagaacaggtggcccataatttattatgcatttgcgtaattacatgggttgactttttgattaatttgtgcggaatgtctgagactttgcattttttaactttttttcattaattggcagtggcgtcaagcgaaataagtgaaaatcacagctacagaagagtgggtgggcattaatttaggcttctgttagccaacactttctttaaaaagatatttctccctctaatttcgacactttttaattctttttttcttcgtttttccgcttttcttttgccaatg

SEQ ID NO: 112409 - DNA, 121 bp, Heterodera glycines
  Promoter: Source sequence=SeqID_307; Location=579..699; Strand=-; Gene=SeqID_81800
ttctaaaaaacaacaaaattaaatcactggacgatgctcacaatcagaatgggttttttagtaaaaagtgaaaatagggaaagaatttgtccctcgcctttcagaacctcttctgcagatg

SEQ ID NO: 112410 - DNA, 218 bp, Heterodera glycines
  Promoter: Source sequence=SeqID_9573; Location=226..443; Strand=-; Gene=SeqID_71936
tttttcggggttggtttgaaaattcttatagaaaccaattataagttttaaattaattttattaattttttcagttggaaatttgtttgagagtttttctcatttaaatttgtcgaattttttaatcccggattttttgtgttttctcggccacaatttttagggtcaatttgtaatcccgtaaaaataattctagctaacctctcctctcctaaatg

SEQ ID NO: 112411 - DNA, 632 bp, Heterodera glycines
  misc_feature (59)..(59): n is a, c, g, or t
  misc_feature (79)..(79): n is a, c, g, or t
  Promoter: Source sequence=SeqID_19667; Location=1..632; Strand=+; Gene=SeqID_84397
ctgaacttttggaggagtcatttcgggtaattattctccagggaataaaatgattctgnggggaacaaccctttaaggncgacaaatatttgagtgtgcaaaagcgagtgcaattggccaacgaattggcactgaccgaaacccaagtgaagacatggtttcagaacagaaggtgagttgatgagtgtgccaaaagcggacaaaatgatgccttattttgagaatcaaaaggaatttggaaaaaaaagggttttgtcgattaattaaggctttaattttgcgttcattttttatttttaaagttaaactttctgtgcattgataaaacggggtcattcggaattcgattcaaaaaaaaaatctcgaggataagaaattttgaactttaaaaaatatatatttggggtacaatgaaaagagggggtcattcaaaaaccatttgaattttggaaatttatagccaatttactaattaataactagggctgggctttttaggcacaaaaaatcgcgaaatagcacctaaataggcactaaaataggcatttaggcattaagcacaaaaactccgaaataggcaaagttaggcattataaaagtcatcgtagacaccccaaaccaagcggaaaatg

SEQ ID NO: 112412 - DNA, 75 bp, Heterodera glycines
  Promoter: Source sequence=SeqID_43369; Location=955..1029; Strand=-; Gene=SeqID_71054
tccctggtgaaaagtgcagcacaatcgctggtagaactgttcaagcgcaatgccggaggtgaaaaggccaggatg

SEQ ID NO: 112413 - DNA, 529 bp, Heterodera glycines
  Promoter: Source sequence=SeqID_2898; Location=973..1501; Strand=+; Gene=SeqID_82250
tgtattttttgaaactcattttaaaaatcaaaaaatatttcaaaaaaatcaataattgcttgggaacaaataaatatattatttacaataataatttgtttttaatatatttaatcattttttgaaaacttgaaaaaaagatcggtcatttgaaataataaattctaaaattttacccaggaaatccatgtatttttgtgttttgcctggacctggattttttttcacatttgacctggacctggatttcatgacaaaaacccaggaaatccaggtttcgaaaaatggcctggacctggatacaaaaaaatccaggcctggacccaggtccaggtcgagctctagctaattcttatttaaatttgccctttagctgcaaaatgtgaatgtgagcacaattcggagcatcgaagatgctttggtgccgttgatcaagttcactttccaatttgatcaaaacactccgatcgatttcgacattggtctcgtcacttttgatccgaatgagcaaatattcaaatcaaaaatg

SEQ ID NO: 112414 - DNA, 312 bp, Heterodera glycines
  Promoter: Source sequence=SeqID_24109; Location=1233..1544; Strand=-; Gene=SeqID_54810
atcagtcagtcgacttgcactgacgaaggcattacgacgagagaaagtgttgggctgagagtcagaaaagcatcggaaatactgaaaggagcggtgaaacatttggcaaaaggtgccaaaacggaaaagacagaaggaaaagcgggagaaaaaggtaaaatggagagagaaaagaaaaaacggaggaggaaaaggaaaagcggaggggaaaaaaaaggaaaaaccaacagaaaaaaaagaaaaagcgggaaaaaatcatagcattgtaaaaggttgataataaatgatcaaatcccaaaaggtgacgaaatg

SEQ ID NO: 112415 - DNA, 127 bp, Heterodera glycines
  misc_feature (38)..(38): n is a, c, g, or t
  misc_feature (81)..(81): n is a, c, g, or t
  misc_feature (88)..(88): n is a, c, g, or t
  Promoter: Source sequence=SeqID_23428; Location=1613..1739; Strand=-; Gene=SeqID_54136
aaattcccaaattttttagtcaggcttcgatttcacgnactaatcgtttctcctctaacgatgcttttggggcgtggaaanagtcgcnaaagaaaagaccgtttagaatgtatttgtgaataggatg

SEQ ID NO: 112416 - DNA, 289 bp, Heterodera glycines
  Promoter: Source sequence=SeqID_39462; Location=738..1026; Strand=-; Gene=SeqID_68027
tattcattacttctccttcagtgagataaaaatttaccctttacgtgaaaaatgcaaaagtgatggcacaacacaaaaaatgataaatttactggcattatgtaaaaaacacagataaaatgtcaaactttggtaaaccttttgaattcaaatgtttcttttttaattttaatttatccttcttattttattttaattttattaaactgattgatattttctctgatttgtttttgctatagcaattattttcgtttttattccttaaattatttattgcataaaaatg

SEQ ID NO: 112417 - DNA, 68 bp, Heterodera glycines
  Promoter: Source sequence=SeqID_10308; Location=1651..1718; Strand=+; Gene=SeqID_73487
ttgttagccacactcataaattttcgcctaattaggtaaagcgtggtcttctcgctgagggaacgatg

SEQ ID NO: 112418 - DNA, 1003 bp, Heterodera glycines
  Promoter: Source sequence=SeqID_20757; Location=428..1430; Strand=+; Gene=SeqID_51323
aaatttaaatgtgttataataactaataaacaccgaaaaccaaaaattcattttcacaaaaaatttttgtggagcctagattgtcaagtataaaactacattttctaacttttgctaagtaaaataggaaaaacaaaacattaaacctttttataataaaaatgaacatataaactgacctttatcgttaattgtaaatccacttcgtaaaagtaattccttttgtcaatataacaataatcgctatcccttactatataataagcgagccgaagctccgcccatttttttggttgagttaaattggcggacttggcgggaaataatttattttttggcgaattgtcttttcgagaagaaaataaaaatttgtttacctatgtgttgtttttttgtgtgaagaataatatcaatcgatcttttttgttattatttcataatttcatctgtttttagttaaataacttcattgtatttgtttcttattaataattgaatgaaatttttttatcttacacagtttttcagagcgtttcataaattcgacaaaaggtaagaaaagaaaatgtttaaattacttttaatatgctaaatagttttttaactttgttacaataatgaatttttttcaatttatttagtatttacaataatgaattaaaaaataaaaaattcatttagctttgtttttatttgcaagaaaaacggaaatttagcgttttgagcttaaaaccggttttttaagaattttaaggaatgctgattatgaatttgataatacctaattcaagacctcataaccgatttcgaataaaactcgaataagatttagctcattttgatacatttttaaacactggcgaatttatgaaacgcaaaaaattgaaatttcaaaaaatctaatacaaataaatagttaatctcttttatttttggattttttattttatatttttgttgttatttaatttaaaattttttagattcaaaatatttttctatg

SEQ ID NO: 112419 - DNA, 74 bp, Heterodera glycines
  Promoter: Source sequence=SeqID_20078; Location=1..74; Strand=+; Gene= SeqID_84866
atttggcacaacaaacagaaaaaataaaaaataaataaaacttttccccttttttcaggtgttattcggacatg

SEQ ID NO: 112420 - DNA, 174 bp, Heterodera glycines
  Promoter: Source sequence=SeqID_10813; Location=2488..2661; Strand=+; Gene=SeqID_74078
ttttcttttctgtcgtttttttcttaaatcattttccattttcggtttctctttttctgtcattttttattttctttattttccattttaaagaataaactttaataaataaaataagtccgcaagaaacgaataaaatataataaataaaaaatagatgacagagaataaatg

SEQ ID NO: 112421 - DNA, 819 bp, Heterodera glycines
  misc_feature (369)..(369): n is a, c, g, or t
  misc_feature (473)..(473): n is a, c, g, or t
  Promoter: Source sequence=SeqID_8383; Location=1824..2642; Strand=+; Gene=SeqID_67878
attatcatttttaaagaatttgaattatttttggctctccgtccccaacaaaacgtttctcgagatcaattttcggtctcagttctctagtcttggaaaattttgactctcgagcagccttatcacatcaacagtcccccttaattatctctaataaaattttgatgaatttaaaaaatgttctttccatttaccgtacttcttcgattatagcccccgggggctctattgttcaacccccctcaaaaggggggctttattcgagagggggttctaatcgaggggggggggatataatcgaagaaatacggtattctttccatcttttgctaagttatatgacagtaattctaattaataccaattccnaaattttggtttaattaatccaagaataattagtcgtacataattttttgcgaactaatcacatcacggaaagcatttgagcattgacatgagaccgaccgacntggttttggcatatccaaaatggatggaaagagacggacgagaacgaattggatcaaaagaacggatttaataaatttatccgatcagaaaaagaaaacgcgaagggatggaagggaaaatgatcaaaggatgaccctgtcgaggataaaggatgaacatgttgtgaaggatcaccatgttttatgagaaatgcccccggagacagcggaaaaattagcgaaaggaaatttaaaaaaaaatgaaagcgaaagcaaacgaaagaaaggcattaattcggagtataaaagcctaatgagcatcaacaaaaatcacatttgtccgatttcttctgctatcctcccaatg

SEQ ID NO: 112422 - DNA, 1003 bp, Heterodera glycines
  Promoter: Source sequence=SeqID_3475; Location=1686..2688; Strand=-; Gene=SeqID_84822
aatgaatgaaaaattatttgccggtttttaccgaattttggactgagtaccggggactcaattgtccaaggctcatttgtcctttgcggaaagaggaaaagcgacaaaggccaaatgaaaagtgttggcgaaattggccaaattaaaatgccaacactccgcgggagatttgctgttttacgccttcgttgtgaatatggttttccaacattatttatttttatgcggggcttctgcaaattaattttaccacttattttgttccaatattttctttgaaataattttaatgaaattctatcgcattctttcacaatttttttttgaataagtataaattgggcaattgtgtggcaattaaatgccggaaatgattttgcccaatttgtctcgactcttttttccccatcgtctctcatccctcgttcatcttctgctgtttgtgccgttcgtacattcccccccccccgtctcattccgtttcatttccgcttttccgatggccaagtgccctttccctcccctccccaattgccccccgagggcactcatttttttcccgcattgttttcatcccccgaggcgaacaaaaatccatttcaatgcatcaaaagccggagcccacttttgcaaattttgcggaaattgtgccaattttggacagacaaagaaaaatggatgggagagaaaatcggggcaaaacaaccaaagattatgtggcaaaaggccagagtaacacaaatcctatggattcactgttttacattttactttttctattttaaaattcattttttaaatttaattgcttccccccttttttttgccaaagtcaagtcaaataaatgccaaattttgactttgtccttttgtgtcatcaaaaattgtgaaaggatttccatttttaattgttctgtatttatagctaaatgtaagcatttatttttaaaaatttctttgaataaaattattattttacttcgaataaattctcagaaaaatg

SEQ ID NO: 112423 - DNA, 1003 bp, Heterodera glycines
  Promoter: Source sequence=SeqID_6378; Location=1306..2308; Strand=-; Gene=SeqID_61314
cgacattacttagtgtcgaaaatactcagtgtcgaatttacatagcgccataataattttatgaatttaataaatagaataattaaatttaattatttaatcatcactaagttttttgttttcgcatttgtctcagcacgtaaaattcttcattattttgttttccttggcaccaaatttgcctttgctgctgatgcacacgcatttacaaaaaaacaaaaattatgtccatttttactggacggcgcaagtgtcggtacatctctcaaacagcactaatacacagcaattaaccatttattatgcctgtatcttaagtcgattacaagcaagttgggtgaaattttcttaatctgcttgagagttgaaaaatttccaagcctcggaagccaaattcgagaagagcagagagaatcgagccccacaaaaaaaaaaaatgaaaattctctgaatttgaagaccgaactctcgagcagcaataaaattttgttaatagattttttacaatattaattaaaattactgattatttttcttaattaattcgtaataaattctcatttttacatccataaaaaaacgttgttttgacatcttcaatgtttgtttgttgggaatattaatgattgtcacaatccccccgatcagctctggaattttttttcaccatttatttcatgaaagtcttgaggatggacaaaattgattaatataatcaaagcatcatcaacagatcgcttcataaatgaaaaaacaaaaaatttccaatgtcaaattaatttttgttgcatttcagcaaaattatggcaatttgccgttaaatggcaatgccaaaagaatttacaagaaagaagaccaatcacctaaattaactcaatctatttttaaatttggtttttatgttcctaatttaattttgttttttcgagtttttcagttttaaattgaatttcctcatcccagtgctgctctctaattcgtctctcgccctaactaattaatg

SEQ ID NO: 112424 - DNA, 368 bp, Heterodera glycines
  Promoter: Source sequence=SeqID_15892; Location=505..872; Strand=+; Gene=SeqID_80230
cgtgcgtcgtattcattatcgatactataaacatggatcagagtgccagttatagcaacatttatgattctcacaatgtttccgtgtttttaaacaaagtttgaaccaaaaacgtgaaaatcgaaaatttgagttttccgctttttgtccggaattcggaattggtcgaaatgaatgccggattcgtgatcagcgaccccgaaaacccacagaaacgtgttttcatgacttttgaaaacaaaaaatttttctttaaaagggagggacaaactttactattaccgaaatgagcttaaatttaaagttttaattgataccaagaaagtaggcattgataagtgagagaaaagcagtagaaactggggatg

SEQ ID NO: 112425 - DNA, 372 bp, Heterodera glycines
  Promoter: Source sequence=SeqID_25099; Location=703..1074; Strand=-; Gene=SeqID_55833
ttttcatctgacaatgaaaagatacaaagttcaaataatataatgaaattaaaaattatttaaagcaataattgcatatttgagcaagaaatcatttttttgaaaaatttgaatgataatttgccatcggtgaatgacacaggcacataatcctcgtcatttaattatgacaacacccaaatgaaatgaatttcttcattttcctttcccaaatcaatgtttctcttttattatatgcgaaccattttttggtcaattcaaattaattagtttgcgataataatctttattattaaaaaattgctccaatctgttctttttttagtaaatttatttaattttcattaaaaaaaacttctaaattacaaaatg

SEQ ID NO: 112426 - DNA, 61 bp, Heterodera glycines
  Promoter: Source sequence=SeqID_30835; Location=980..1040; Strand=-; Gene=SeqID_61234
ggtgagcacttagcggatgacaattaaatatcttaaaaaattatttatagacaatggcatg

SEQ ID NO: 112427 - DNA, 86 bp, Heterodera glycines
  Promoter: Source sequence=SeqID_10652; Location=2962..3047; Strand=-; Gene=SeqID_73894
aggattcattgaggaattggtggacgaaagtgctccaaaacaatgagaagacgataccacagaagcaactcgagtgtgtgctgatg

SEQ ID NO: 112428 - DNA, 891 bp, Heterodera glycines
  Promoter: Source sequence=SeqID_5743; Location=737..1627; Strand=+; Gene=SeqID_46105
catattttggtcatttttggacaaaaatctgtaaacaactcgcattaaaaattacaaatttttccggacccccctatcctcaaaaaaattttttaaaaagcgcgccgtaaaaaaacccattttataaacaaaaaaagtcgtcgcatggcttaaaatcgcaaaaattaggcagtttttggtgaaaatctgttaacaaattgcattcaaattttcaaaatttttccccggcggcgcctgtcggcaccgccggaccccccccccctgtcccacaaaatttttggaaaaagcgcgccgcaaaaaaagcgtttttaaagcagaaaaaagtcgtcgtaaatgaagaaaatgataagtgaaaacaaaaaaatgttggaaaaaaacaattccggtgaaaaatacaagccatttgaataaatattaaccattttgcattgcatataataaaaattttaaatgtccttgaatttcatgaattttccccactatgtccttgcaaatcggcatacccgtccttggaaaccgagcattgggcgataccaaccctgttttcttttattttttttcatgtaaggttaacaaaagcatgcattttgtggttttcgaggtcgtcgatcagtgatcacgaatgtaatatacctaaccaaagttttggccaatcccggatccgaattcagacaaaaagtctgaatttcaaatttttggttttaaaattatgttcgaatctgttcacaaccattttaggatattacattggtttcttattattactcatttttaatcaattttaaaataaaatgtcaattttgaactttcgactttttgttcgaattcgggtccgggattaaaaatgccctaattttggatttttagattggcttaataaacaattaaatg

SEQ ID NO: 112429 - DNA, 651 bp, Heterodera glycines
  Promoter: Source sequence=SeqID_7346; Location=1186..1836; Strand=+; Gene=SeqID_64539
gcttgatttaaaaatttgtaaaaaaaatttcttaggagccaaaattgttgaagatttccatcgtaagagtgtctacttttaattaaattaatcaaatttatttagaaaaacaaaatcagtgacacaccagaatgccgaaaaatgattgaagaaatgaggaattgtatatgcccaagccaagtggataaacgggatgaatactaccgtgacgtattcctaattgattttaaaacttttaatagtaaactgtttttaattcgattaaattaggcaaaaccagttgattttctgccacactcgtgcgtggaagaagaaggttggccgcaaactgattgctgtcccgaaaacacccgcgttgaatgttgcgcattccatgaaacggtttatcagactagcaaaattgctttggatatttcaaattattattttaaataaatattataataatattttaggaagcagatgacgtccgaaaaaacgtggttttggtaaatgcgctaatatacaaaaattgaaatccaaaaacaattattagatttatgaatattcacaattactattttgatcaaaaacaagtagattagcaaattacagaattaaaaatttcttattaatttgtgttaatttagaaagctcgcatgcgcaattatg

SEQ ID NO: 112430 - DNA, 210 bp, Heterodera glycines
  Promoter: Source sequence=SeqID_13075; Location=1..210; Strand=+; Gene=SeqID_76862
gaaaaataaaattattaattacataaaatggtaaaataatagaaaaactgtatttttttttaatttaaagcacaaaatccttaattaacaaattaagcatgaaaaaatgcaataacatagaggaatttatttttgttaatttttaattttattgctttccaatgaaattggatataattgagaatttcttccatttttagttgtgggatg

SEQ ID NO: 112431 - DNA, 1003 bp, Heterodera glycines
  Promoter: Source sequence=SeqID_21921; Location=1290..2292; Strand=+; Gene=SeqID_52557
ctggcgagaatgaatttgtgcgttctcgtgccatttcgcttatttcgaacaaataaaaagaaacatgtcaaagtctacctaattaaggaaaatgaacgcacattaatgttccataataatcgaataaaaataaaaccaaaatgtaaattggatttcacacctttcctctttcaaattcatgactatgccaaaacgcattttcgttcctttttcaaaagaaatatgttcgatattttttcgtataatttttttgataactatcaaatttatccgaaacttcatcggcaaaattggcactttgaatgccattccttttattgccatattttcctttatatctgcactaatttgcatatcattcacaataatttgtccattagattttggtttcattctcatagaaatttcatttaattattgtttaaatgtcaacaaatctcataccgatgcttccctttttgtttttatttggacttctttcctggttttgctttgctttttttattggcattgtgaccttccctcacttttcattttcttggcactccccggagaagacccccgcccacccccgccgaatggacaaatgcggggaggggagacaaaatgaatttattccgcttcttgtccaacttatcgctctgcacacacacacacagagccattctgatgcttctgctcggaagaaggcttttttgccctcgggggacggattcatttctcagcagaaaagacaatcaaaaaaagggaggggggaaacatttttgggttgttgtgttttttttttcgtacaaaacttcagcaaaatttgaatgtaaaagtttattttatttattttgcttaaacacattccgattccaattgattcatctttattttggcacttaattttacataaattttcattttttgacttctgtaacaaattttctcatcattttgaagtctaatttcatgctaatcggctaacaatttttgcaaatgcgcccatttttgcgaaatg

SEQ ID NO: 112432 - DNA, 192 bp, Heterodera glycines
  Promoter: Source sequence=SeqID_8826; Location=658..849; Strand=+; Gene=SeqID_69336
tttcttttttctcttcagctgaataaattttcttccctatgaaaaaaaaaaattaaatttaattggcacattaaaatgtaataattaaatttatttatttttattttatttggtttttcgtcagaggcattgaattgagatggacacaggaaactgagaaaatttaaaagatttttcagtagttggccgatg

SEQ ID NO: 112433 - DNA, 95 bp, Heterodera glycines
  Promoter: Source sequence=SeqID_6804; Location=298..392; Strand=+; Gene=SeqID_62955
cgtgagtaaggcgtgatgagtacccgttgaatatcccccccccctcgccgtcctcagctgctcgccacggtcgccaccgacttggctacggaatg

SEQ ID NO: 112434 - DNA, 58 bp, Heterodera glycines
  Promoter: Source sequence=SeqID_31007; Location=1298..1355; Strand=-; Gene=SeqID_46240
tggtcgattaaatttctgccgtttatctgttcatttcaaaatttaatggtactcaatg

SEQ ID NO: 112435 - DNA, 341 bp, Heterodera glycines
  Promoter: Source sequence=SeqID_10251; Location=1..341; Strand=+; Gene=SeqID_73406
gagattctaaaggatcgggaagaaattgaggagttgttctcggcgatcacgaacaatttacaagcatggtcgcagaaaaaaatggtaatttacattgcactaaagctactataattaagaaaaggagaaatgttaagttgtgcaaataaaaatgatagataagataggatttcgcttttctgtgattagatttgtttttccgtttttaaacatattttctgtcattttttagtttttgttcggttttttccgttaaaaaccgagtaaaaatcgcaaaaaatcctgcaaataacggaagataaattgtgaggttttataaaaaattgctttttcaggaaatg

SEQ ID NO: 112436 - DNA, 421 bp, Heterodera glycines
  Promoter: Source sequence=SeqID_21847; Location=728..1148; Strand=+; Gene=SeqID_45677
tcagagagagctgtaaaaaatattttacaattttcaataaaaaaaaatttagttggatacgaaaattaacgtgactcttggaattgggactagattttttgaatcgttatgttttaaaaagaaagaatatattttccgacattgctagcaggcaccgccggtggaattttgaatattttttgggaaatttgtatacaaaagcacggatatatctcgaaaattgagcgagaaaaaacccaggtctcgaaaagattggggtttcctggtcctgttatgtcaagaaaatacaggcccagaccaagatgggtccaggctttttcaaaatctcatgcttataagttcaatttatttaattttttatattatttgtcctcctgacccgattgattccttttttaaattttattaatttgtcaagatg

SEQ ID NO: 112437 - DNA, 155 bp, Heterodera glycines
  Promoter: Source sequence=SeqID_30321; Location=1436..1590; Strand=-; Gene=SeqID_60739
tttttatattattctttttaaatttatatttaaaatacccacccgtattattaaattcattgaatatataataaattaattattttatcaatcattgagtttttttcgcatcgtctcagcacatttaaaaaacaaaaataatattgtttaagatg

SEQ ID NO: 112438 - DNA, 669 bp, Heterodera glycines
  Promoter: Source sequence=SeqID_29248; Location=1..669; Strand=+; Gene=SeqID_59773
aagataaatagatgaaaatatttcaaattttatggtttaggtgacgaacaatgatacgacagttaattggaaagctataaaaatgctacgtacactattatacctaatggacaatacagaatatttgtagctgttgggccatacggtaattcgaaatgaaattttttatatataatatttactatttacttttccattttccattatgcaacccattttagcgctatgaagaatttggcgttttttttttgcatgattttaccaaaaagaaattttttgaaaaattcagaaaaatttctataactttttgaaatccagaaaaaccccctaagattggtggatctcttaaaatttgttgatgaaaattatgggaggcggtataactgaaatatggcataagcagtaactgaatattttgataatgttaaagaatgtgacttgaaaactttaagttttttttaagatggcccaaaacaatttggattttcaactgacaaatatggcaaaattaatcgaaattttttgaaaaacattgtaaatgcagatgctacccgagaatggtttttaagcaatgaaacagcagagaaaatcaccattctagtggagaagggctctgataaacgtattattagcgaatatacgaattatgccaaattaaacaaagcaatg

SEQ ID NO: 112439 - DNA, 515 bp, Heterodera glycines
  Promoter: Source sequence=SeqID_3684; Location=1516..2030; Strand=-; Gene=SeqID_51441
ttggaaatcaaaaagaattgccgtggataaacaaaccgaaaaagaattgataaaattaaaataaaataaattaaaataaattgtgggggctttttgctgtcattttcttcttcgctttcctttctttgcccacattttgcttttctcttcttcctattgactttttccaattgacgcgaaactacgcaaatcgaaggaaacgaaacgaaacattcgcatttattgtcatttacttaattaactaattataattaatcaatccaattagaggtagaaacccaaaataataagagaatactttctgtaattaattaatttatcaacaaaatattaataatttaattatgtgattaatgccgaggatatttaaagattaattacataattaattgagtaaatcgatgccaatcttttgactgccttttttcacatgtcccaccatcagcagcactttcctcccgccatgtttaaatccgaccggcgtttgctcagtgcgccgtaccaaagtcgaaatg

SEQ ID NO: 112440 - DNA, 696 bp, Heterodera glycines
  Promoter: Source sequence=SeqID_17596; Location=924..1619; Strand=-; Gene=SeqID_82102
ttgttgaacaacaccaacagcacaacggcgccgactcgactttgctgtgcacacaatcgcccacggggaagaacaacgtcaacaaaatggcatcaccaaatgtaaaaaaaggggcaggggggtcgagagtctcggggtcagtttgggcaccgagtttgtttaattttaattgccaaaattctgtaaatttgtatcattcgttttttttatgtttaagcaagcatagttattccatggctaatttgaaatggaatttacaaaaataaatttgaaattcattctaatctaaaaatataatcttagttaaattataccgatttccagcagaaaaatgtgacatattttaaagggaatttatggagaaatgtgccgcaattttttgctgtaaaaattcgcggatatctttgactgatatctgtcgataagtgcgaatggataatcaacaaaagcgatgcatttattttttacatttactgggattttttaaattatacaattgaattggatttatttgcttttgattttaattaatcaattaatttaattttttatttaatttttcgaattcttttattttttgcccgcttttctcctcaggcaaattttggcgttcggtccgcccggcgttctctgtccatggacgcctccggcacttgggaggaggaattggcacgccaagtggcggaacggaaaatg

SEQ ID NO: 112441 - DNA, 311 bp, Heterodera glycines
  misc_feature (26)..(26): n is a, c, g, or t
  misc_feature (101)..(101): n is a, c, g, or t
  Promoter: Source sequence=SeqID_26266; Location=782..1092; Strand=-; Gene=SeqID_57011
ttaatttcaaggtcaaactattcggngttcaagatttcttgaaagttttgacaaaaaaatttttttaatttttcgtaccccttggcttagacttttgaccntaaaccccatctctaatgggggaaaccatgaccaaaattttattttttttctcatatttcagaaggccttaaaaaccaaattgtaattgaagaatgaagggttgtgcggaaaattatgcccaaaaatagcccattttttccatttttaaagcaccataaattccggcttttctggaaattttgtcaaaatctaggtttctggccaaaatg

SEQ ID NO: 112442 - DNA, 80 bp, Heterodera glycines
  Promoter: Source sequence=SeqID_36805; Location=456..535; Strand=-; Gene=SeqID_46474
cgtggtgagtcaaaacttttgttgttttagtaactaatttcgctctgttcccacaggtaaaaatctcggacttcggcatg

SEQ ID NO: 112443 - DNA, 203 bp, Heterodera glycines
  Promoter: Source sequence=SeqID_38090; Location=1..203; Strand=+; Gene=SeqID_67008
atttctaaggctgcttgagagagaagatgctaggcatgagcgctacaaattaaggaatattaattagtttattggtacataattaatgctcattggtttgaaaaatctaaaatagcttaaattaagttattaaaggcaaaagaattagttaattaacattcattaacaaattagtttttaaatcgaattcagtttcagaaatg

SEQ ID NO: 112444 - DNA, 387 bp, Heterodera glycines
  Promoter: Source sequence=SeqID_44651; Location=1039..1425; Strand=-; Gene=SeqID_72111
atggtcaatagttatgtttagcaaaattttaaacttcctcccccgcgagtcacaaaatgttaaatattttctgttaaaagaattataaaaaaggttttttgcccaaaatcctcaaaattatttaaaaaagagaacacaccattgattcgctgtaatttttttcaaaaaataactcttgaaaataaataagttaattatttcttaggcaaagaatttttcaatatatttaataatttaggcagagcagaaaggcgaatttacggaggacgaactgccgccgccatcagttaaactgagtcagtgtttgaaaaattttcttttaaatttattttttattttattttttcaattaaatttacaattatatataataaattttaaggtatg

SEQ ID NO: 112445 - DNA, 1003 bp, Heterodera glycines
  Promoter: Source sequence=SeqID_4369; Location=2576..3578; Strand=-; Gene=SeqID_54196
tttgatgcgctgagcacgaatttgaccttcttttgacttaatggtatcctccagccccatttccgtgaccttttcaacaaggccttcgatgttgcccatggcaagctgttcagaaaaaactttgttttttcaaaaaaatatggcatgtgatggatttcgtggtgaatccgtcaatggtataccaagaaaattggaaattatgcccaaaattgtgcaaaaatgcatgtcaaaaagctacacataatggaaattcaagcgcctaaatccatagcgaaataacggcattttttgccaatccaaagccggcagcgaacgccacacattttggagcgtgcgcgacggcggcccacaacgagtcgaggactttgatgccgttgtcctcgaagatgttgtcactggttttggtggttccaccgctattttggatgaagaaaattgaagacgaaagctggacaaaaggcacagtcagtggaaagtaaaaaagaaaggctaaaaaggaagaaaaattgaaattatttagaggttttttttttatcactaatttgggtattttattagtgcatttgttgacgtatcttttaacgtaaataagatttttttgtcgccattaatttttgagaaaatcgcttaaaagaatttgttttgtttgtttttttttttgctccaatactttcgaccgtgactgttgtacttctataaataaataaaaaaaacaaatttgtgtttattcatctcactaccagcagaacccttgatgagccgcaacagcgcagaatttcccttccccctttatcaccaaaattactaaattttcacagtttggctcttttacaatttacgtatcctaatgttagcacaaaatttcgagtccatacatttttcaaaacttacaaaatcaaatacgcaattagtgcgtgaataaataatctaaaggcgtaaagtaaattggaggcgtaatgtaatagagccaaattttctgaaaatacagagcaattttataatg

SEQ ID NO: 112446 - DNA, 332 bp, Heterodera glycines
  Promoter: Source sequence=SeqID_17504; Location=2226..2557; Strand=+; Gene=SeqID_82011
ttttgacgggcgagcgattcagctaatgagcaaaaaaaaaggagataaaaagtcaatttgaccaaagggttttttaagacatacgagaaattgcattttagaaatcaaacagacttagagcaacaaaaaaaagaaaatgttataatgccctaaatgtttttgaagccgcaaaaatggcagtgccaaaaatgactcaaaaatataagaattcgtttaagaatttatgagcgatttcgaaaatttattttattttttacattttagaacctactaaaatttatgatgtattaaattcaaaaattatttattacgatttgaataaaaattgaatg

SEQ ID NO: 112447 - DNA, 1003 bp, Heterodera glycines
  Promoter: Source sequence=SeqID_7071; Location=2255..3257; Strand=+; Gene=SeqID_63740
ttttgatttatttacaaaaaattaacaaattattataattcattttaaatatatgaccaaaatttaaaaaaaaaattagcaataatcaaaaattcaattcgtatttgtaaaaataaaaaaagatcaataattcactttaatatacacgtaaaattataaaaaaatatcaacaaaacaataatcaataattcaccatgcaacatcagaaagtaatttgtataaattaagaaaattcaatggtcctaaaatgactaattttttttttgttgtaatttttatgtaaaagaaatgctctggaacccggcatttacgaccccgagttttccgctccccgtcccccgaccctttttaacatattttttaaaaaccaaaaaaagcctcagggcaagaattttttgcttttaaaaattatttagagcacaatactgagctggctttatttttgggtcggggtcacttcggcgcggaccatttcggcgccgcaaattttgaaatgctataacttttttatttgtcagttagctttagccaatctagcatcatttgaaagctctatgtgtgctctatatttacatgtaaaaatagaaatgaatgattcaaaaataaaaaaagttatgccacgtggcgcctaaaaagccaagaaaaagtcaatttttgaggttttttggccataacttttttggaaactgacgaaatttttttaaattttacaggctaatagagaatctgaagagctatagattgataacaaaaatttttaatttggttgatcaggaaaaaagttgttagcaacggcgccgaaaggccggcgccgaagtgggcggttcccttattttttacacttttgaataaatattgtcacacccctaaatgtgaaactttttagcacctatttttttaggttttttagaacctaaaaactaaattttttggcagtttttagcaactataaatcgtagccatattaagaaaatatattatattaatgaattattttagcatg

SEQ ID NO: 112448 - DNA, 58 bp, Heterodera glycines
  Promoter: Source sequence=SeqID_7152; Location=1..58; Strand=+; Gene =SeqID_63978
caccaatatcaaaagcccacttaagcatcccaacgctttctcacacagcgttgcgatg

SEQ ID NO: 112449 - DNA, 289 bp, Heterodera glycines
  Promoter: Source sequence=SeqID_23190; Location=1..289; Strand=+; Gene=SeqID_53899
tttaattttatttattttttatttatgtattttgttaattttttttattaaacaatttttccttttccatcgatttgaattttcattaaagtaaacgcaaaattatttgttcaattatgtattaggtgtttacaataaatttccgtttgcttttagcaaaagaaagaatttgataatgatgcattccagccaaaattcagcctctaattcctaccagccgcagcagaacggcaacaacattcaccaaatctccgaggggacgacggccacggcactgcccgaggcgatg

SEQ ID NO: 112450 - DNA, 691 bp, Heterodera glycines
  Promoter: Source sequence=SeqID_32522; Location=389..1079; Strand=-; Gene=SeqID_62836
tttgtcatctgtatgcaaatcgatggctgctcatttttcctctgctgctgctggttactcactcttctgaactccttgtaaatgaggaggccctaactgccttaaattacccaataaaattttctagtttgagaagcattcccaaattaattttaggaaaagctaaactataaaaatacataaaaaacaaaagttggattcatttctctgtcctattcaaaacgaagaagtgaaagagagcgagagagatagagaacgcagagatagacaacggaaggaaaggcgagaaacgcagagagtgttgcgctagaagagaaaaagcgagaacagagaagcaaagacaaaagtgtgcacgttagaagtggaagcagaaaagcgagacagttctacgcaaaacccctcgggcgaggacgaaaagcggccgaatcattgtgaaaggacgaacgcaacgcaaggcatagagaaaaataaaaagagagagagggagagagaaaaggaaaaggcagacaaagcagaagagataaagcaaacggaaaagagagactaacggccattgcttctgctgctattgcgacgaaacgggccaaaccaagttcaaagtgccagtgcgacggttccgttcaatgctaatcagctaattgctcactaattaccccaaataacaaaactgtgcctgcttctcccaacaatg

SEQ ID NO: 112451 - DNA, 278 bp, Heterodera glycines; identical to SEQ ID NO: 109672
  Promoter: Source sequence=SeqID_4213; Location=2060..2337; Strand=-; Gene=SeqID_53618

SEQ ID NO: 112452 - DNA, 951 bp, Heterodera glycines
  Promoter: Source sequence=SeqID_2131; Location=1..951; Strand=+; Gene= SeqID_78013
aacgacaataacacaatggtaattatcctagctcgctttgcatcgaaattaaatatgcccggggcacactttttgttgtttttaatgactaatcactgccccgctgatcagtcaaagtcagaaggggcgctttgttttggtaagcccccgccccccgcttctgctggtcgtatcccattattctttctttgggttttaagctgcaggtttttacacatccaatttaaaacaaaattattattttttacacgatttagcaaataaaataaaataattatttcttttgttctgtgtttttattttattttggatattagtaaagtaaacaaaaaaagataaatgatttgtaatcactttatcattgcaagatttttagtgctgataaccaagaatgtcaacaacggatggaataggtacttacaaatgttaaaaaggcattattaaagaagacaccaataaataaaaattacctattatacctctaaattaaatactttaatattttgaaagaaatattcttaatcgaatccgagagtaattatcagaaatagatgactaattaacctttaaaaatttagcagaaatttattaaataatatattaaatttaaaaaaatctgttgaattggggcgatatgtaattttgatgattttaaattaccaaatatttttttagttaattatgatagaaaataggcgaaaattttttcagcaaaattcatttaatggttaaaagttttctctgtttatcagattgagttaattaattaattaattataaaatatgcttctaattttattatttttgtgtgtaaggattagcaaagtttactatttcaacaagaaaatgaaaaatttacttttgaaagccatgaaaaacattttttaaattcttcgtatttcatgattttttcaatatgaatgctgaaaaaattttgagcaataaaatatg

SEQ ID NO: 112453 - DNA, 614 bp, Heterodera glycines
  misc_feature (8)..(8): n is a, c, g, or t
  Promoter: Source sequence=SeqID_20287; Location=968..1581; Strand=-; Gene=SeqID_85085
tgatctanaataataaaataaattatttaattttttgaatatttcaaaataatatttgtgaaaaagcgcagcggaaaattaagtgttttttagtgctaaagtcatttataaataaatgttcagagaagtgttttttgttcctctcatataataaaataatgcaaaaatatataaaaattcaaataaattgttcgaatttgaattttagaagttttcttatgaaatttttacttttctttttggacaaagcgaaaggaccgacgaaaatggcactgccgaggccccaccatcccccaaatggcactgacgatttttttttatttttacattgaaaatccacgcactaccagccaacatttattaacgtgtcactatgtgtaagcataaattgccaataaatataaagccatatttccgtttgcttccctaatatggtattagttgccttaagaaaatattaacaaaatttaatagacaaacggaagcaataaaaattaataattaaataattaaacgcgtttaaaagcataaattaattttattgccaattttcctttcaaagcgaacatttatttccaattgcttaattcttttaattgctgaattgccaaatg

SEQ ID NO: 112454 - DNA, 61 bp, Heterodera glycines
  Promoter: Source sequence=SeqID_30387; Location=117..177; Strand=-; Gene=SeqID_60800
tattcgtaaacactgctgggcttcgtagcaacgatttgcatcggtacaaaagcacaaaatg

SEQ ID NO: 112455 - DNA, 301 bp, Heterodera glycines
  Promoter: Source sequence=SeqID_15251; Location=252..552; Strand=+; Gene=SeqID_79457
ggtgattatcacggggcatttaattcgttttctgcgttttttttgtcccatttttaggcattttctaacgcttattctccggttactttttgcattcactttcggctgtcttctccaattgacttcgctgtgccatttgatcggatcaatgaactgactggagagaaattgatacttggacaattagcaaatgattgttgcctcttccgttgtccaattgcatgggacaggagaaagtggaaaaatgtgtgggaagaaatgattgctcgaacgaacccaattgacattgtgatcagcgatg

SEQ ID NO: 112456 - DNA, 815 bp, Heterodera glycines
  Promoter: Source sequence=SeqID_23350; Location=1..815; Strand=+; Gene=SeqID_54061
tgaaaatcggcgcgagagtgaaagaatcgggagggaagaaggggatctattactctttgattgatattgtcagcctttaaatctataaataaacttgttaattttttcaaataaaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaatagccaaaaattatcggcaagaaattgggcatatttatcggaccgcttactcgcagccagatttaggtattggagatttggcaaataaactaaaagaaacaatgcgcgaaaaccaaatacggtttgaaaggcaaagacctcaggaagaatttagggatgaatgggtgacaacaagaaatcgttgatgatgctaagaaaaatccgagactccaaactgaatttagagatgaatttattgtttgtaaactataaataggatcaagaaaaaaataccaattaaataaaaatg

SEQ ID NO: 112457 - DNA, 83 bp, Heterodera glycines
  misc_feature (19)..(19): n is a, c, g, or t
  Promoter: Source sequence=SeqID_35261; Location=1..83; Strand=+; Gene= SeqID_64851
gagaggttaaggatggatntagtgaaatattgttaaaagcgaattagtaaattaagcatttggagcccatttctgcagcaatg

SEQ ID NO: 112458 - DNA, 600 bp, Heterodera glycines
  Promoter: Source sequence=SeqID_12211; Location=597..1196; Strand=+; Gene=SeqID_75790
ttttcaaataatgccctaaaagggagaaaaatcattgaaaaagccaaagaaaataaaggaaaagcccagaggggaagcgagcggataaaaggcaaagtgatcggattaaaagaaatagcaaaatgatcagaggaaaaacgagcgggtaaataggcaaagtgatcggaggaaaagcgagcgaataaataggcaaagtgattggaggaaaatagacgggtgaacggagacgacggcgtaattcgttcccgccattagcaaaaacggaagtgatcgctgggaaagagagtgatcagcagagccaaagggacaaaagtgaactccgaacgattctcatcattcgaagcacataaattggcctttacacttcgcttttcccacgccatcgccgacattcccccgacgattggcgagattagccattttcacagcaaagccgagaaaaagtgttcgctcaccgccgccccattcgcaatttctttttaaataaacgcccattcggccgatcgaagggacttttgtttcgccattcgtttcattttaattgaaatttaatttaataaaaatttaattttatttaatttcagtcatttgcccggcatg

SEQ ID NO: 112459 - DNA, 222 bp, Heterodera glycines
  Promoter: Source sequence=SeqID_40959; Location=849..1070; Strand=-; Gene=SeqID_69181
atttcggtttttttgctaattttaattggggacattttgactgattttagcttgggggacattatgacgtggggacattataaaagtatatataagacaattgtgagcttttatcactttattttcattagatttgtattcgttcaatctttttcaaaatattagtctatgccaatttttcatagcatatatactttaggagcaaacctatttatcaaaatg

SEQ ID NO: 112460 - DNA, 267 bp, Heterodera glycines
  Promoter: Source sequence=SeqID_4926; Location=3512..3778; Strand=+; Gene=SeqID_56230
tttttgcaaattaatctagaattaattaatataaaattttaaaacgaataagtccttttctagaaaaaaaaactgcaaaataattttgcgaagatgattaatgaaaaaaaaagaaattcaagcgctatttataacagtcatgaatataggttaagtaaataataacaagtataaaatcagattttcattcattttaagtcactttaatattaataaaataaaattgcattttcaattcctgatttttaaaataattttttgataatg

SEQ ID NO: 112461 - DNA, 163 bp, Heterodera glycines
  misc_feature (32)..(32): n is a, c, g, or t
  Promoter: Source sequence=SeqID_32289; Location=1917..2079; Strand=-; Gene=SeqID_62598
gagggtaaacgatccccttactacacaccctnagggtcaaagttttaatcgaattttgggtgtttttttatgtgcattctgctgattacatacccctgaaatttggtagtttcagcgtaactcgaactcgacccgcccttcctcgtcccatcatgcacaaatg

SEQ ID NO: 112462 - DNA, 712 bp, Heterodera glycines
  Promoter: Source sequence=SeqID_25456; Location=344..1055; Strand=+; Gene=SeqID_56187
agtgtgcagcaacagttgctgttaatgaccgttaattaattaattaattatcaaccgggcacagcgcctaatctgtttggcgtgtcacagctatagccctaggaattggacggaaaacaattgccgtgagttatatttggttcctcaccatgccataaacgcaaaaatttaatcattaaggataagaggaaaattaattttaaaaaagtttggcaaaaaataaattaatttaaattgactggaaaactatatggttataaaaagtggtttcgatcacttattactcaaactcatagctaaattttggtacattaaaaagaaaataaaaatattttttaaatcattaaaaaatgaatgagtcaagcatattgtatttataatttataatttatttattttaacttaaaattttaatatgaatattaagtattttgaccaattttaagtaatcaattttttaaagaatttgttttttaatctttaacaatattccatactgtactttagctggctggccattttcctgtgacttgtcgctaattaattaattaattaaaggtaaacatatccaagggatctgcccttcacttttctctaacattttcagaacaaatttgtaatctttttttttctccggaggtcatttggtctttatatcccactcattaatgagtcattcattaatggtcgaccgttgtacaaattcgacatg

SEQ ID NO: 112463 - DNA, 91 bp, Heterodera glycines
  Promoter: Source sequence=SeqID_936; Location=443..533; Strand=+; Gene=SeqID_64513
tttcgaccaattccgaataccggatccgaaatcgaacaaaaaaaaatagaaaatttaacttttagaattttatatctttagtctaaaaatg

SEQ ID NO: 112464 - DNA, 1003 bp, Heterodera glycines
  Promoter: Source sequence=SeqID_11105; Location=500..1502; Strand=+; Gene=SeqID_74435
ttttttgtggttctttgggccaatgattctgaatttgaagttgattgcgtccattacgaattccaggccctaattcgaaccaaaaccaatttttaccaaaacgattgcacttttttcttcatttttatgataattttctgatttaacccacatcgttgtaatcacttttttcttgaaaaaatttatataaatttttaaattttgttcgaattagggagagtttgtaatggactaatggacttcaattcctgatcattgtcccaaaaccccaaaaaatttttagaaaaatccgagaacctcgagcataataatttatttgaattcccgaaaaaaagtctttatttaatgaatcgaattttctaataataaatatacatatcacaaaaaatggatctcttcgcattgaggtattttatacaattatttgaatctttgaaaagaagctgaaaattttaaaaatgcaacaccagagcgctttaaaaataatgaatacaaagcaaaaaaaattattacagacataaattagttgataatattaaattaaaaaataaattaaaaagaaagtacaataaatttctttttccgttgtcaatcaattgtttgagtgttgcatttatagttttaataaaattattaaagaaagaacgaaaaagccttaaaaactttaaagatttcgttactttaataaaaacctatgtgaacaattcaaacaaattaaaaataaattgcaactaatgtttataagttgggcgcgcacggttgggcgctcacggttgggtgcgcacggttgggcgccagcacgtttggacgccggcacatttgggcgccaatattccaacaatttttttaaatttgtttttttttatttaaaaatgttttaaagcgaccataaattccaatttttatgttttaaaatttattaaaaggatataagtaaatattattccgtacggatgcagcagcaaattgaccaaaagaaataggccaaagctagagcacgatg

SEQ ID NO: 112465 - DNA, 236 bp, Heterodera glycines
  Promoter: Source sequence=SeqID_10615; Location=2368..2603; Strand=-; Gene=SeqID_73846
gatgctcataattttctagtatttacttttaaaacataggcatttttggtttaaaatggttccatctaaggcgcagaaaatgaatgttaggaatttgacgattttcatatacattcccgagacccggaaaaaacatttttttcgatttcgaattttgatttaaatgcatttcgtaatttttggttgtttttagtgtcaccgaatcaaaaatttagataatcatgttcagtgtgatg

SEQ ID NO: 112466 - DNA, 379 bp, Heterodera glycines
  Promoter: Source sequence=SeqID_38673; Location=558..936; Strand=+; Gene=SeqID_67417
ttattaagaccaaaaaatacaaaaatttaattattttaattttgtcatattttatttaatatttttttaaatttcccttgttattttttattacattctttgattcattgttttcgaatatttgcagacattgcaaattaaaataaggaaaaggctaatatgacgaacccctctactcactccaatgaaatcgacacaacaattagcagaaacaacaatgattttgtagtggatgattgcttcgcggacgacgatttgcttacaccgacagagggtcttttacaattagtcttaatgacggaatttacttttacaattttcatttttaaattaagctgatggttctttttccttcaaaaatattccttctactgaaatg

SEQ ID NO: 112467 - DNA, 332 bp, Heterodera glycines
  Promoter: Source sequence=SeqID_16749; Location=1988..2319; Strand=-; Gene=SeqID_47392
ttaaaattatatacgctataagccaaattttgtagcattttttgacagaaagacaaaattttgtgcatttttgggggactgaaaaataaattttatgcatttttgggtctgaaaattttgcgggaattatgtcgtccgtggtaacgataggcgttgtcggtggcaattttgcaaaatttaacgaaatttggtaagaaattgaaccaaaaaatgctatttccaatgtttctccctcaaaaattttaacaaattgcgtaaaacctaacctataaaaaagtttcactacggtgctgtcaaagaaattttttaattagattttcccctgaaaaatg

SEQ ID NO: 112468 - DNA, 162 bp, Heterodera glycines
  Promoter: Source sequence=SeqID_6678; Location=511..672; Strand=-; Gene=SeqID_62461
tattattcatcaacagctgtgtcttctcctcgactaagtgcctttgccaaacgaaagaaagtatttgcaagggtttgaggcaaaagtttgagggatacggaggaaatgtgtttaattggtggaggggggggggggaaggggagggggaagtgtaggacgatg

SEQ ID NO: 112469 - DNA, 129 bp, Heterodera glycines
  Promoter: Source sequence=SeqID_6311; Location=1..129; Strand=+; Gene= SeqID_61105
ttaatgaattgatggaaccgaacaatggattttatgccttctatggggacaaaataccagtgacaatcaattttgctgtgggcgaagcaaaagtggataaatccatttctgattcaagcaaatcctatg

SEQ ID NO: 112470 - DNA, 342 bp, Heterodera glycines
  Promoter: Source sequence=SeqID_15734; Location=596..937; Strand=-; Gene=SeqID_80060
ttaattgtcaaattggatcagaaagaaaaattgccttcaagtcctttgccgaaatatttaggagaaaaatggcaagccttccaagacgaaaaacgaaatgaactcaaaaaaagagaaataattggaaaatattataaaataaaagagaaaataaagcaaaaaggaagaaaatactcaacaaaagaatggcataaaatcaatgcgaatatagcgaaaaaattgggcacaaatcgaagtaaaatttatgaatggatcaaagaatttggtcttcaaaaaaataaatgtcataaatcaaaaagtgatgaagaaaaatttaaaattgtgcagaaatttattgaaatg

SEQ ID NO: 112471 - DNA, 67 bp, Heterodera glycines
  Promoter: Source sequence=SeqID_40196; Location=1..67; Strand=+; Gene= SeqID_68601
aattccttttgcaaagcgttaatttcacaattaaagaatttggaccttcgggtgatatgtgaaaatg

SEQ ID NO: 112472 - DNA, 719 bp, Heterodera glycines
  misc_feature (26)..(26): n is a, c, g, or t
  Promoter: Source sequence=SeqID_11750; Location=1615..2333; Strand=-; Gene=SeqID_75243
aaaaaaaaagatcaattttattattntggcaaaattccttggtaacatttttctatttcattaaaatggttttcattacaaatatattttttaaaagtgttagtgtttaattataattataatataagatttatttcatttaaaaattattatagtaatcatcgcttttagtgcgtatgataattccccaaaaatagcattgatcagcttttatagtatttaattaatgtgcgcaaaatacaaatgtataaaagttatgaatatgtgataagcagaagggattcccagtttggtctcggatttattacacatttaaaagcgaactttgattatttttcattccgaaaatgtcagagttaatgaggaaaaattgggtttttgaaaaaatttgcttaataaaaaactatacaaattgctaaatttgaaaaaaagcattgatttttttaaaacactggataacattaatttttttaaagcattataagcagtaaacattgattttttaaaattctaattttcattcatttttctgggctttccttattcccgataaattattaattttattttctatataatcaatgttatgtttaaatatatattaaatatttttcagtctctttctctttattaaaataataacataatgtctttttcatggtttactcagcgcttcccatttttatcaaataataattttataaaaattttagagcatg

SEQ ID NO: 112473 - DNA, 776 bp, Heterodera glycines
  Promoter: Source sequence=SeqID_6766; Location=626..1401; Strand=+; Gene=SeqID_62815
agcggtgaaagccccggcgggtgccaatcgcaaaaccccaaaaatccggcattttttggaaaatttatcaataaaaatgcactaaaacgaaaatttctcctctaagaatcgactttaaaaatatttaaaaagacacccttaaaaatcggcccaaaaattttcacaatatactcctatgaaatgaaaaaattttctcaaaattcactttcttggcaaatttttaattttaaaaattattttttaggtaaattattttgggttttttgaccttaaaatcccagtcctactcatttgcatctgcaacaagtgaataaaaattatttttgctcaatttttggctaaaaattatgtcactattcgtcactatttcgcactttttgccactattttgtcactattttggaagtagtcactattttagttaactattttgagatttctcgtcactaataaaagtcgcggccctacttatcacattatccgctgtaatcggcacactgagaaaaagccggctaaatgattttttggaaatgaatttaattagggaatgaattttattacacaaaaaattaaaaacatattcacaaaaagagttgactattttagaaatttttaatttttcttctctctgatattttgacaaaataaaaaattataaatttttgtttttaaataaatttattaattctgataaaatttagtaccctaattttttaaataatttccccccccccctcccctcagtttacatttgctttttgctctgtgccgagatg

SEQ ID NO: 112474 - DNA, 741 bp, Heterodera glycines
  Promoter: Source sequence=SeqID_154; Location=2239..2979; Strand=+; Gene=SeqID_75373
gctgaataaaaaaaaatttttttttgcgttcaaaatttttttgttaaaagggagggatccggcggtagcacgagagacgaggtgctcctgcccacccccgccccctccctcctcgttcgtcgtagggggccggtttaaaagaggggggagtcgccggtgaagggggggggggggaagtagaaatttaacagattttcaccaaaaatggttattttttcaatttcgaaaaaatgcatgcatttttaaggaaagtttaagcaaaaaaattctatttcagtgataaaccgtctcggctattcgcttccagtcatccctgtcagagccatcgccgacgcatttcgaaaaaaaagtaattccgccgctttgccgcctatgcacatccggagttttgccttcaattgtcttcgtgtgtagctgggcgcttcggtgtagtgcaccgcgccctcatttccctcggcatctttgacaatggtaatctgtttaattataataattaatcctcaaaaaataaatccactttttttgaaaccccaatttatggcgccaatggcatgcccgggcggggccgagaccttcgataatttttcaaaaaatcgagtttaattttgaaaaaaattttcagacagtttatagttttggtaaactctcaaaaaaaacatttcttttccttcccatttaaaaaaaagaaaccttgataaatttgtcgatgcattccatcagcttccacaagaaccaaagatg

SEQ ID NO: 112475 - DNA, 220 bp, Heterodera glycines
  Promoter: Source sequence=SeqID_33256; Location=660..879; Strand=-; Gene=SeqID_63374
gaagaggatcagaaaggggaacagaaagtggaagagaaagtggaagaggaacagaaagagaaagcggaaaaggaacagaaaggggaagaggaagtggaagaggaccagaaagtggatgaggaccagaaagtggaagagaaagtggaagagaaatggaagaggaacagaaagagaaagcggaagaggaacagaaaggggaacagaaagtggaagagaaatg

SEQ ID NO: 112476 - DNA, 1003 bp, Heterodera glycines
  Promoter: Source sequence=SeqID_35118; Location=128..1130; Strand=+; Gene=SeqID_64750
tcattaaaaaacgaaaaaaaaataatggaaataaaagcgctaattaatatttaatattttaaaacaattttgctacaattttcagaaatagaatcatttaaaaattatttttttggcatattccgttatcccctaaaaacttttttcaaattttgctggactaatttaatgcgctgaaaatgaacccggctttgtttttttgattcgatccagcttcattcgcctgagatgcattaactcttaagtggaaacttaaaactggtttttgagcgcatgattaaaataagcttaatgtaggtctaattaccaacgagaaatgtgaattttgaaaatatttaaaaggttttcagttaatttatgtatttaagtgtgccattaattgagtctcaaaaatccttaaatttatggcacagttgagagaaaagacgagaattggatgactctttcttgaacattttgcatcaaagttggtaatagattttccagatctattctagtaaatttgaggtgtggtcaagaaaaaagagagtttttggcaaaatcattttaaaaatttttacattttaggatcgttattctttttttttataaatttgatgcatattcctcgaaataattttctttatttcaaaatttaagctgaataaacattaaaattaaaaacgttttgatcactaaactgaaaaaatgccaaatcttcggtataaatttttttaaattgtcatattcgaaaatcaatggttaataaaaattcatttgttttaggaatttgatgacttccacaatttcactatttacctgaacaaataataaaattcaaatttttgatgattaaactgaaaaagtgccaaattttcggtgattctgtttgctcatctgctgtcatactttcttttttgtactggtctcacaaactacagtcaaaagttggcatatttaagtcagaatttgccaatcccttcaccaattcctctgtttaaagcccttttacaaatcggaaatg

SEQ ID NO: 112477 - DNA, 553 bp, Heterodera glycines
  Promoter: Source sequence=SeqID_24296; Location=1488..2040; Strand=-; Gene=SeqID_55017
atttattggtaaattattattttttcgttttttattaaatatttatttttgcgttatcattccttttcttttccctccctccccaatttgtctttggcctatcgatcccatcgcccctccctctctcctctctctccccctcccgtggctgacaaatgagaaataataaaatatgactgacattttttgtctgtccgatgttaaggccattctttcgattcttttttcaatttgactatgccatcgaagctcaagaattgttcttttgcatctcattaaaaagcgaatggctgaagaaaaaagaattgaaaggacaaagaaaattaaaacaaagcgttaattaaaaatggcaaattggtaattcaattcagagagaataatttgcgaagtcggaggaataaaggccttaattaaacacgaaagagcaaaaggacattaaaattcattccgctgacttttcttaggctctgatgaagggataatcgtttttttggtcattaattaattgttggttcggtctgtcgtcacaattaactcacccaaagaagcgatg

SEQ ID NO: 112478 - DNA, 117 bp, Heterodera glycines
  Promoter: Source sequence=SeqID_43785; Location=1206..1322; Strand=-; Gene=SeqID_71375
tcaaaatagatgtatgattcgtgatcaaggaccttaaaatcaaaagggtcaacgcaataaaatttcgtttgccacaatatagtgatcattgtcagatcgttttttaggtgtttaatg

SEQ ID NO: 112479 - DNA, 1003 bp, Heterodera glycines
  Promoter: Source sequence=SeqID_1380; Location=1829..2831; Strand=-; Gene=SeqID_73172
aggtcataactttttttaaacttaaagaattttttaaaaattttgcaggataatagaaaacatttagggctatcgaaaaatatcaatattataaaatttgatccattttagacgaaattatgaataattttctgtcaaaaattattcatttgatggtttttgactaacgtcccagcaccttttgtttgttcatgaaaattgaatgcaccaaaaaaaattcccccacacaaatgaattaatgatttcatcaaattttgtttttcttttttttcaaaagcaaatgcgagaatgaagaaaatatatgtaaagccaaaaataatagaaaaatgaatggggctgatgaattgggcttccaacgaatcggaaattgttgaaaaatcagaccaggattagcactaaaccgaaacgaaaaatttaacgaaacccaaagcaaaatcactgaatttttaatcgcactttaatttattccttttccctcagatgtaaatttgggttgttttacgaaaaaatgcatggcattccaaaattccctttttataaacaggagaaataatcaatttagtctttttagagcaaattttggaactttttcatctaaccatgttttattacattattactagggttataaattatatggactaaaaacggtgaaatgtgatttcgacagttccgagaaatttaaaaaaaacttacatgaatatgaaaagtatacttgaaattttttaatttaagaactgaaaaattctgcattgaataattttgttattatatttttaatatatttttaatttcttttgtttggaaaaaaatgtgcaatattgccataaagtttgattttgccaatacatttcttttattttaaaatctgttgtttaataacacttttatttctgcaaatttttttcatacataggtaaaattgaaaaatggctttaatgcgcttttactagaccaaatcttcgcgggtaaaattttactttctcgttgcgggttgattatg

SEQ ID NO: 112480 - DNA, 113 bp, Heterodera glycines
  Promoter: Source sequence=SeqID_14725; Location=2915..3027; Strand=+; Gene=SeqID_78852
agccaaagatcattaaatcaagactagtcaaagttggtattaaaacattaaaaggtgaaatagagtacataacactacaaacagtagaaaaaattactgatgtcacaaaaatg

SEQ ID NO: 112481 - DNA, 584 bp, Heterodera glycines
  Promoter: Source sequence=SeqID_15303; Location=2168..2751; Strand=+; Gene=SeqID_79538
tagaatttttttaggattttttttggaaaatactgaatttctattaaattgatcagccttaaaatataaatggttttttattattattgatgctgtttggacatggctagacgtaagtattaaaaaggattgtggattatgactctttttgactccacataatgaaggatctcaagaattttaagataaaatcttatcttacgatgccaaaggttccataatttagtggatttaagaaatgttatggcaatattcgattgaaaaagcctagtgtttagagatatttcctgccaatattgagaaatataaatttttttaatttcttttccataaaaatatgatggttttgggcagcaatttctttttatgctattaatttgccatctttttacaacgcagcatattgattacgtaatgacaaggcattaaatttgcagttttcgaaaggtttttagcccgcttttcatgcgttatacgaaaagtgtttttgtttttgctgaatgagtacgagtgccgagttacatcgtgccaacttttttttagtgaataaataaataaatatttatttccacttaattcgaatg

SEQ ID NO: 112482 - DNA, 682 bp, Heterodera glycines
  Promoter: Source sequence=SeqID_13500; Location=1343..2024; Strand=-; Gene=SeqID_77398
aaaaaatataaatatgaagcgtgcccccaaatcacaatgttcatctccctcccccaaaaaatctcaaacaattaaatgcattcgtaaaattgaccaatttcttccaaaagtcttaaacatcattttatccgttccaaatctaaatttgttattgatcaaattgaaaaatgtgcagatccacaggctgaattacgttcatgcgtgcacaaggtggtcgaggaggctattcaagacgcacagaacacacttggaggagcaaataaggtaggtgtcataatttcttcggaacttttagaccagggagacatcatcatgcctataactccaattacatcaaatgtcgtggacaccatttttaaccagttttgtaaagtggagcagagcaagtccaaacacgtcaacttatatggggccccttttgttgtcaccgtaactgttctaaacactgaaggcctaccacgacgacgaacaaccaaaggaagtgcccctccaattcactcttcccaatcacacattttcaaaattaacaacaacgacaactattgccttttttatgcactggaactgatgcgctactactcattatatatcaggggagtaatttcaaggaaacaatttagatggctcaaagataatcaaacaactgttcttcgtcaaaaagtactacttttactccgcgatg

SEQ ID NO: 112483 - DNA, 155 bp, Heterodera glycines
  Promoter: Source sequence=SeqID_22735; Location=1779..1933; Strand=-; Gene=SeqID_53428
tgtgagaagcagaaaatgggaaataattaaatgaattttaatttgacaaaaattttaaaaaattcaattttttataaagattcaagcaatttaattaccatttttcaagttctggcaaaaagaaaaaggacaaaaaagccaacaaaaatgtgatg

SEQ ID NO: 112484 - DNA, 377 bp, Heterodera glycines
  Promoter: Source sequence=SeqID_7536; Location=3212..3588; Strand=-; Gene=SeqID_65151
acaaaaataaataaattatttgattagccaaaaagtacaatatcccctctctggtcggctcatcttcgcaaattccaatttccgaattgcgcaatgttttcttcgcttttgcccaggcccgtcttctcgacttgaaagtgggtaggaaaaattgaaaaatgcgaaagaattaaaaatttgctatttttaactattttgtcggtttacattttccagttaaataaaatacataataaactgtttagagtggtttttttgaatgattaaactcaatctcgtgaatttttccgtcttgaatttcgctattatttgcatttctttgcaaatattttcctacactaaaatttttacaaaaattttttcgtttatttagaatg

SEQ ID NO: 112485 - DNA, 1003 bp, Heterodera glycines
  Promoter: Source sequence=SeqID_650; Location=5343..6345; Strand=-; Gene=SeqID_58113
ttccgtttttgtcaatgatttttcgtttcccatttaaacattgtccaaccccattgaaggcaaaaaacttcaaaaattgttttaataaaatgtgattttcgtgtttctttcatcaagtacaatccgtaaaaaataggaaaaatctaaaaaaatcagggctctctctattcatttcgtcttagtggtctgtgcgttagtcaccaaaaggggggtctcaggttcgagtcctccttatgttgtgtgttaatttcaatttcttcttttacagaagaaggcagaattattttttcattaataaaagttttcgtgtcaataaaaaatcatattcaaaaagcgttggttacgtacaacatcgacaattttatgaaattttcttagcttataacttggtgaatactagagcaaataaaaccattttatgctcattttgaagggaaaattctggagaatattgtaaattttatttgggttggccttaaattgtggacttggctaaaaaagaattaaaattattgaaatttttactagggtcaaaaaaattttcctcgggtcagattttcttgaaattttgtataggcctatattttgacctcctctagcgattccaagtttattttatggaacttaagtttttaactctagatcggctcttctatttttacaagggaaaatccccaaaaaattttaagttttgcaaagttttggcgttctgattactaaataaataataaacttatttgtacttggagcccaaaattgaatcgccgtgtatacaaaaaatattcaccaattcaaaaaacgcaaaaaaatcaaaaaaaaatcagggctctctctattcatatacaaaaaatattcaccaattcccttttcatgactataaaaatcttttgttttccgctttgactcattaaaaaaataaagcttccaacgaattattattctgctcttttgtgtgacatcattcggaactcgtccaaaattgtgctaattgctgccaaaaatg

SEQ ID NO: 112486 - DNA, 99 bp, Heterodera glycines
  Promoter: Source sequence=SeqID_14595; Location=753..851; Strand=+; Gene=SeqID_78672
ggtaaggggagcattttctaattagatgattagcaaaatgaaacggaaaaaattatattcggcgtttttaccggagtgtgattttaaaatagcgatatg

SEQ ID NO: 112487 - DNA, 713 bp, Heterodera glycines
  Promoter: Source sequence=SeqID_1235; Location=2073..2785; Strand=+; Gene=SeqID_70394
tttggcgggccgttttgatgtaatggcaaggcacacgggcgagagacgtgtcgacggcatcttccgatgagggagagcgaaactgaaggggaaaagacatgcaaaataaacaaaaatagaccttaaattgggaaagtaaaaataataaacaaaattaaaaattggactttagatttggagacaacggctaattgaggatgagacggtgaaggacaatcggacgaaaaataagaagaaagcattaagtgcttgggagaacattggcaaaacaaagaaggaatggcattgaatcgcaaaaaagttgggcgtctcattaactaaagatttttaaaggaaaagggacaattttggtgcctgagcttaaatttgcaaattaacgaattttattaacgaataaaatgaaatgccaataataataattaaaattcaaatttaactttccaaaagcacaaactttaattagtttctgacgatagcagaaatccttttaaattttaaatgatgttaattgctactaataactaaattttagctttttctctgtatgttaatcgacaaaaatcgcctgcggagtgccttttggcgagtgggctttttcaaacgcatttctcgggacgtggccaaatgtttgctgtgccatcagaaaatttcgacaacgaatgggaacaccaccggactgaaaaaccatttgaagagacggcacgcggaatatg

SEQ ID NO: 112488 - DNA, 110 bp, Heterodera glycines; identical to SEQ ID NO: 98226
  Promoter: Source sequence=SeqID_25524; Location=164..273; Strand=-; Gene=SeqID_56264

SEQ ID NO: 112489 - DNA, 672 bp, Heterodera glycines
  Promoter: Source sequence=SeqID_7995; Location=4009..4680; Strand=+; Gene=SeqID_66630
ttgatataattttaataaaaattaaatgtttaaaaatcatattcaaaataaaatttaaaaaaatatccatcatttctcggcatgctaattcattttaggagaaataatttaaaaataaataaatatatgtatttttttgttgcatagctgaaagccgcccctccattttaagcatttggttttttgtaaaaagaaaaaatcaattaaaattactcaaaaaatatatccaaatccgtcgcggtttcacgggggggggggggtcaaaatttggaacacggacccatcataaatttgctcatttgtcaaatgtccttgatcttcggaatggaaaaagggtcgaccgcgaagcgatgacccaaaaaacagaaaaagcaattagaacgctgaaaacggcgataattaagcgattataatgcgccaaatccctaaggctgtccccccggtgggtgcctatttaagcggaacgatttgtcagcaataatcagtttcaaaaggaagaaaaattcggatttaatcctttcgctctttcttttgtcaaatttaaatgatcagacttattttacctgctgtcgaaattacttttccaagatttgcttttaggattaaaaaaacacaaaatgaaccgtctgtctgtctgcaccctcctctgtctgctcattctctccgccaatg

SEQ ID NO: 112490 - DNA, 145 bp, Heterodera glycines
  misc_feature (51)..(51): n is a, c, g, or t
  Promoter: Source sequence=SeqID_13383; Location=3963..4107; Strand=-; Gene=SeqID_77265
gcaattataaaataaatacttaataaaaaagtaaattggtctataaaatgncagaaagcacttatcaaatggagtattattttcgcaaatacacttttgaattcggcaaagtgccagaaacaatgcgaacaatccggggattatg

SEQ ID NO: 112491 - DNA, 308 bp, Heterodera glycines
  Promoter: Source sequence=SeqID_17458; Location=1102..1409; Strand=-; Gene=SeqID_81945
ttttgatcattattgctgatcaaaacagataaataatagatcattgatcattgatcagaaacgaataaaccgatcactaaccaactgatacaatggcatcaaaatcattatctatgatcactgatgatgacgagacaatcaaaatgattactttgttcagcaatctctaatttgatagactctgctgaagacctgatccactagggaaatctctgatcgatcactcactgatcaatcccatgatttgaatgaacaattgtttttgatcagatctggtacagtgcacgtgcctaatgattttcaaaatg

SEQ ID NO: 112492 - DNA, 136 bp, Heterodera glycines
  Promoter: Source sequence=SeqID_37367; Location=1..136; Strand=+; Gene=SeqID_66455
taataataaaaaattttttttaattttttttgaaccccaattaaaaaagggaaaaaaaattccagtcaaaaaatttaattggaatttctccaattttgtttcccataatttcagagggtgggtgggtatcataatg

SEQ ID NO: 112493 - DNA, 1003 bp, Heterodera glycines
  Promoter: Source sequence=SeqID_28697; Location=166..1168; Strand=+; Gene=SeqID_59279
cggcaggttcgaatccggccggtgtaacattatttttctgtgcatttttacattattttcaatgattttaattaatttaaaatattttgttgagttaataaataaaaaaatttttacattaaagaatttaattatttattttttgaatttgtaaatttcatcttaaattattaaatattcaattgttaattttcaacgttattttcaattaataaatggaggatttaaaaatactacaaaagtccgcaattttttgctctataagataaattttaattcatatttttgtcaccttcttacaaattgctataaaaataaaagtgattttgtgctttgggtccaaaggggggtgcacatggtttttaagtggaaattttttttcaccaaaaatcctccaaaaatatgtctttaggggttatttgggccgctgatcacgaatacgtgatcagattttacttctgacatggttaagacctcaagaatccctgtgtgattggggattctgagacatcatttttggggagggtggcgaagttcgagtccggacggtgtaaattattttctttgtattttttgctgtttctacatattttaattaattgaaaatattttgtgttttattcgttaataatttataaatgttttacatttaaaatagttatatatatatatatctttttaaattaagttagtaccaattttttgaaaatttcaaacaaaatgacaaaaatcttctgattaagaatatttttttggatttttcgaatccggaattggtcgaaatagattcagaatgcggggggggggggagaaatttaatacatccaccaaaaacaaaatagtaataaatcgaaatttttgccgaggtttcaaaaaaaaattttttttttgtagttgaatttttcgtctggcactgacaacagctccaccggcgccgccactgcctcttcactgaacagttcaaattcatcaacaacaacaacaaaaacaagcgccaatgatg

SEQ ID NO: 112494 - DNA, 115 bp, Heterodera glycines
  Promoter: Source sequence=SeqID_1255; Location=1288..1402; Strand=-; Gene=SeqID_70873
tcatactatttgaaatttatgccccattttttgttcccccctgaattgtttgttttgccagcgcggttttaattaaatttgtatctgaaagccgacggacggatctcttctcatg

SEQ ID NO: 112495 - DNA, 828 bp, Heterodera glycines
  Promoter: Source sequence=SeqID_3359; Location=2250..3077; Strand=+; Gene=SeqID_84356
tttcgccgacagcgcttcacagcaccgtcggaccaatttttaaatttgaataatgtttcaaaacggaatttttcaacactaagaaatgatctgaaaaaattttcagaaaatgcgccaccacctatgaattgaaaaatcttctcaaaaattgtcgacaaaatttcatttttcttgataaaaagttttatgtttgaaaattgtcattgttagaaaaacattatataaaaatatttataatatttatttaaatgatcaaaattgtttttttttggtagagtttttctcgtatagccctaaaaacccttaataacaagctgtaaatgcttttttcacgtatttttcggaatttagttccttttcatgctttttttcaattttttttgccaactaattgtaccactttcgcgatttggggcctttttgtttgcgagtcctaataataaacaatgattaattttactcaaaatttattttcgatcagcgatatgctatctcatgggcgtggctttacaaaaaaaaatggcatttaaaagaaagccacgcatttattttcatttcattattcttaaattttatgcatatctaatttcactagttttaatttttaattttgtcaaccgctaaattaattaaatacatatctaatttcactattttaaaattttcaaccgctaaaattaattaattaatttaagtttcaaatttatttgtttttcagataacccttcctattcaatttgtttaattttctatgatgtctttatcgcgtttccagtttgaaacgtctgccattggccaaaaacgtacgagcgagggggttccaaaatg

SEQ ID NO: 112496 - DNA, 58 bp, Heterodera glycines
  Promoter: Source sequence=SeqID_40511; Location=1113..1170; Strand=-; Gene=SeqID_68820
ggtgggctgagggcatcggaccgtgggaataaacttttgccattttcaggtcgaaatg

SEQ ID NO: 112497 - DNA, 285 bp, Heterodera glycines
  Promoter: Source sequence=SeqID_4186; Location=612..896; Strand=-; Gene=SeqID_53511
ggttgttgcctcgtgtaattgttgtcgtttttcctaaacattatacctatgtggatagaatccgatctaccaaaatcttatggtgcctttgttgattttcgtttccatataatgtcttacaatgagttgaattcattgttttttggaattaagacaaaacgacaataataatagtgaaacaacccattatgttttgcttaaatgggaaaatttttattaaataaaatcttccaaatttaatatggaacattgtttttaatacgttttccagcggttctttggatg

SEQ ID NO: 112498 - DNA, 124 bp, Heterodera glycines
  Promoter: Source sequence=SeqID_21469; Location=621..744; Strand=-; Gene=SeqID_52078
tttccgtcgcttcgcatttttcctctaaaatcgccgccgtccatcccccgtggaatttggcgcagctgaacttgtaaaagcgttcatttccgtcaaaggcggagctgaagcgcgagaggaaatg

SEQ ID NO: 112499 - DNA, 477 bp, Heterodera glycines
  Promoter: Source sequence=SeqID_19708; Location=1..477; Strand=+; Gene=SeqID_84454
taataaataatattccaattttaaaaaatgaagaaggcgatcagttagagaccttggcatttatttttcaaataacttaaaatgggaaaaacatatagaatttattactaaaaaagcaataagaacatcttttgctttactcaagtcacttaaaactaaaagcccaaaaattctcataaatatattcaatgttattgtcgatccattttggaatttggttctccgatttttaatccatatatgaaaaaagacattgatgctcttgaaaatgttcaaaaaacatttttacgtattgtttttagacgtaataataataaggatccgggtataacgaactcctccaactctttaaacaagaatccctcttaaaacgcagaataaaaatagatttaaaactcttccatgatataattttggaaaagatccatattcagcataatgattccttttcaaaaacatattcagaactgaaaaatg

SEQ ID NO: 112500 - DNA, 163 bp, Heterodera glycines
  Promoter: Source sequence=SeqID_33571; Location=577..739; Strand=-; Gene=SeqID_63592
ggggggggggggttgccagcaaaaataatttcagggggtagaaattgttaccttcgcaagttactgcgatcattcatttttacaataaaaataaactcaattctgctgctcacagatcacacgaccgactgatatcaaatcgttgcgcgttgctgaaattatg

SEQ ID NO: 112501 - DNA, 1003 bp, Heterodera glycines
  Promoter: Source sequence=SeqID_1200; Location=344..1346; Strand=+; Gene=SeqID_69787
cataaaaccgactagaaccaataaaaattcaaattctttcaaatgtctttttcaaaatcaggcatagcaaagttaataatttgtcatgattagagaccgcattttgaggcaaatgccttttttttctgcgcactactttcgatatattaagcataaataacgcattttccacttggtttgaggcttctacgttgacttttattatgccttttttttgcctttttcgggattttcgtgctttaaatgccttttttggcattttgccgttttcatgccttttttagcgttttttccgaaaaattccataaaaaatgcaataaaatcgggaaaatacacccctaagaaatgacttggaataattttagaaaatacacccctaagaattgaaaaaatttcagaaaatacacccctaagaattaaaaattttcttaaaaattgatcgccaaaattttatcttttttctttaaaaaatttttgatttaaaatttgttcttttggaaaaacattataaaacattaataatctttaaaaatgaccaaaattaagttcttttgttaagttttacgtgtttttgctcactaaaaaccttagaaaaattttttttatgccttttttcatgcctttttcgggattttcgtgccttttcatgcctttttttcaattttttggtgcctattatagtgcctttttcgggatttttgttgcctttttttgcggtctctagtcatgatacattctttgtatgtgtgtggtatatacagcaaaatgaatgaccgtaaaaattacagggaggcatactcaagaaaatgtggaagatcagttttttggacgcagtgtttggtgggggaacgaagtgtttgttgacttgggaatggcagtgctttttttggggggggggagagactcatttcatcacaactgttgctgctgctgttgttgtggtgcttgttgctgctgctgttgctgacagtgactcatcagatgggcgaacaccgcgcgaatg

SEQ ID NO: 112502 - DNA, 350 bp, Heterodera glycines
  Promoter: Source sequence=SeqID_13459; Location=1012..1361; Strand=-; Gene=SeqID_47128
tttttattttcatttttcgcccatttgtttgcccctccggcgaatttccaacggccgaactttttttgtgtcatcgccgcgtacctttataaaggggaggagaagtgggagaaggacaacaatttagttgcaattcaatcaacgcagcagcagaagaaaaaacaaaagtgagtgagacaaatctttgaaattcaaatggaataatttaaaatattttttaaattttaatttcaatcccaatttttttgattttttgagctagacaaaaaaaacattcgaaatgcaattattaaatataattatttatattcaaatttcaattccagtctaaatttctgtctatgtagatg

SEQ ID NO: 112503 - DNA, 287 bp, Heterodera glycines
  Promoter: Source sequence=SeqID_5774; Location=1293..1579; Strand=-; Gene=SeqID_59187
cttctcggatagcttagaatgttcagtccacccgctctttcccatctaagcccgccattctcctctcaacaaaagcctctcatttcaatttcgtaaacggaaaagggagggaagtgagaaaggggggggggggggaggacaaagtggataaatgctccgatgataaagaaatgaacagtttcaccgcccaccgcctgaaatggcattttatggccaattatttgcatttgtttactcaattgacccgaacagattgaaaagtgcaaatgcatcatcattagaagatg

SEQ ID NO: 112504 - DNA, 666 bp, Heterodera glycines
  Promoter: Source sequence=SeqID_21066; Location=1..666; Strand=+; Gene=SeqID_51659
aaaagaaaacatattattaaggagttttgaggttgctgaacacggttatgacatccatttgaccaaattcgaacaccgaaccctgactcgaacaaaaagccgaaatttaattttcgacaaaattcaaaattggatggaccagcggacggctggcggacgggcgacttttctctgattgcttcttgcgcttagatggggtgggaaacgacggctaatggctattcactttttgcgttgagggaaggggattttggatgggagtggacgatgattacgtgatgcgatgagaggaggagagacgaggcgggagggggggggggggatcgttcgtcattagtcaaaatggatgtcagcttcgtgatcaaagaccccccagaaccccaacaaaaacgcttgacgacttttttaaactttggggaacaaactgcactattaccaaaattacaatggggttttccgaatttcagtacttttcgagaatattctggaacaatttacttacataaaacttagactttaagctttcgattaataccaagaatgtatgtcttgagtaagaaaaaagttatggcttaagaaactaagtgtggtcattgattggacgtgtaactgtcgatttagcaaacaactcatcgcacagaacaatttgcaaataaatttctgatg

SEQ ID NO: 112505 - DNA, 613 bp, Heterodera glycines
  Promoter: Source sequence=SeqID_2492; Location=706..1318; Strand=-; Gene=SeqID_80056
accaattgccttcgccggccaccctacagtatcctgcggcactcattgtgaaccgtgacccccatcacaaagggggctcccattggtgtgccatttatgcccgggacttggacgtgcctgtgatttactttgatagccttgcccttcccataccaccaagtatttcatcatcctttttaaataattttcccaaaggtttacacaaaaacattgaagcctaccagtccccattgacatcaacatgtgccccccattgtattgtctttgtttaccacatgtcccatggaaaatcattcgataaatttatacatattctcaaaacttgttcaaaccctgacatgtattcattattaatgctaaataaaatgttgaacagttaaattatattttcaatttcttaattttttcaaaattgtgtcttccacctactaattatgcattattctacctaaaagttacatcttccaacgtttaattattttcgtactttatttcccattcattaattatgcatgcaataaaataaaaaggggcggagcttatccatttgagttggaacaccggtataaaagccgctcgaatttcttcattcaggcataaaaaatctgaaatg

SEQ ID NO: 112506 - DNA, 76 bp, Heterodera glycines
  Promoter: Source sequence=SeqID_9502; Location=204..279; Strand=+; Gene=SeqID_71657
cgtaacgaacggataaaaggcacaaataaacggccaatgctttcctttccccttcagtttgatttcactgcacatg

SEQ ID NO: 112507 - DNA, 706 bp, Heterodera glycines
  Promoter: Source sequence=SeqID_16712; Location=286..991; Strand=-; Gene=SeqID_81113
tgttggagagggaaaagcacgagtgcgtttttgggggaattgcgaaggcgacggcacaaagaattgttgaaaatgccgaaaatttgatttgggctttaagggctttgttggatcgccaactgaaaatggaggtgatcctcagcaacatcgccaacgacccgacctttgatgacgagtcgcgcactcagcaggtagaaacaaagaccaaaatgaaatgccattcagtgttgggcgctgggcaaagtgaactaattactagtaattgctcaaattcgtgccgttttttggggggtttttagactctgctatggttagttgtaacttgttgtttttgatggtctatcgatgctacacccgaaatttttatggaaaattttgtatttttgctgagattttcgattttccttgttcgtacccacccacgccaagacctcccttgtatacggtagtgatgttttggtgggctgatcgcattactgtattaacatttttccaacacgaatttgtcccctacgattgtctctgacccgttattagagcgagctgttgttcaacaacaatgggatatggtgctattgtttatcaattagaccgtaattagtctacggtataatgacgtttgatgagggattgccttactgtacatcatttccaacacgaatttgtgtcccatcattcgtttgccaaaatcaaaaccccaaagatg

SEQ ID NO: 112508 - DNA, 171 bp, Heterodera glycines
  Promoter: Source sequence=SeqID_16379; Location=2173..2343; Strand=-; Gene=SeqID_80772
attaaaatccggtccctattgatcacacatgtctcttctttttaccgtagtatatccgttcgatcacacacgtctctctaacagatttatgcacgagaaacaatactttttttccaattaggcgatgttgacacattgcacactttggtgaaggaacatcatgagctgatg

SEQ ID NO: 112509 - DNA, 213 bp, Heterodera glycines
  Promoter: Source sequence=SeqID_4903; Location=473..685; Strand=+; Gene=SeqID_56149
ggtatgttttaacgaattacaaattctgaatgtgcaaataccattaaaaggcaaagagagggaggcttatttgttgccataattacatttctcccctctctccctccattatcaaatcgtcccattttcggcactgacgtcgactttgaaaagcagcggttgtcttccgtcaacataatcatctgtacgcccggccgtcttttacaacacatg

SEQ ID NO: 112510 - DNA, 128 bp, Heterodera glycines
  Promoter: Source sequence=SeqID_17020; Location=799..926; Strand=-; Gene=SeqID_81439
accgcgtcacactgatcaacgttctcggacgttctcagctcgacccatcttcggaactgatcattttcaacgcggcaaaggcaacgaaattcaattttaaaaattgcgtaattaaacatttaggcatg

SEQ ID NO: 112511 - DNA, 154 bp, Heterodera glycines
  Promoter: Source sequence=SeqID_8147; Location=821..974; Strand=-; Gene=SeqID_67132
ttgctgaaagtcgagaccgactcaaaagtgcttgacaattctcaatttcgattctcgagagtcatcatcatttgtatatatttgttaattaaattaataacccaaaacagactttctgtttataattgtgccgcttttccaccgctttattatg

SEQ ID NO: 112512 - DNA, 112 bp, Heterodera glycines
  Promoter: Source sequence=SeqID_31566; Location=1100..1211; Strand=-; Gene=SeqID_61897
gaagcaaaaattaaactaaggcccgcgttcaagcccaaggccattgtcagcaactccgatcaggcgccatgtgcgtgtccatcaaaaaactgccgacaaagcaacgaacatg

SEQ ID NO: 112513 - DNA, 149 bp, Heterodera glycines
  Promoter: Source sequence=SeqID_22323; Location=1497..1645; Strand=-; Gene=SeqID_53001
cctttttgaggtggttcgctaataatagccacggggtgtccttatttgaggaaatacagtaaatcgctttttattattttacaccaatattttaaacttaatgccaacgtcttcgtttatacaaaaaatgcgtcctcaacctatagatg

SEQ ID NO: 112514 - DNA, 52 bp, Heterodera glycines
  Promoter: Source sequence=SeqID_32851; Location=820..871; Strand=-; Gene=SeqID_63094
ggcaccatgtccagcccgagcagccaaagtccggcaaaatcggccaaaaatg

SEQ ID NO: 112515 - DNA, 135 bp, Heterodera glycines
  Promoter: Source sequence=SeqID_11; Location=2446..2580; Strand=+; Gene=SeqID_69057
ggtggttgtttgtgggacgaagagcacgctgttatccatacagtgagttcactggtcagaattcgaaatccaaacgaccgactgtgtttggcaagagctgttttgattggtctaaaggattatcgttctcgcatg

SEQ ID NO: 112516 - DNA, 127 bp, Heterodera glycines
  Promoter: Source sequence=SeqID_14349; Location=1..127; Strand=+; Gene=SeqID_78378
tttcgatttaatttttttttattcgataatttcctaaaacaaatgttaagcatcattcgtgctaatccaagcaattctaattctaatggtcaaaaaacgttcagcccatcgtcggaacgaaaacatg

SEQ ID NO: 112517 - DNA, 83 bp, Heterodera glycines
  Promoter: Source sequence=SeqID_24121; Location=832..914; Strand=-; Gene=SeqID_54823
ggtaaataaaaatacatatatgttttttaggtttttcggaaaaatcccaaattttagaggaagaatttccgggaggggacatg

SEQ ID NO: 112518 - DNA, 1003 bp, Heterodera glycines
  Promoter: Source sequence=SeqID_2660; Location=7758..8760; Strand=-; Gene=SeqID_80940
aaattttttcttttcctcttttaaaattaattttattattgccaaatttatctttttcttcatttttcccttgtttttttttcatttttctttgatcacaagtactttgcactgtcctttctctccccattttttcattttgttggtttactcggtactaaacccctttaggatatttgttaagccttttcaaatatcctgggggccatccttaaaccgaggagtcctgccccggtactgggttacttcccagaggggtgggcacgggcgttcactgtccacggggcttattccgctggtatccagggctgcggcagtgactgaccgaaaccatgtttccgtcatagcccgccgggtgtcacagcgatgtttaagcctaaccagatagtcggtctggtgtggatgggggcccttcactcgctggccttgagggtgaaggtgtgcctgttcctagcagcgggggtggcggttcctagccctaatgtgccctgcctacgggctgcattggtacagcgagagaataaccgggactggctggcccggaggaccgcgagtcactgagcagtgtcgaacgcgcagctgctcaaactcaacaccccggattaaaatccgcgttgacggaactcatatgtgctgtgggcgttggcgaaaatgctctgtgaagggagtaattacccgacatagagatgcctacaccatacctccgcactttggtatggtagtgccacacactttgagttccatgagcggttccataatcgcttgctatgatagtcatagttggtgggtatgccctccaatgtgatggctttgggccggaaggttaaaaacacgtgtaggggctgacctatgcgcgtttttggctctccaaaaatggcccaaaacatcgctcaggggacgggtcatgcccgatttttttttgatcggccattttctttgacatttttaactaaactcaatggttgaattttctttttttttaaatttaagaaagaaaacaatg

SEQ ID NO: 112519 - DNA, 1003 bp, Heterodera glycines
  Promoter: Source sequence=SeqID_10329; Location=622..1624; Strand=-; Gene=SeqID_73514
aacaaattttggtcaccacctccaaatcaggacaaatcttacaaatcgggacattttcattttatcagatttggaccctccaaatcaggacaactgacaaataggacagaccgacccctggcataaaagttgatctagcaatttccttccagcaaatttgagccaattttagagggcgtgtaaatttacaaaaaaattcatctacacttcccaattttgttttcttcttatatttgtgtgttaggtctatttggcaaaaatttctaagaagatgtgaacaaaaaaattaattaaaccaagttagacagtgcattcattcctcatagtgatctcaaatccaagaatgatggcttgaaggaaatttttagaaaaaaaatttttaaatgaaaatcctaccaattgagcttaataatcgcaaaaaccaacctttttttgttgaaaatctgttaacaaattgcacccaaatttttaaaatttcccccggcggcgcctatcggcaccgccggacccttttcttcccaaaaagttttttggaaaaagcgcgccgaaaaaaagttatgtgaaaagcaaacctgaatttctaataatactcgatcatttagtccaaaattattaattgtttgaaataattgaagaaaatttgtttgaaaattttcattaatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccggtcccgaaaaaaaatcgaggtcccggtcccggtcccggcttctcaggtcccggcagactcaaggatgggaggaatgaaaatatcaatgaaaattaatttataaggccaaatagctatgcttacagaagggattgcattttagttacaatatttaacatttttgctgctttgtttcgctgagaaatg

SEQ ID NO: 112520 - DNA, 1003 bp, Heterodera glycines
  Promoter: Source sequence=SeqID_1326; Location=4442..5444; Strand=-; Gene=SeqID_72564
tcctttttggcttgtccgtcatcagcctaattatctaccaatttcgatcaattctttggctcaaactaaccctgacgcaacagcgcaataggacaaatggacaacaatcaaatcaccaaaattttgacgtcatcaaaaataacgagccccaagtttcttggatgcttcccatgcgatcaattacccaaccctaattcaataaaatttcccgcatcattgattgttaatttggaccctcatcattttccgggctctcattggattgcaatatttgtatacggattagatcagaagaccatttactttgatagtctgtctttgcccattaatgaattggtaattaaatcctttcttaatgcttttcctggaacccattttaaccaaagaccctatcaatcagtttcatcaaattcatgtggacatttttgtatttgttttgtttattttttatcaagcggactaacttttactcaattcctctctaaattgaattcttcgcataatccagaaatgtttgttcaaaattttattcgcaatttcccgataaaatagaaaaaaattcgttttatttgttttatgactcttttttttttttggttccgtcccaaaaaggattgaccataggaaaggaaaggcaaaaattgagtgccgctcagtgccagggaccaatgactgtcgatggggtccctttccttccgaataaatctcggcgagtgttatttgccaaaaaaaaggtaaaaggagcgagcgacctttcccttcaacagcataggcgaatgctgattggctgaaggacaaattcactccagcagaataaaaaataggatgatgatgattggttgaatgaccaatatgaccattcctcttagattaatcgttggaaattagattagtaaatacaatacacaagcaaataaaaatggttttaaaggtttaaaagtgaagaaaaagactaaatattattcatattttggaaaattaatttttaattaaagaaaaaatg

SEQ ID NO: 112521 - DNA, 176 bp, Heterodera glycines
  Promoter: Source sequence=SeqID_20095; Location=294..469; Strand=+; Gene=SeqID_84879
ttcactcgtcggcattttcatcagaaaatctgtttgtacagtccctcagcagcaaacgacgcaattcgcaagcgcaacaatcgaacagtcagctgacggcggtggaaattaacgagaaaaattgtcagcgaatttcctttaccaatggcatttcgacggatggcacgcgattaatg

SEQ ID NO: 112522 - DNA, 174 bp, Heterodera glycines
  Promoter: Source sequence=SeqID_23795; Location=1..174; Strand=+; Gene=SeqID_54496
tttccatttgaatgcattggcgttttgtttataacgccaattattttttggcgttttatttccttttttacagtccatggtcgggaaccacaatcgaaatcacctggtccattttttttacttttaaatccgaagtcgaacttttcgtaaaattatgtcttttttgcctatatg

SEQ ID NO: 112523 - DNA, 146 bp, Heterodera glycines
  Promoter: Source sequence=SeqID_25952; Location=963..1108; Strand=-; Gene=SeqID_56705
tttgtggcctgactttgtttgccaaagattttcactgtttgcgcaaattcgtgccgtcatttctctgcgattgtccaccactgcgtgttgtcaatatcttttatgactatctgtttcccgaattcccggccgatgacagtgccatg

SEQ ID NO: 112524 - DNA, 94 bp, Heterodera glycines; identical to SEQ ID NO: 97954
  Promoter: Source sequence=SeqID_38649; Location=798..891; Strand=-; Gene=SeqID_67399

SEQ ID NO: 112525 - DNA, 1003 bp, Heterodera glycines
  Promoter: Source sequence=SeqID_11569; Location=1204..2206; Strand=+; Gene=SeqID_75013
aacacgtaaaaattttccttggtataaaatcctgaactgacttttatgtgtattaaaatagcgaattttttcgctaatttcactacgtgtagagaagcaagaaaaaaatttccacttgttttgggacttctaagataaaataaaattctccaattgaaacagatcgccttgcatcagcttaccttcactaatttcaattttgggagtatttaatttattgaaaatttaaaaaaaattttttttctttattttgacagttcaatcgggaaatactggtccgcaaatgtcgcactacggtaaaaaatgcttgtaaaatgatcatataattgctattattgctattatggccataaaactctgaaatcacgatttttaaatttaatgattataacaacttgaatatagaacgaatatgcataaagtaactaaatttaatatgttggatagcacacggtagctctaagtattctctatcaaaatttataaatttcaaaaaattttgaaaatttaaaaaagtttattatgggcataaaattcaaaaatcacgatttttggatttatggataataactatacggttagaaaaacaatttaaatcatcaccctatttttattttattaataaaatatatttttaaaattgatttaaaattttttgtattttttcctctgcgattttatcgccttttttaatatttttttcctttttgcattagccaggagtagagatttaaatttataaattgatttacgattttaattatttctggggaccattttaataaaatgtgaattaatggaaaaaaacatttaaaaattaatcattattttacttattattgccaataatttgttcagtagaacaaaatttattaaaatcttaataattttttatttacattaaataatttttttatatttgtaaaagcagaagatttagatttatattatttataaaaataaaaaattaccaaatttatttttagaatttaagaagaaaatg

SEQ ID NO: 112526 - DNA, 123 bp, Heterodera glycines
  Promoter: Source sequence=SeqID_22862; Location=2006..2128; Strand=+; Gene=SeqID_53566
aatgataacaacagaaatggaagaaaaggtcacgtgtgtggtgagcgctactgcaacctctgcaaaaatttccacaatcccgaacgtggctgcttcatccaactgcttgagccaagggaaatg

SEQ ID NO: 112527 - DNA, 465 bp, Heterodera glycines
  Promoter: Source sequence=SeqID_15907; Location=1..465; Strand=+; Gene=SeqID_80252
tttttctggcaattgcgttgacggctgaaccaaatcgcgaggacgtcttgattggcctcgcacttgattttaaaacactaattccttttaataaacttgacttagtttcgggaaaaatttgtgcgtaattctgatagtgtgtccaacaaaccaactttatctggtgtttgtggttgaatgctctcagtgtaacgcttttattcgtccgtcccagtttacttacaatgagttgcactctgctctgctctgacatcggcttaccctcctgttcaacgattgaatttggaattaaactgccaagtgaattgtattttgaaaataaaagcctatgctgactgcgccaatttgttgtgtcgtttatcaacaagaataaatataatcaataaacaaatgaataaagtcagaggtgaagagagagacaaagtgtgtgtggggtgaaatgcaaatgataaatgagaatgaatg

SEQ ID NO: 112528 - DNA, 311 bp, Heterodera glycines
  Promoter: Source sequence=SeqID_20384; Location=1..311; Strand=+; Gene=SeqID_50905
aaaaaggcgaatgcccttattcgagatgcatccgatgagctcttttgtgccttgtcgaaatctgcctaaacattctaaagggccgagtccctttgcgtccccggcatttgaataagctgaaagctcatgcacaggtgcttcgtcgtctcgtccgcacacgctgctcgcgctctgccaaaaaggttttgctacaacacggagatggcctcccagctattgtggggctcattgcgtcaattgctctcccgcttattgctgatgtcattgaaaaatataaatagtttccaaaaaattaaaaacaagaaaaaatg

SEQ ID NO: 112529 - DNA, 734 bp, Heterodera glycines
  Promoter: Source sequence=SeqID_69; Location=13809..14542; Strand=-; Gene=SeqID_61210
ttttggaacgtaaacaacaacgtttttatcatatatatttgttcttaatcttaatatttcttggctctccgggtgcatatctaccaagagatatccaaaattttttgaacacgcgtctcgatatgattccataaagtgggcggtcttagaagggaataaatgtgtagctaatgtcctaatctgaagggcacctgccggattccttaacaaaaccaaataatgagaatttccacgtgcgacacgcaattctttattaaataaattctgcgttaccaaaattacactcatgccccaattgtgtgacccgcgtgtaaatagagaatctaaatatcgactactcaaattcactagcaaatcatctaatattaaaagcaatttttcttttttcgccatggctctaatttgctcttctgacataataccattgtgaacagtgactggcacattgccaattttcccattgcgctgtatatttaaaacatttcgattcagttccccataacaatatatagctctttcaattttaaatgaaatcattttctctaaattttgtaaaagacggattatccactctgacttgccactccctgtgctccccgacacgatcattgtgaatggatgacgaaattgtaattctccatgatcaaatttttgctccatttttaatatttactctaattaattatgatatatatataatatataaattttgaatttagattcatttaaaaatg

SEQ ID NO: 112530 - DNA, 268 bp, Heterodera glycines
  Promoter: Source sequence=SeqID_9918; Location=1..268; Strand=+; Gene= SeqID_72945
cttgggtattgtatttaaaaagaaatgcctattttaattacatttgccaattttaatttaaggagaaaccaacacgcgcaaaaaacggcaaagcggcggattggcacggggagataatgtggtgccgaacaaattcgatctgacactgccaggccagtataaaacactgaaattgttttagccaatcttagaaaatatttaaaaaaatattcagcgttgttaaaaaaattttgagcatattttttagcaatttttacccaaaaatatg

SEQ ID NO: 112531 - DNA, 792 bp, Heterodera glycines
  Promoter: Source sequence=SeqID_10672; Location=1958..2749; Strand=-; Gene=SeqID_73919
ttctttcacaatctttgctaaacttaaaaggataaatgatagctattggattagagaaagattaaagcagggcatttttaaaaggatgtcataaccattggattagagatagattagtagagccctttcaatgtcagaatcaaaaagcaaaggaagtaagtaaactagctacctagatattatagcaattggattagagaaattagtagagcccggcatttctaatgtcaggttcaaacagtaaaggaatgccgggaaaatgataacataataagttgatcctatccagactcaatttggcaacggccgatgaaaacaaaaaccaatttggaaatggtataacaccaaacgcctaaaaaacatggcaaaaaacggagactaacatttagcgaggaaaaatatgtcgctttgattttactttttttaggtttgcctttgtttggcgtaatgtttattgcgatttataaaaaatcaaaaaatcaatatctacagaaattataaatttgggttcaactttaatgcgattcgtaatactaattttgtgttaagtatgtacataatgttttggtatttcccgaatatcaaacacataaaaacctatttttctaaatatatgttctcatttatcgaattttagattaatctccaattttcaattattttacgttgtcatggttttttcaaattctaaatttttcaccttttgaccatttcaatttcctggcccactgctgatccaccaccaccttcacctgctcaaaaaaatcttctcggcacaactttaacggcatg

SEQ ID NO: 112532 - DNA, 749 bp, Heterodera glycines
  Promoter: Source sequence=SeqID_11039; Location=3455..4203; Strand=-; Gene=SeqID_74372
ttgcaacacaaaagtgacgaaaagtagcgccaacaaaaatagcaataattaatgcgcagaaagaaaaatgttccattttctgtatgaaaaagtagtgaggaattaaagtgagatttagcaatgaaatatatttttttggaaaaataatttaaaaagcaaaaaaccaaacgccccaaaataaaactttcgaaaaatggttaaaaatttgataaaattcaaaaaaatttcttgacatggaatatccctgttgtatagaaagaaggcaaaaacaataattttgaaagagaatggaatttcaagaaatgaaaatgaataattatctgcatttagctagtcattctgttttatgatggactacccaatgaataaaattctttccatgtaattgtggcattattcaatgagaattaatgaagaaatagtgagacagagaaaaagagaaaaattggccaattttctttccacgtattttggcatatgttggactgagacctggagaaatagagaggctgagaaagaaagaaaatgccaatttctttccacgtattttggcatatgttaatgaaatttttcaaaagaaatagcaaggctgagaaagaaagaaactccaattactttattgaatgcaaatataattatgaaaaatgaaaaaaaattgtcccggttattacgattaaatttatgaaaaatttatttattaaaataataatagaatgtaaaaattagggaccgactttttcagtgtcatg

SEQ ID NO: 112533 - DNA, 1003 bp, Heterodera glycines
  Promoter: Source sequence=SeqID_18850; Location=441..1443; Strand=+; Gene=SeqID_83545
taaattaaaattaagagagagcagtgaataaattaatgatcggagtgattggtctgtcaatccaatgccatggcaatgcccaaatgaaagtccggtcaaaaaggtttttgttgaccgccttttttatgctccaaatgacaaatcaaatccatgctgatcatccggcttttgattatcataagtgcaatgcttctcatgggatttacggaaggagtttggcgttatttgggcgccggcggtgttaaaagggtgccgctttagcaggtcgagggcagaaatgcttccacccaccccgcctcgcgaagggagaaatgcttttcaccccctccccaccccctctctttcgtttccgatcattccaatttttgccctttctcattccgccagttcctgcgcttctttttccgttcccacccaagtcgcacactttgataattttctgcttgctaatgggattacgctaatttaaaaacttggaagcgaaaggagaaaaggcggcacttcggatcagccaatcattcattaattcattcacaacgccatccgccggttgagaagagaaagagacagcgaacagcagaaagtgcaatttgcgctggttttcttttgggtgcgaaatgcgatcactttttagaagatttaacttttttgagatatttacaagttgtactcgaaaacaaacttaatgatttatttgaaatgaaaaagaaaaagacacgttaattaagttaattcattaagcatgcggatttagttgctttttaatttgtccatttcttttgctgtgctcatttgtcttcgttcctatgcgtcttacgtcaataaaaaagccatagcagcagaagagtcaattaacaattaattagttcgattgatcactcacattcccattgaccgcctcgacggactgttcaaacattggctccaatgcttctcaaatttgcgttttccattcaaaagtaattaaacattcattaaattaacttattcttcttcaccaatg

SEQ ID NO: 112534 - DNA, 230 bp, Heterodera glycines
  Promoter: Source sequence=SeqID_38821; Location=657..886; Strand=-; Gene=SeqID_67528
ccaacgcttgtcaagcagctgaagtcccgccgattgcccgacattttggtgattcattaatcattgattaattgatcatcgatggattgctccccttttttgcccttcacagatcatttgcttcaagcgcttcatctatgaaccatttgagcgccaatacatcaaacagcacgtgcccgtttcgttcccgttggacaacttcagcctgagcaaatacttttcgcccgatg

SEQ ID NO: 112535 - DNA, 619 bp, Heterodera glycines
  Promoter: Source sequence=SeqID_17358; Location=1692..2310; Strand=-; Gene=SeqID_81843
ttcctggtacatacaactttagattctaaaaacgggtgatgcttgtcaattcggtaaaaaaaaattcattcgaaaagcaaaaatcaggaaggatcatcttgtatatgtacataccggtattagagaaaataataattgttaattagaaaaaggagacaaaagaagatgagtgcagagaaagagacaaacgaattcgaaagttaagcctggtcagacacttcctcaaataacaaaacacacgcacacaaaacgcgcataatcctttcactgattgtgaagaaaaagctttttttctctggataaaaataacttttttcgcttttcgttactcgaaaatttcacgctaaatattttagaaaaaaaatggatgggactgagtttgccatagaatataaaaggctactcgccgtccctgtacgtgcctcttttcgaatgtcttccccattcccatttaaatttaacttcgcctcgtcccggcaccgccggcggtgccaaaagacatcgccgggaattttatgaaaattcagaaaagattgttaacataacataaatttggtacagaaacaatttttaattttgttcagctcaaattttgatctattttattatttttaaaatg

SEQ ID NO: 112536 - DNA, 962 bp, Heterodera glycines
  Promoter: Source sequence=SeqID_3326; Location=1426..2387; Strand=-; Gene=SeqID_84223
gctgcaaaaaaatagcgaaattaataatggccctaaaaagcaatgaaattttatattttgcggcaaaatttgccaaatttttttggcacttttccgttttggggcctaaattttcggtttatgacccttttttgggttttggcaattgaaaattaggggaaacagtccgaaaataagagtatactgagaaattcaacgaaaaatgtctaaaaataaaaattaaagggttagaaaatgcaaaaattcctaaacgaaaacttaaatttaattaaaatttaccgtttttaaaaaaatcaatgcttttacctcaagaattgagcagttgagaaagaagccactgagaaaagaaattaagaaaatggaaaatgctaaatatgtgtttggggatgttcaacacattctatcggcgaacatctgtgaaaaagaggaaaaggagaaatttaattaatttaaatggagccaattagggagagcaattagcggcactttccttttttggggacacaaacgcttttaaaattaatttgtaaattaaattttgaattgcctttttatgtaataaaagcgcgcggactttttggcatgaaaaaatgtgcgctctgttaatatattgaattttttgaaataagcccaaaaaattagccaaaatcaattattgaaaaattattagataaagcaaattacataaaaaaaaattcgtttttcgactgatttatttagtgaaaattttttgaatttttttgaacatgtcgccaaaaatgtcatctcgtcaaaaaataattttttattgcattttttgttacagaatttcttaattttacatgaaaaattccatatatttagcaatggaatctttttgctgcgtttgtaaagcaatttatggaggaagccacagctgttccgtcgcctatcgacaccgccggaccccattgaaccattttttttaatttgaccccaaaatg

SEQ ID NO: 112537 - DNA, 359 bp, Heterodera glycines
  Promoter: Source sequence=SeqID_19923; Location=1189..1547; Strand=-; Gene=SeqID_84682
caatacgactgagtggttttggaccattttgtcaacacgctgacaatacgaaacaaggacggtaactcttatgaggtaaatttggaaaaagaactcaagaatgatcccgaggcgacggcttacattgattttctgaaaactggcaaattccctgatggtttggatgagaaagaaaaggacgaatttgccgtagccacagttaatttccaattggactctggcatcctttatttcaaagaatcgggatgccaaccacgaatttatgtcccaatttcgttgagaggcttaatttttgaatccttccactcttcccttcttggtggtggtcatttgaattaccgtaagactttagccaaatg

SEQ ID NO: 112538 - DNA, 686 bp, Heterodera glycines
  Promoter: Source sequence=SeqID_19143; Location=791..1476; Strand=-; Gene=SeqID_83895
tgtttcgcgggtttaagagtcaatttccccaattcaaattcaacgccatttaactgccggataattttcacatcatttagcattaaaattgcttccatcaattgatgccgaaaatatttaattggtcataaaatgggaaaatttaaaataatctagcctaattaatacctttacccacaaataaatattaattcacgctcgctcttttgagtttatccatctctaatctgtgttttgcttgaagctaatcagaaatcctctatttaaagaagacaaaattaaacttaaattcattttggaaaaattaaatgtatatttaatgaagcatttaccgtatttttctcccttccataccgtatccttacataatgccaattttgtcttttataacgcttcactcattttaattttaagcaaaaattgttcaaaaccgatcaatcaaataataaatttaacatagaatttaaaaacaaatattttttgtttttttgttgaaaaaatccaatttaaaattattttgaaattgttaaaaaataaattatttaaactgttaaaaaaaaaagtgtttgttttttctcatcacacaaaagccccatttaaacaatttttaaatattattttaattttcaaatattaattaagcctttctaaattcccaacaaatttgcttaattcgtagagaaatg

SEQ ID NO: 112539 - DNA, 529 bp, Heterodera glycines
  misc_feature (55)..(55): n is a, c, g, or t
  Promoter: Source sequence=SeqID_31018; Location=1..529; Strand=+; Gene=SeqID_61374
gggggggggggggcctgggatttcaaaaatagattttaagggggtatattttttntttttagaaattccggattaggcggtgtgtttttgattaattagattaataaaaatatatttttttaaattttaataaaaaaatctttatatttatattagagtagagcgggacccggggaattttgggcaaaaccgggaccgggacttttcaggttggaaaaccgggaaaaacccaagacttttccctgtcccggtcaaaaccggaacttaagtactcatttgtacgttattttcagtaccaggtccaggtccagctctactctaatttatatgtttaaataaatatttacttattacaaaaaccattgtttgctaaaaaaaattttcgtttaatttttttttcattggatttggtataatccataaacaaacttcgaaataaaatgaaaaccatttaagatttaaaaaaaaatgaaaggatgtacaatatttgtgatgaaaaatacttaaaaatgttacagtcaaataaatg

SEQ ID NO: 112540 - DNA, 223 bp, Heterodera glycines
  Promoter: Source sequence=SeqID_10282; Location=2729..2951; Strand=-; Gene=SeqID_73439
attttataaatttttattcttgaaattaatctaaccttctttaagttttcgtaacatctcaagattttccggaaaatatgtgattatagccaatgttttttccatgtcaatcgctttttatattgtttatttgtcgtttacttttgatctacaacatcccgaaatgtaactaattaattaattaactaattgaaaataatattttttatatttaaatagtatg

SEQ ID NO: 112541 - DNA, 134 bp, Heterodera glycines
  Promoter: Source sequence=SeqID_570; Location=1599..1732; Strand=+; Gene=SeqID_56341
acttaaaaaacaaaaatggggattgaaaaaatcgaattaagaaaattttgagagaaaaaatttaaggaatatacacttatttatgtgtcataaaagaaaaatacttccgttataattgccaatatttagtgatg

SEQ ID NO: 112542 - DNA, 1003 bp, Heterodera glycines
  Promoter: Source sequence=SeqID_7778; Location=1923..2925; Strand=+; Gene=SeqID_65930
aaagcaaatatgtatttaaatagatcaaaaaattttttagtcaccttttacttggttaggaatttaaaatttagcctattaaaatatttagaaaattttttattattttttatgttttttccgacttccgaattccgatttccgacgtttttggggtcggaattccgatttccgacttccgaaaaatttttgggcctcggaattccgatttccgaaaaatttggacccccggaattccgatttccgaaaatttttggggcctcggaatgcaatccctgagctgcacagaactgcttttcatttatggaaacagtaacacgttaattacggataatttttaattatcgaaataccaaattatcgagtttttgccattttattttatttttcataccttttttggttttggttcgggaaataatagaaactatacctcaataaaaaaagttcccgtgaacgggaatttagaaagagcgagacgggaatgggattcccggcttttcccattttaattaaaattctgataaaatcaaaagtagagtaaaaatgaggatgagtatcaaaaaaagggcgcctctatttttggagaaaggtacaaaatagagattctagtgacgaatagtgattttaaaataatgggagtttgaggcgcgattatcatactctttctaagtatagtaacctttcatttagtgtccgcaaccttcgttgtcagattggtggagctacttttgtttttgatgcggatgtattgccttcagatcagtttatgatcttgtaagttaaaataataattggaaattttttttctcaataaaaaaatttataaattattatacatacttgcaatttttcaaatggaatttttttttatttgctccaattcaaaaaagttatggccattgaactataaaactttctcgaacattttgttattttggtgcatcagtgtgataaattcctaaatatctcagtcctcgtcataaaatattgtttaagaatg

SEQ ID NO: 112543 - DNA, 202 bp, Heterodera glycines
  Promoter: Source sequence=SeqID_13218; Location=794..995; Strand=+; Gene=SeqID_77046
ttctccaggcgatgatcgccccgaatctgaagagtaagttgaaggcaaagtcaaattacaccaacgaaatttaagaaggccattattcctcgggtactttttcgttggacggcgagggaccgtccgttttttcgtcggtttgctcttcctccgtatcaacgacaggcgctcagagcaacgctttcggaaggactagcgaatg

SEQ ID NO: 112544 - DNA, 853 bp, Heterodera glycines
  Promoter: Source sequence=SeqID_14767; Location=2783..3635; Strand=-; Gene=SeqID_78899
ggtcttttttgctctttgccgaattcccaaatcgggcgaagggagaagaattagaaggaagactttttaaatcacttacagccacagcaatccaaatcaattaaatgtaaacaacacaacaattaaaagcacaattaaaattaccacacacaatccgcatcaccaatttaagtccgggccacgagtgaaaaaaacataaaatgaaaatgaaagacacaaaaaaataaaacaaaatgccaaattaattaaaactttaaaagtcaaatgaggtcattatttaattatcacacttcccaaagattggcaatttcaatgtaattattcaaaacggtgattgatcatcagcaggattgtccaaatcaatttttgacttaatagaagttgaatattaccttaagtaatgatgaatttattcacaacaagaatatatcttgatgaggagaagatttgtcaaagcaattgtatacttggtaaaaaagctactggcgtgggaaattttaaattggctattacaattaaacacattctattttcacttttaatagagataaagaaatagtacgctaaaatggggactgggtcgttttggcgcccacgttttggcgccgacgatttggcgcccacgttttggcgcccacgttttggcgccagggtcgttttggcgccgctcgttgcgcgaagccaaaaattaaaaaaggtaaaaatttgatcaaaaattttacaaaaaaagtgaaaaacttttaccttccaatgggtttttcaaattttcaaaaaattcacaaccccctagatttttttttcaaacttcccgattttgactgtgttttatgggtgtagattagagatcaacatg

SEQ ID NO: 112545 - DNA, 301 bp, Heterodera glycines
  Promoter: Source sequence=SeqID_10905; Location=2973..3273; Strand=-; Gene=SeqID_74186
tcatttgatgaaatattggagaaaaatgggaagaaaaagaagaagaaaaacgaaaatgacttcaaaaaaagagaaataaattggaaaatattataaaataaaagagaaaataaagcaaaaaggaagaaaatattcagcaaaagaatgggataaaattaattgaaaaattgcaaaaaaattggggacaaatcgccaatacatttatgaatggatcaaagaattggggcttcaaaaacaaaaatgtcacaaatcaaaaactgatgaagaaaaaggtgaaattgtacaaaaattcattaaaatg

SEQ ID NO: 112546 - DNA, 322 bp, Heterodera glycines
  Promoter: Source sequence=SeqID_17611; Location=1607..1928; Strand=+; Gene=SeqID_82122
ttctgatcattggcctttgtcggcgccttaattggaaatttgcattgcaaattaatgggtcataagataaacattttcttcaaaatggtatatatcagtgaaagcgatgaggtcatcaaaaattttggcaatcggattacgagtcaaaaatgtcggaatcggcaatcggcatgccgacacatccctggtatatatatatctctattaaattctatatttagtgtttcccattttttatggctggtcttctttgcatatttagacacgtccgtaattagctaattagtgctcgacacaatcggtccctaatgattgcctaatg

SEQ ID NO: 112547 - DNA, 1003 bp, Heterodera glycines
  Promoter: Source sequence=SeqID_102; Location=2658..3660; Strand=+; Gene=SeqID_68302
tgcgaaaacggcgagcgaattgatgtgaagaacggaagaacgaacgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaattttgataaatttaggttcaaatttggtagtataggccagggaaactctgataaactttcaggtcgatgtcgataatttttggaattcgggttgggtatttactggttaagataagaaatatgtctttttgaaacagtgaagtttatgaaattcacaaactgaaaattgacgaggaatcagaaaaacagagtaaaacacccataaaaaaaagtgtgaatgaaaagggaggaaaaaggggcacaatatttatagtacgacgcaacaggggagggcaaaagttaggtaggtacgtaggtaggtaccattgcccaaattccaaggttttctctctatataaggaggtgttttctcattggactgacattttttgcattacgcctattgctttgcttaattgttccctcctctattcagtccttaatgttctgatttaattttctgtgttacagagtacgcaaaatataattaacccgaatgtttccaattgttttttcaatcaaaattgactgtttctcacagaattttcctgctggacaatctaaacttggaatttaatcaaaaaaacacaaaaaattgcttttccctatttttaaaatttataattcatttcattatgtattgtttttatgttttttccttttttagaacacaactatttgcgtttatcatcatcatcccttcattgtgcaacaacacttcaaaagcgacctcatcgccgtttctcatcgttcgttcgtccgtccgtccttcacatcaattcgctcgccgttttcgcaatg

SEQ ID NO: 112548 - DNA, 296 bp, Heterodera glycines
  Promoter: Source sequence=SeqID_6091; Location=3125..3420; Strand=-; Gene=SeqID_60302
tttttcagtattctccgcaagcaacagcacaacgcatataaaacgagcagattggccacacaattccatcagcgagcattctctgcaaattgacttgctttgctttctttgcgcattcgtccgcctctcttttctcttttccttccctcggagaatcatttggagctttttgttaatatttatgccctattaagtaaacccagtcttattaacctatttttactctcggaaagttccttttttactcactgacttcagccttttgtcgttttagaggaaaaccgtctcaaaaaatg

SEQ ID NO: 112549 - DNA, 158 bp, Heterodera glycines
  Promoter: Source sequence=SeqID_11316; Location=1414..1571; Strand=+; Gene=SeqID_74697
ttttgcgtttttacacgtaatacattgattaatcttatataaaaaaatatttccataggaaaatttcattcatcccaatttatttaatatttatgtttaaaaaataattttctataaaattcacagagaataattgttgttcctgcttcttcaacatg

SEQ ID NO: 112550 - DNA, 175 bp, Heterodera glycines
  Promoter: Source sequence=SeqID_1615; Location=2363..2537; Strand=-; Gene=SeqID_74838
tcgcttaattcgcttaaagacgtaaatgagtaaattcatttaaaaataaaagtttggaaaggaaagcaccgaaaaagcacgagcggaagggcggaggacaatgagcattgagaggagggcggcagagagacagagagagccgaggaaaagtgcggggagagaacgggcagagatg

SEQ ID NO: 112551 - DNA, 136 bp, Heterodera glycines
  Promoter: Source sequence=SeqID_8916; Location=6557..6692; Strand=-; Gene=SeqID_69634
cgctgcagatcaagattatccatcagatttttcgcatgatcttaatcaccgaccagtgcctgatcaggatcacctatcagacttttcccctgatcaaaatcatcgaccattgtctgatcaccagcaacaaccaatg

SEQ ID NO: 112552 - DNA, 1003 bp, Heterodera glycines
  Promoter: Source sequence=SeqID_16231; Location=2594..3596; Strand=+; Gene=SeqID_80610
tgaattttgagtcaatttcttaaagtatttagcggaaaattaaaattaaaaattcaataaaagttttcttaaatattctagcaatgttttcaattaaaaacaagcacaaaaatattccatgatgtttttttcgttaaaaagtagtaaaatttgaatgaatcacaaaaatgtttgcgacgatttatcatatgaacatttaaatgaaatttcggaattatttaatttttctttttttataaatggcaaaaaaaaaggaatttttgtgttattttttgtgatgaataaggcaaaaggcatcccatcagccaaaaggtgcccatcttcctgcacaaagcgccattagtcatcgccgacgaacagcgacgacccccgaggggcagggtaaatgatcaatttaatcgtcattaaaaataaaattaaaaaaagacacaaacattggcatggcatcggcaaatcggtgctttcagtcagaaatgttaaattttgaaattattggtccaaaatggactaaattgggggggaggagacgattaaccaatttaatttaggcaaatttgcggatgaagaaaaaggcgacctcatttttggactttctctttttcttttaaaataaattttttttaattttgatattatataattcaaatcatattatgagaaacatatattataatatatcatatttatttgcatgaaaaaataaatcttttctattagtgatcaacagggcttcattttctactctactgctcatcaaaattgcaatgaaattagggaataaaaaaatatttatgatctgtaggggtaaaaatgtttatttaatcgagcaattactttatttttatttcaatatagcttctttcaaattatttattttatatttagtgagaaattttattaaatatatatatttgccatgaataattgctgtcaaattaaataataaatttattttaatgcttttaatataatttgtttttagaaatatttcatcattaaaatg

SEQ ID NO: 112553 - DNA, 402 bp, Heterodera glycines
  Promoter: Source sequence=SeqID_16275; Location=1..402; Strand=+; Gene=SeqID_80667
atatttaatggattattacgaaccgctcaaatatgatatgtacactggcaaaatcagtcccaaatcatttgaaaattttattaaaaatgccaatttatttttaaaaaatagaaaaatttacaaaaaaaaaatgaattttatgttttccaccataaaaaaatcattaacaaacatatcatggcagcaaacttttgtttgaagaaaaataaataaaaaagtggcggagcaaaagccattagggagggggggggggggcaaagttgacattgcatggatgcttaaccgggcccaagttggcggcgccgccggcacacggccccgtgccgttgtcggcggtcgaagccgtgccgtgtgctgtgtgccgtggccaagtgtaattgttgctgggaagccccaaaaatg

SEQ ID NO: 112554 - DNA, 1003 bp, Heterodera glycines
  Promoter: Source sequence=SeqID_852; Location=572..1574; Strand=+; Gene=SeqID_62723
gtgggctaattgtctcattgaccaactgtcatttttaattatcttccttgaaacggtctggtgtaagtttaactaactatcagttcctaacatccaattattaaatttgggaaatttatgaattaattattttttattgggatgattttacataggaagtttatcgtttgggtgagactcttcaaacttatgtgattaattatgacaaattaccaagaatggtttctagtatatgcttgtgaataatgagtcctcgacaaccataaggtctaattagtgtcagtttgtaacgacatgatatatgattcacaactaatcactatctatataccattgtttttagatgagaaggtgtagtaattgatgaatttaatgatgaagcattgaacatattatgagtgggaagtatgaaaaaatcaaagaattttaattattagtgacagttgttaaatcaatttttgggtaatttaattaagaaccaattaatcaactaatcactatctatatgccattgtttttagatgagaaggtgtagtaattgatgaatttaatgatgaagcattgaacatattataagtgggaagtatgaaaaaatcaaagaattttaattattagttacagttgttaaatcaatttttgggtaatttaattaagaaccaattaatcattaaaatgcgggaaaattattaacaaagttttgatcgagatgttttacatatgtgttttggtatggtcgaatcccatgctaaaatactccaattgctaatagggtatgacatctgcattaattataattataaccaattattctttaatttttacaaactgaatatttctggggaaagaagggttatgatggaacttaaattatatgccacatttttgttgtaattcaatgaagcagaaagcttgaagctgagacaaaggaaatgatgaacactaaatgagtatgataattgttgacagattaacttagttatggtattgatggttaggaaatatg

SEQ ID NO: 112555 - DNA, 203 bp, Heterodera glycines
  Promoter: Source sequence=SeqID_6959; Location=5670..5872; Strand=-; Gene=SeqID_63404
ataagcacacattttcctagaactcagttttgattcccattattttagctacatatatcggcttctactataaatttggatgttttcaaagggaatttcataaaaatagcatttcaaatgacgtcacattttttgagttttcttcccatttcgctttcagttttaatttcttttttttctcctttttatggaggtgattgatg

SEQ ID NO: 112556 - DNA, 153 bp, Heterodera glycines
  Promoter: Source sequence=SeqID_26209; Location=2133..2285; Strand=-; Gene=SeqID_56952
tcacatgaacattaattgagcaaaccatccctccttttctaggtgtatcatggcaaagataccggttgtttcattaaaaaaatgcgcataccgttggaaaaacagcgctaccgtatcgtctgttgggacacggaaacgcgcctagagccgatg

SEQ ID NO: 112557 - DNA, 162 bp, Heterodera glycines
  misc_feature (38)..(38): n is a, c, g, or t
  Promoter: Source sequence=SeqID_35924; Location=684..845; Strand=-; Gene=SeqID_65383
atcaggtgcacctcatccaataggaaaactgatgaatncgagaattaggccaatctgccgctgaaagacactccgttccgcggctttcttttgctcgacgaaacgcggggcggagaagtgcccgccgagtccgtccctgtggtcagtgatgtgcagaaaatg

SEQ ID NO: 112558 - DNA, 255 bp, Heterodera glycines
  misc_feature (52)..(52): n is a, c, g, or t
  Promoter: Source sequence=SeqID_22277; Location=1570..1824; Strand=-; Gene=SeqID_52949
atagacaaatataaaagtcctgaagaataaaagtgatagtgtacaaaaatgnttatttaattaccgtaaatccgttatttgaaggcccgggccttctattgttcaacccctctataagtcaaatgtgaattgcctattttttgtgcctctatttattcattataagcatttttacattcaaatttcatggtaaatttgtaattttgaataaatttagttaaacaaatttgcttataccaatttctctataagatg

SEQ ID NO: 112559 - DNA, 266 bp, Heterodera glycines
  misc_feature (256)..(257): n is a, c, g, or t
  Promoter: Source sequence=SeqID_11168; Location=1461..1726; Strand=-; Gene=SeqID_74522
atttttcaaagaattactatgtaagagcattcgtggagatgtatgaagcgttgggcatggctaattcagaacgttcatttgacgtttcaatgaatcaattcaaaaatggatgggccttttttgtcatctctttgaattcaaccttagacgatagctgtggatttgagctgttgagaagcggtacaaccagtattagggccacatttgattcaccaattccaaagggaggagtggggatgaggggtgtcggagaatnngaccaaatg

SEQ ID NO: 112560 - DNA, 224 bp, Heterodera glycines
  Promoter: Source sequence=SeqID_27254; Location=1292..1515; Strand=-; Gene=SeqID_57943
aaaaaggagcccaaaaaggcttgcgcattgcgacttctgagcatttggatgacagaaagaacgagtcgggaagaccaaccttaagccaacaaataaatgtacatttgttttgtttttagctggaatgtgtcaatttgtccggacggaaagtgaggaaaattccgccaaagccaattccgacaaaagcagcgaatgtcgaacaaagtcaacagcaggaaaacatg

SEQ ID NO: 112561 - DNA, 263 bp, Heterodera glycines
  Promoter: Source sequence=SeqID_750; Location=923..1185; Strand=+; Gene=SeqID_60392
tcttaatccaatgattagtttgatgcataaagactaactaacattttggattaaaatatataattctataggttttaaaaattatatttttaaagattatgttttttaagaaaaaactgagggaataattgagttttgtaaagaaattgaaattacttgctgttaactatcttaatcgataaatatctctctgctttttgttgtcccaaccgaacaaatcgcataaagtaagtcgggttaattactcaataaaacaaaaaatg

SEQ ID NO: 112562 - DNA, 104 bp, Heterodera glycines
  misc_feature (77)..(77): n is a, c, g, or t
  Promoter: Source sequence=SeqID_22989; Location=1..104; Strand=+; Gene=SeqID_53689
aattggttttatttatacaagaaattacattaaaaaatttttaattctaaggacatccgcgcttctttaaccaaatntcgtgcggattggacattgtggcaatg

SEQ ID NO: 112563 - DNA, 54 bp, Heterodera glycines
  Promoter: Source sequence=SeqID_9447; Location=3661..3714; Strand=-; Gene=SeqID_71456
tcgaattatacagagagccatcaaaaagcaaaaaacaaactaaaaggattgatg

SEQ ID NO: 112564 - DNA, 179 bp, Heterodera glycines
  misc_feature (20)..(20): n is a, c, g, or t
  Promoter: Source sequence=SeqID_24225; Location=949..1127; Strand=-; Gene=SeqID_54942
ttttttttaatttttgaaanatcattttaggaggcctccgtcgccgcagacgcttccgctgcgcccgaccaaaccccgtcccggcgtcgccgcaagtggcgaaactgcgccaaaatccgtcggtggcacccatccccgccaaaactgtgccggagagcaaatttgcgttcgcccaaatg

SEQ ID NO: 112565 - DNA, 368 bp, Heterodera glycines
  Promoter: Source sequence=SeqID_7934; Location=1863..2230; Strand=-; Gene=SeqID_66427
aaaagcggacactgatgaatgatgagattaatacatcttttcacggcctatttttccatttattttttgaattttccaaattagccctggccctgaaaagcaagtaaatgtaggcaatgatcattaaacaaatttgtgcagcaagaaaccgtgatttgttctagtgagatgcgagactctcgagctctgctctagaaaatgacgagtttttctcgacctcaaattttggaaacttctcgctctcaaatattactaatgagttgcttatttgttagcatggtacaaaaaaaaattaatcgctttttaattggttcaaaatggttttttagttcatttatctttcaattgcttattaattaataattatg

SEQ ID NO: 112566 - DNA, 181 bp, Heterodera glycines
  Promoter: Source sequence=SeqID_18683; Location=759..939; Strand=-; Gene=SeqID_47537
tgaaggtccatggttcaggtccacattaatccaatgtttttttccatttttaaactatcaaaatgattaaattgaatgcttttttaaacaattaattaatttgttttgccagttttttatcttttcactttcttttttagctttaatccatttattcaaccaagcgtgcaaataaataatg

SEQ ID NO: 112567 - DNA, 68 bp, Heterodera glycines
  Promoter: Source sequence=SeqID_20440; Location=467..534; Strand=-; Gene=SeqID_50978
ggtacaaattaatcaaattaaataaataataatttttcttaatttattttttaagtattacaacaatg

SEQ ID NO: 112568 - DNA, 601 bp, Heterodera glycines
  Promoter: Source sequence=SeqID_238; Location=11716..12316; Strand=-; Gene=SeqID_79393
tgcgtacggtaatgggagaaaaagtggggcatacggtaatgtgagaaaaagcggggacatacggtatgggagaaaaagcggggacatacggtagtgggagaaaaagcgtggacatacggtagtgggagaaaaagcgggaacatacggtagtgggagaaaaagcgtgggcatacggtagtggtagaaaaagctgggagatacggtagcgggtgaagcggggacatacggtagtgggagaaaaagcggggcatacggtagtgggagaaaaagcggggcatacggtaatgggagaaaaagcggggacatacggtattaggagaagcgggaacatatggtagtggaagaaaaagcggggacatacggtagtgggaggaataagcagaaaaattttcaaaatttggtagtcaattacgttaccgtactcctaaaatagaaactctcccccacaccccccgagggctttatttttctaccccctcgaacggtgggcattttttattaggcacattttcgtgtaaattttaagagcaatttcgaccaactttatctcattttggaagaaagaatcacatgggaaaacggaaaggagctgctgaaaatg

SEQ ID NO: 112569 - DNA, 237 bp, Heterodera glycines
  Promoter: Source sequence=SeqID_12527; Location=1221..1457; Strand=-; Gene=SeqID_76178
aaaaaagtaaaccttttgataattcaacacaaaaaaatggattttcagtaattttttttttgaatttgctttgatttaaaaaaatatgtaaaaatggtttcgatcactgtttaaaatgacattttgagtatttgtttctatgaaatttattatgttgaccagcaaaaaataaacatttattaataaaaaaaatttagctccggcaagtggttacaagaaaggtcgacccacagcatg

SEQ ID NO: 112570 - DNA, 734 bp, Heterodera glycines
  Promoter: Source sequence=SeqID_40970; Location=1..734; Strand=+; Gene=SeqID_69188
tacccatttcacttccgtttatttgttgctattactttttttttttttgttaattacataatcattaattaacaaaaatgaaagaaaacaatttttaattactaaattaattttttggattaaatgttttttcgactatttgtattaaatctgaatacgaacgatgaagttcaagagtcttggttttgtacaaaaatttttggccttgaccacgagggtgaagtttttcacaaaaaaatcatgcccaaactaattttttacttttaatttttattaaattggtctttgggaaggaattatatatttaaatttttatgagaatttaaatttgtccggaacccggcgggtttttgttaattaataaggttcttaagttttttcaaatttataaatttttcttcctacaattttattaattattttatcaccaaatgtaattcaaataatatttatttattttttccaatataaaagtaaataaaaaaaaccaaattaacaaatcaaaatgaatcatcaaaaacaaaacaaaaaatgcattttccgtcccattcattccgcggattgagcagcgaataattaattcattcctttcacaaccataaattatttttattataatgttaatcatttatttgtccacataactctcatcagaaaactgctgctttataaatatttaaaataaaaataattatttttgaatttaaaatgaaataaaaatttagccagaaatg

SEQ ID NO: 112571 - DNA, 306 bp, Heterodera glycines
  Promoter: Source sequence=SeqID_9831; Location=1..306; Strand=+; Gene= SeqID_72845
atggaaagagacggacgagaacgaatgggataaaaagaacggatttaataaatttatccgatcagaaaaagagaacgcgaaaggagtgatcaaaggatgaccatgtcgaggataaaggatgaggatgaaggattaccatgttttgtgagaaatgcccacggagacagcgcaaaaattagcgaaaggatatttttttaaaaatgaaagcgaaagcaaacgaaagaaaggcattaattcggagtataaaagccaattagcatcaatataagtcacattcgtgcgatttcttctgctctcttccaaatg

SEQ ID NO: 112572 - DNA, 56 bp, Heterodera glycines
  Promoter: Source sequence=SeqID_17968; Location=754..809; Strand=+; Gene=SeqID_82533
actattaaaattaagggattccgagaaacaatgccattgtacaccttgaacaaatg

SEQ ID NO: 112573 - DNA, 179 bp, Heterodera glycines
  Promoter: Source sequence=SeqID_4876; Location=4434..4612; Strand=+; Gene=SeqID_56044
tttagattaaagaaataaaatcaaaatttgctcgtcgtttttatgtttattcattgtcgattcttaaaatcatttctgctgctgatggtttccattggttaccattttccattgctacaaaaattgttgcctaattcagaaattagaatttactgatggcttcgaattcggcttctatg

SEQ ID NO: 112574 - DNA, 267 bp, Heterodera glycines
  Promoter: Source sequence=SeqID_4439; Location=430..696; Strand=-; Gene=SeqID_45809
tccaaaatttgaaaataattattctaaatgaaatttaggtcttaaatcacgaaaatctcgaaaaagtcataaaaaaattgcaaaaaattcacgaaaaaagtcaaattttgaatgaagttggcagatttaaaattagatttgttgttggcgcaaaaaagtgaattttgaatatgatttttagtctcgctcggaaagaagcgaattgtctaatgaatgtacattttttaagtgatttacaataagattaaataattttttttaaacatg

SEQ ID NO: 112575 - DNA, 357 bp, Heterodera glycines
  Promoter: Source sequence=SeqID_8546; Location=812..1168; Strand=-; Gene=SeqID_68479
tactttggacactatgctgtgcatcaacatccaggacaacgacattgggtagtttttgaggatttttcgttttttattgaaattttaattttcaacagttttttgacgcgcactgctcgccgaactgatggcaaaacgaatgaggagggatgagaaggaagtcatgcgcaatccaagcggaagatgaaaatatattgtggatgaaatatattcattgtaaatttgccgatgaactttaatatttgatcgtatgcatatttctgtattgatggtaccatctgtactattactcaaaacatatatatatatatatatttgtcatcctaatatacctctttttttcattagcaaaaaatg

SEQ ID NO: 112576 - DNA, 103 bp, Heterodera glycines
  Promoter: Source sequence=SeqID_6341; Location=3556..3658; Strand=-; Gene=SeqID_61192
actaaaactcaaaaaaatgcttgaaaaatcgcatccaaattattctttttattggccatttaaatttccaaatcaaaaacttctcaattttcaggtcaaaatg

SEQ ID NO: 112577 - DNA, 94 bp, Heterodera glycines; identical to SEQ ID NO: 97954
  Promoter: Source sequence=SeqID_39728; Location=1226..1319; Strand=+; Gene=SeqID_68229

SEQ ID NO: 112578 - DNA, 75 bp, Heterodera glycines
  Promoter: Source sequence=SeqID_1689; Location=3012..3086; Strand=-; Gene=SeqID_75336
tttttcttattaattaacaaaagagaataattttatatattaaacaacaaaaaagtgcaaatatttagcgaaatg

SEQ ID NO: 112579 - DNA, 118 bp, Heterodera glycines
  Promoter: Source sequence=SeqID_17875; Location=858..975; Strand=+; Gene=SeqID_82423
aacaagaactggcaaaaagactgaagtgatcgccggaaaaattgacaatttcgttctgcgtagtagtggtaaatgaatattatgccatagtatgttctttttttatttaggtatcatg

SEQ ID NO: 112580 - DNA, 565 bp, Heterodera glycines
  Promoter: Source sequence=SeqID_4171; Location=4870..5434; Strand=-; Gene=SeqID_53458
gttagaggtcagaatagtggattgggaactaataaatgatcaaagagaaaaaataagtgatcacaagttagtgtgaaagggtatgtgagtaagtgattgcgtgatcagaaaaataatcactgtgtgagtgttcacatgtgagagagagtgatcgggatgagtgtgatcataaagactgaatgattagaaaatgatcagagtgagtgaatgtagattagagtatgattaggagtgagaatgagtcattataaagtgaaatagtgattacaagtgagagtatgatcaaagagagatagaagagttatcagtgtgcgagtgagagtgtgattgaagtagtgagggattacaaataaatgattgcagagagagagagagagagtaatcggggtgatcagagtaagaagtgtgtgatattgagtgatcagaagctgccagagtgggagtgagtgatcagaagatgataagtaggattgagtgatcataatatgatcagactaggacaaagagaccaaaagtgatcgggatcaaaaaattatcaaaatgatcagataaccatgtgcaaatg

SEQ ID NO: 112581 - DNA, 279 bp, Heterodera glycines
  misc_feature (27)..(27): n is a, c, g, or t
  Promoter: Source sequence=SeqID_40207; Location=1..279; Strand=+; Gene=SeqID_68609
tgtgtcaatatggaagacgaagacgcncctgcttcggaagaggtcaaaatgttccgaagacgcgaatttgcttcgcgtttttgtttccgctcttgaccggtcgttaaatatctctttctaggcataaaatagtaataaatttaatctgaaaaaagaaatgcctaattataacagatttgtttccaagtaaaaccaaaataaaataatttcaaaatttatcgaattaaaaatatgatttatcgtcagttaaggaaaaacggtattgtgaattaacaaatg

SEQ ID NO: 112582 - DNA, 434 bp, Heterodera glycines
  Promoter: Source sequence=SeqID_7177; Location=1129..1562; Strand=-; Gene=SeqID_64054
tgcccaccgttaaggaaaattcaattttcgtattttactaaaaatacaaaatttgcggaaaaatcacaaaaataaataaaatccggaaaaattggctatattttttttctcttcgacagttggagcccatcgaagttggccttgccgactttctgttggccaccgcgccgaagggcgcttcatttaccaccgcgtgggacgcgctcaaggaggaggggcacgagacggaggagtcgtacgcgctgtccaatgtgcacacattggaaggtgtgcaaacaaaaattattgccattttttaatccagtatggcattttaagttagtttttcaattagtatggcattttaagttagtttttcaattagtatggcatttttaatggcatttatgctagtatgctattttctaatttagtatggcattttttccattatg

SEQ ID NO: 112583 - DNA, 148 bp, Heterodera glycines
  Promoter: Source sequence=SeqID_11764; Location=3299..3446; Strand=-; Gene=SeqID_75263
tattttgccattttagacgtcaaattttggtccgccctactagttccctcctcctcctcttcttcttctcagggtcactataaaaaattaatttaatttaattaattaaatttaattttgtcttttccaggcttttccgagtgccatg

SEQ ID NO: 112584 - DNA, 1003 bp, Heterodera glycines
  Promoter: Source sequence=SeqID_21081; Location=686..1688; Strand=-; Gene=SeqID_51670
ataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgaggaaagggggagggaatgtgcgggcaacgtcgcaaagggcgacagcagggaacggcgacccaaatgccttcagcggaaaagcataattataagtaccccgcgggagttttgccacttcaatttccggcctaattaggcatcagtttcacccgccccccttccgttggcacttcgttcggctttttgtccgcctaagctctttcccgcccaattaatacgccattcattctctccccattcgttttgcaattaattcataattgccaattcgaagttgctatttcgacgacgtcaatttatcccaaaagaaataattaaatttaattgccaaaatatttaggagaaaagtaattaacattgtggcaatgaattgtttttaatctgtcaatcaattaataataattagtgatgctttgtccgtcccttcatttggcctaattgctcaaattgtgccgatg

SEQ ID NO: 112585 - DNA, 617 bp, Heterodera glycines
  Promoter: Source sequence=SeqID_10480; Location=47..663; Strand=+; Gene=SeqID_73691
tttctaaggatatattttttcaaaggtaactcaactgatcaatcttcgtcgttaattgttcattaattattgttttatatttatacaaattgttttccttttttggtgatcattttaatttattcttcccattttaaatcgaattcgaaaaattattatttttatttatttatttttatttaatttattaaattgaattgtttcttctctcctccaaatttctcatttttgtttttcaaagggcgaaattcgtgcaaaatgtacagaggccaacatttgtcgcaaatgtttttcttttttttccatttcatttcatttgtttttcttcaggggccgtagcaaaagaaggtggttatttgacgaggtcatttaaccatggttatttgacctggtcatttgaccacgaaatacgagaaaaacggtagcaaaagaagatagtaaattttctgctggagcaaccaccagtcaccgttttttaaccatgaactaacttcttttgctataccaccaactttctaccacgaaatttttatttacatatatatatatattttgcttcttttcatggaaaacaagaagtcaataagttgttttgcaaatttgcagctgaaaggatg

SEQ ID NO: 112586 - DNA, 225 bp, Heterodera glycines
  Promoter: Source sequence=SeqID_14439; Location=2246..2470; Strand=-; Gene=SeqID_78474
aagcgattcacccaaatccgagaaaggaatcgacatgcgcatttggtccgaaaggccgaggaggagcggcaaaagcgcattgaggagaacaagcaacagagagaggaagcggagaagcggcggaaggacgcggaagaggtggtgggaaagagccaaacaaatgccaaagggggggggggaatcgtgaaacatggatttggcaccaaacaaagacctctaatgatg

SEQ ID NO: 112587 - DNA, 398 bp, Heterodera glycines
  Promoter: Source sequence=SeqID_43796; Location=1..398; Strand=+; Gene=SeqID_71382
aaaataatacgcaaaatatctctcccgtacaaaatctgaagagtaaaatattcgaaaatataacttaaaaataatcggccccataacttcttttatttaaataaaatgggaaattaaaataattagtttatatttctatccccgaattaaataataagaattatcgtttccttcgaataacttatgccatggacaagaatcgaatagcaagtagataaattcgaaagcattaaaaaaagaaaattaacttaaaattaaataaattgcgtgagcaaatattaatttcaatttcattttaagaaacttagatttttatgaagaatttaaatgaaattttatttgaaaatttaccccctaaaaaatatttttttaacaaaagtatataaactaataaaatg

SEQ ID NO: 112588 - DNA, 116 bp, Heterodera glycines
  Promoter: Source sequence=SeqID_24549; Location=790..905; Strand=-; Gene=SeqID_55271
aaatacctattcatttcatataattgcttatttagtatgatatttgtttttcaactattttattgctttaattggacatttctcaatttttgttttcgttttttttggtgaaaatg

SEQ ID NO: 112589 - DNA, 148 bp, Heterodera glycines
  Promoter: Source sequence=SeqID_1427; Location=232..379; Strand=-; Gene=SeqID_73507
tctgcaaaatgggaaatcattgaagaaataattagcaaatggacatttaatgaaatgggaggagaaagatcacccgggggagggggagagaaccccatattttaatgtttaccaattaattaattatcagtcgaaatctgtggggatg

SEQ ID NO: 112590 - DNA, 129 bp, Heterodera glycines
  Promoter: Source sequence=SeqID_7623; Location=3618..3746; Strand=-; Gene=SeqID_65436
tctaaatcattaaaattgttgaaaagtcattgtcggagcccattttttacttttaaattgttttgctgccctcgggctacacaactccttcacaaggcaaaccgaagctccgatattgatcccgcaatg

SEQ ID NO: 112591 - DNA, 289 bp, Heterodera glycines
  Promoter: Source sequence=SeqID_41871; Location=363..651; Strand=+; Gene=SeqID_69913
ttggatgactttttttaaaattaaaaataaaattaaattaaaactatcaacaaaaatgtgagtgcaaattggtaaagcatgtacaaagcattatttgtgggatataaagcaacaattgttagttaaatcttgtcaaatggaagtccgcttgagaatatgagttgtgtgaatttgcgtgccttttgtaaactttaagtgcgcgacactaaaacgtgaaagtacatgaaaaatgatatccatcacattttgtagtaacagaaacatcatagcaattgtcgtgagaaaaatg

SEQ ID NO: 112592 - DNA, 537 bp, Heterodera glycines
  Promoter: Source sequence=SeqID_8663; Location=1..537; Strand=+; Gene= SeqID_68803
tcaattatcaactaattgtgttaaaagaattgaaaatttcggcccagttttctttgccatcagcagaaatcatattcaattgaccattatgaacagagaaggctacgtatttaaacatttaccatcatcaaaaaatcccaaaacgaattcttcttttttttgtaaaaactgagaaaaaagagattaagaaataattaataaggataacggctgatcagttgatatcagccatttaagacacctgctggccaaccttactattctcaatttttttttcatacttttctagctttacttataatgatttacatatcctttttatatatttacataaaatccaatgttttaaaaaattaaaacattatgaaaataataaaattttctgcctatgatttaataatattttttaattcctttagtcttcccataaaaataaattacatttaaaaaagaatgtaaatttaaaaaatgattttgaaaaattccttatttatttttaataattaaaaatctgaaaaatagatttctttagatatg

SEQ ID NO: 112593 - DNA, 169 bp, Heterodera glycines
  Promoter: Source sequence=SeqID_11650; Location=1371..1539; Strand=+; Gene=SeqID_75104
acgagacagacgcagagtaaaggccttatttgttaggcaaatttcgaaaataaaccaatgataaaaccccgaaaatgctgaaggcattgccttccaaggccaactcgggcaaattccaaggcgcctttacaaattttccatgggaaatattgcgaaagtgttgaaaatg

SEQ ID NO: 112594 - DNA, 269 bp, Heterodera glycines
  Promoter: Source sequence=SeqID_36411; Location=629..897; Strand=-; Gene=SeqID_65718
gacccattttaatattaacttgacctattaattgatgcagaatttttttctctatcgatatgcaaaatttggtgcaacttgtatgcatagaaaaaaagttatatggagagaagtaaatgttgttctttacattattaagaatgaagagatagtacgtaaaagtgagagaaataaagataaaaagtaaatgtgacagaacgccaattttttcccataattatccataaaaaagatttattgccgcttttttttcttttttaccgtccatg

SEQ ID NO: 112595 - DNA, 80 bp, Heterodera glycines
  Promoter: Source sequence=SeqID_4768; Location=4116..4195; Strand=-; Gene=SeqID_55655
aaagggaatgtaaagcgtcagaagtttgaatattaaaagggatcatatctgttcggccataaattattttatgagccatg

SEQ ID NO: 112596 - DNA, 270 bp, Heterodera glycines
  Promoter: Source sequence=SeqID_39068; Location=160..429; Strand=-; Gene=SeqID_67724
ttctgtaaatttttcactttgcgtttttcctatcgctcattcctaccatttgtttttttcttcagattttcacatttttttgctcggattttgatgcacagcaacaacagcaaatgttcggcaccaatttcgtcacttttcgcctccgccaatttgtgcaatcaatcgaaaagaaaatgaatggcccgggggcgacagagggtgggcaagacagtgtggaaaatgcggaggtgacagacacacagaaacaaaccaattattacaaatatg

SEQ ID NO: 112597 - DNA, 1003 bp, Heterodera glycines
  Promoter: Source sequence=SeqID_4377; Location=1242..2244; Strand=-; Gene=SeqID_54217
gtatgcataaatttataacaaatttatatacataaaaaatatatacaaaaattgacattgaaacgaaaaacagaatgcatatttaagaaacaggaagaaaaatttggcaattaatcaatttgtattaaaagaaaactaatatgtaataattagggatgcaacttactgattgcagttgcaaatgagtagggctgggatttttaagagcaaaaaacccaaaatagttacctaaaaaaatttttgccaagaaagtaattttttgagaaaattttttttcatttcataggagtatattttgaaaaattttagctcgattcttaggggtgtattttttgattttattgcatttttattaagagacaaaacgccaaaatagtgaattttcactattttagtgacgaagcgtgaaaatagtgatttctagtgatcgatagtgagatccaaatcgaaaaatttcaacgcagaaatgcgttttttgagctcctttcttcaaaacaatcgagcaaaaaaaatagttaaatcactaaaagttgcatccctagtaataattagggatggcaatggattttattgtttgtctcgtctgatgattaacattcattcattctcgatcaataacatcatcagcagatttcacattttaacacacatagccatgccatgccattgcacacgtccggcaggcaaaaatttaccttttttattttccttttttgttttttcataaatacacatacctattaagcatttatatgtaaaattattttacttaaatttttaaatctaaaagacatcaagcctttttttaacatatatccatgtaatacggatatccaccgatattatctcaagagataaacccatccattttgccccattgttcgattcttcgttattcccctctgttgtacaccacaaaaaaaaaaaattggtttctaacgctgtcaaatgccgagaaatgcccctttctcatttttttaccccaattattttcaacaaaatg

SEQ ID NO: 112598 - DNA, 781 bp, Heterodera glycines
  Promoter: Source sequence=SeqID_690; Location=875..1655; Strand=-; Gene=SeqID_46108
gtggcctgaaacgcaggaaaaacatgtttttttttcatggttgttaagctacttttcgagttattggcaactattttctattttttttatttttagcacctaaaaactaaaagattttgaaaaagctataattattttggcctttttccaaaatttgttaataaaaatgcaataaaaacgaaaaatacactcataagtagggagtccaaaaatatgcacataaaatcgcaaaatatgcgcataaaatatgcaccaaaaatggcaaaatatgcacataaaaaatatgcacataaaatatgcacgaaatgccaaaatatgcacaaatatgcacataaatcgcgaaatatgcacaaatatgcaaaacatgcatatggaaagtcatcctagaagcttcaaaacacgctaaaaacatgtttttcgtgcgtttcaggcctcccacaggccagaaaaaaatatggactccctactcataagaatcgacccgaaaattttcaaaaacacccctacgaaatgaaaaatttatcaaaaattcatctccaaaaattatttacctacctatttactttcttgacgataaactttgattttaaaaattatttatctcatactgatttggttaatttttttgaacaacttttgtaattttacacccctaaatttgaaactttttagcgattattttcccttttttcggtttctttttgaaaatttgccttaatttatttgctctcaatcgttctttttagttcagcatcatcatttgcttctgttcatccatatg

SEQ ID NO: 112599 - DNA, 311 bp, Heterodera glycines
  Promoter: Source sequence=SeqID_7440; Location=1904..2214; Strand=+; Gene=SeqID_64825
aaagtccagcaaatttgggatgtttttgcgcgtgaaatttggccattgttgcgcccaacattcaccatttggactttcccgatgaccatcatttggacaatttgcatcgtctcatttcgccaacaattctcgccgatctcgatcagttgaattcaatcgactccgatgatttattgcccgattcaccagctgatgatggaccaaatgcaactgttggccaagtgctgtcaaattggttgaacactccgcgaaacgatggaaagccgaagcaattgcgttcttgtgactattgtcatgtgtcagaaaccatg

SEQ ID NO: 112600 - DNA, 353 bp, Heterodera glycines
  misc_feature (22)..(23): n is a, c, g, or t
  Promoter: Source sequence=SeqID_25535; Location=1..353; Strand=+; Gene=SeqID_56277
atccgatcattaatattaatanntttccaaacgcctctccacccccggtgacggcaccatggcgctgtgctgcgacacgacctttctcgcccggctcgtccgccagccagcagcaatgcgtcaagcgcgaggacgaaacaacggcggtggaacagcagcgacaaaacaccggcacgagcatgaaagcatcgccgtcgctgtcgctgcggcaacagcagcagcgagcaacggcggtgcccaaggcggaagtgatggcggaagacacatgcgacgaacaagcgccagaccggcatcagcaacacccgggaggcaacggcaccggtggtggcggcgagctcagccccgaagacatg

SEQ ID NO: 112601 - DNA, 71 bp, Heterodera glycines
  Promoter: Source sequence=SeqID_10776; Location=2132..2202; Strand=-; Gene=SeqID_74032
aatgaatggtaattaattaatgttcagctcagaccactccatgggctgcgctttacttcgtcaccctaatg

SEQ ID NO: 112602 - DNA, 707 bp, Heterodera glycines
  Promoter: Source sequence=SeqID_8911; Location=1..707; Strand=+; Gene= SeqID_69618
gcatattccatttgatttcttcaatttccctcttttcaataatattgggaagatgctttttcttatatatttatattatttaataaatattatatttacaacaaattctgagcctataaaaaattgtaatgcattatcactcagatggactgacggtaataaataaagttctttttgcatagctctgtttttaagattaggattaactttcaaaaattaaaaaatttcgacgaaaaaataaattgaattttgataaaaaaaaataattttatgattattgataattaaatgtaatgacatacaattaaacaaagggtaaaattttttctaatcatttaaccccctaattttaatagtttttaaatgttttatttatcgattagaagtgtgcacattctaacgcttcataattaatttaacactaaatagttaaaatgccgaatatttcgttttgttgttccaaaactcgtattttgttaaattatcaaccggtttagatttaaaaattcaattttctgtttgtttggacaaaacatcgaaaaactttaagtttagtttgctttgtgatgcattaaactgttcccatacaaatttatttgctttctttaattacccaatttatttatttttatcttaaaaaaatgatatttcttgtttttaataaatttatatgacattttttacatcacttttttaaggaagtaatg

SEQ ID NO: 112603 - DNA, 190 bp, Heterodera glycines
  Promoter: Source sequence=SeqID_13830; Location=1..190; Strand=+; Gene=SeqID_77768
cttagaaaccaaaaaattgatataatttatttagatccccacccagcctttgatcaagtcccgcatgatcttttaatatacaaactcaaaaaaaccggaataacgggcaacttattaaattggcttcgggattttcttcttggaagaacctttaaagtaagaataaatcaaattaaactttttgcagatg

SEQ ID NO: 112604 - DNA, 136 bp, Heterodera glycines
  misc_feature (53)..(53): n is a, c, g, or t
  Promoter: Source sequence=SeqID_34406; Location=1..136; Strand=+; Gene=SeqID_64206
ctttagcccctcagccccgccccccccccccccctgcccttttaattggaagnctggaggacaacagcccatacattttcctttgcttgttctactcattgtcaaaaagtactaataataattccagtccatgatg

SEQ ID NO: 112605 - DNA, 65 bp, Heterodera glycines
  Promoter: Source sequence=SeqID_4595; Location=3150..3214; Strand=-; Gene=SeqID_55024
tttgtctctgctgttggacggcagctaatcactccagctgattgcgtcatacatggtccgcgatg

SEQ ID NO: 112606 - DNA, 139 bp, Heterodera glycines
  Promoter: Source sequence=SeqID_43624; Location=770..908; Strand=-; Gene=SeqID_71251
ttttcatgactataaaaatgtttgtttttcgccttgcctctcattattaaaaaaaaaaccatttctaacgcaattgattatcctgctatttgagtgacatcattccaaaaaggcaaattgtgctaattgccacaaaatg

SEQ ID NO: 112607 - DNA, 867 bp, Heterodera glycines
  Promoter: Source sequence=SeqID_3224; Location=1793..2659; Strand=-; Gene=SeqID_83766
cttttagactatagtacttaaagctaagaactttattcctgatatttgtatcactgacgcatttaccgtatggggtgcagctgggtaaaatttgggacggtaatgggggacagcgcaacttagaatatttggttctgttagaacattttgttccgttctcgactgtcaagtcgagattgatacatttttttggtataagtttatcaattaaaaatttgaacatagaaaggatataaagctccccttcttcatagaatttgaaaaaaaatgtaaatcaaatggacattcgttctctaatcccatattttgtgattccattttccatttcattttcattttaatttttcacttgaatttgcttttgcttgctcagttgacaaatcgcgagctgtgaggtcttttcatttgctcataattttttcctaattagccttaagagaactgaaaattgagtccacaaagccaattaagacataattggaaaaatgacaaggaaaagattgttcagagaataaaaagagagataataaatataaacataaaattaatgtttatttaattacaattttattcaaatagcgatatttttattaaaatttaaaaaagaactttcgattgtctgagactgaattttttcagtgttattttattttaaaaaaagttattaaattttaaatttatgcaaacaaacatttcgaaaagctttttgattagagaaagcttttgaaatgattgtgtttgtttagacagtcaaaagaatcaaaaaatgcctataaaaggaaggcgatgaaaggaaaaagcacccacaggaaaatatcattttattattttaaaaaccaaaattttattttagaaaaccaaaaaatg

SEQ ID NO: 112608 - DNA, 423 bp, Heterodera glycines
  Promoter: Source sequence=SeqID_19725; Location=1..423; Strand=+; Gene=SeqID_84468
tcatttgctgttttatccatattactggatatgagatatgcttgttaaagaagaacaggctcgagaattctaataattttaaccggcttagttttcaagacaattttctacaaattaaattaccgatttacaccgcaaaaaaaaactaagtttctttgagagtttatcattttccgctccactaaaacatcagtattttttgttctagcagttttacgcgtcccatggcaaaatattctagaggaaatgcgtcgaacaaccttcctgtttaaaatttttttcaattttaaatgtttttttgtaataaactaaatttgttgggacatgtaaaatgccatgggacgcataaaccgaccagagccgtatatataatgaaattttaaatttttttttgcaaaattttttttggctttgttgcagatg

SEQ ID NO: 112609 - DNA, 1003 bp, Heterodera glycines
  Promoter: Source sequence=SeqID_20398; Location=349..1351; Strand=+; Gene=SeqID_50924
tagtaccgtacccgccgaatacagaaaatgtcaataatgcccttaactgtggactggaaaacagtcatcatttggctttgagtcaaagcagcacacaatgccaaatttgttaataaaattaattaaaattcaaattatatagataacagagatggaacccgtcagttgggccccagcatttttttttgactataacttttttttctatgtcaaccaaatccaactctattgttggtatcattcgaaaactctttacacgctctattagccttacaaaaaccgaaaaagatttaggatagtatataaaaaatttatgaagaaaaacttcaaaaatttcgactttttaaattttcatgtataacttttttggcaattgtttaaccgcgaagcaatagcatagaaccaagttctaaacatattaagctttcgaatgatacctaaaaatattcgatttggttgacaaagaaaaaagttaaagtccagaaacttgctggggcccaactgacatagacccaacagagattgaattgaaaagttacaagaggatcgagaccaagaaatgacatcataaaacagcaagaaatttcttgttctgaaaattctcgctcagcaggtcccctaattgattggccctaattgaagccataattttgattttcacttttttttttgcttctagctatgaaatgaaatcatttttttaacaaaggaaatgaaaaaagcaatataaaaaacagcaacaatttttaattcaattgaaaacaatgtttacggaggttttcgaaagaaaatggcttttgttgtgcttttttaattaaaaaatggaaggctttaaacatagaaacatttgaatggtaacaaatcattataaatttttgaaaaaaaaaaaattatttctcacttttgctctacagtgaaaaagcaaaaataacaaaaaaatttcattttaaatttcctctttttaattttgtttttattctagtgtttttaaaaatttaaaatg

SEQ ID NO: 112610 - DNA, 1003 bp, Heterodera glycines
  Promoter: Source sequence=SeqID_3203; Location=425..1427; Strand=+; Gene=SeqID_83673
gagacatgaaaatagtacgccaaagcgagagaaaaagaaatgcaaaattttcatcacactataacttaagcaccgagcgtaaaaaattaaaaatcgagcgttaaaaaagttcgtaatttttttctctatcgatatgcaaaatttggagtggatttaacgtgcaggaaaaaagttaaacgtcacgaagtaaatgttgttctttacattattaagaatgaagagatagtacgtaaaagtgagagaaataaagataaaaagtaaatgtgacagaacgccaattttttcccataattattagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggttaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaaccaaaaattgttcggagaaaatgctatttttgggcttctctcgccataactaagccgcaaaaaaaatatgttaaaacataaaaatcctagccctattcataagacttggcgcacatttcactactaattattttttgcgtcgtagatg

SEQ ID NO: 112611 - DNA, 136 bp, Heterodera glycines
  Promoter: Source sequence=SeqID_1122; Location=3593..3728; Strand=-; Gene=SeqID_68218
ctttttggttttgttcaactttccatgttagcatatacaatatatggtgaaaattgcaatttttgactcatttgcacattgttcagctgatgaatgggccagaaaataatccatgtacacattgtccagcaaaatg

SEQ ID NO: 112612 - DNA, 83 bp, Heterodera glycines
  Promoter: Source sequence=SeqID_21681; Location=989..1071; Strand=+; Gene=SeqID_52294
aaactggtttaaattttttattgaaacatagatgaataatttagtttgtttcctcacatttaaaccatttcagaccaaaaatg

SEQ ID NO: 112613 - DNA, 142 bp, Heterodera glycines
  misc_feature (18)..(18): n is a, c, g, or t
  misc_feature (30)..(30): n is a, c, g, or t
  Promoter: Source sequence=SeqID_29675; Location=1156..1297; Strand=-; Gene=SeqID_60142
aaaaatttcagcaaattntttgaaatttanagcaattttagtaacaaatggcattaaaattctcaaaattttcctcggcggcgcctaacggcaccaccggacccacattttatcatttatttgaaaaatggagaccaaaatg

SEQ ID NO: 112614 - DNA, 515 bp, Heterodera glycines
  Promoter: Source sequence=SeqID_3684; Location=1518..2032; Strand=+; Gene=SeqID_51442
tttcgactttggtacggcgcactgagcaaacgccggtcggatttaaacatggcgggaggaaagtgctgctgatggtgggacatgtgaaaaaaggcagtcaaaagattggcatcgatttactcaattaattatgtaattaatctttaaatatcctcggcattaatcacataattaaattattaatattttgttgataaattaattaattacagaaagtattctcttattattttgggtttctacctctaattggattgattaattataattagttaattaagtaaatgacaataaatgcgaatgtttcgtttcgtttccttcgatttgcgtagtttcgcgtcaattggaaaaagtcaataggaagaagagaaaagcaaaatgtgggcaaagaaaggaaagcgaagaagaaaatgacagcaaaaagcccccacaatttattttaatttattttattttaattttatcaattctttttcggtttgtttatccacggcaattctttttgatttccaatg

SEQ ID NO: 112615 - DNA, 1003 bp, Heterodera glycines
  Promoter: Source sequence=SeqID_2599; Location=960..1962; Strand=+; Gene=SeqID_80640
cccgtgatcatccctgcccgccccttccaacattcgaacccagacattgttttcaatgagttcatgcacaggcatcaatcatttggggaagtgaatttgttagaccagagaatttcaataattattgccacttattctttccctgttaaataaattttttaattttttgatttctttattttttgtttattacaataattatttattcgaccttttttctttaataatttttcagttatgtactcctttaaaaaatattttgaggagactctcgaaaaagaggactttttctggccgaaaaacagagaagacgttgaggcgttgttatttgagtcatcagattataaaattgcaatacatagagactacgaaagcccttattccgattatataaccatatataatcgtacctcgattttttgtttcaccatggttgagagaaatttaagattttttcatgacttaggaagagggacgcctatcggaaggtttacaactgtgctaaatgttacggtacaggcgaattatacgggagaagggtacatggcaccagcgttttacttttggttcttttgggagggcagaagtcaaacaaccaacgcatccttcaggagccgttttttttgtattgcgtttcagcgttgagagtgatgggcagggcatggggcagagaactacttatgaaccctatcgaaattttacttgacatcttcttccaacgcatggataggttagaaaaaaagcaaacataagcttaaaaattttttagagatttggttggaacatgggcactactctatagactcccgccctcactttttgacgcttcacgccgagtcgttgcaaagaaggcaatggaagaatttttaaaattaccatcattttttcgcatgattttttataataaatattaattggaaatgtctttttaaaattcggtttctggccaaactattcattcgatcctaatttgctattttttcgtagaaatttagaaaaaatg

SEQ ID NO: 112616 - DNA, 885 bp, Heterodera glycines
  Promoter: Source sequence=SeqID_19457; Location=1063..1947; Strand=-; Gene=SeqID_84177
cggtaactaaacgaataaaagaaaaatgcattgcgaaggtcgaggaaaatgaaaatggcagaaaaaaggaacgattccgaaacgaataatttgccaattcctccaaaggaattaatttgctgaatttccatttgccctttcgttttctccttacaattgctttgcttggcgagaattcggattttctcgctgctcaatttgctttggctctttcccatatgtcgtcgatgcgcataattcacaatcgaattaggaggataaataaaggaaaacaaaacaattggagggaagcgaaaggaaagtgaaaatggacaaataaatgcaggaagaactcctgacaacgcaaaaagcgcagaaaagtgactaattgggatgccatccatccattgcgaaagtgaaacattccttcccccccccctctccctccggccaacccacaatatttggtacttaatcccttttaagaccctgctaacagttagtgctttccctgtaattaatctcccatttcagacggctaagcgaaagttcgaacaagttgccatggagatgaaagggagggacgtcggccaacatgaaaggagggagtgggtcaatttgcgattttaattattggaaggtatcagaaagcattgcaattatggtaatatgcatttatgggtaaacaatcaatcaacaataagaaacgctccgtgtttttagtgtcttatgcccacaatttgaccgattcccataaaattgtggtcaaatggttgactttgagttgtcaaaagggcaaaatcgtcctcctcatccatcggttgatttctgtgccgtgtccaagtggacttttgaaaggaaaagcgtttaatggcatccagatgttggagttcggagggaaggatg

SEQ ID NO: 112617 - DNA, 383 bp, Heterodera glycines
  Promoter: Source sequence=SeqID_22553; Location=1108..1490; Strand=-; Gene=SeqID_53223
tttgtccccgtcatgacagatactgttttagtgatttttcctaattttattatcaactgaatttttaattatatttaaaacgataaaaaacaaaaattcaacgaagttttattcgtttttaaaaactttgagatggtgaatagtttttgcattcattcaattttcatacagaaaaccaacgacaaagacgccggaagaagcgatcagtgggaagcacagttggcgtgctaattgttggcggctttttttgcattttggctatttgggctatcgggaaatattgtaaagattgttcgcccgaaaatcagcaaggagaagacatcgaaaatggcagaagagtagcggcacgagaaattcagccagaatcacctgaaggacgcatg

SEQ ID NO: 112618 - DNA, 818 bp, Heterodera glycines
  Promoter: Source sequence=SeqID_14068; Location=1..818; Strand=+; Gene=SeqID_78041
ccagatgtccacatagaccaagaaattgaatttattaagaaacatgttacgaaaaattggaaatttgccggaaaaatacttaaacgatcaaataatcttgaaatttttgcaaatatgctttttaaacgggtgaaaattttctacatagaggcatttagtgcccctgaaagcgaaaatttatactattcatttttagaagttctcgataaaattcaaaaattacctaaacttattatgcatgagtatggaaaccaagcattagctatgcaaaaattagaaattggactcaaagaaataaatatatttaaatgtcaagaagcagagattatatccgataccaatttatcgaagataaataaattccaaaaacaagtgcaaaattatcgatttgacatgaaaatgttatacaataaaatacgattgacagctattaaacatgtatttaaacccgaaaaaaaattttttttagtccttttcaaatagaaaaaaatagagaaattttttattcattatttcggcatatctaataaaatcgcaactttttttttgcaaaaacgaaacgttttcgttactaaagaatcggatgattttttgtgtaatatttcatggttacttgcgcaaaagaccaaaaagttttgcaagtttgaaggtcgttcactaatttcatttgccgaatttgaactaaattttacaatcgaaatagtttgagtatttaaagagaccaaaattttttattatcctatcaaattttttgacttcaatcattaggttacgctattttattttgatttaacatttcttttccacttttagaaatg

SEQ ID NO: 112619 - DNA, 105 bp, Heterodera glycines
  Promoter: Source sequence=SeqID_12264; Location=554..658; Strand=-; Gene=SeqID_75850
tagagtcaattatgttttcaaactaactaatttgctaaaaatttatttattttctaatttttttattctttttttatttaatttttattttcaaggcttccaatg

SEQ ID NO: 112620 - DNA, 148 bp, Heterodera glycines
  Promoter: Source sequence=SeqID_1427; Location=234..381; Strand=+; Gene=SeqID_73508
tccccacagatttcgactgataattaattaattggtaaacattaaaatatggggttctctccccctcccccgggtgatctttctcctcccatttcattaaatgtccatttgctaattatttcttcaatgatttcccattttgcagatg

SEQ ID NO: 112621 - DNA, 214 bp, Heterodera glycines
  Promoter: Source sequence=SeqID_29856; Location=1394..1607; Strand=-; Gene=SeqID_60320
atttattgtctttttatttatttatttttagcagtggcagcgaatttcggccgttcgaattgctccattctttcaccaccggtagcaatttggacagcgacctttacttggccatgctcaaaatcataaaagagctttgcaagcgagaggcatcttttttaaaaaattttaaaaatattttgtaaatatttcagcctgccctaaagtcgcaatg

SEQ ID NO: 112622 - DNA, 311 bp, Heterodera glycines
  Promoter: Source sequence=SeqID_26702; Location=1..311; Strand=+; Gene=SeqID_57466
tttttgtcccgttttcccataaatgacgatccgccccataaatttaatttttattcgttcgttaggttaaatttcatagacagcatttttaaaagcattagaatagagaacctaacatattgaaaatgctgtttaaattttaacttgaaaagacagtttctattaggtttaaaattgattctttgaaaaaactcgatctcgagtgagtccttgaaatagctcaatttaaatgtccttgaaaacatttcttaaccgaaaatctatcagtgctaattaaaatattaatattaattaatttaaagaagtttatg

SEQ ID NO: 112623 - DNA, 223 bp, Heterodera glycines
  Promoter: Source sequence=SeqID_12100; Location=2358..2580; Strand=-; Gene=SeqID_75661
tttatgtatttgacaccagtctgataataattcgccaaaatttatttattatttgtccatttattacgaattattttgcatctatcactccaaattttgttaaaaaaaaaaaaatttttttattgtcccaatttttaccattttgtgttttttcaacaaaataaatatttgttcaaatttaaagaattaatttttaaaattttagacacaaaaacaaatcatg

SEQ ID NO: 112624 - DNA, 405 bp, Heterodera glycines
  Promoter: Source sequence=SeqID_21596; Location=233..637; Strand=+; Gene=SeqID_52195
ggcgtaattccaaattcagaagttctttttactgtgggctgtcctcttttcatcgccgttttactgccccgtgggtgctgtgccggtgtatttttaaaggtggcgctgaagtggcccaaaagttgcgaaattacgaattcgctgttgaactgctcgaatttcttttggaaactgatcgttagtttttatttattggataatttgtcatcatagcatatttttcgcaaagttcttcgcaatttttgcatgagttctcgcggtaaatggtacgaacgcattgcactcaatttggaacgccatctgaagagtttggacaagtcagcacacttttgtcgactcggcatggcggatgagttggtggggaagtcggacaaactcatcctgcagcatcggctgaccaaaatg

SEQ ID NO: 112625 - DNA, 165 bp, Heterodera glycines
  Promoter: Source sequence=SeqID_38517; Location=753..917; Strand=-; Gene=SeqID_67300
ccaatttgggcgttcttttttgattatgattacggccaaaaaatatggacaccagtttgagcgctatgttcaaaagttatgcggaaccgaagttgttcaggcaacctaccgccgattgggcagctaatcaaaaatgcttttcaaaaaattaaaaaatacaacatg

SEQ ID NO: 112626 - DNA, 641 bp, Heterodera glycines
  Promoter: Source sequence=SeqID_2831; Location=668..1308; Strand=-; Gene=SeqID_81836
tctctctctatagttttcctcttctctaacttctaattcccaaccactcctatacacccatcacacacacaaaaacgcacgcattcaatcatgtgtgaaaaccgcacgcgttacccactctaccctcccatccgcgccgacagagaaacatacactgcattctcttctctacccagcctttctctattagtccccaattatatttttcaattttatgtttctttttctctatgaaaacaaaacaccactttaggcgcaaattcaaaagggcaaaagtgggcggagcttcgcctcacttaatatatagtaagggatagcccgaaataaggacaaatcttacaaataaggacatttttattttgtaagatttggaccctccaaataaggaaaaatcttataaataaggacagatccgaaccctgcgttacgaatacgtccactaaaacagttcacctaaattaattttaacaaccaatccgtttgcacgacctaacccaagaccaaatggctattctttaagtcaaattcgtgtttaacgaccccgaaaatttatggtcaaaaaatattgcttttgaaaaaacaaattttttgttaaaagaaccgtacgaaggaactacaggacatttgacttcgctataatg

SEQ ID NO: 112627 - DNA, 245 bp, Heterodera glycines
  Promoter: Source sequence=SeqID_2532; Location=780..1024; Strand=+; Gene=SeqID_80226
aattagcatattttcatattttttgggacgtttgggtgaaggaggccttggagagggtaccaatgagcaaaagcgaaaattttgatcaaaaacaattcttaaatgcgcatttccaaattttaacactttttgccatttttaaattttaatttgaattgcattttttctctggccaggctgaggaatgggccaagtcgctcgcgggtgcgttcgccaacaccgccccgtcagcaatgcccgacatg

SEQ ID NO: 112628 - DNA, 1003 bp, Heterodera glycines
  Promoter: Source sequence=SeqID_13519; Location=1316..2318; Strand=-; Gene=SeqID_77418
tcggttgaataattgtaaatcaaacatttcaagcttttcaggcgtaaaaaaatttattgcccgccaaatggccaatattttgctttttgaaaagtcgattctcaggggtgcccttttcggctctattgtcctttatgagttcaattgacttttatgagcccaaaggtattttgagtccaataaaatattttatccgtcggagttttacgggagccccgctcccgtacttttctacccatcaggttttttacgggagcgggagttttacgggtactcccaatcctggaagacatgggtcattcggatcaacgaagtacatccgatgatttacccaacagtagtcgtattgttatttcagatccttcgcgaaaacaaaggatttcttatattttttactgatgtaaaatgaaaattcttcaaaaagttgaatcagaattcaaaatatttgatcggactcataaactctgattggactcataaagtgcactagcgcccattttatttttttttgttgaatatttcataataaattttttgttcacaagcaagcagaaatagttgaaaatagtccggcggtgtcgacaggcgccgccaggggaaattttgaaaaatgtaaaatttctgccaattttcggttacattatgccaaaaatttgaaaattgtttattcataattttttttgtttatatgcaaaaattatgtagttgaaaaatagttttttaaaaatttcacaagcaaaatagtttcataagcgaaaatagttgaaaaatactttctaaattaaatgttttttgcgtttatctcaccatatgttatccgcaaaaaaataagtgaacgcctaaaaatccgggcccttctcttatccaaaattccgatttatcagtccctaatttgtaaggtgttttggcaagttcagccctaggcgtatattcttctattctgattcatgcattacagaccattttgcctacgcctctttcaattattaaattattccaaatg

SEQ ID NO: 112629 - DNA, 205 bp, Heterodera glycines
  Promoter: Source sequence=SeqID_8789; Location=1..205; Strand=+; Gene= SeqID_69227
aaaggaaatgtttctggcattggtactgtgagtgtttttgacatatgcgatgccaattgtcgggaagaacagcgtaatgataatgaggcggcgagttcaaaggttccggagaccgttactatcactaatgatgattagtgaaatttcgtgatagcgtgattaaatcaaaatcacatacaagagctgattcattcctaggaatatg

SEQ ID NO: 112630 - DNA, 187 bp, Heterodera glycines
  misc_feature (42)..(42): n is a, c, g, or t
  misc_feature (60)..(60): n is a, c, g, or t
  Promoter: Source sequence=SeqID_31577; Location=1034..1220; Strand=-; Gene=SeqID_61905
atagtaaagcataatagtaattattaaaaagcaaataaaatntaattgatgaattatttntaaaaatacatataatacatattagaaattaaattcataaataaattatccaattaaaattatttaattaattttgtcaaatccacgctaattttctttcttttcagtttcggctatctcggaaatg

SEQ ID NO: 112631 - DNA, 336 bp, Heterodera glycines
  Promoter: Source sequence=SeqID_30642; Location=422..757; Strand=-; Gene=SeqID_61051
aattatatataaaataatatatttaatttaacgctcgtttggcgtaatgttttaagtttcctttatcaagtaaaattttaaattttattttttaaatatatttgatttaccgctcgtttggcataatgtttatagcttcattccgaaatttatctttttcatatttatattgttatagctttaggaaagctttaaatttttacttttattcaattctctttaatcttttatttaataaatacacattgcttataaaaattgtttacttataatttatattgttttcagtaaaagttgttgtataatattttctaggtaaaatgaaaataacaaatg

SEQ ID NO: 112632 - DNA, 161 bp, Heterodera glycines
  misc_feature (17)..(17): n is a, c, g, or t
  misc_feature (124)..(125): n is a, c, g, or t
  Promoter: Source sequence=SeqID_9627; Location=1..161; Strand=+; Gene= SeqID_72125
agagggcgagaaaattncatattatgaattcacgtcccctctaacccgtacgtaaagtgagtttgtgtttcggtcctttacaatttatacttttattttctgtttctccacccacttacccganntgaacatccaaaaggtgctcatcttgaatgaggatg

SEQ ID NO: 112633 - DNA, 205 bp, Heterodera glycines
  Promoter: Source sequence=SeqID_2978; Location=1..205; Strand=+; Gene= SeqID_82616
aaaataaatttatactgttatatataaaaaaagggtggagttacattttttagacattatggatttctttgttcaaaaatatgtttgcttttgaataattattaaaattaagggatgaaaatcgatagaagaaaactcttgcacaaatttaaactcattattgaaattacaattatgcaaaataaattaaaattcagttaaaatg

SEQ ID NO: 112634 - DNA, 678 bp, Heterodera glycines
  Promoter: Source sequence=SeqID_3750; Location=1..678; Strand=+; Gene= SeqID_51728
gctcccatcattctcttgtcgaacaaatagcgcaacaacgagttcaggtcggtcggtcgcttggtttgcctgcatttggctgccctttttgcaatggcgccgcctttaatgattaacccaacaacaacaacaaaaacaattactattctataaaagagacacttcatagggcaaaagctttccatattttaacaattggtctttactaaataacatttaaatggcatttgtttgatcagtgatcgggagcggcaagcagctaacaaaccaaaaattaaagaaaacaatccgattttgaatttccccaaatatttaaaatttcgttttccatttttttttcatttgctttccacttatccaggaagagtccgtgcgtctttgtgtgttctcctcttgaacagtgaacgagaatcgggcaccggcacttcgctttgcggcagcaacaaaagtggagggaaagaacaatcgaagaggaaaaataaaatgggagggaggaattggctatgattttcattagagatctgaattttgaaaaaagcctgtacctgtacctgtacctgtatttcccgattggcctgtacctgtattctgtacctgtatttcctgtagaaaagtacaggaaaatacaggttttttcgtgtttagctgtacctgtacctgtactaaattctaaaaatg

SEQ ID NO: 112635 - DNA, 265 bp, Heterodera glycines
  Promoter: Source sequence=SeqID_39484; Location=1..265; Strand=+; Gene=SeqID_68050
atattcctaaattttataataatatatgcaaattatcctctttaattaatatgcaaaacatttgtaaaatcaatgagtttccttccgctgtttataaatgaacagacaaaatataatataatatataaatataatcaatcatatttgctatagaaataaaaatttatgcagcaaatcatataaccaaacaaaataatcatacttaattaaataataataatataatataataatgaattattaattattcttttagaaaataatg

SEQ ID NO: 112636 - DNA, 284 bp, Heterodera glycines; identical to SEQ ID NO: 98949
  Promoter: Source sequence=SeqID_20785; Location=226..509; Strand=+; Gene=SeqID_51348

SEQ ID NO: 112637 - DNA, 75 bp, Heterodera glycines
  Promoter: Source sequence=SeqID_12803; Location=1..75; Strand=+; Gene= SeqID_76532
tttgaacaaacgtttatcgacaactgttgcatgcaattggtggcccgtcctgaacagtttgacgtcatggtaatg

SEQ ID NO: 112638 - DNA, 147 bp, Heterodera glycines
  Promoter: Source sequence=SeqID_20111; Location=1..147; Strand=+; Gene=SeqID_84900
ctcaaaatttcagctaattatcttctaaatataaactctcacagcgtgcggaaatattgagttaatagctccaataatctccgacttattattttcacgaccatctttgtgaaattttcacattttcagctcattttcctcaaaatg

SEQ ID NO: 112639 - DNA, 61 bp, Heterodera glycines
  misc_feature (39)..(39): n is a, c, g, or t
  Promoter: Source sequence=SeqID_23807; Location=1629..1689; Strand=-; Gene=SeqID_45812
gggcatcaaatccaaacccaaatccaatcccccccaatntccctctttcacttttcagatg

SEQ ID NO: 112640 - DNA, 759 bp, Heterodera glycines
  Promoter: Source sequence=SeqID_25965; Location=1112..1870; Strand=-; Gene=SeqID_56723
ggaaaaaaaggtaaacaaaataaaaaaaatggtttatgctccccagaattactggaaatatccgaaatccggatttttgcattttgacatttttatgtcgatttcgactaaaacaatttgtctttaaattatattttttgtggcaaaagctttaaacttttttagaaaacattgtccgaaaaaataatttctccgatcagtgatcagaaaaattatcggacccgccaaatggacagaaaaaaaatgtgccaaatttttcaaaatgccaaaaaattgatgcgagttacaatttaataaattttataatttttcgtattcaaatttgaaaatttgtttagattttgaacagctgagtgctcattttttgattaccgatgaatcggtagaagtctacatgaaaaagtatcgagaataaaattaacaaattaattaaaaccaattaaaaaatttagtcaatccaaagaaaatgaaacgtttaatcacgattttgaatttccaaatcaaacttttgaatttgatctgcaaatttggatacaacagtacagctacaaaattacattgcgaagtcaaagcaagcgcggatattttccccagcagtggtggggcggactgaagtttaatgagcataataaattattggtaattgaattattaaaattaaaataacttaaatatttggtagatagataattaaaatgtgttgaaaatattattttgaatttctataaaatttataaataatttttaaattttagcatg

SEQ ID NO: 112641 - DNA, 425 bp, Heterodera glycines
  Promoter: Source sequence=SeqID_32544; Location=1..425; Strand=+; Gene=SeqID_62854
acgtatttttctctggcactatccctttttggttcatctctcgttttttgaaagcgatttttgttaattcagtcgaaaaaattaaattccagaaatttcatttctgcccccaaaattgctcgtaccattctcactgcaagtcgcccttccgcctcgtacttttcggataacaagctgaaaaggaagaaataaaaaagaaagtgccaaaaattgtttaaggaacagaaaatgctttaaaataaaatatttaaatgtatttatacaattcaaatcggtctcgaaaaataataaattcaattagatgattatttataaatacagaaacattgagaagcacaaaatttaacaaaatgaaaaacacgaaatttaatttaatatttcgttaaataaaatgaaaaaatgccatttagttaattggccatatg

SEQ ID NO: 112642 - DNA, 452 bp, Heterodera glycines
  Promoter: Source sequence=SeqID_162; Location=1..452; Strand=+; Gene =SeqID_75594
atcgaaaagcgcactccgtcgatggtcggggtaagaagaggagaacactgttttgtttttggggcatgccttttcagctatgatttttggttgtttttttgtcgaattcgtttggacaaaaaaatgaattttttttaaactattgtaattaaaattttcccacatttttacaaactctttacagtatgccgcaaaaatagaagagaagaacaatttagaatttgttggtgactacaaatagcaagtaaatttttaccatattttcaattgaatctgattttttcttgaaattatttactaaatttcttttataaatttatgacatttaatatttgccaaattatttaagtgatttttaggaagcgccacgtgacgaaaaattgcacttcattgaccaaaccgtgtgccattgcccgcttggcaaatttgaattaaatgtagtttaaataatg

SEQ ID NO: 112643 - DNA, 170 bp, Heterodera glycines
  Promoter: Source sequence=SeqID_38660; Location=1..170; Strand=+; Gene=SeqID_67408
tacaaccacttccaagtacgatacaaccacttcccctaccagactaccacttccaagtacgacacgacaacttcaaagtacggtacgactactcaaaagtaccgtggcaaacgctttgcggtaaaacttaattttgttttataaaaaaaatatttcttataaacaggatg

SEQ ID NO: 112644 - DNA, 330 bp, Heterodera glycines
  Promoter: Source sequence=SeqID_2974; Location=4646..4975; Strand=+; Gene=SeqID_82581
agagataaactgctgcaaaaaccaaagcaatctgatcatgatgctgatgataaaccagatgagggtacacaaacgacaacaaaaacgcatggggatgcattaaaggaagagatattgcaaaaacaaaagcatgctgataatgatgacaataaaacagaggatgttccacaaatacaaacaacaacatcaacaaaaacaacaaaaataacaaaaacgcatggggaggcactaagagaaaaagtgttgcaaaagcatactgatgtctctaaaccaactgcgtccgatgcagagcatgaaactagtgatgtcggtggtggtggtgagaaaatg

SEQ ID NO: 112645 - DNA, 284 bp, Heterodera glycines
  Promoter: Source sequence=SeqID_6430; Location=1357..1640; Strand=-; Gene=SeqID_61545
caagaaacagacactttttataatgtttgcagaaaaatatagaatttttcaccttatctgcgcatatcctgaaatcacttgtcttcctttttagggaagcgattaaaaggaagctcgaaatttatgaagcgcattgtctttcgaatttctataatattttaaggaagtgattaaaggtggctcgagatttatgaagcgcattgtctttataatttttataataaatgattgaattatattaatgtttaattttatgaagaaactattgacggacgcaaaaaatg

SEQ ID NO: 112646 - DNA, 1003 bp, Heterodera glycines
  Promoter: Source sequence=SeqID_2716; Location=2880..3882; Strand=-; Gene=SeqID_81226
tgatcaaaaataattttcattccataattgaagttgggtgtttttttcgtttttactgcatttttattgagaaattttttccaaaaaaaaaaattgaaatagtgtaaaaatagtgacaaaatgtcaaagtgaattttcactattttagtgaagaagcgccaaaataatgatttctagtgacgaaaaatgtcatcagaatcgaaaatttttaatgcagaaatgcgttttttgaactcctttctttaatcaattgagcaaaaaaatatattttttcactaaaatcacggccccagtaataacttttttatttgaagatatgtagaaaattctaataaaagcaaacagtcgcaccaatgctgcagtgaaaaattcaatttacgaagagaaaaaatttacaaatattttgttttgtgtatttttggattgataatgttcctaattgaaaaaatcataaaaaagactaaaataggttctttttaagcgatttttaagcgatttttagagaataagaaaattttttgaaaaagtctcatgtttttgggtcttggtctcttaaagccagattattctaaatttttaagaacaaaataaaaaaatatattaaaaactgttgatttatttttttaaataaaaatattctattattaatgttttcattgttttccatagtcttaaaagaaaaagttaaaacacaaatttggcacagaattcataaactggtttctatttaataacataattaacttggaaatgtgaatttaaccattaaaaaccaaaattcggctgtgggttgccttaaaaaagtcatacctgaaccccaaaatttttttttaatataacttaatatcctgatcaagtcttttacataacagatcagatcattcctcacttctaatcactaaggcacggatttttagtggcaaaataaaattccaaaatagtgacataattttcagcaaaaattatcaaaaataatttttattcacttacagcagtgcaaatg

SEQ ID NO: 112647 - DNA, 68 bp, Heterodera glycines
  Promoter: Source sequence=SeqID_15922; Location=1..68; Strand=+; Gene= SeqID_80267
ggccgaacacaaacgtggtctcggaattccagccaatattgccatgcgaacatcccagattgaaaatg

SEQ ID NO: 112648 - DNA, 813 bp, Heterodera glycines
  Promoter: Source sequence=SeqID_25121; Location=1..813; Strand=+; Gene=SeqID_55850
aaacagcgccgactgcaattgtggcccgaacagctgacgcgccacagttcgagctcctcgatttctgttaaatcgcttaataacacatgctaaaaatccctttccccctcgcctctcttctctcattttttccttttctctctctctttctcttacaccatttcccaatttatcgtaccttacattcgctatcccatttgaagtgacagccgccccatttttgagcccaaatattgcgaaaatttccccatcgtttccccaaacaaaccctctgacggaaagggcccattcctaagggtggaaataacaaaagcgctcattaattaacaaagggaaacattttgggggagtaattaaatcacatttttgtcccgggacataagcaaaaacacaagacaaggatccgaagattgaagtaagtaaaaagggtcattaattggggtgcttaatccatcagaggaggaaaaacgaatttgacaagcgaaactggggaaattgggaaaccgtaacatttgaggaagagagaaaagaagattaattgaggggaaagacaaaaggcaattgccacatccggggacttttgaaggaacagcggattttcacaattatttaaaatcttttaatcttgtggcgacggcacacgggtggacacccgttcgatgtgcgcagattctaccattatatttgcgcgggtccgctcgggctatttacgatggattgcgagaggatgctaaatcaaattggaaaaccttagtcgacacactcgccaccaatttaaagaaggtttcctccagccttgttgcgcgacagatg

SEQ ID NO: 112649 - DNA, 168 bp, Heterodera glycines
  Promoter: Source sequence=SeqID_4668; Location=3201..3368; Strand=-; Gene=SeqID_55303
atccttggctcaggagagtccatggagttccaggggcgtggtggcccacacgcacacattgtagcccagactgacctggacgcagttccagaagtcatccaggaatacatatgggctcatattccatctttgccgtgcaaagacgatgactcacccatagcgcaaatg

SEQ ID NO: 112650 - DNA, 686 bp, Heterodera glycines
  Promoter: Source sequence=SeqID_30857; Location=1..686; Strand=+; Gene=SeqID_61249
ggacccaaaaatttttcggctaacgcactacctctacacttacacacttaggaaatcgtgcgaaacaattatttattttctttgattataaaaaactaaaaactttggcacgtcataactcggcactcagactcatttcgcagaaaataaaaaaatttttcttaagaaccatgggtgctctatccacccaccaaatttcatttggaaatcccacggacacctggggaccttcctttgtcagaaaccatgtggtcccccctttggtcccaaatcaattttatttttataatcttttccaaaaaaatagtagaaatatgaaataaatacaattctatagagcaaacaattgcgggttttcccgggcattcaaatagcggatttacggtaatctaatttaaattgaaataatatgcataaagaaaaataaacttaattggaataaataatttacctaatttttttcttaaaaatttctccttctccaccaatttccttctctaatttttcacgcagaactccattcttacaaatgtattttttatttttttggtagtgaagcgctcgcaaaggaaatgaattttgattttttaagaaatagtaattatctcactacttaggtatatatacctaatacaaccccacacattttgcaacgacttaattcattcatttttctgttccaaatg

SEQ ID NO: 112651 - DNA, 877 bp, Heterodera glycines
  Promoter: Source sequence=SeqID_16891; Location=1..877; Strand=+; Gene=SeqID_81319
tttcgcttttcgctttttatttttcaatttaggcccatccctggtgccgacggcaccgccggacctcaagaaatccttattctcttaaaaagtgaccaaagttgcaaattttaacatttttggaccaaaatccgtaataaaatgcactcaaattttcgaaattttttacaggcgttgcctatcggcatcgcaggagaaatagatatcttattattattaataatttgtctgtttgcacaatgaaaacagaaagaagcatcctagaattaaaaaatatgtcaataatagaaaataaaatatatgcatattatcaattaattataaaaatagaggtaaatagaaaatttacattgaataagtaaacctttttaattaaattaaaaaataaaatttatcataagttttgttgttatatttaaaattaaataattaagataaaaataaatataatgattatatttcgttttataacataataaataaattacagactataaaccacaccaaaaatttaaaatgtttttaaaattaaatatctattcgggttttgattacatatcaaattattaccgtattggatgagctgaacaattaatgaccaagcaaagaaagacggtcaatagagaaatggagttcattggataattaattaattattagaatttaatattaatactatttaatttatttactattaaaaatgattttatttattttatgaataaaatttttagttcccaaatgatcaaatgaaatgaatgaaagtggtgaggtacaccactttttcattggacattttggcgtaaaatgtgaaagaatgcataattaactatttattatagaattaataattttacaaatttgtgagtaaaaaatg

SEQ ID NO: 112652 - DNA, 287 bp, Heterodera glycines
  Promoter: Source sequence=SeqID_418; Location=2585..2871; Strand=-; Gene=SeqID_52033
aaaaaaagaataaaaaaatgcaaagaaaaaattgacaataattccattcaaaattatgagcagagtaaggaagcggcggccactgctgctttaatgtaatggcattttcattttcacactttgttaaaatgccaaaaaacaattgttttctgttttttcagaaaaaaatacaacgaatcattcccggaggcaaactttcccgaaatggtaattactacctaattaattaattacccttttgtgtgtagtttccgctctcgacgcctcaggcgcaaccattttccatg

SEQ ID NO: 112653 - DNA, 409 bp, Heterodera glycines
  Promoter: Source sequence=SeqID_13113; Location=679..1087; Strand=+; Gene=SeqID_76906
ttttatatcatcaaaattataattcaaccttaaaaagtgagggttggataaaaatgcaaattctcgtgtaaaagcaataggtagatcacggtctgcggatgcgtcgactcgatctcgactgaaggagacattatgacaaatttcgcgaaaacataatttttaaattttttgttggcttggtcctcggttgggttaaaactaggaccgaaatgaagaagatgcaagcttaagcttacagatttacctatatgataaataaaccatttacttattagcaaatgctgagacattagacttcttttaaaatgtttttataatgtttatttcttaatttctagtaaaatttgtctaacaatttatttacgcttacgataacaatttttcgcttccttatccgcatatcataatg

SEQ ID NO: 112654 - DNA, 388 bp, Heterodera glycines
  Promoter: Source sequence=SeqID_10746; Location=1186..1573; Strand=-; Gene=SeqID_73993
ttgaattgtttacggattttttaaaaccgttcaaacaaattattattaatttggatatgcaattcgaaggagaaaaatttgggctttttaaaagcgttattaagatttttatttgaattttttatgatcaaaaaaatgctattttttcaaaatttttgaatgttttttttagtcactatgacagaacttagatctcaccctaattaaattgaaattttttataaatatatttgttcaattttacaataatttgaatttatagaaattaatttttcaaagaattgttgttattaatttagcaattcacttaaaaaataatgaagaatcattattacatatttattagattattaaaaattaattttaaattgctttcctttagaaaatg

SEQ ID NO: 112655 - DNA, 401 bp, Heterodera glycines
  Promoter: Source sequence=SeqID_11060; Location=2934..3334; Strand=-; Gene=SeqID_46921
tacctcattttatattttttggcattttttagcccaattttgtattcttataaattttttgcgattttagaaaatcaaaatttgagtatagtttctgaattgttttaatttataattttctatttttaatgcaaaaaacttgatgaagaagcctcaagccattgcattttttattcaataggtttaatttttattttggcagttgcaatgccatttttgtatacataattagccattttcacagttttaaaagccctcaggggctctagttgtttggacgtggctataacggagggaataccgtaagcctgaaatccccccccccctcagggctttgtgcgcgcaccgtggagcacaaattcgaatcggacattgcgacgacaccgccgttggcactaatg

SEQ ID NO: 112656 - DNA, 346 bp, Heterodera glycines
  Promoter: Source sequence=SeqID_10567; Location=1845..2190; Strand=+; Gene=SeqID_73807
ttttacgatttgactgtttgggaatttatgaaaatgtcaactagttttatatattttatttttattattgataaattcgaagtattcttctggaaattaaaggagacatttattgattttttgtgtggattttttgtttattgcgtttaaatgaaaaaatatatttagatataatattatgcataattcataaatttttagtaattaaaatacctaaatggtaatacagacattccatcactaagccaaaaacggacatttcgccaactagtcgaaaatagtcgtacgcggtaatctgtacagcttaaagtctaaaagagaaagattgtatgggtaaggaaaaatg

SEQ ID NO: 112657 - DNA, 319 bp, Heterodera glycines
  Promoter: Source sequence=SeqID_4095; Location=1..319; Strand=+; Gene= SeqID_53163
ggaaaaaaaaattttgaagaatcccaaacgattttttgtaatttttttttttgataaaacaactaaataaaatttgaaaaaatgttagagtaaattgtgtcaatgctgattttgaaaatttcaattgggagccctgcttttaatccaatgaaaaaattgagtcattcttcttgagttatttttgggcctcagttcttatatcattgatgctgattttgattcaaaatttttaaatcaaaaccccaaacgtccatagaaaaatcatcaataaaataaaatttaggtttttcatgcaagtccaattgacgcggtggacatg

SEQ ID NO: 112658 - DNA, 557 bp, Heterodera glycines
  Promoter: Source sequence=SeqID_13803; Location=992..1548; Strand=+; Gene=SeqID_77734
tttctagatattttttttatattaaattattttgaaggaattagacgtgccaaattggcatggcatcaacccttaatcagaaggggaaagattttacagccaaatttggcatggcacccaccttaaacagggggacgggggtggcatttgacgtgcaaaaatttggcttggcatcaatgatttggcatatcatgctattgattgaaatggttgtttaaatgtagcgaatgttcacaaaagcaaagcattaattttaggcaaatcaacgaaagacaccccaagaaatattcaaatctttaacaagtattttgcagggagctgagccgttaaaaccatcaaatgaaaaatttcaacaaaaaaatgcctataacttttgtcaaagtcaactaaattaaacattcttgatatcattcgatagctaaaagagttctctaatagccggaaaatttcaaaaaatttcgttaaggttcaaaaaagttatgaccaaaactgtctgaaaacctggttgttttagtacttttggccctaactttgtttcagaagaagaaaataaaatg

SEQ ID NO: 112659 - DNA, 576 bp, Heterodera glycines
  Promoter: Source sequence=SeqID_17373; Location=1711..2286; Strand=+; Gene=SeqID_81858
aaccctttcattaaagtctgagtacaaagctttttttttgcttagtggattaacccttaaagtgcttgagtttgattacgcggagagagttccttttcgcaatggcacaaccgcgcccggcataaatattttgttggaaaatgaacaacatttgcgtgtacatatttgtgcaagagaggaaagggctacccttctttcaaacactctcttggttggaggcacttaccggttcatgcatttgaatgtgagaccaaagcgcgattttggacaatctgtgaactacactttatctttcgcatttggaagttcagttcacttgattcgggttatcctgttttatttatttgtcattttgaatttgatgagtttaagggaccgacagtagcatttaatccattaactcttcgaagtccgagcgaccgggttcctcaatttgtttgtccaaaaactaaataaaattaaatagtcgatggtcaaaaaaattccataccccctcaacatcagcagcacagtggaacgatttcgcacaatgatcgtccatataatcagcaaccaatgcaaggtagagacacaatg

SEQ ID NO: 112660 - DNA, 1003 bp, Heterodera glycines
  Promoter: Source sequence=SeqID_19159; Location=288..1290; Strand=-; Gene=SeqID_83904
tgtgtaaaatatgtcgtctaagcatgattaatcgctttgaaatttgaatcctctcaatttctcagattgggaattgacttaatgatatttcaacatttattgacttaatgggtgtcccgacaattccgagaggcgtctgagtttttggtaagttataaaatataatttagccaaaatttgctttgatgaataaaaaaagaatcataaatttacacacaaacatatctaattattacaagcataagaatattttttcagccttttttaaggctaaatattccaaaaagtgacagaaattagaaaatattattgtggaaagcattgtttaatgcgctcaaaagtcacgaaattggaaatggcattaatttattattaatgaggggccatttgggtacaaaagagaacacacggaaaaaaaagtgtgacagacactttaataatgggagagagaagaagcagattttgttagaagaaaaaaccattaatttgtacatttgacgccaatgttttacgtcataaaaaagttagccaaagaattggaaataaattttaatgccctcaaaaacatcgaatttaaacaggaaatagggaaggaatgatggtatcaatttgttaatgaggggccatttgggtacaaaagcgaacacacggaaagaaaaaaatgagacaaacttaatgatagagacgattattttttattgaaaaaagcaataaaaattaatttgtacaaattacatttcatctatcataaatgctcaaaacaaagcgtcataattttttggttgtatttttgtaaattttatattttgaaaaactaattttttctcttttttgataattcaactcaattaattaatttttttattccaaaatattcagaaaaactaccgtaataattatttaattgaatttttataaagctataaaaaaagattcaaaacaggaggatataaattaacaaattgaaatagaatgttttaatttaagtttaagttggacaatg

SEQ ID NO: 112661 - DNA, 167 bp, Heterodera glycines
  Promoter: Source sequence=SeqID_31824; Location=821..987; Strand=-; Gene=SeqID_62130
cgggatgtcaaatcccgcttggttcttttggattggcaacccgccatgctaattgggtatgttctcaaattctgatcactttggtaatattgtttatacattggccccgttttgttttaaggcgtgttgttgggcttgtcgtgttgtgtggtccgttcaccacgatg

SEQ ID NO: 112662 - DNA, 700 bp, Heterodera glycines
  Promoter: Source sequence=SeqID_287; Location=5685..6384; Strand=-; Gene=SeqID_81329
atagtagttacttaccagtcattgtcgcggtggtgattgatggcttttggtctttgatgtttgccgcgtgattaattacctatggggggtgattaattagtgcgcgagcctaagcctatgggtgattaattagtgcgggaatcctatgggggggggggggagtgcgggaatcctatggggggggggggggtgattaattagtggggagcgagcctatggggggggggtacttaattaatgcctatggggcgaagtttttgagtgaaattttcgcgcatttttttttgattttaaatttcgggggggggggggtgaagcctaattttagagggaaattttcgcgcattttgtgggggtgaaaaaaaaaagttttgggggtgccaaattttaaaagtttgttttttttttgggtgatcattggtggggggggggagtatgcagcagtgctgtggtggtggtggtggtggatgagagataaagtgagagacagagagaagaagcaacaagagaaaagagacaggggatgtgagataagagtgccggggggggggtatcggaaatgtgttatttgtttgtcgccgcgccgtgttgctcgcggaaaggagatgagaaaaaggggacacggtgacccactaatctctgccgtgatcaaccggggaccgtttattaatagatttttggcgggggggggaagggtatg

SEQ ID NO: 112663 - DNA, 558 bp, Heterodera glycines
  Promoter: Source sequence=SeqID_8171; Location=356..913; Strand=-; Gene=SeqID_67201
attaatagcacaaagtgccataataaattatataaattcaatagcctcaggacttctaagtcttctgtaattattgttgttgttgttttgtattagcgagttttgctcgttttaatttatctgttaaaatgaatcaaaaaatgcaaatgttcaaataatttgatatttaatgaaatcctccatggtttaggattgatggatatcagaacaattgtccgagtagctttactaatattccgattttcagacaataaatacaaaaataagaattctaattttaaaaaattttttgtacccagtttagatgtccagcggtgtatcccttacgcgtacattcgaaaaattccagatttaattttaaaattttttcattgaatttaaattaaatgcaacaaacattacgccaaaaaataactaaaattaaaatcatcaattttattccgttgcccggtaatcaaaaattttcagttgtacttgcttaaaaattcattgttttgctctgtttttattgttttttttgcttagtatttctgtctgaagtatttttttgttataatg

SEQ ID NO: 112664 - DNA, 199 bp, Heterodera glycines
  misc_feature (39)..(40): n is a, c, g, or t
  Promoter: Source sequence=SeqID_12546; Location=1856..2054; Strand=-; Gene=SeqID_76197
taaataataaagaaaacaaaattaggagagacaagaaanncaaagggatgggagtgcagttgaaaagtttctgtttaaattttattttattcacatggcaaaaacaaaaatgctaaatattgtttttatcgcttttggcaatcgacattttttaaattttggatggaaaaacggtagttgactttaatttggactaatg

SEQ ID NO: 112665 - DNA, 934 bp, Heterodera glycines
  Promoter: Source sequence=SeqID_412; Location=2260..3193; Strand=-; Gene=SeqID_51752
attagatttgatggatttcacaacggaattcgaagttttaattatatccattggaatttgttaattgaagcggaaatttgttgttttttccaattttttagtgcctatttgaaaatttttcgtgcctaaatgtttggacccaaaaaacaaaaaaacataactgagaacattttaacgacattttaaatcaatgaaaaagtcaaaaattaaaaacataaaaaaacaatgaacaaaaaaatgtgcgtcagagagtggccaaattgaattcaaatttcggtccaaaattggcctcaattttgtcatcatagctccacaaagtgacgaatgggatcagcggaagatcattagaaggaagaaccaaatcgaaggattctttaaaaaaatcataaattacttttataaatcgagctttattcagtgtcccgaaaaccccaaagcaattctcgggccaaaaaaataccaaaaatttatcactgagaaacggcgctccgaaatttcaagaccccttctaaaaaggcagagaaattctcgactcttgaccgatataaaacctaattaattccgataaattttttgagcactcggaattccgatttccgaaaatttttgaggcatcggaatgccatccatgatccgtacaatcgtaaaattccgatctctaatctcaaccagacagggtccaaaaagggcagggttttaaactctaaaacccggtcgaggcgtgcaattaccaaattctggctggccctaaatgtttcaaaatacgtctcacgaatattttacgaacccaaaaatgtgccattttttgtgagaaaaatgcgtcggctggccaaatcgacgccacatcccaccgtatcaccagcaccgtatgcatattttgcataactgagtttcaacacattgttaatgcaaaaagcgccactgtttgagtatg

SEQ ID NO: 112666 - DNA, 764 bp, Heterodera glycines
  misc_feature (22)..(22): n is a, c, g, or t
  Promoter: Source sequence=SeqID_23026; Location=1250..2013; Strand=-; Gene=SeqID_53728
cttactccaattttcttgcacntttcgacataattttggcaccattctttggttgaatattttcttttttgcttatattcatttgccatttcaatgaatttttgtacaatttcacgtttttcttcatcagttttcaatttatagcttttttgtagccccaattctttaatccatttataaatataattattatttgttcccaattttttcgttatttttccatcaattttattccattcttttcttgaatattttcttcctttttgcttaattttctctttaattttataatattttcttattatttcccgtttcttctgttcattttgcgctttttcttctttttcttcccatttttctccaaatatttcgtcaaatgatttttcttgtagttttttttcttttgatccaatagggctaattagggcaattagaattaaaatcaaaaagaataataacaataatttcatttctccgggattatcttccaaatatgaatctatattatgtttttttttttcttaaataaattcacattattaagttaagtcaattaagagccttttattcacatgaaaaaatcacaactctctaatggtcttcggcaaaaaattgtttgaaaaatgaaaaaaagataatatattctttcctccttaccatttgtttaaaagaatttcttttctattaaataatttctttttttctattttattgattaaaaaaaggaaaataattaattatttttttggaaaatatgtaaaatg

SEQ ID NO: 112667 - DNA, 516 bp, Heterodera glycines
  Promoter: Source sequence=SeqID_5069; Location=1205..1720; Strand=+; Gene=SeqID_56788
ggattgtgttgtcatttagataatttgacctcaatcaatgggctaaatttatgaaaattgtttgcgaaatgttatgtcaactatttgaaattttctggaaaaaaattttaattctaaaattcttttagacatctaaaaaattccagaaattttcaaagggccctagaaagattttagcgctaacttaaaaagtgtggcgtcaatgtttgcaaaattacttgtcgtaaatcgtgtaaacttatccccggcggggcttttcggggttgttgatcacggagtttatatcaatttagaccaattcctaatccaaattcgaaaactcaaattttccgaattttgatttttttttttgtgcaaagttagattaggggcttcagaattggtcaatcaaaaatgatgtcagatacgtgatcagcgatccaaaaaattccttaaacaatttttcatagtagacatcatttaaaaaaattattttgggtgccattttttaaagccatttctgccgagccaacgatg

SEQ ID NO: 112668 - DNA, 103 bp, Heterodera glycines
  Promoter: Source sequence=SeqID_11742; Location=2164..2266; Strand=-; Gene=SeqID_46982
ggtattgaaatcattttggctaattaattaaaatttatggcgaggatatttcattttatccactctccttgttctttatttattgtttaagataagtgcaatg

SEQ ID NO: 112669 - DNA, 125 bp, Heterodera glycines
  Promoter: Source sequence=SeqID_18723; Location=1..125; Strand=+; Gene=SeqID_83398
ccaatttttataaaaaatagagttgaagagatacaacaacttcactcttggaattacacatcacttttcattatgtaaaatcagctgataatccggctgatttggcttcacgaggagcaactatg

SEQ ID NO: 112670 - DNA, 905 bp, Heterodera glycines
  Promoter: Source sequence=SeqID_22105; Location=1..905; Strand=+; Gene=SeqID_52753
aaaatttgggtgcaatttgttaacagattttcaacaaaaaaaggttggtttttgcgattattaagctcaattggtaggattttcatttaaaaaatgataaaatatgtatcaatttaaaaaaaaaactatgaggaatcatattttctttataggaaacccacgagtatacaaaaaaaaaattgaaaataatctaatttctgtagagggattgaaccaggggaaagaagaagggaaagtcaaggagactagccattaggccatttgcacacttgcgcagtgttacttttaaagaatatattaattattattttttatttttctctttgactccaattttcttcactaatttttcactcagaccccattcttaccagtgcttgtttttcccggttcccggttgccctaccgggaccgtgaccgggacctgagattttcaaaacccgggaccgggaaccgggacctcggatgaccgggaattcccggcccggtcccggtccctgtcccgtggcactctacttagaaatattttttgcggagaatcaacctcaatgttgatatttatttaaatcaacaaacattacgccatcaacttaaatatcaacgtaatttttaaaaatttaaaaatgaattccattatttagtatatctcattagctataaaaggaattgaaggaaataaaaataaatatgaaagcaaaaaattatgttgtcaatcaatttgttgtctttcaattgaaacattgactcatctcctattttccgatcgcctacagccgtctctccgtccgttgacaatcatttcgatcgtttacagcgatttcttcgagaatgcttcttcttgttgcttttcctctcttaatttttctacggatttgccttgttaacataataatttagaatttatg

SEQ ID NO: 112671 - DNA, 194 bp, Heterodera glycines
  Promoter: Source sequence=SeqID_12183; Location=1..194; Strand=+; Gene=SeqID_75758
tgaaaatacaaaaaataaaataaatctagaaatatttttaaaatggaaattatggaagaatttcatgaaaaattgtttaattaaaatgagttttgaaaagtggattagcaattaaaaattaataaaacaaagtgcaaaagtgaaaaaaaagagacgaaactatggtaaaaaaattggcttttttattaaggatg

SEQ ID NO: 112672 - DNA, 601 bp, Heterodera glycines
  Promoter: Source sequence=SeqID_31996; Location=271..871; Strand=-; Gene=SeqID_62309
tcttcaaaggaaaacaccccttcaataggcttgggattttggaggagtcgttccggtaccagcgccgttttggagccttatactactgataggctatcaaccgacagcagaaaattatgctctagtcgtagatgcattaaaaagacttttcggaaacgagaaattgataaaagaagcacttcaaaatgaacttttaaatttgccacaagcaaatgagtcggttatatcacttcgtatctgtttagaagaaatagaaagagtcgaatggcagctaaacaatttttgtctatattttcctagattttttccataactgccttttgtgtcatcgaaaagagaaaaaaaattgtttaagaaaatgccattgatgcatttggtagtgccaattcttccgctgactctcttttgagaaccccacaagttctaaggaaaacaacatcgtaatttcacgaaatggtaatctgtgatggatgctttttgctttagctcatggaatcccagcctttaaaagccacagatataaaagtacaaaaaaaggaattcaaaattaatgaaaataaaataaaaaattttatttttttagtcgcctccctccccaatg

SEQ ID NO: 112673 - DNA, 532 bp, Heterodera glycines
  Promoter: Source sequence=SeqID_37622; Location=375..906; Strand=+; Gene=SeqID_66644
ttcttgtacgatggaatggcaacaaaaagtgcttatgaattcaacaaatgtgcagccatcgcttaaaaatagcaaaccaaactaatttgcatcataataatttttagactgcatccacattttttaatgatgcccacaggcaaatcaaatgctataaaatagtaattactgcatagaaaactatcataatattttaaagcattatgctggcgcgtttcttacaaatgcaaattatgcccatttttcgattttaaacaaaaattggcatggttttgcttaaagaatgcaattttaaacttttcgtattattcgacagtcctgcgttttttaatttgccttcaaaaatttcaaaaaaaaaaataaggaattcgaaaaatcgtaatcgagagacagtttaaaatttggttgcttttgagcaaaggtatacgatttttaaaacaaatggaaaagattattgcaaaatgttatgttcaccctaaaacagattttttatttttcaaatgtaataataattataattttacagaaaatg

SEQ ID NO: 112674 - DNA, 572 bp, Heterodera glycines
  Promoter: Source sequence=SeqID_10353; Location=1..572; Strand=+; Gene=SeqID_73535
ataccgtattttcacgattatgtgcccgtctccaattatctccccctttctgaggaggttgaaaaataatatatccggacatataattagagaaaatacggtatgtatacagtagaagatcgaaaggtgacgttaaaaaatctagcctgatatgtttccacggtttttaggggcacattagtgatcagtgataactatagaacatccattactgataatgaagaaaatttaaaaatttaattcgaaacttaaaaaagaaaagaaagcttcggtgcgttgcattaatgtaagacataaaaaattctcgcccggtgtgactcgaacccagcccgggagtgtcgctttcagctcgataggttcacagaagtggtaaaacctaacgaaaaatgtggtgtctttattgttgtaatgcatttatgtacatacattgctcttgcagtttaggccccacgtaatttcataacaataaaaaaaagtcaatcatttgaaattagtttaatcaatttttaaaatttcatccatttgacatctatttttgaaaatcagcagtttcttctttctgtttaataatg

SEQ ID NO: 112675 - DNA, 417 bp, Heterodera glycines
  Promoter: Source sequence=SeqID_43569; Location=130..546; Strand=+; Gene=SeqID_71213
tgccaatttctgaataaaaggaatttattaatcaaatctaattgtaagctataaaaccgacatctggttcgagacgcccttcaaaatatccattttgctaaaagaaaaataatgatctgaagcaaaaaaataaataaatttaatggttcaaattatgatgtgatcataaggcagaaggaataagggtcaatatttatgaaaaaatggaaaattttccaatcaagtacttgcttttttgaaaatttttgatttataaaatttgttttcggtttcgtcatatagcataaatggcgaaatttttgcgcgcgaattcaaaattacactgataaatgccttttttgtattttttttttttttggtctgccaaaactcgcttcattcccaattaaaccgagcaaatttcaaatttaaaaaatg

SEQ ID NO: 112676 - DNA, 514 bp, Heterodera glycines
  Promoter: Source sequence=SeqID_5554; Location=1624..2137; Strand=+; Gene=SeqID_58437
tctgatttatgtgatgggaattgtggccacatgtaaaataatattgcaaaacaattccttctttcttttattcgctattttattttatagccatttggatggccgaaagcactgctgatctggtaataaattaattaattagccaaatgattaatcaatcaactaatttcctgtgattgaattttttggcaaaaatggcgaaaaattttgtaaaatacaccgcataattcgggatttcaaaaaaccaaaaatacacccctaaaaagcgaaagaaaaaagaaaaatacactcctaaaaattgaattttggacttcagccccccccaaaagccaagggtctggctacgcccttgttctttggccatttttgacagattcttttcaaacccaaggtgttggcattcaatcgctgtctcgagctcacctcgccacatttctcgcgcgttttctttgaagggtaccgtacctccctttggatcgtcggctgctccctctacgccctctattgggccatg

SEQ ID NO: 112677 - DNA, 112 bp, Heterodera glycines
  Promoter: Source sequence=SeqID_11286; Location=1258..1369; Strand=+; Gene=SeqID_74661
tgtgtgatttaaagatttgaacaaaaataactttgagaggggaggaaggggagaggataaaaaaggaccactaaatatggacaggtaaaaaaattaaattaagattaaaatg

SEQ ID NO: 112678 - DNA, 560 bp, Heterodera glycines
  Promoter: Source sequence=SeqID_6430; Location=200..759; Strand=+; Gene=SeqID_61546
cctgcaaaatttattatttttgttatttgtttatgctattctgataaatcgttaatgaattatgtgttacgaagccttaaaaatgtaattttccgactttttcactaattttttagcttgggcgacatttcgacgcggcgacattatgacgcggtgacattttgacgcggcgacattatgatgcgacgacattttgacgcggcgacattatgacgcggcgacattttgacgggcagcgaaaaaaagaaagaaaaaaattgccaaaaaataaatggcgtaaaaaaacaaaatgccagtaaattcaaataaaaaacaaagagtctttatgcttgatcaaatgcctaatcaacgtcaaagcttccaacccacttcaaataagtcaatagatgttttttagagataatattttaaatttagttagtatttactattttcagtgccttatttgcgttgtttagttttgatcacacttgatcagccataactcgcttcattccctataaaatcgaataattttggtatcattcgaaagatactgaaaagaaatagcataggtaatg

SEQ ID NO: 112679 - DNA, 163 bp, Heterodera glycines
  Promoter: Source sequence=SeqID_39903; Location=1046..1208; Strand=-; Gene=SeqID_68363
gaaagaaacatttttttactctttttgattgacaataatcttcaaaataattatgaaaatagtcaggtaatcttacctttgaacctatctatgaaaacaattatattcaaagtgactatcataaatgacaataacaaaagtgataaaaaatatatccagaatg

SEQ ID NO: 112680 - DNA, 525 bp, Heterodera glycines
  Promoter: Source sequence=SeqID_21; Location=1..525; Strand=+; Gene =SeqID_78594
tttttaaaaaataaaaatttttagaaatttgggggggtagggcagaattcgtgctccagtaccggggaaaaaaacaaaaaagaattttgggctttacccgggaccttttcgggttgaaaaaccgggaatttttggctggaaaaacggggaaaaaaccccccgggactggtcccggtcaaaaccgggacctcggtactcagttgtccgtgttttagtcccggtcccgctctactctagtttaaactcaaaattaaaaaagattcacccatcatttaaatttttcccaatgtgtttaatgattattttttgatgactttggcggccaaaattttttgttctgttgtttttggcgatatgcacccctggtgaaatttttcgggtttcttgcattttcttaaggtttttaggaaaattaaggaaaactaaaaaagagcagctgaacaaccgaaacaggtttttaggcgccaaactaataaaaagtaaaacctaaaaacataatccttgtaaattataattaaaacaatg

SEQ ID NO: 112681 - DNA, 307 bp, Heterodera glycines
  Promoter: Source sequence=SeqID_9472; Location=1..307; Strand=+; Gene= SeqID_71548
atttggaccgtcaaacagcagcagccgaggtttaaattacaaattaaatcagaaataacttttatttgtttaggtgcttgggcatatcacaccgcgcagcatgctcaaagttttaaatcggccaattgtgtgtctgatttgttgtcaaaaatttttcctgattcaaaaattgcggcaaattacggatccaaaagagacaaatccgcagcaattattacaagttttcataaaattaaaggataaataaatcgagaataatttaggagtacttgctccgcattctgtctccattacgttgcaggaaatg

SEQ ID NO: 112682 - DNA, 508 bp, Heterodera glycines
  misc_feature (11)..(11): n is a, c, g, or t
  misc_feature (29)..(29): n is a, c, g, or t
  Promoter: Source sequence=SeqID_26437; Location=1690..2197; Strand=-; Gene=SeqID_57167
aaaataattcnaaaaattaaaagtttttntagtaatctcaagatatgttaaatgagcattattactattttcaatataaaatatattaaaatttgtttgtaaaatatagccagcaaaaaaaaaattatatgcaaacaaaaaatattaaacatatctttatgttaatcgatatggatttttttattacgtcaaacaaaaaaaaatgtacattattaaatataattattaatttgaaaatttttttattcacaaagaaatttctaaatatgaatttattttttttattaataataatcgagatattaacaaaaaatttttgtttttctgtggatgaaaaaggtatgaaaaagaaacgcataatttttttttatttaattaaattatacaaatatttgaatttatcataaaaacatttattaatattaaaatataatttatcaaatataacttttatcaagaaagaaatgatcgaccagccgtgaaatacctattcgaccttaatgaaatg

SEQ ID NO: 112683 - DNA, 110 bp, Heterodera glycines; identical to SEQ ID NO: 99093
  Promoter: Source sequence=SeqID_32108; Location=661..770; Strand=+; Gene=SeqID_62432

SEQ ID NO: 112684 - DNA, 118 bp, Heterodera glycines
  Promoter: Source sequence=SeqID_32139; Location=1..118; Strand=+; Gene=SeqID_46285
gcccaccaatgtgtcggtgtcgcgttccttcttccgtgagctgttgccgctgtccaccatcagtcaggagggaccgtatctgttccgcatgttcaatgacaacctgtgggccgacatg

SEQ ID NO: 112685 - DNA, 772 bp, Heterodera glycines
  Promoter: Source sequence=SeqID_14838; Location=1518..2289; Strand=+; Gene=SeqID_47239
agaattatgacaccttttacattatgtcttaacaagttgatcgatctcactttttacattttatctcgcgcatataaaataataaaaagggctttggatttaaaactgctgattatgttttcatgctttgtttgagcagaggttttaattagagtgcagcgggaccgggacctgaacacggacaattgggtacaactgagtaccaaggtcccggttttgaccgggacttggaaatttcaggttttcccagccaaaaagtcccgggttttcaacccaaaaagtcccggtcttgcccaaatttctcggtcccgctgcactctacttttaatccataaaattttttaaaatagtggcgacgtgttttacggaaaatgaattgacgttttgttttttcttgtccttgctgatttggctgtttgctttttcttttgaattgcttcagcaattactcaattcatatttccaatttattaattcttcccttgagaaactatgaaatataaaaattctaaaaatataaaaaagtgcatatttttattatgtaggtatggattagctttctttgttttaagtaactttgttgctttcttttgtccttttcctttttggtcctttggtttttcttttgttgtattttttccttttatttacataatttccattccttcaattactttctttggtcagtcttcattaaccagttaattcctcctcaacttgcatatttcttcgtccaattacacttgcattttctacaaagtttctgaagatg

SEQ ID NO: 112686 - DNA, 76 bp, Heterodera glycines
  Promoter: Source sequence=SeqID_45325; Location=1..76; Strand=+; Gene= SeqID_72645
acacaaagagcgtcttcggagggcccattcggctgcccttactgtgattctgttgaacacgctgactagcgcgatg

SEQ ID NO: 112687 - DNA, 74 bp, Heterodera glycines
  Promoter: Source sequence=SeqID_5938; Location=554..627; Strand=+; Gene=SeqID_59739
ggtaaaccccagtcggagttgcgttccctacgtcaaagactgtttcgatttttttagacgacgcgtccggcatg

SEQ ID NO: 112688 - DNA, 52 bp, Heterodera glycines
  Promoter: Source sequence=SeqID_2685; Location=2743..2794; Strand=-; Gene=SeqID_81079
ggtaaatttatatttgaatttgcatatttttccattcgtattttcaagtatg

SEQ ID NO: 112689 - DNA, 338 bp, Heterodera glycines
  Promoter: Source sequence=SeqID_17983; Location=1..338; Strand=+; Gene=SeqID_82548
cttagaaaatgcattataaatatcttctaacacatatacagctttctaatgataccaagtttgtttgatttggccaataaagaaaaaagttatggcttcataaagttgtctcagacgcagttgaaccctaccgtgcctatgcaccaatttttcactgcaaaattgacacgaaaattcctatttaaacttggcaaattgcattcttcgcctcattccttcgatcattcattcagctcgtttcacttttcccttcaattcttaaatcgccatgcttttccaatattaattttttttctaataaattttataacatccttccttccttttaagcctaaatg

SEQ ID NO: 112690 - DNA, 201 bp, Heterodera glycines
  Promoter: Source sequence=SeqID_30272; Location=1251..1451; Strand=-; Gene=SeqID_60694
gaaggagtgccgggctatgtgctgccaaaagttgaagtgtgtattgatgggctgggggatgtactgatggtcttacaattaagcattttattcgatttcttggcgggggagtgggcaaatggaattttttgaaaaaagttttaaaaaaaacacaatttaaaaacgaaaaaacaactaatttccttatgttaggcaaatatg

SEQ ID NO: 112691 - DNA, 363 bp, Heterodera glycines
  Promoter: Source sequence=SeqID_4471; Location=1077..1439; Strand=-; Gene=SeqID_54561
agaagcaaatggttggacagcgggtgttggacaactacgagtatctgaagtcccttgggaggacgacatctcacaagaagaggcgtcatttgttgagcagtgcaggttgtgaagagctgttgaccctggtggagatttgcttaaacctacttaacggatccttctgtttgacgcggaaacagaaacaaaaattgttgccttttgctaacaccattcgacggttggcacgcgtgagaagtgagcagagtgcgagaaagctgatcttacaacaacaacaaccacagcaggagggaggttcactgtttgcccctttgttggcacccatactgttagaggcggctcgttatctgctgcacaaagatg

SEQ ID NO: 112692 - DNA, 312 bp, Heterodera glycines
  Promoter: Source sequence=SeqID_24385; Location=1..312; Strand=+; Gene=SeqID_55116
ttatttcaatttgcatcacagaaaaaggccgctctgttttggaaattttccgttttggggatcatttcaacaaatatttggtcacggatgacggtaaaatgcgcaatccggggtgcaaaatccttaaagcttggattttttcccaatcgtcattccccggagacattgagctgagtgtgcgcacgctcaagtcagcggtaggagtcccttcgagagatcaggccgatcctcgttcggacacgaccacagctgttccgagagaccgggtcggtcctcgtcgagaccaaaatccgtcgttccgaattctccatg

SEQ ID NO: 112693 - DNA, 110 bp, Heterodera glycines; identical to SEQ ID NO: 98226
  Promoter: Source sequence=SeqID_30521; Location=677..786; Strand=-; Gene=SeqID_60934

SEQ ID NO: 112694 - DNA, 70 bp, Heterodera glycines
  Promoter: Source sequence=SeqID_34102; Location=820..889; Strand=-; Gene=SeqID_63981
caatgatttaactaaaagttttataaataaatgatttttaacgtttttcaaacaagcaaattaaaaaatg

SEQ ID NO: 112695 - DNA, 463 bp, Heterodera glycines
  Promoter: Source sequence=SeqID_41948; Location=1..463; Strand=+; Gene=SeqID_69979
ccggtggcgcctatccggcacacgccggacctacattttccactatttttacaagttttttgccttaaaacggccaaaatttggtcatttttagtgaaaaagtccagttgttacccagccagggaaaaaaaattattggataaatttgcaaaaaaaaaaaaaaaggtcttcggaccggacccctccctttccccccccccccgaaaatttttcctggctacgggcttgccatctgttaacagtggaaaatagaaatgagagctttatacttaaattactttaacatttgtgtttttcccattcactgagccatgcgaaatcatcaattaaaggtcaaattaattgataaattaatttttctctttttattaattttccctcaaattcattcctcctttttaacaatttttttcctcaattttttgttgtttttagctttgtgtcgaagcccaatgtcgcaatg

SEQ ID NO: 112696 - DNA, 82 bp, Heterodera glycines
  Promoter: Source sequence=SeqID_256; Location=2053..2134; Strand=+; Gene=SeqID_79946
attaattaataataaagaatatttttaaggcaataaattacggtatttatttgcgctgccaatttgttatggctttgcaatg

SEQ ID NO: 112697 - DNA, 895 bp, Heterodera glycines
  Promoter: Source sequence=SeqID_41701; Location=1..895; Strand=+; Gene=SeqID_69774
ctttaagcatacattttttaactgaaaaatgagaatttaaaataaggactgccatctaatttttgaatttacacatttgctaaaagagaaattactggcaataattttaatcgaaaaatttggagtgacttactgcgaatttcccgattaattattgcagttaattaataacggtaataattttcaaagtatgacaaattcaaaatatatttccaatacataaactagaaagcataaatgtaacgaataaataaataaatacatttgtccttgtcaataccaattaatttaatctttcgtcgccaactctcatcactcacttttcgttttgtgtataaaaagggagacaaataaataacatcatccagtttttattgcaaaattttctgctcactaaatgcaataattgatttaatttacgaaaagattagctaaaataatgcaacttttgtgagcatagaaattagagtgccacgggaccgggaattttgggcaaacccgggaccttttcgggttgaaaaaccgggaatttttggctgggaaacccaggaaaaaaccgggactagtcccggtgccggtcaaaaccgggaccttggtactcagttgtactcagttgtccgctaccaggtcccggtcccgtggcactctaatagaaatacataaaattttttagccaatgttttcatattttaatgaaataaacaagaggaattttcaattttcttgcaaacactttttgaaaatattatctctaattttcatcaattttgacatttactcggaattcccgaaaattctattcacgcatttttgagtgtttctaagcatcgatcactttataaatttgttggattagccatattattacagcttttaatacgcccgtcaaaaaatg

SEQ ID NO: 112698 - DNA, 53 bp, Heterodera glycines
  Promoter: Source sequence=SeqID_3898; Location=139..191; Strand=-; Gene=SeqID_52342
tctttaaattttatttttattcaatttttattatttgtgtcgtcccgacaatg

SEQ ID NO: 112699 - DNA, 117 bp, Heterodera glycines; identical to SEQ ID NO: 111031
  Promoter: Source sequence=SeqID_24560; Location=466..582; Strand=-; Gene=SeqID_55284

SEQ ID NO: 112700 - DNA, 322 bp, Heterodera glycines
  misc_feature (74)..(74): n is a, c, g, or t
  Promoter: Source sequence=SeqID_42120; Location=1..322; Strand=+; Gene=SeqID_70086
ttttggagaaaatgccgccaatttcaccgccaagaatgccaaatttcgtttctggccaatcatttcgtgtactntcagcaagttgtccaatccgtcgccgtccaatcactgctcgagcttaaccaattgccgtccccgtcggatgccattcttgacgaggtgcagcagttgtgccaatcggaaacagtggcgggcagccaagcgctgaaacagagctgctggttggcattcggagcatggtcaacgaagtatgccagcatacgacggcacagaatgcgaaggaatgtgccggggagggcggcgccggtgccacggcaaaatg

SEQ ID NO: 112701 - DNA, 62 bp, Heterodera glycines
  Promoter: Source sequence=SeqID_6925; Location=1992..2053; Strand=-; Gene=SeqID_63317
ctattttggcattttagcagaacaccaatgcggggactgtgggcatttttgtccgtttgatg

SEQ ID NO: 112702 - DNA, 289 bp, Heterodera glycines
  Promoter: Source sequence=SeqID_22760; Location=350..638; Strand=+; Gene=SeqID_53449
atcgcttcccaaaacaattgcaacaaattcggacggaaaagagaataattgatcaaattgtggaattgtaatttcaaatttttaacaatgtatctttattttgataccacaaataattttttgctcgtcattctcaagtttaattgactttatctcattgtctaaataattgcttattaaaaaaaatgttttttttcgtctttatcatttctctattatgttcaatgtacatatttctcttttttcggctgttttttaattttcaattattacaataaaattagaaatg

SEQ ID NO: 112703 - DNA, 535 bp, Heterodera glycines
  Promoter: Source sequence=SeqID_28547; Location=1..535; Strand=+; Gene=SeqID_59152
tattacgtatataaaatataaaaattgattgatgcaaatatatttatttgataatatcaattaaagattaatttccggcatctatttctaccaatcaccgagccccagacccgaattcgaacaaaaattcgaaaagtcaaattttatgaattttgagttttatatcaattaaagattaatttccggcatttatttctaccaatcatcgaacctcagacccgaattcgaacaaaaattcgaaaagtaaaattacacacacacttattgggctttactaattgtatgtactttgtctaatattcctttggtaatttatttaattaaaaatatattttattgaaaatatttttctattaaatttaatttctcataatttagaaattgccagttgtggagatttgattgcattactcaaaacctaacgatacgatgtgtttttcaagagaaagtttgtactcacaatcagcaaaatctatgcttttaaaatgcttattttaatccattaacttttgatttttccaactctctagaaatg

SEQ ID NO: 112704 - DNA, 239 bp, Heterodera glycines
  Promoter: Source sequence=SeqID_38213; Location=1..239; Strand=+; Gene=SeqID_67102
ctggaaaaagcggattttcttaaaaatctctgagtgccctcctaattctaaaatttggcaaggtgctagaccttataccacagtattttaatgcaaaatttcaaactcttctgaaatcaatgagctgagttagaaaattacgcttggcgatttgtgcaagtttttcttcactaaaattcacgtccctaattattatattcgaacaattctttatcaacattatattaattagagaaatg

SEQ ID NO: 112705 - DNA, 445 bp, Heterodera glycines
  Promoter: Source sequence=SeqID_40361; Location=1..445; Strand=+; Gene=SeqID_68721
gcaaaatggcatggactgatgggtgggggcaaggggaggagggcatctcaattaaaaaaatatatcctcaccagcagcacataatttatgtttcgattgtttctttcttttttacatttctttgtgtgtgtaatgccatgaaagttggcacgcgaatgaatcggaaaaggacaattaaatgcccagatgaggcaaaagcggaggaaaagcataacaaattcaaaaaactaaatgagacgagagcaatggagttgtaataaatgctaatgaaaagaagggaacaaatgaataagggcagaagaatgggggaagttttggcatgacttcaatttattttaataaaaaaaggaaaataaaaaaattatgcacttttaagggggacagagagaattcggcttaacaaaacaaattttatgggaataattcaaaatgaaaaagtgaaatg

SEQ ID NO: 112706 - DNA, 1003 bp, Heterodera glycines
  misc_feature (28)..(28): n is a, c, g, or t
  Promoter: Source sequence=SeqID_734; Location=901..1903; Strand=+; Gene=SeqID_60093
agtcaatttcgcttatgtcttcagtcangtttttgtgttccactgctcacttccacatttccattcattcattttctccttctgcttaataaatatatatttgtgaagagagtccgggggatttggtcgggacggtttcccccgcccccttctgctgctcagcgtctgcgtcgtcgtccgcccagcgtcggtcttccccgcaggagtctctcactcctgcgggccttcgcttccaccggctcgtccgtcccttcccccacatttgggaaggcacggccgagaaagggaaagggggaagcaaacagctgattttgcccttggcaaagtcggctctcgcctccctcgctccccacaaaagtttttgtcgcctccttggctgcgacaaaattggagccccgtaggggtcagttgttccttgccgaaaggacctgacctccatcaatcggccgtagccgccgatcaaaaagtcttcgcccgccaaggggtgaagaacatcggctacagtcgccgatttactttctccctaccgaaagggaggaaggctcactcggccatcagcagccgactcttcgtcttgcccaaccagtggcaaggcactcggccatcagcagccgactcttcgtcttgcccaaccagtggcaagacactcggccatcgccgccgctcattcgcctaacccatcaaagggtaggcacattcggccaccagtcgccgacttcttcgtcttgcccaaccagtggcaagactcattcggccatcagcagccgactcatttagccgaacccatcaaagggttggcacattcggcctccagtcgccgacttcttcgtcttgcccaacaagaggcaagacacattcggccatcaccgccgacccaagtctcacccaacaaagggagacacaaccggccaccagcagccgaatcttcgagtcttcaccaacaagggttaaaggactccggccaccagcagccgaaaactcccaaagcaggagaatcaaaatg

SEQ ID NO: 112707 - DNA, 78 bp, Heterodera glycines
  Promoter: Source sequence=SeqID_10801; Location=1..78; Strand=+; Gene= SeqID_74061
tctagagtcaaataaaatattttcaaaattatttatttcctccccccattaatgtttatatcagctgccaaactgatg

SEQ ID NO: 112708 - DNA, 52 bp, Heterodera glycines
  Promoter: Source sequence=SeqID_31273; Location=1..52; Strand=+; Gene= SeqID_61643
tgaatttgttcgttccaaaaagcaaatttgggacagaaatggcaccaagatg

SEQ ID NO: 112709 - DNA, 141 bp, Heterodera glycines
  Promoter: Source sequence=SeqID_5369; Location=1397..1537; Strand=-; Gene=SeqID_57804
tcctcgaaatttgcacgccccccccccccaaaaatttctgtttaaaagccaataaaaaaatatgtattttcatttttatttattatagaattttattgtgaccaccatatttttaatgaataatttttctttccaggcatg

SEQ ID NO: 112710 - DNA, 113 bp, Heterodera glycines
  Promoter: Source sequence=SeqID_22407; Location=1..113; Strand=+; Gene=SeqID_53073
aagcagtacctgaagctgaactcagaaaagcggcaacgactcggagaaaccgggcaatttggtccccggagcggtatgaaccacgaaagcgaggcgcaattcgaccaagaatg

SEQ ID NO: 112711 - DNA, 100 bp, Heterodera glycines
  Promoter: Source sequence=SeqID_13846; Location=1..100; Strand=+; Gene=SeqID_77788
gttgccacgacacaaaataggcgcggctcatcatccacattcacgacacacccgtgagtggcctgagttcaaggagaacatttacaaaaacggtcaaatg

SEQ ID NO: 112712 - DNA, 704 bp, Heterodera glycines
  Promoter: Source sequence=SeqID_28719; Location=1662..2365; Strand=-; Gene=SeqID_59295
ttttacagaaatttcgcaattactatgtataatattcattcaaaaatttcaaaaaaattgcatttttgtaagttgattttataaaattatcaaaatatatagacccataataaaaatctgtaataaggcttattaaaaagcccaaaattttctttgcataataatggtttatcaaaatgaacaatattagttgccgattttttaaaaatacataaacaaaatgattctcaactatgcaaagagcctcatattctgtgtttttttcagaggatgacgtggctaaattttaaaacacttttttggacaaaacagtaaaaattcaacataaatccaaaattcaacgcgaaccaacaattcctttgatttttcaaattaagtcaaagattttaactagaatttttgtattcattttataaaattattttttatttgatttaattctgattacagctgtatgattttctaccatttaatttattcaatataataaaatcctctgttccaaatgaatcatcataatcattacgctcctcaccaaacattcacattctctcattttttcatttttaattttcataaaaaggaattttagttcgattaatttttttacaaaatattttatgtatttatgaattaaaataaataattttttgtccgtcagatattccaaaaataaaaataaacaattaaataccctcaaaatg

SEQ ID NO: 112713 - DNA, 189 bp, Heterodera glycines
  Promoter: Source sequence=SeqID_23819; Location=981..1169; Strand=-; Gene=SeqID_54520
tatattttcactatttttccaaattttgttggattttaccaaaaatgcctgtcgatgctaattagtgcccgggtttttgcggtaaaaaaagtcgggaacatgagtttgaagatggaccttgaacggggaacgcattttacttatcatcggtttggctgggcctccgtacttcgtattcctccaaaaatg

SEQ ID NO: 112714 - DNA, 1003 bp, Heterodera glycines
  Promoter: Source sequence=SeqID_8287; Location=982..1984; Strand=-; Gene=SeqID_67576
aagcaatcaataattgatttccgacatttatgcgttctgattcggttttccaattgattatttttttgagcagccgtcggaatgccgatttccaatttgcagcgcgcttttttcaaaaattcgcactcagacaaaaatgaacgcaaatatgactttccagatccatactgcaatccccgaggtttatagatgccgttttggatttggaaaatgaagaaaaataatatggctcataaaaaaatttggcagacgcaattgactccgtaaaaacccaatcgtactgcctcgactcactctgttttacgtgggagcgataaacacatgaaacaaaattgggaaagaaaatggtcggtgcccaagttgacaaaaataagactccgccccctctcccccccccccacattttcaaatcattcatttgttgtcattttttgaagggagggattagtgaccgttcgttcaccttttcctctctcattttttgttttaattatttgttggtcagacaacagcacatttgcaagaaaatgttaatgataagtgtaacagatatgcgtactaacaaatatctgccatatttattagataggattggtcaaaaatatgttgtcaaatcatcccaaacccccccccccctcccccagcaagagcaagctttaactagttaagcatggtttcattcattgtattgttcgccaaatttatttaccaaaatatacatatatttaactgacaaaactattttaggtatatatttattaacaataacataattttattctccgaaccctaacttcatgtcagccgaccaagtaatttggaatttaatttaaaaagcacttgagtaattttcataaatgttggcattatgtttaatatcaaaatgaacaaataggtatccctaaataatttaaatttgtgacacatcctaaagtcgattccatcaaaactgccccctcaccgaaacccggaaaagtatccctaactcctataaaaacaaatg

SEQ ID NO: 112715 - DNA, 390 bp, Heterodera glycines
  Promoter: Source sequence=SeqID_27827; Location=282..671; Strand=+; Gene=SeqID_58504
ggtaaaaaatgggcaaattttttgaaatttaaggtaattcccaaaaaaaaaagtcggtgcggtacggcactaccggacctttattttaaccatatttttggaaaatggaccccaaaatggcaaataggtagtcattttttggcgaataacggctacaaattcctgctttctccccggcgctgaacttccatttcttttttaaactcaaaagtggagggtgtacgtttttaattcgaattttataaatatttttgcagtgtctgcgctctgaacggtcattgttattgcgtcggccattgcatcaacgcgaccaatgcctccggggagaacggcgcgacgacactgatccccgcccgagtgctgctcaatggcgactttcggccacgaatg

SEQ ID NO: 112716 - DNA, 183 bp, Heterodera glycines
  Promoter: Source sequence=SeqID_18246; Location=1196..1378; Strand=-; Gene=SeqID_82842
ctttggcgtcagcgggaattggaccatttgaattggtgaacgaacggaccaacgaaaagctgactttggagaaagaaacgaaatattgtgcctgggcttctggtttccgatgggtgttgaagcgatgcccaattggacaaatcgttcagtgggaggttgaaaattcgaaccatttgaacaatg

SEQ ID NO: 112717 - DNA, 82 bp, Heterodera glycines
  Promoter: Source sequence=SeqID_7922; Location=1781..1862; Strand=-; Gene=SeqID_66388
tccttaaaatactgaagaatggcagacaaattttaaataaaaattaaaacataaaagaaaaaaatataaccattccacaatg

SEQ ID NO: 112718 - DNA, 539 bp, Heterodera glycines
  Promoter: Source sequence=SeqID_1959; Location=209..747; Strand=+; Gene=SeqID_77022
taatcacttaaatgaataatttatctttgttattaattaatgttttaatggttacctatcatttcgtcactgatccgtcacgttcatttcgtcactgagatataattttaaaaaatattggctaatttcaataaaattatcttattaaagtattacctaattggtttaaatttctcaaaaattatttctgggtaggagtaggagtaccaccggtggtagcccctttttcgaaaagatttttagattttaaaaaggcgaaaaatgaatttataagggttttgaggtcgcagatcacgaatttgagtgttatcctttcgatgtggattttctgctgctgctttctgtataaattccagcaaaaatgtgacgcaaattattgtcttgatcaacatagagggaattgcgctacgactttccctctaatgctattttctgacgcattttcataatcagcaacgaatgttactgtaatgactgatcgaaaatagctgtgggagctcaaagtgctgtgggagcaaaaagcaaccggggccaaaatg

SEQ ID NO: 112719 - DNA, 66 bp, Heterodera glycines
  Promoter: Source sequence=SeqID_2563; Location=826..891; Strand=-; Gene=SeqID_80433
ggtgaatttttgaatttgaatttttaaattttttaaaaaattttttattttgtcaggtttttaatg

SEQ ID NO: 112720 - DNA, 835 bp, Heterodera glycines
  Promoter: Source sequence=SeqID_15430; Location=673..1507; Strand=+; Gene=SeqID_79699
tcgccaattcccccgagggcaatttcattgcttttgggccatccccgcagggcaaatggaaaatgtttttttttggcgttttcctgctgaagttcatccatttttatttgagtgatgagacatcgaaattcccacttctccatttttgtattcatttttaaaataaatcatattttagctcagaaattgaaataaattttaaattttcattaattaaccaaaaacttcgatcgaatgatggaacaaatttcatcggaggaaaggtgtcagttttaaatgcaaattttgtattcttttttggatttgtttgaaatatttttttatgattttacatattgaaaggaagtgtccaatttcctccattccgccaattcaaattggcctttttgattttgataattaattcttaatgtgtgtcttttttttaatttggtgtctccattagcacaaattaaccgtgaataataaacaaaaagctttgattaggcggtcttttttttgtttgttttgatatcaatgaatatgatgtgacagacattaattggttatgcagtttcggagagtgcacttcgtccgccgaccctccctttgccgtggctgtcgaagaggcggacgagggcggcatttccattgaagtgccgacgcttcagggcaatgcctcgggcgatgtccacgggacgagcggctgttgccggcacattttcgtcgatgttcgtttaataattccctttttccaatttttctaatcgcttaaattcatttgttcaaaccaaatattttaatcccttcatttccactaattacccttccccttaatcagcttttgatcaatatg

SEQ ID NO: 112721 - DNA, 232 bp, Heterodera glycines
  Promoter: Source sequence=SeqID_35384; Location=1..232; Strand=+; Gene=SeqID_64947
accgaccgttcttttttttcaacatcctgagctaaccatttactgtctaatgtctatttttataatttgacgttgttttgctagagccccgccgggattttgccagggtttccggtcccggtttcaattagttagtacacaaatctgaaagtattgaatgatttactttatgtacctatgtgccaacaacttttcatgaatgaaattatctgtgcgctacttgccaacaatg

SEQ ID NO: 112722 - DNA, 238 bp, Heterodera glycines
  Promoter: Source sequence=SeqID_14090; Location=238..475; Strand=+; Gene=SeqID_78065
ggtggggtgacattttttgctgctgataatgaattttttttcccacgctttgttaaggttgaagcaatccgtcgcgaggatgttttacagatggtcgaggacttttctcagtcggaaatgcctttttcatcaaaacattccccgctgtcgtttcattcattgcatcaacaatttttgactgaacttggtccaaatcgcatttgatttaattcaatcccccttttcagaagaaccaatg

SEQ ID NO: 112723 - DNA, 954 bp, Heterodera glycines
  Promoter: Source sequence=SeqID_6651; Location=1737..2690; Strand=+; Gene=SeqID_62337
ttttttttatcaaaatctatttaaaatttcaaataaacttttaaaggaatacattgatgaataaatttgataccaaattcgtaataaagcagtttaatataaatgaattaattataataaaaatcttaccagacgtgacaatttttgcgttttggaaaactagcaactttttgtttttttcaatgaaaaaatgggggtggattatcagtagaattatggccaattggggtggatgatcagtagaattatggccaattggggtggatgatcagtaaaattatggccaatgggtggcggccgttaggagaggataatttttttgcctctttctctcgcttttatacaattttcacctctcctctgttactactgcttctttaaaccctgacttttcccgtaggataaatagtgatttatccttttatttattatttttcatgacgattgttttagcgtaatttccctatttaaatattctttgttgtcaattttaccttttttatgtttgtctcttcattcgaaaattgtattcgaattatatatcaatgtttttatgttttcattttatattgaaatattgaattcattatttatgttttatgaaattctcctttaatttcctgataaattccccaactttgattacccttaactttaaagctgccgttacaaaaacgagcagctaatatttgactaaaactaaagtggtgctgaattggaattatcccctcaaatccaatccccaactctgatttccaattccctccccacaataaattccgcttttctccaacgttccaaattgagctgattttctacttttttaaatgcgtatagaaaggcctatatacaactgtagcgatttatatattcatcatcagtcagtcattcatttcatttctttacattttaaaaatattttttccaactctcaaaactcattcggataaaatg

SEQ ID NO: 112724 - DNA, 158 bp, Heterodera glycines
  Promoter: Source sequence=SeqID_21607; Location=1..158; Strand=+; Gene=SeqID_52207
attttgaatttgtttggcattttgtttctttggactgctgcctaagctttgaaaagtcttgaaaaagttcatttaaaggcttgcataaaatatgacttggtttttcttattaattaccttctagtctgctgccattcaactattttccagctcacatg

SEQ ID NO: 112725 - DNA, 264 bp, Heterodera glycines
  Promoter: Source sequence=SeqID_27999; Location=835..1098; Strand=-; Gene=SeqID_58662
tctctgaacaatacagaatttttgcaggcggcgggtctattagttccttgtaatttctcaacaatttcatcaaccattgcgttttgccactaccagtagctccagacaaaattagagtgaatggtgcaataaacatttttatgcatatgttaatgcaacttcctgtttatttatatagagatgttgcacacatttgacccattttatccctccccgatttaatcatataattttcttttttttagcacggaaaaataatcaatg

SEQ ID NO: 112726 - DNA, 1003 bp, Heterodera glycines
  Promoter: Source sequence=SeqID_1538; Location=670..1672; Strand=+; Gene=SeqID_74333
aattttgacggaaaacgaaatgccctgaagcgcttttcatcccctccccttcccacatccattttcccaaccggcaaaaatggttaattgctggcggcagaaagcacacacaaaaaagaaattttttttaaaggatccatatgaatggaaacattggaaatttgggcactttggctgttgggggcccccgaaaaaattccaaaaaggggaatttttttcagggatttggaattgattaaaatagatgtcagattcgtgaatattgaccccgaaaacccccgtgacaaacaagttttcacgaattatgacaacaacaataatttgcaaaacaaaagggctcccttttttggaatttttttctggggtcccaacagcaaaagtgccgaaatttataaagaagattaaaactacaaataaactcttgaaaatctaaattttggtaagcctgcataaaataagggaattcatttaaaatttgatcattgaaacgaaagaatcgattgtttactgtaatctcactcatttccattcccattttcatttctccttagttcattctgctaaaatttggcttttttaattcgtcaatcaattcacgttcacttacaacaaaagtgtctatgtttttttccttttgtaattttcataacaatttccaaagatttgttaacccttaggttttttaatcgaaaatcagatgtatagcagcaatcttttgagtaatttttttaagaaaacattcgcttatgtcttttagaaacgagtacagttttggttgtgcttcgtttttggatcctaaagccatttaacacgcaaaaacttccttttctcaaaacagcgaattgtttaattccacgttgcatcaacaccaagataatacatataatttcaaacgttcattctttcttttttctttgttcctccaagtttcaaactgcacacaaaatttacctaaatttatttttagccaaagcatttcattgactttctgtttaaaaaaatg

SEQ ID NO: 112727 - DNA, 163 bp, Heterodera glycines
  Promoter: Source sequence=SeqID_8195; Location=603..765; Strand=+; Gene=SeqID_67277
ggtgagtgtttctttatgaattgttcgaccctttgcaaatcctaaaacttttaaattacccgacaattcgtttttatgtgtttttcgttcgcttcgcaacaatagccaaccgcagcactgttcacaatcagtggcacaaaatgtgaagaattggaaaggaatg

SEQ ID NO: 112728 - DNA, 845 bp, Heterodera glycines
  Promoter: Source sequence=SeqID_2381; Location=1543..2387; Strand=+; Gene=SeqID_79442
gaactgatgatgtaataaaggatgttattctaaagcctgttataatgtcggtgtaagggcaaggaatgagtcgtattgtatccaaatcaagcggtaggtcaccttaaaaaaaatcacaaaaatgaagtattttgctagcaccatcaatcgcagcgttttcattcgtttctgtcggctcttccatcaattttcatatgtggctttggcaatttctaaattctgctaaatgagtttaccaattactttcagtttcggttaatcaggtggtttcaaaaacataatcattcaggtccacaggccatttttcggcaacgtgggttctgttttcagcttttttatggaaaactgctcgttaatttttatggagatttttgttgttaattttgatttaaattaaggatctgggatcggcgatgcggaaaggagcacgcccagagaaagtttttgaaaatttactttaacagattttcaatatttccattccaagttactcttttaaatttgattttatccgagccggaattccatcaaaatttttcggcgtgattttttgatatgcaaagtaagtttgttgggagttgggactcaaactaatagtaaaggcattctcgaaaaccaaactcaaagtaaagacagtctcgaaaatttgaatttatttttcttttgcatttcgtttccataatttttttttgttaacgttgcatctgaaataatgcaattagcattgcacaaaacaaattaggtaggtattttttttaatacaacctttttcatttctcttttttattcacagatatttgacttttttcttctagttcatgtgtctttccaattctgtcagaatg

SEQ ID NO: 112729 - DNA, 1003 bp, Heterodera glycines
  misc_feature (856)..(856): n is a, c, g, or t
  misc_feature (974)..(974): n is a, c, g, or t
  Promoter: Source sequence=SeqID_20579; Location=339..1341; Strand=-; Gene=SeqID_51134
gggggggggggggggggggggggggggggggggggggagagaaaaaaaaagaaaaaaaaaaaaaaaaaagaaaaaaaaagaaagaaaaaaggagtagaagacgaggagaaaaagaacccgcttttaaaaaaaaaaaaaaaaaaaaaaaaaaaaaaaaaaaaaaaaaaaaaaaaaaagaaaaaaaaaaaaaaaaaaaaaaaaaattatttttttttttttttttcttttttcttttttccccccacccccccctcttttttctttataaataaaaaaaaaaaaataaaaaaaataaaaaaacaaaaacccaactatattttttttaggaagagagggttgttttttgttttcccccccccacaacaaaaaaaaaaaaaaacaaaaatatatttatttttttttttgtttgtttggtttaataaaaaaaaaaaaccccccccccccacgagggggggggggacccccaaaaaaaaaaaagagaaaaaaaaattttttggggggtttaaaaaaaataaaaaaaaaaaaatttctttttttttttgtgggagaaaagagggggtttttaaaaaaaaaaaaaatataaaaaaaaaaagggggaaaggcggggggggttttttccccccccggttttttttgaaatttttttacccccaaaataagccctaaatttgaaatttttttttttttttttttttttacaaaattttttttttaaatcccccaaaatggttcaagaagtaagggctttggaaagggggtttttggccagggaaacggggaaaattgttaaaattttcaaattaaagcttcaaaatttttatttccatttgttttaagggaatttgaaagcaaaccncaaaaaatcatcaaaaatgcagaaaaaatctgtgacaatgaaaaaatggagaaagcatggagaagtagtgaaaatgttaaggaaatggtctcaacaatgaaaatacaaaactaaatgntcgacaataagctagttgacggaaaaatg

SEQ ID NO: 112730 - DNA, 465 bp, Heterodera glycines
  Promoter: Source sequence=SeqID_25796; Location=1..465; Strand=+; Gene=SeqID_56560
tttttcttttcgcaaatcggtgctaggagaaatcgggagtttcggttttcgaatcactttttcaaagaattgcaacaagtgcaatttatcattttttaaacaaatctggttaacataccataattacgaatcctgggaatcaagagtctcgggttttcgaatcatattgacactaaaaattctttaacatatcaactaaataaaaaaccaatacataatcaataaaccaaattttttttatttgtatgtcatgaaattcctgtctagcttaaacaaaattttattatttttttgttataattaatattaataataatattaaactgttttcgctgtttattatttaaatatgtgaagaattttaatttctgaatatttttctcatgctgaattatttcattgcttataaaattaaaattaaatttaaattaactttttcccattttaataagagaataaagcatg

SEQ ID NO: 112731 - DNA, 254 bp, Heterodera glycines
  Promoter: Source sequence=SeqID_9654; Location=1902..2155; Strand=-; Gene=SeqID_72207
tctctaacctctcttatctgcgtgctctctcacctaatcgatattgttggcgtacgcgcctgataggccacgccccttttcctctgcttctctgacctaactctctttctttcgtgtactctctcgcctaatcgataatcgtggcgtacgcgtctgataggccacgcccccttttctctgttttctgacccccaccgtaatcctaccgtcattcttacttcagcaatcatttattcctactgtattgaaacatg

SEQ ID NO: 112732 - DNA, 348 bp, Heterodera glycines
  Promoter: Source sequence=SeqID_12000; Location=3088..3435; Strand=-; Gene=SeqID_75522
ttgatccgtttgtgagagtcctttcactttctgtgagaagcgttagccatcactttgaaatttaaaattgaaatttccatttttctccacccatccaattcgaatggattcgctcaatcgtgaggtgtcttttctcatccgctgcccctcattcgctaattaatagatcaaagatcgggtgcgcgattcgcattggctcggttcgtacggcgacagtccgcacgcgacatttagcgacattgtgatgagaaggtgacgagaattgccggacaggcgaagaccccccccccctctctgatggtcctccaaatttaagttttgatgaggtgaaaaagtctgggagaaatg

SEQ ID NO: 112733 - DNA, 526 bp, Heterodera glycines
  Promoter: Source sequence=SeqID_7466; Location=562..1087; Strand=-; Gene=SeqID_64909
aattaattggattttaattaatttactttttggccaaattcaatgatttttgaattaaaaataatttttagaccaaacattgtttaacgaattgaccaaagaagcgaatttgattgaaatggttgaggaaaaagaacgtgagaaattccgattgacgaaattggcacaatttccggaaggatggcaagaaataaaatacggagaaaattcaaaaataaatgaggaaaaaacaaagcaggttttgctgttttattgcataatattgagtaaagcattagccaaatttaagattttaaaagagacgcaaaaaataaatcattcaaaagaaacgcttaaaaatttgacggaaaaattggagaaaatcattcaaaattgggtgagagagaaagggaagggccaaatttggaaaaacaattagtaattaatttgccaatttagtcggcggaggtgcgaattcaattctcaagtttaatgcatttgcaaatgcaattggaccaaatcgacgccattggcattttgccgcatg

SEQ ID NO: 112734 - DNA, 371 bp, Heterodera glycines
  Promoter: Source sequence=SeqID_15660; Location=1725..2095; Strand=-; Gene=SeqID_79961
tgttttacattttttcctttattttttctttattatcattttttctttttcattttctttatttatgctgatttttgtcaaccctttttataaattaattgaatgcattttttaagtttttattactagcttttttaattggataaatatttgttgttttataattttctattaactttttcatttattccatggtaaaggcgctgaatttttctcccccttcactggctcctgtattctatacgatgattattttttaataatattttgtatttatttttattatttataaatgctattttaatttataataagtttatttcattcggttatatataattatgtaattacagttaattggattaaatatg

SEQ ID NO: 112735 - DNA, 1003 bp, Heterodera glycines
  Promoter: Source sequence=SeqID_7063; Location=1762..2764; Strand=+; Gene=SeqID_63715
aatcatgggttttctatcgacaaaatatgattcttcataatttttaattgtctcatattttgtcattttttaaagaaaactcgtacaaattgagcctagtaatcccaaaaaccagcctttttgttgaaaatctgttaacaaatcacaaaagtgataagaaaagcaaactgaattctaatattattcgatcatttagtccgaaaatgattatttgtttgaaataattgaaatatatttggtttgaaatattgattaaatatattataattaattttgctttaactttggattttaaaaataaaaaaccaaataaaaaattaattatttatattttcgcttgaaataaattaaaaattaaggcttgcgcaaaatttggtaatttttttgacaaaaacctgttaacaaatcgcattaaaaattttcccgggacacccctccccccgtcccccaaaatttcctagaaaaagcacgccggaaaaaaacgtttttaatgcaaaaaaatcaatgcttgtctattaattgcaaaaattggcctttttggtgaaaatctattaacaaaccagaaccaaaataaaaaaatttttccgacggcgccatcggcaacgccggaccccctccccccgcccactcaccaaaacttgtttggaaagatgcgccgcaaaaagaatgttaaaaatcttgttcttctgatcccgaatgcactgaaatttacgatttgctaatttcctccccaaaattattgaattcgataatgagagacgaaaaaatataatatttaatacttttttgatcgaatcattttaaaaataactgatttgaaacaattttgcaaaatattcttataagcagaaactattaccacgtctaaccttaaattagacagttgttgccaggtttccatatttacattttttaattttaagtgcatttgggttttttaaggatggaatcacagctcgtgatttagtatttttttaaaatttttttattatagttcacgatg

SEQ ID NO: 112736 - DNA, 389 bp, Heterodera glycines
  Promoter: Source sequence=SeqID_28966; Location=1769..2157; Strand=-; Gene=SeqID_59540
gaaattaaatataattaaaatttattaatttgtatttgttagggtttccttcccaactccaattgcagcggttattggcaccaatacaagtgagttccctaatttatgtatgaaaatttttttttatccagttaaattactttaaaattttgggaatcatttattttatggtatcatccgatggtattagcctcgaaattttcaaaaaatttgttaccaaaatttattttttcgcagtctttggccatatgcttttgcaactattaaaatgaatatttttcggaaactataagtaaaatattattcctttccattaccgtaacatcgaccatattgttacagaaatccctgctgtttaatctaccaaattttcgaaccccttttttatg

SEQ ID NO: 112737 - DNA, 209 bp, Heterodera glycines
  Promoter: Source sequence=SeqID_13194; Location=1046..1254; Strand=-; Gene=SeqID_77016
agaggaagaagcaaagaataataatttgatgggttttcggattggttcatttttgaaacggcacagcttcaaagacccatcagttgcaattctctcctctctctctaagatttgaccattccgtcgaagatgtgacggagctccgctttccgctggatacagtaatcacgcaaattgaagacgacgcaaacgatttccacgttcaaatg

SEQ ID NO: 112738 - DNA, 163 bp, Heterodera glycines
  Promoter: Source sequence=SeqID_10375; Location=1..163; Strand=+; Gene=SeqID_73563
aaaatatatgattgactattggtaaaatttttgaaaaaaatttcgcattttcgcatattttggcttttcgcatttcgcttttttttcattctgcattttcagtttggcaaatttcgcttttggcatttggcttgttatttttcaatcttgcgcatccctgatg

SEQ ID NO: 112739 - DNA, 384 bp, Heterodera glycines
  Promoter: Source sequence=SeqID_12827; Location=657..1040; Strand=-; Gene=SeqID_76549
atttaaatataatttaatttacaattatatatgttcacgtcacttttattaatcactttttaaagacaattaaaattgcatttttcgtttctgagcgaccttttaattttttaattaactaatttatgacacttcgttttaattagttgtcgtccggacgaaattgcgtcacttttatcagcgagccgactaaagatgttgtcaaaagttttctttatgatcatacttcaacaaatattttaacacttcaaagtgtaagcgcttttttcagatttattatttactttaattattttaattaaaatcaaaataaaaattttccaatatttaaaattttatttaataaaattaattaataacaattaatttcagtcgcttccaatg

SEQ ID NO: 112740 - DNA, 335 bp, Heterodera glycines
  Promoter: Source sequence=SeqID_8518; Location=1160..1494; Strand=-; Gene=SeqID_68368
tggtggggggagggggaggagagaagcatgtagagggaattcccccctcccccgccccacattcccttccaatacccctatgtccccatgcccctttctctccccctttctcccctgtacccccccccccccctttttccctatgccccgtactttctccccatatctctctcccttgtccatttgcataaatcagtattccgctctttcccattcgttgctccctatcactgatttgaagtttcgtttgttctgatttggccaagcgttgctttcccttctctctttggcctttcctttgccattaatccactgatcactttcttttttagatg

SEQ ID NO: 112741 - DNA, 178 bp, Heterodera glycines
  Promoter: Source sequence=SeqID_15939; Location=1..178; Strand=+; Gene=SeqID_80289
tgttccccggaaattttttagaaaaagcgcgccgcaaaaaagtgcatatgcggtgaaatgaggaaaattaccaacagaaacaaaaaactattcgttaaaatttcatttcggcgaaaaatacaagtcatttgaataaatattaaccatttttcattgcatataataaaaattttaaatg

SEQ ID NO: 112742 - DNA, 187 bp, Heterodera glycines
  Promoter: Source sequence=SeqID_4696; Location=1517..1703; Strand=-; Gene=SeqID_55434
ggaaaaaagctcgtaaaaatgatatcaatgaagcctcaattcgtggaatggaatggcttaaatgggaggaccaagagagaattcgggcgcgaattacggagctcaaaggttacactggtttttacaggaactacaatattattcagagtccgatgattctgcttacacacccaaagccgccgtaatg

SEQ ID NO: 112743 - DNA, 79 bp, Heterodera glycines
  Promoter: Source sequence=SeqID_9966; Location=1..79; Strand=+; Gene =SeqID_73007
gggggaatttgggggcggaataatggggttggggcggaataatgtgtctgatactactaacataatatttttgcagatg

SEQ ID NO: 112744 - DNA, 218 bp, Heterodera glycines
  Promoter: Source sequence=SeqID_40462; Location=186..403; Strand=+; Gene=SeqID_68790
tttcgagatgagtttgaacttgttggatgtgaatttcgaagattgggtggcctttttatattcaaattggccggggattggcgaagtgatttgatgaaatatttgtttgttcactttaatgatcagaaccattcccggcggaacacaaccacaaaagtatttgttcacctttttaacattgaattcgcatagaaaattcgtcaaatttcagtacaatg

SEQ ID NO: 112745 - DNA, 109 bp, Heterodera glycines
  misc_feature (3)..(3): n is a, c, g, or t
  Promoter: Source sequence=SeqID_7431; Location=4700..4808; Strand=-; Gene=SeqID_64794
ttntgattgttattttggttcgtcaatatttcaaactttgaatttccatccacggaaacttaagggtattttattgaaaaaatgcaatttaattacaaatattaaaatg

SEQ ID NO: 112746 - DNA, 478 bp, Heterodera glycines
  Promoter: Source sequence=SeqID_8468; Location=1799..2276; Strand=-; Gene=SeqID_68171
gttttccgattttgatcaatttctgttttctattcttattttttgtttattttcctttgagattttagagaaaattagctcgcgtaattacaatatttttttcatctaattcgttaatttttgtgccctcgtattttttacttttttaaatgtttttcaattttattaataagctattcattttatttgatttttatgtcgatataatgacgattttttggctctgagaatcgcccaacaaaacacggtacaaaaaattattcgttctcccattgcaaaattttttgtcttgccaattttggttgtgccatcattgttcatcaacagtttggcacaagacgttaattttgaacttcgaattgtaacggtggccactgaaaatacggacggattgtgtcggctgaatcggtcggcaaatgcatttgggcaccaattgtttgtggttgggatgggcgaaccgtggaatggcggggacatg

SEQ ID NO: 112747 - DNA, 1003 bp, Heterodera glycines
  Promoter: Source sequence=SeqID_17388; Location=361..1363; Strand=-; Gene=SeqID_81871
gaattttgactgaaaccgaaactgagtttactgtggaagttacagtaacgatgataaaactgaaaagaattgatcgagccattaaagaaaaagcactgataatctgactccaccgtaatggctccccagtaatccgacactggcggaatttttaaataatattaaaacttttaatttaaatctataaatttttaattaaaaataatttaatgaaacctggatgaaattttcgtaattgttgaaagaatcacttattcattcctattttaggtaccttttataaaattaagtgcttaaaaatcctactctatttattaaatgttattctataaaaattgtttaaaatgggatttttttaacttttgcctaattttttcagattttttttgcattttttcttgcttttttggatttttatgactattttttcaggacttttttccatttcgtgatttttgcgtttttatgacttttttagaaactttttgaagatttttagtgacttaaattcccaaccctatttataaaaagcatattagtgtcctatttttccggtgtctcattttttcattttttaaacttttctcacggtatcggattcttcgtaattggcggttttttcccccgttttctcctaacttcgttcgttcacctgtttaacacgcgctattatgagcccctcttggcgcataaagaaccttttgcttttgaacattcgtggataaattaggcgcaaatcagtgtcattaaacggcggattaacggagtggcggagaatggcaaattggaaaatgtacgaacgatggtcagaggaacagccctttaattggggggggggagggaagcatttaagcgagttgtggcaattagtgccaaataatttgacagaaatgagaccttgcggagaaagagaacgctggcctaaaagaaagtctcagacttaacgatcagtcgtaaaagaggacaatttgggcaaccaaatgatggcccaggacaaaaaatg

SEQ ID NO: 112748 - DNA, 379 bp, Heterodera glycines
  Promoter: Source sequence=SeqID_1909; Location=765..1143; Strand=+; Gene=SeqID_76711
atttttttttatgtgtgttgaatagagtgcagcgggaccgtgaaatttgagcaagaccgggaccgggactttttggccgggaaaaagccgggaatttcccggtcaaaaccgggaccttggtactcagttgtccgtgttcaggtcccggtcccgctgcactctagtgttgaattatcatttagttttttcgggccatatgtttaggggacactattttccttccactgaaacttttaaaactgaattttagttttctaaatttcttatagggtttttttctagtaaaaaaaaaaaaaattttttttttgattttttattgtacttcaatacccaatttttctttataaaatttattcgaaaatttgtgagtaagaccatg

SEQ ID NO: 112749 - DNA, 1003 bp, Heterodera glycines
  misc_feature (197)..(198): n is a, c, g, or t
  Promoter: Source sequence=SeqID_30105; Location=85..1087; Strand=+; Gene=SeqID_60544
ttttatttatttgtgcttgtataatccgattcttttggacgattaatgtatgtatatgtcacaaagtaagtggattatccccttttgtggacttttcttttctttataaataaataaataaataaagtacagaaaaatgaaaaatcacagtaaaaacaactttttaaatttcagcataaaaatgtaaaataaacatnntaaaaataaattcaacaataattttaacaataaaaaatgtaaaaattaacagaaattcgcgggttcataaggtaatttggacaataaaacaaaaaatcacgggttcattcgatagttgcgagaaattccccggagaaactccaaaataaatgtgaaattgattttttgaactcgcatctccaaaattttgtcatcccatcagaactcattttagcgaaggtgtaaaggtggccttcgtaagacaattttactttttgttttttggttgcaattgggtaagccatttctgaaaaatatccaaatcagaatgtacatcaaattggttaactattaaaaaataataggatttggaataagtaaaattgtaaaaaatgagcgagtgttaattaaacctaacttatgccaagtggcgagggatccctcaggcttagtttttagattcttaatttttaaaaaagcacattttccgatttttgggttggggcccaaacgaccccggggcccaaaaacgggggcccaaacgaccccggggcccaaaaacgggggcccaaacgcgggggcccaaaaacggaggcccaaacgctctggtcccctaccctgtacgtttcattcggaagtcacaccgtcacttgggtacctctcctttgttagtaattttttccccaattttttcgtttttcgtgactataaaaatgtttgctttttccatttctctctcattatgaaaaaatatttctaacgcaattatttccctctttgtgacatccttcgaaatactgcgcattgtgctaattgacacaaaatg

SEQ ID NO: 112750 - DNA, 435 bp, Heterodera glycines
  Promoter: Source sequence=SeqID_17655; Location=1113..1547; Strand=+; Gene=SeqID_82183
ggtattaactttgttcccaaagaaacgtctcaaaaaatcctattatataaattttttttcaaattaataataatttataatgaatgactgatataaagccggcacattcgtcatcaaatttacctctggaataacacacagacatttacatttaagcttaaatatttttttaattatttttgtaaattggttcacctatttttattttttacgtaggaattaatgcccgtgttatttctctaattgggccgaaccccctcccccatatttgtaattaattctctctttggataagtcgttggttaaaatagaattttaaattaaattgaataatgaaaaggataattaagcactaaataatttttgaaataaattaggataattttttattcaaagcgatttaaatgaaaaatggcataggcaaaatgtaaaatg

SEQ ID NO: 112751 - DNA, 1003 bp, Heterodera glycines
  Promoter: Source sequence=SeqID_12564; Location=1080..2082; Strand=-; Gene=SeqID_76224
atggattctgatacttttgggcccgataaagaacccgcggtcttaaacactttcaaaataggctaaaattggcataaactgaaaaatttggcgtcttgcagcctgttaagttttagtgtatgcacaaaaaacgagaaatgaaccaataaatagagagtgcagagaaaaatacatctctcattttggggtactatttctttatctctattattagagaataactgaatttacttttatatgtaaaaaagcttaatatttgcttaaaaaagcttcttttcgactgataccaagttgtccaatttgattggcaaaaactttcaaaaataatttttgaaaaccgtgattttttaactgtttggtcaaaaaataaataaaaatacatgtttcacaacggactctaaccgccgccctttatccctttgctatcttacaaaaacaaattcgtcacacatgcaaatctcttttgaactgggagcctagaattaattcggtgtgtgcaggagctttttttataaaatagtttggaaattaagcgactttttaaattttgcaacttaaagaggtccaatctaaatatttttgtgccaattttctgccaattttgaaagggttggaaaccggtttcttgaaacggagccaaaagcgtcaagttggaaccgaaccgacctgccctattaaaaatgatcagctcaattttatttttatggtttaattttcagcatttttatttccagaaaatttcttttgaagaaattgcaaaattcaaaattatttattttaaaccctttaatttgcctaatcaattaaattgtaatcaattaaatattttcattgtcttgtctagtttttactttgcttcaacataaattcattctctgcaagtagtcaataaggtgaggaaaagataaagatcattttcccagcattaattgattttttattcccaattttgttggacaaatattatttaaataaatattattgtgcttttcgagcttcgatg

SEQ ID NO: 112752 - DNA, 377 bp, Heterodera glycines
  Promoter: Source sequence=SeqID_14801; Location=1..377; Strand=+; Gene=SeqID_78949
ccgaccctggagcggctgatcccgtgcatttggatttcgcccattgactgcttttttgagggcgcgaaaccactgtattaattttgaaattacttcagaaaattcttgcaagaacccaaacgctttcaaaaattgagaaaatttttgatttcctgctggcaaatcctcttggaattttgaaaatcatacaaaatattgtttttttttaaatattggggggggggggtaagaaagattcacgctctttaaaacccaaaaaaatccgataaattttgaatttttgcaataaattttttaacccctcccttttttaaagcggtccgtcgcccccaattgacatacaaaacattccgttgggccccctgctgcaactgatg

SEQ ID NO: 112753 - DNA, 285 bp, Heterodera glycines
  Promoter: Source sequence=SeqID_1817; Location=1539..1823; Strand=+; Gene=SeqID_76152
aaatttcgttttgaattgacgacgttatttttaattctaaactttaattaataaatcgcgctgggatttttatgtgctaaagatcctgaaatatgtaataaaataagtgctaaaaagtattaaaaaatgtgctaaaaacaaaaaaaaagccaaaatatgtacgaaaatatgtgctcaattggaaaaaccaagcctatctgtgcataaaaatcctcagaaaacctcatttatcatttcccctcaaatacatatttatatttttgcaaaatttaaatttcaataatg

SEQ ID NO: 112754 - DNA, 1003 bp, Heterodera glycines
  Promoter: Source sequence=SeqID_2089; Location=5058..6060; Strand=+; Gene=SeqID_77800
ttcgtaacactggtgctcttcatggccacaggatttacaaattgtaacggcaaagcactgatgcagaaatatgtatgtttaaaattgagattaaaagcatgagaaggcaataaaaaagatattgttgattttttacagaagtgaataaaaattatagataaacattcgcaatttataaaatttgcgtcagccatttttgctgaaaggaaatttgaagcaaaaggaattgacggaccttcaaaaacaaaaacaaagtccgcttcaattttttgtaaaagcacagaaatatatttgctggattcgaataccgtaaaacccgggaacattttccctggtatgattgtctcttgtacggttttatgtaatttgggtttgggtcttcatccaactcgtaattcgcattggtgaggctattttaagagacagaaatttcaacgggtaggaaagagagggttgagaaatgtttataattcttcaaaacattacagcaaaagaaaaatgatgaacgaatgagtgaaagaggagaagcataaagacttttatatgaatgatgttctgaaagtgatggaaaaattacctaatgcatattctacaaccaaaagtttttacctcaacagtctgggtggtatataaataggcaaaatgttaaggcaccttccatttgacttttttccaacggcagaatttgcctcgtcgctcatcactccgtcccatttccctttgcaataatgcagcggaagcaacccaataatgtaataatcattattcaaaattgtttgttttttaaatttggtcttgttacaggatttgctgaacgtcagagacaaccattggagtgccggtggagaaggaacgcgccacacacagaaccacgggagtgccggcggagaaggaacgcgccacacacagaaccaggggagtgccggcggagaaggaacgcggcgccacacacagaaccacgggagtgccggcggagaaggaacgcgccacacacagaaccatg

SEQ ID NO: 112755 - DNA, 394 bp, Heterodera glycines
  Promoter: Source sequence=SeqID_41540; Location=449..842; Strand=-; Gene=SeqID_69629
ccttggggaaaaaggaaagatatttttaataaaattttaaaaattgaagaacaaaatcggcgctagtattaaaatgataaatatttgaaattttttccagttttttttataatatatcattaatatttattattttttttataaatttgaattacattttaatttcttaatagggatccatttcaagacatatttcaatggatttacaagcaaaatttgacacattataaaattggaaaaaaattccaaattttaacactttgacactagcgccacaaaacttatttaagtgaaaaattttcatatgtgaattttgatgaatttttttaattattaatgaaatatttagggaattacatttttaaatttatattttattttaggaatttgaatg

SEQ ID NO: 112756 - DNA, 91 bp, Heterodera glycines
  Promoter: Source sequence=SeqID_7063; Location=4072..4162; Strand=+; Gene=SeqID_63716
cgtcagttaaatattttaaaattaaaaaaaaatgaaattaaatcaaagatttcaatggcattacggcaattgcaacgaggcgtcggcaatg

SEQ ID NO: 112757 - DNA, 179 bp, Heterodera glycines
  Promoter: Source sequence=SeqID_20805; Location=995..1173; Strand=+; Gene=SeqID_51383
aaaatatttatttaaaacaaataaataaaaagttaatcaaaaaaagaaaaaattgaaatttctttcatattgttaaatatgtaaataccaaatgtaatagaaaataaattaatcctttaaatatttattaataataaaacaattcttttctccgtttgaataaaattatttaaggcatg

SEQ ID NO: 112758 - DNA, 472 bp, Heterodera glycines
  Promoter: Source sequence=SeqID_12208; Location=2198..2669; Strand=-; Gene=SeqID_75781
agagcacacacaaataaagcaaggacagacagaccattacggattacggatttgatggaatattttgggggcgcgaaatgcattccaaatttgttggcaatggttgaagaacattggtctcggtattttttttattttaggaaattgtttctatgggtagaatctgaggcgcgaggcaagaatcaatgccttcttttggctcaatttcgaactcggacacggatgaactcggattcggacatttttcgaattaaaattttcattttttttgcaaaatattgccaagaattttaaatttttccgaaaaatgttcgaaaccgggttcggggttcgaaaatgggcaaaatgaatgcagctgcttagttggattacccctaaaatagttttcttgaaattaaaataaaatttgggaccagtctttgcctccatttgcccattttattttttttttgcgacatttttcgtaaaaatg

SEQ ID NO: 112759 - DNA, 124 bp, Heterodera glycines
  Promoter: Source sequence=SeqID_9034; Location=3682..3805; Strand=-; Gene=SeqID_70068
cttctacgacatactgacagcgccactgccggcggcgacgaaagagttgcagttgcgaaaccatccaacaccagctgaactgcttcaaattgcggacgagcacatcggagacttaaggacgatg

SEQ ID NO: 112760 - DNA, 364 bp, Heterodera glycines
  Promoter: Source sequence=SeqID_20122; Location=1..364; Strand=+; Gene=SeqID_84910
cgtttttatagttaaaaaaaattcaggcgggcaatggcatttcctatctgatggaccgcggcttttttcatcgtcggctccacgcccgcgcctgtatcgttgacagtgccggcaaaacgttgcgcatcactgacttttggacgggtacggtctcaacactcctgttttattcaaatttcatttgaacagagaatgaccccggggacattcatttgttccaaagagacgcctatttgcccaacactgtgcttccgtccgctgttatgtaccgggacggatggaggtcatcatcttttatccaattgaatattcacatttaactttggcattttgttaatagtttagatgcagcaaagcatagatg

SEQ ID NO: 112761 - DNA, 385 bp, Heterodera glycines
  Promoter: Source sequence=SeqID_16312; Location=1..385; Strand=+; Gene=SeqID_80703
tcctttgccaccagaattgcctcataaacagaaatccctctagaccaaatatccgctttcacagacaacttaattttcctattaataaaatagcttttaaaatatgggcttattgtaaaaaaaaaatttaaaataataatattaatttactttaacagaaaaatttgccattttttctatttgtttttatttaattttttactattgagcaagaattttttaaattttttccaaacattaaaaacatcattttagacttttcgtttgtggtttcttgtgcccacagcctaattattaatattaattatgaattcttttatttgttcccatttaattaacttgtttattgccaacaaatatttcaggactactgtatttcccgatg

SEQ ID NO: 112762 - DNA, 491 bp, Heterodera glycines
  Promoter: Source sequence=SeqID_3502; Location=4438..4928; Strand=+; Gene=SeqID_84937
ttatgtttgcatatgtatttacgtctatcctgcctttttgattgtttttggtgcacttcataaataaagagaatcagagcctaccattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacgaaggagtagagagaaatgaagtcacatagaaattttttcattccgtcttcaaatccactcatttatttgttgctcattaacattttagcgatctcgtagcctaatacacttacaactggatggacaacttgacttcgtataaattcataacgttttacattcctctcccgcactttagcatttatttttttcaattagacattaatatacatcttctaggtggcgctaattgcaggcatg

SEQ ID NO: 112763 - DNA, 229 bp, Heterodera glycines
  Promoter: Source sequence=SeqID_218; Location=4490..4718; Strand=-; Gene=SeqID_77996
attgcccgtcgattggcctgctgtcaagacgatgttgttgttgtttgctagttttagacatccaaaatgttcactttcattaattggaagcgaaatttgttgaaaaatggtataataatgcttccgctttcattttttgtcaaacgcttgaaccgatatggtattgctaatattgcattgcattatttattaaaatgcgcatttatgaacagtttgaattgacagtatg

SEQ ID NO: 112764 - DNA, 546 bp, Heterodera glycines
  Promoter: Source sequence=SeqID_11614; Location=2406..2951; Strand=-; Gene=SeqID_75063
aatggccccaaaatgccttccgcccgaacttttgttcgaacttgtgcctttattccctgtcgaggaaactcttccgaatgtgttttatcctgtcggctgcttcacaattttttgcttccacgtgttgacaaatggaaagaggtatgccgtgccatttttgggccaaggaatttgatttaaacttttaaattgaaagggtaattctgtcaatggtccgcccttttttggaagaaaatttatttatttattttacaaagtcgtgaaaatatgtttatgggcttttcagggcagttgatcattaatctaataacattcattttgactaattatgaacccgggcccgaaatcgaaccaaaagtcgagaacttcaaaatctttcaactagtggaaacttattctaatggtttttagggtcgctgatcacgaatatctgatatatttagaccaagtccggcttcctaacttattaataaaaaacataaatcgaaaaatttgaatttttgacctttgttcgagttgggtttgagaaattggtcaaaatagatg

SEQ ID NO: 112765 - DNA, 75 bp, Heterodera glycines
  Promoter: Source sequence=SeqID_35946; Location=729..803; Strand=-; Gene=SeqID_65399
gggagcaaaacaagggaaaatagggaaaaataaaggcactttttgacagtcgaaaggcgttaccaaaaaaaaatg

SEQ ID NO: 112766 - DNA, 214 bp, Heterodera glycines
  Promoter: Source sequence=SeqID_1188; Location=3862..4075; Strand=-; Gene=SeqID_46660
aaactgtttgattatatacttttgcaccatactgtatgtaagtaatttaggtattgacaattctgaaattggcatttcgttatttgtttttcatatgaatttccatttttcatttgattcagtttcactttcaagtactctgttctgtatttcttttatattgtgtatttaccatttttctctttattttcagtactagtagttattaataatg

SEQ ID NO: 112767 - DNA, 232 bp, Heterodera glycines
  Promoter: Source sequence=SeqID_3621; Location=529..760; Strand=-; Gene=SeqID_51148
ttttctatcgctcattttacttttttttaacctgcaagataattatgtagataaaagagataaattagagataatgaaaatcacttctctggagataaattaaactatttgaacaaaatatattccttcccaaattaccgattttattttcttcctttttttctctcttttggccttatgtatgtatatcaatttttaaattttccgtttctgtttagcaaaaaaaaaaatg

SEQ ID NO: 112768 - DNA, 611 bp, Heterodera glycines
  Promoter: Source sequence=SeqID_18964; Location=1122..1732; Strand=-; Gene=SeqID_83697
aagccatgaaaattgaaggcggacgaaagaatgatgaatgctaattgaccccatttgcttgttgttgttgttgtttcttttccgtcgggtcaattgtttgtccgcacttttttgggattagatatgtagattaaactttttgctatccattttcataaatattttttcagaaactgctctaaaacgcgccaaattttatttacaagataaataaggctctctgatgcttcttctatcaaaaagggagatgaataaaaatttaaaaaattttttaattgttttttaaatatgcgcaaaagtttaggctaaactttttagtgaaatttcaatcactcatagttttacgagaagtgatcagaaaaatcccagattttgcagggtaacaactcagaagaagcagatattagctttaaatttcctttccattttgttgcatttgaaatttttcgagattcctattttacgcactttttcaatttttgcaaaattaattcataaatcttttttcagaaactgctcaaaaacgcgccaaaaaggggagatttaagctttttcggctgaacaaattttgagaaatttcaagggttattgattttttgattgaaaaaatg

SEQ ID NO: 112769 - DNA, 133 bp, Heterodera glycines
  Promoter: Source sequence=SeqID_2580; Location=1464..1596; Strand=+; Gene=SeqID_80528
ggtgtttctcctttgctttttgtttacttatttgacttgttcaggtacaattccccccgtgggctttgcgccccattggggcgggccgacgatgtgtttgagttgcttccaatttttccaattgcctgagatg

SEQ ID NO: 112770 - DNA, 377 bp, Heterodera glycines
  Promoter: Source sequence=SeqID_37805; Location=183..559; Strand=+; Gene=SeqID_66790
tttgaaacaaatgtatgtacgttaattcacttggcactgttcacaattcaacccttttgtgttgtgtttgcattcgtaaatgtcatggacaacctcataagaacggctttaaatcaacaaaataataataattaatcaaattgaaaattgtggcacattgccgcgcctggcatggtggccgtactcatattttgtgtatcatcgtgctgaattaagatttaatttgaaaaatattcaaaataggaaactctcgcacattttggcgcactgcaactgcacacaatgcaaaaaaaacgtccaaaattgtgtataaaagtcgctgttgtgatgcatttttctcatattttactaaaggggcgtaacacaacgagaagatg

SEQ ID NO: 112771 - DNA, 777 bp, Heterodera glycines
  Promoter: Source sequence=SeqID_4078; Location=980..1756; Strand=-; Gene=SeqID_53095
gctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgagccctggtcataacaccgataagagacaatggccaatgaattaattgttgcacgttttgtttttctctttaaatctggggccggttccgtcttagtagtaaaagagccggttccgtctcaaatatttttggacccaaatttttttaaatttcagaatgtgaacagaaagttgagatataattaacagtgctgccaaaaatatgcacgaaaagtagccaaaatatgcacaaaaatctcgaaatatgcaaaatatgcaaataaaaataccgatttttctacgcaaacacaaaaaaagaacgtgtttttcctattatttatagcatggaaaaggcaggaaaaaaaatacatttgcatgtttttggcagccctgatatttaatatgcctaatatttttgggtgttaaaaactaaaaactgccaaaatatttaggttttcggttctaaaaacctcaaaataggtgttaaagtttcaatttagggatataaaataacaaaatttttgaggaaatttttcatttctcaggggtgtatttttgaaaattagacgaaatttatgtaaattaatctttatattcgggttcggggtccaaaatg

SEQ ID NO: 112772 - DNA, 315 bp, Heterodera glycines
  Promoter: Source sequence=SeqID_3346; Location=981..1295; Strand=-; Gene=SeqID_84307
tgattttgtggtatatgaaaggccccatatatcggggtaaaataaatatacataaacaaaaaataatcagctaaatttccagtcgaaatttaaaattttacaaattttatcatcttgagtcaagacttttttccgccactgtatcactctccccagtttatttttccgccaaatcattgaaaaaaaattgctttaaaatttcaaaaattaccgaaatatcgatattaaataaacgcctcgcctcgattcttcaactcaacgattcgtcaactcgacgattcgtcaactcgacgattcgtcaactcagccaaaatg

SEQ ID NO: 112773 - DNA, 92 bp, Heterodera glycines
  Promoter: Source sequence=SeqID_6901; Location=1454..1545; Strand=+; Gene=SeqID_63241
ggtaaaatcgcacccctggatattgaataatttaatattgtattacaataatttaataaataaatgtaatatcatttgatatttccaggatg

SEQ ID NO: 112774 - DNA, 237 bp, Heterodera glycines
  Promoter: Source sequence=SeqID_30420; Location=1..237; Strand=+; Gene=SeqID_60825
cgatcaaattgaaaggactgccgtggggccccgtccaattcgctgaatggcggccgccgtcttcgaccattgcctaagctttgtaagttttcatttgcaacattttttgttcatttcgtctctaccccccccattccgttcactatatttcatcaatttaaaatttattgctaatttgattttctaattgctaaatttcctaattttattcctccttccaggtctttgtcgaaaatg

SEQ ID NO: 112775 - DNA, 246 bp, Heterodera glycines
  Promoter: Source sequence=SeqID_33522; Location=1..246; Strand=+; Gene=SeqID_63564
tataaaaatattttaatacaaagaaataaagaaacgccgtgatagtattaggcttttctctgcacagtggagttgacccatagtgtctcatgtctatttaaatgctgtctttccctcttccccggcagtcttcattcaatcatattcttttgttttcttcatcatctccacctttgacccctccgtatttattttgtttaaatttcactaaatgatgactaaaactcagaattaggtttaagaatg

SEQ ID NO: 112776 - DNA, 152 bp, Heterodera glycines
  misc_feature (32)..(32): n is a, c, g, or t
  misc_feature (58)..(59): n is a, c, g, or t
  Promoter: Source sequence=SeqID_32150; Location=1319..1470; Strand=-; Gene=SeqID_62481
atgaaaaattgcatttgtgaaagatacaaaanatcatttgggataaagcgcatttacnnagaaatgatttaaagaaagaactccaagaaaagttaaagctccagcaactgatggtccagcttaatacactgcagtcgaaagtagacaaaatg

SEQ ID NO: 112777 - DNA, 75 bp, Heterodera glycines
  Promoter: Source sequence=SeqID_42679; Location=773..847; Strand=+; Gene=SeqID_70504
cctaaaaggaacaaaaaattattaactacaacggaatttattgctgttttttctccgaatgacctcgtataaatg

SEQ ID NO: 112778 - DNA, 136 bp, Heterodera glycines
  Promoter: Source sequence=SeqID_9304; Location=3700..3835; Strand=+; Gene=SeqID_70921
ttctttgttaactaaaaaacagaatatatttataatgatgaaaataaaataaagtatttggaaataaattcaggtgaaaattttaacatgtacctctctctccattggtgatttttttcaataataataattaatg

SEQ ID NO: 112779 - DNA, 57 bp, Heterodera glycines
  Promoter: Source sequence=SeqID_20470; Location=87..143; Strand=+; Gene=SeqID_45582
ggtctgtctctgctccctttttagctatctctgctgctttcagtgtctgtgacaatg

SEQ ID NO: 112780 - DNA, 152 bp, Heterodera glycines
  Promoter: Source sequence=SeqID_13823; Location=1295..1446; Strand=+; Gene=SeqID_77758
ggtcagtcgattaatatggcaaaatagaattaaaaatttttttttaaatttcatttatgtcggggacctttcttttttttaattttcaagaaattaatattttttgcgcttctgtttcgtttaggtggttgtgtccaaattcattgaaaatg

SEQ ID NO: 112781 - DNA, 343 bp, Heterodera glycines
  misc_feature (309)..(309): n is a, c, g, or t
  Promoter: Source sequence=SeqID_28243; Location=1175..1517; Strand=-; Gene=SeqID_58886
tgggacggacgtttctcaaacccatcaaatagaaaatttgccaaacattattttgctaaagagaagagtaactaaatttttaatttttgaaatcattcaattgcactaacaaataaatgttctctattagctgtaactttttctaaagtcgccaaccttaacataccgtataccatacctttttgcctcacgaccctacggttacggtagggacaaactgtgctttgattgggtgcctcagttccaagttattcggatattatatcaattaaatccatcaatgttttgagtcaaaatttatttaccccnccccccccgtttttgtaggcatttcgtagaaatg

SEQ ID NO: 112782 - DNA, 495 bp, Heterodera glycines
  Promoter: Source sequence=SeqID_2724; Location=827..1321; Strand=-; Gene=SeqID_81277
ttacgccactactgcatatgaattggtaaaagcaaattactttattttataaaaatttggcaaaatggttaaaaaattcaaaatttgtatatattttttgctttttctcccacaaaaatgccattcttaggggtgtatatttaaccccgaccccgagtcggggttaagggtcggggtcggggtgcgtcggggttgggagcgtcggggtcggggtcggggttaaccccgaaaaatgggcaaaaaagtcggggttcggggtcggggcggggtcggggacgcaaccctaaattaaaatattgataaaaccattaaggaattcttgtacttttggacggttgcattacgggagcaatcaaaaattgtcgtaccataaatgtgaaagttgaatatagagaaaatttttattatggaacaattgcctacaattgtaaaggcgaaatgaaacaagtgttcgagagcaggcaaataaaaaaaaaatgaaataattaaaaaatg

SEQ ID NO: 112783 - DNA, 146 bp, Heterodera glycines
  Promoter: Source sequence=SeqID_15517; Location=1..146; Strand=+; Gene=SeqID_79796
agtcggcggggcccagatggcggggcccagtcgacccccaccgtagggaattaggcagcttaaaaaaaaacaaaatacagtatcgttctcccctcgggatttttttcgaaaatttccaaagccatttgagttttcagatcaccatg

SEQ ID NO: 112784 - DNA, 145 bp, Heterodera glycines
  Promoter: Source sequence=SeqID_13441; Location=1924..2068; Strand=-; Gene=SeqID_77330
ttgtagcagaacaaatgagacatagctgacaaattgccggggcttttatactcccagaaaattaggccacgcccacttttgaaagctatttaagcagagattttctcgcacaatcaaatcattcttgcaaaatcatcctcaaatg

SEQ ID NO: 112785 - DNA, 1003 bp, Heterodera glycines
  Promoter: Source sequence=SeqID_3705; Location=6410..7412; Strand=-; Gene=SeqID_51542
tgctggtggcagctttcattcatccattcaattcattcactcatccgcacaatcgattcgatctgccgcgctttgtgctgcgactgcgtcccgcgccatgcataaaacaaaaaagaaaatgacgcgagttatggtggtggtgatgatgaacttttttgtttcacagacttccggggaaaggaagagattaaaaagaaaaggaagcgcaaatttgggaagggaaaagccgaaaatgaaagaaagggcaacaaaaaaagagactttgaatgcgacgtaatttcatagcctttctcattgtcagaagtgatcaaattaatttgttattattctgtgtcatgacaactcgtacaatgttgaacaaaggcaaattgcttaggttaggcctaggcttaggcctaagctttaagctaggccgcttaggcttgcttgggcctaggcttaagcttttactctactttgtaaaatacgagttgccttttgtcaagttgccattgacccctattattcaacagccctatgggtttgttattagcgtgcaaaacacagaaaaattatatttttaaaaatttatttttgtgaaaaaacaaaatttactctaatatattttttttacaacgattcccttcttaaagcaaatttctttcattttgtttaattttaatgagaatcagagaaaaactttaaagagttagacagtgccatcaaacaaaaaagaaaagcgccacgagcacatttctgcacatcgctaatcgattaaaaatttggacattgcctttgcctctgcctcctccgttctcttttctctcaagctttcgctttttcctttcgctggtcggccatgctcacattctgtcgattcttttccttcttttcgtgtttttagaattactttatcacagaaagacgtcgagactcgcgcttaattttcctcattattttttgctatttcagctcaaattttgaagttttattccaacaagacttattgtaagacaaaacaatg

SEQ ID NO: 112786 - DNA, 102 bp, Heterodera glycines
  Promoter: Source sequence=SeqID_17998; Location=1206..1307; Strand=-; Gene=SeqID_82567
gctaaatttaaatttttaattcgatcgttaactttgaagatggataattatttttcagtcatttttttatttgaattttattaaccaattcaaaaaacaatg

SEQ ID NO: 112787 - DNA, 269 bp, Heterodera glycines
  Promoter: Source sequence=SeqID_16694; Location=2661..2929; Strand=-; Gene=SeqID_81091
ttgctaaattaagaaaaaaaggtagaaaagagaggaaaaacaaataagaataacgctggagtgatatcatcccaaaatgttttccgttctcgagcgatgacctactttctcgttggcttggtccatcactcaagaacgacaaacatgagggaccattttataatatggagaaaatatctgtagtgaataaagacggggtaatgggcatggggtgggggaaggtatataaaagtcgaaatttatggtcaaactcattcatctaaaaaatg

SEQ ID NO: 112788 - DNA, 207 bp, Heterodera glycines
  Promoter: Source sequence=SeqID_19428; Location=1994..2200; Strand=-; Gene=SeqID_84148
attaatttaaaattattttttattttaatttttgtgtttgaagcgtttcatcttcttctgaaatagccaaaaagatgattgatgtgaataaacaagtttctcgaaatctcatttttcaggttaattgagcacttttattgtactatttaaatataaattattcaatattttgttatttaatttacatttattatttaggcttctatg

SEQ ID NO: 112789 - DNA, 885 bp, Heterodera glycines
  Promoter: Source sequence=SeqID_12893; Location=1962..2846; Strand=-; Gene=SeqID_76628
tgggttcttaagaaaaatggttttattttctgccaaatgagcacgagtgccgagttatgacgtgccaaagtttttagttttttataattaaagaaaataattaattatttacatattttcaatgtgttgtttggtgtagaggtaatgtgttagtcaaaatttttattggtcacaagttcgaatcccctttgtgtaaatccattttttaatttttaattttcctttttatgagcacttcaattagcaaattttatttctttatcaaaatctttattttaattttattccattaaaaattgcattaaacataaagatgtaataaaaaacctgtcgaattaaaaaaatatatttttgtctaatatttttattgagtattttatgcactaaataatttcaaaaaaattaaaaataaagtttttttaataaaaaatattttgataattgacttggcataatagacaaaaatttaaaaaattaatttacatgtaggggatccgaaccctgggttgcctgatgctgactagtgcactaccgctataccactggacactgtgccgaggcacaaataagtatttcttttatttcatcattaaaaagtttggcatttttttatctcggcacaggggtccatttggcagaaattgaaaacatttttcttaagaacccaggtgtgctctatctacccaaaaaatctcattccgaaatcccacggacacttggccacctccctttgtgagcaacatgcttttcctttgtcgtctgcctgaaaatcactcaccactcaaaggggagccggacgaagtgctcctgcgtgtttatttaaacaccgaagcggatgtggtggccgattcagttctttttggtattttgtcggaactacacatg

SEQ ID NO: 112790 - DNA, 160 bp, Heterodera glycines
  Promoter: Source sequence=SeqID_4503; Location=791..950; Strand=+; Gene=SeqID_45831
agtttttaaagaattttgccataataagttcgaccgccgacctctccaaccctcggtcgaccggttaaaggcgaattcaggaccctaaattaatttatttggctcttttttcacagtcaggctttttgattatttttgtgactttattcccatcctaatg

SEQ ID NO: 112791 - DNA, 449 bp, Heterodera glycines
  Promoter: Source sequence=SeqID_24364; Location=1018..1466; Strand=+; Gene=SeqID_55089
ggtaagcggagggtggcggacactcacttagggggaaggaattgtgacgcataaaaatggcataaatacccttcgggattgggttttcagggtcagctaggtcggggtttggatttttcggagtcagctaggtcggggtcggggtaaaccctgaaattgcctaaattttcggggtcggagggccggccgtaaattgacatcaatcaatgaattttaatcaaagcctcgtgaacaaaaggatagttttagtctgagaatgggacaaaaaaatggctccaggcttagatttttaaaaacccgacaaatttttctcggttcggtgccaacaatctctacaattaatgcattcgttatccacaggcccgtcattgtcgcgccgggcacggcctcagcccttggacctgacttcgtgcgttaatcccgccgtcaaccaactgaccggacaaatg

SEQ ID NO: 112792 - DNA, 85 bp, Heterodera glycines
  Promoter: Source sequence=SeqID_876; Location=1..85; Strand=+; Gene =SeqID_63146
ccaacaaagcgcagcgaatcgcaaactgaacatcagcagcagaacaactgaacagcgcaaagcccacggcaaacaacccacaatg

SEQ ID NO: 112793 - DNA, 122 bp, Heterodera glycines
  Promoter: Source sequence=SeqID_8312; Location=448..569; Strand=-; Gene=SeqID_46584
tttttgagaaaatcgtatttttcaaaaaaaaaaaaaatttttttggtgcaatacttttgaccatgactgtatgtacatattttagggttaaaaagaatctcaaacaaaaatattcacaaatg

SEQ ID NO: 112794 - DNA, 119 bp, Heterodera glycines
  Promoter: Source sequence=SeqID_15790; Location=1..119; Strand=+; Gene=SeqID_80113
cttttcctttaatccttgccgagtagaccggggggacggggggggggggtgagccattcattcgtccctttggcccctttccgccgctttctctctgctttcaaattaactttgagatg

SEQ ID NO: 112795 - DNA, 285 bp, Heterodera glycines
  Promoter: Source sequence=SeqID_23232; Location=1590..1874; Strand=-; Gene=SeqID_53947
ttttttgccaaaatggaaagaaagttgaacagcagaagaagaaattggcctaaatatatggtaatattgcatctctaaatacattcatttaatgggttcccgggtgatttcgtcagtaagtcatgtcgtcagtgagtgatttcgtcagtgaaaattaattaataaaaacagcgtacacctagctaaaaaaattaaaaattcgagccataagaacagaccccgtaaatatttaaacgagtcacgatttgcaaagtcctctataagattgctcaaattgttgcaatg

SEQ ID NO: 112796 - DNA, 207 bp, Heterodera glycines
  Promoter: Source sequence=SeqID_21111; Location=1154..1360; Strand=-; Gene=SeqID_51701
aattccctttccaacaattttgttgcggctgtttttcccgcaaaagattcacgaacgaatttgaagaatttctgcggatcgttgtgggaacaaattgagcacctcaatgaaattgacgggcgcgaagtgaaatggtgaaaataaattttgttttttgaaaattttccaggtttcttggcggtgatctgaacaatttgcaaaacaatg

SEQ ID NO: 112797 - DNA, 72 bp, Heterodera glycines
  Promoter: Source sequence=SeqID_1503; Location=2389..2460; Strand=-; Gene=SeqID_74020
gcttaaacataaatttaaaaaaaaaatcattttaaaattaaaatgaaaaaaacttacctgtggggccacatg

SEQ ID NO: 112798 - DNA, 166 bp, Heterodera glycines
  Promoter: Source sequence=SeqID_24571; Location=1..166; Strand=+; Gene=SeqID_55296
ctccgtatgccatcaattggtgctccgttcggctaattggcaaatttcgcccaaattggagcagagcatttactggaacgttgaccgaatttttgtggacctcaattggagccagaacagatcctgcccaaaccccgaagtgatccaagtgcaacacacgccaatg

SEQ ID NO: 112799 - DNA, 325 bp, Heterodera glycines
  Promoter: Source sequence=SeqID_11709; Location=1..325; Strand=+; Gene=SeqID_75198
attattgggacgaagtgcgcgaaaaaattattttaataaactttcattaatattccaattttaaataagtaaatctttttttaattttaggatcaattgaattcacaaaataaagagaagacaaaaattggaattgcaaaagaaaaagaaagcacaaataatctcgacgaaaaaagttacaaatttaaaaataaattataaaaatttaaaggcatgacgaaaccgccaataaaattgaaaataattgaaatattaaagctaattaattaattagttaatcaattgttgtgggtataattaattaattgctttttcagtaaaaatg

SEQ ID NO: 112800 - DNA, 118 bp, Heterodera glycines
  Promoter: Source sequence=SeqID_42679; Location=719..836; Strand=-; Gene=SeqID_46711
ggtcattcggagaaaaaacagcaataaattccgttgtagttaataattttttgttccttttagggtcggagctggcgacttccaatgtaagggtatctcgacatttatggcggaaatg

SEQ ID NO: 112801 - DNA, 57 bp, Heterodera glycines
  Promoter: Source sequence=SeqID_782; Location=2730..2786; Strand=-; Gene=SeqID_61117
tgaaaaaaatgtaactaaaagtgagctgatcagaaggattattgagttggaataatg

SEQ ID NO: 112802 - DNA, 441 bp, Heterodera glycines
  Promoter: Source sequence=SeqID_44785; Location=1..441; Strand=+; Gene=SeqID_72211
tgtatattctctctttttattttctctttggcattatgtatttccaataggcgaaatgaatgtttttggcttagtaggcgaaatgaatgtttctggcttagtaggcgaaatgaatgtttttggtttggtaggcgaaatgaatagtaggcgaaatgtcagtaggcgaaatgaatagtaggtgaaatgacagtaggcgaaatgtccggttttgggttagtaggcgaaatgaatgtttttggcttagtaggcgaaatgtcatcgtgccgatttggacgagttggtagtttttttgacactaagatcttatttttggcctcaaggtttcttttcttggaaagttttccaaaccctacttttaatgcaaaaaaagtttaacaaaaaccccgtcctgtttaatagaatttaaaaactaagtttctctttcctttcaggcaaactatg

SEQ ID NO: 112803 - DNA, 70 bp, Heterodera glycines
  Promoter: Source sequence=SeqID_4846; Location=2066..2135; Strand=-; Gene=SeqID_55933
ggtgaaggaggaaaggggagggggagggggacggatggcaaaacgaatcccaaaatggtagcgaaaaatg

SEQ ID NO: 112804 - DNA, 626 bp, Heterodera glycines
  Promoter: Source sequence=SeqID_18442; Location=1491..2116; Strand=-; Gene=SeqID_83039
taattaatgcgcttattttataatatttttaaatctcaataaaactaacatttatagttttctgattttattttaggtacaaaaaatcgcgaaatatgcacctaaaaaggcagaaaaataagcaaaataggcacaaaaataggaaataaattctttattaacattttttaggtagtaaaacacgtaaaaaatttaatcaaacgaaatcagttaaatatttattaaatattttaaacactttttcgaataaggacaaatttttaaaccaataatttttatcaaaaaaaaataattttggggaccaatttttgggattaaactatgaaaaaactaacacaaccggtgatcatcaaattactgtgacattaagcgcattaaaacagacaaagtagcatttattttcatgacaaaaattttgattttacaaattatctatcgcaatactgattttactgatttgggcgcttaattttgttggtttttggataaaatttgtcattttacacgctaaatttgaaagttttgagcaacttttcccatttttagcacctattttttgggggtttttagaacataaaaactaactattttggcagttttagcaacataaaaatccctattttatg

SEQ ID NO: 112805 - DNA, 517 bp, Heterodera glycines
  Promoter: Source sequence=SeqID_31284; Location=1491..2007; Strand=-; Gene=SeqID_61652
agtgattagaagaggtgcaacagtgattagaagagtgatcagaagaggtacaacagtgattagaagaggtgcaacttgattaagaaaggtaaaacagtgattagaagagatacaacagtgattagaagaggtacaacagagattaagaaaggtaaaacagtgattagaagagatacaacagtgattagaagaggtacaacagtgatagaagaggtataactgtgattagaagaggtacaatagtgattagaagaggtacaacagagatcagaagaggtacaacagtgattagaagaggtacaccagagatcagaataggtacaactgtgattggaagaggtacaacagtgatagaagaggtataactgtgattagaagaggtacaatagtgattagaagaggtacaacagagatcagaagaggtacaacagtgattagaagaggtacaccagagatcagaataggtacaactgtgattggaagaggtacaacagtgattagaagtggtacaacaatg

SEQ ID NO: 112806 - DNA, 92 bp, Heterodera glycines
  Promoter: Source sequence=SeqID_26871; Location=1235..1326; Strand=-; Gene=SeqID_57617
agtgcagcagtcaggcggatcacttttggcccctttgttggcccccattctgatgagggctgcccgatacctgctttcgcgcagcaataatg

SEQ ID NO: 112807 - DNA, 57 bp, Heterodera glycines
  Promoter: Source sequence=SeqID_26628; Location=430..486; Strand=+; Gene=SeqID_57380
aaatttgattgcctttaggcaaagttatgccatgttttgtcgaaaaatcgcacaatg

SEQ ID NO: 112808 - DNA, 140 bp, Heterodera glycines
  Promoter: Source sequence=SeqID_41813; Location=1220..1359; Strand=-; Gene=SeqID_69851
tccaaggtcgaggaggcccacacgctcacattgttgcccatactgacctggacgcagtaccacatgtcattcaggaatacatatgggcgcacattccatctttgcccgataaagatgacgacacgcccattgcgaaaatg

SEQ ID NO: 112809 - DNA, 99 bp, Heterodera glycines
  misc_feature (66)..(66): n is a, c, g, or t
  Promoter: Source sequence=SeqID_22418; Location=1..99; Strand=+; Gene= SeqID_53084
gaacaaaaagcagtgtcaacaaagcgcagtgaaacgcaaattgaaggcagcagcagaacaacttancagcgcaaagcccacgacaaacaactcacaatg

SEQ ID NO: 112810 - DNA, 140 bp, Heterodera glycines
  Promoter: Source sequence=SeqID_2009; Location=1..140; Strand=+; Gene= SeqID_77310
ggccaattttgcaaggctggcccagcagttgtgtctctctgaattcggccagcttttcaaggtattaaaaattccaactattttaaattttaaatttaaattatttaaaattaaaaaattaaggagtaggttggagcatg

SEQ ID NO: 112811 - DNA, 244 bp, Heterodera glycines
  Promoter: Source sequence=SeqID_1368; Location=3049..3292; Strand=-; Gene=SeqID_73063
aacagaaatgggaggagaatgagtttgggataatttgatggaagacagtcattgggccgggggggggagaatcatcgtggaaattgtttaaaatgacatttaaatacctattaattttgaaaaaacgaatatttgcatgtcaacaaataagttctctgtttatcagctgtctgaacacattactttttaaaaattctcttggcactgttatggaatttataacttaaaagttttgaccaaaatg

SEQ ID NO: 112812 - DNA, 634 bp, Heterodera glycines
  Promoter: Source sequence=SeqID_26551; Location=1..634; Strand=+; Gene=SeqID_57289
atcaaatagtttcttgtgttttgccaagcaacgtacctgcctacccagacacccagcccaataaatttagggtccgcttaccaaaacaatttattttaacggttcctggggtgtgtgggctgcacagcatcagctatccgtattcatggcactccacgattgggactttggatgatcaatggattaacattcactttgaggacacagaaagtgatactgttgagagacagcgagtgatcagggttccggtgcccaagggttcccataaaaaggtggaacagctgagagactttattgttgcaacattacgccatcagagcagcaccattgaacagctaaaaaacgacacccaaacaagcagcagcagcaacaccaataatcagcaacacttaaagtaacacagtcgcaacaagcaatagcagcaataaatcccaaagtaacacagtcgcaacaagcagcaacaacttcagcaactataacagtaaaaaaaggaacagcaacggcaaaaccgacaccttcaccatcgccaccggttgcaccagcaacagcaacaactaaagctgctaaagcctccccagttgtgcataaagaatttaatgaaaatgcagcaggagtcgatgtccttgacattatg

SEQ ID NO: 112813 - DNA, 191 bp, Heterodera glycines
  Promoter: Source sequence=SeqID_12658; Location=1..191; Strand=+; Gene=SeqID_76333
atcgggatcacacaactttcccttattaataaaaaaaatgtccttgttttgaaataatcattaatatttatacccaatacatactattttctcatttttgcaccattttgtgcgtttttagtactgaaaagccaaacattttgcagttttttttaccaatcatacgattttttgtttctcagctttcaatg

SEQ ID NO: 112814 - DNA, 145 bp, Heterodera glycines
  Promoter: Source sequence=SeqID_10250; Location=1248..1392; Strand=+; Gene=SeqID_73405
aactttttatcttttgtcaacttaaatttgatttgcaaaatttttgatgaattacgtttagttaaatttttccttaattaaaatgaaatgtgttaaatatttttggtctattaaagatctttaatccatttcctggttgaaaatg

SEQ ID NO: 112815 - DNA, 213 bp, Heterodera glycines
  misc_feature (66)..(66): n is a, c, g, or t
  Promoter: Source sequence=SeqID_38367; Location=1..213; Strand=+; Gene=SeqID_67198
ttttgacccgaaaaatctatctttatttcagaaaaattttactttatacattttttattcaaattntcgtccatattttgtttgtttttcgtggattaaaggaataatcgaattattatttcttctcaaacaaattatcttttctccaaatttttcaaaaatattttctcttaaccgcccatcccctcccattcttaattagagcacaatatg

SEQ ID NO: 112816 - DNA, 278 bp, Heterodera glycines
  Promoter: Source sequence=SeqID_7826; Location=644..921; Strand=-; Gene=SeqID_66085
tctgataatcatacaaataataaaaaattattaatttagatattttggtacacattttagggtttgtatattcttatatatttcgaatttaattttttttatgtatttcgcatccctatatttacgaattaatgtttttctatattgaacttcaaataaaatattcctgtttagaatttattttaaaaaataataaaatataaaagaaaaaatgcgtttaaacaattataaataaatttctagtaagtattaagataatttttatagaattgaccatg

SEQ ID NO: 112817 - DNA, 95 bp, Heterodera glycines
  Promoter: Source sequence=SeqID_15452; Location=1752..1846; Strand=-; Gene=SeqID_79715
tggccaggagctcggctcctgttgccgacgcatcctctgcgaggggcggcttaccgcagcataccacgccaattgagcacacggcaaagcgcatg

SEQ ID NO: 112818 - DNA, 98 bp, Heterodera glycines
  Promoter: Source sequence=SeqID_6213; Location=1..98; Strand=+; Gene =SeqID_60745
aataattactctgaaaattagcgattaattgattgacactctttgaggagctgatggatgtggcgaatggtttttatgatgcgaaagacgacgcaatg

SEQ ID NO: 112819 - DNA, 159 bp, Heterodera glycines
  Promoter: Source sequence=SeqID_35395; Location=1..159; Strand=+; Gene=SeqID_64956
tttggtgataatataagaatgatttggaaaaagatcccaccccggaaaatgtgctggttttatacttttgaaatcgcttctgctccgcccacttttcagctcgacaagttcatccgctcaaaaccaaaaatcattttaataatttcttaaataaaaatg

SEQ ID NO: 112820 - DNA, 176 bp, Heterodera glycines
  Promoter: Source sequence=SeqID_21623; Location=1905..2080; Strand=-; Gene=SeqID_52219
tggttttcgtgcgtttcaggcctcccacagtccagccctcccagatgcatgtgcatatttttgccagccctactaatcctattcatcaatcatccaaaattaaattttatattgagtttacctttatttattttaaacgtaggtactttaaaattgcactttttaaaaacccaatg

SEQ ID NO: 112821 - DNA, 956 bp, Heterodera glycines
  misc_feature (588)..(588): n is a, c, g, or t
  misc_feature (896)..(896): n is a, c, g, or t
  Promoter: Source sequence=SeqID_28010; Location=1..956; Strand=+; Gene=SeqID_58668
tttcgcctcgcgtttatacgggagatttgtaccacttttgtgccctaattagcaaagaaaaaattgcgtgggatttttcacatgaaaattaataaaaaagtaattaaataaaccatggcgcaaaaaaacagagcaatgaaattgggtaatattctcttcccatcaaaattagcacaatttcaaccgatgcaaagagaacaaaacgatttttgatggtcattttgattaattgctgcaatgcaatgtcattaacacagattcattttgcaaattgtcattatcattagatcaaaaatgaccaaaaaaaataattaaaagaagcgagagaatgcgaaaaggtgaaaataaccactttttgggacccattgggcgaaattctggcgattcggcgcacttttcaggcacaacaaatttcaatgaattttgtgaaattttttgttgagactatgtgcccctcaaaatgctttgaaccaattttaaggggcgaaaattctaattccttcaaataaatacgcacaaaaaatccaatggacttaaatttttgaaacagttagtggatgcattttgcttgtttttgtttatttgggntgttggttttctgtgccattgacatttatttttgtaatttgtcgggtgccgcgcttctgctgcttcgctgcttcggcttgtcacgaaaaatgcgggtgatgaaggttaagcacttttaactcattcctaaattaattttggttttaaatttcgagcatatagcaattaatttcttatccacttttactacaaattctgcaaattgtttttttttttacttggttctttttttttggaaattgaccaaaataacagttatatgtactgttaaagcgaattatttttgttggtaattataatacataatntattgaatcagtcagtgtttattattctctaaaaaaataaaatcccatataacagtcatg

SEQ ID NO: 112822 - DNA, 555 bp, Heterodera glycines
  Promoter: Source sequence=SeqID_15158; Location=203..757; Strand=+; Gene=SeqID_79351
atcactcactgctgaaatgcaggctaatgaaacaaaatgcttttacaataatgaatggatacgccatcctcctacactttaattgcaatgagtgcgtgatttcgtcggtcccatctctcctcctccccactctctttggccccgctctcttctcactctcttccccactctcctcctcccctctcctcgttggccccactctcttccccactctcctcctccccactctctttggccccgctctcttctcactctcttccccactctcctcctccccactctctttggccccgctctcttctcactctcttccccactctcctcctccccactctctttggccccgctctcttcatccacctactctctcctcatattcactcactttattaatttaatttcactttttttttgtttaccttatgttgctcacaatcagctgaatcaactttaaaatgctaaaatccttttctacccgtccaaactcaaattacccccattaaattggattcatccaatcatttggcaattaattttgaagcgcttctgaaaatg

SEQ ID NO: 112823 - DNA, 296 bp, Heterodera glycines
  misc_feature (65)..(65): n is a, c, g, or t
  Promoter: Source sequence=SeqID_16960; Location=1..296; Strand=+; Gene=SeqID_81389
ggataatggggtttcaacgatttgaaacggttgcttttgcccattatgctgggaggttcgattcnccactttgtcttgtccgagctaacgaagaaggaaatcgcaaaggggagcagcttagggtgtattgcgaaaacgacgtggaaattctgatggcggcaattttgaagtttcggcagttatttttggggataacaggagatttggatgtgatgaaggacagcgtgacaatcgctggtgttgtgatgaagatattcagggcaaaatttttgaaggacaggcatattccaatcatg

SEQ ID NO: 112824 - DNA, 1003 bp, Heterodera glycines
  Promoter: Source sequence=SeqID_806; Location=4597..5599; Strand=-; Gene=SeqID_61691
actactgcgttccgaaaaaatgacatcaaaagctgaacaaattttacaactttttaaacaactttacaactcctgcacaacttttgcatcaaatctctaacaactttggtacaaatttaaaaaactattcagagcaatgataatttaattgagtaattttctatattctttttcgatagaaagtcttaaaataatgagttaagacgccctacgttcattccaataatataaatacatgttgaaccaaactactactatgcacttttgtcagaaccccggattctgggggtgaaatttttttgaatttttttaacaaatttttcctgatagaaatgcttaaaataaggtgttattacgccctacgtgcattccggcattataaattcatccctgaccaaactactgtgttccgaaaaaaatgacaacaaaagctgaacaaattttacaactttttgaacaactttacaactcctgcacaacttttgtatcaaattcctaacaactttggcacaaaattaaaaaaactattctaatttttgtttaatcaagataaaacttgcaatttatgtatgattaaataattcaattatttttgattgatggaattttgtacatgttatccaagcaattcaattttaccatctggatacattttgaattctctctttcgttagaggtccctgcgtgcctgtaaacttccattgcctatagaagtccctgcgtgcatgtatcttagcggtccagtcccagcataatgcatgaaagaggtccctgcgtgcctacacttccactggcgtaccttttgcacaaaaatagtttaaaagcacactcctttgcttcgctttttagtaccgtctgtcctaacaaaagtaatgtgttcttttaattttgagttccagtgcttaaataaatgttattttatatttttactgttatctaaaactaaatatgttttttagtttaatattttattgatttattttgccattattttaaattaatg

SEQ ID NO: 112825 - DNA, 213 bp, Heterodera glycines
  Promoter: Source sequence=SeqID_25807; Location=1225..1437; Strand=-; Gene=SeqID_56571
atgggtagaggaggggacagaaatgaaaatttcaaatattttccatcaactgaattttaaaaaataattaaagaaactttttgttaaatgggaaggatgaaattgatgaaccctggggaaaaggataaaatttgcataatttagttatttatttttttaataaaaacattttttgacggtttaaaaaagtctgacttataattttctaaaatg

SEQ ID NO: 112826 - DNA, 260 bp, Heterodera glycines
  Promoter: Source sequence=SeqID_15677; Location=1080..1339; Strand=-; Gene=SeqID_79985
ttttggacacttgagaacctcgaaatgcatcccacgttcagttggccgagttgcgcttctcctccgaacttcgcctcgatgagtcagagacgcggcgggcgacgatcgaacgcacacaaagccaaatttggacaattttgggagtgccggtactggattgcctgcaattcttttcctaattcagcgctttaggcaatttctgcgccggaaagtcttccgtccgccgtacgaaaagccattgacgcggaaaagcaccgatg

SEQ ID NO: 112827 - DNA, 99 bp, Heterodera glycines
  Promoter: Source sequence=SeqID_23648; Location=823..921; Strand=-; Gene=SeqID_54346
ggaaactctccaggaatcctatcgtctgttcccgaggggcgctccgcaagagaatcctcaggcctcagcgatcatgtcgatcatgttactctctctatg

SEQ ID NO: 112828 - DNA, 431 bp, Heterodera glycines
  misc_feature (50)..(51): n is a, c, g, or t
  misc_feature (78)..(78): n is a, c, g, or t
  misc_feature (135)..(135): n is a, c, g, or t
  Promoter: Source sequence=SeqID_35538; Location=1..431; Strand=+; Gene=SeqID_65081
aaaattttgaaaattttcgaaattttaaattttgaaaaatcgagctcatnnaactctacaataagttcgctggcaccncctcgctcagaccaaaccctgacgtggtattcacctggtactgaagtggaaaaaaanaattaactgagtctccgtgtctgtacaggtccgggatttggtcaaatcaaaaaataaaaaataccagcatatagaggacacttctgcggagtgccctcacagcgggaattttttgatccgagtttcagaaaaaaagttatgggccgtcaaacgcaagaaaaaatgagaaatccgtccctgggactcagtcgtccgcgctgaatttttctctatagttttcccggatgctcctcaaaaagttgtaagacccttccaccactttcagggcgctcccggccttcggccgggagaaaatg

SEQ ID NO: 112829 - DNA, 147 bp, Heterodera glycines
  Promoter: Source sequence=SeqID_16859; Location=800..946; Strand=+; Gene=SeqID_81287
atatttatcaaacacactgttcctggtagaaccaatcaaacgcacgcactaataaccaggagctcgcctgatcagctggagtacaaaggaatttaccgcgttcgtgtgattccgccacgagggctacgcatccctgtgctgcccatg

SEQ ID NO: 112830 - DNA, 799 bp, Heterodera glycines
  Promoter: Source sequence=SeqID_4230; Location=2200..2998; Strand=-; Gene=SeqID_53694
caaatatactaaaattgtattgttcttgaaatatttgaatatcttcttgattatttttagttctgcaccatttaaaattgatagatatttggattaaattcgttcttctttttgatggattaacaatcgcgagagttgtgcgttgtatggatttacatattttctttgctcatacgctttttgatggattaacaatcgcgagagttgtgcgttgcatggatttacatattttctttgctcatacgctattgagaaaggagcctaaaaattctttttgcgtcaaaaaattttttttgatttggattaacttttaagcccgtataaatatatttagggggtttttagtttaacacccatattttgctatttttcggcgtcttccaacccggtgagggctggtggggtcaggggtctgctggcgggcagatgcccgtggggctgggggctggtgggggcaggggtctgctggcgggcaggtgcccgtggggctgggggctggtggggtcaggggtctgctggcgggcaggtgcccgtggggctgggggctggtggggtcaggggtctgctggcgggcagaagcccttggggctaggggctggtggggttaggggtctgctggcgggcaggtgcccgtggggctgggggctggtggggtcaggggtctgctggcgggcagaagcccttggggttgggggctggtggggttaggggttctgtgtgttcatttatgttcctttttgtctggtaaaatttattgtttgcttttttttgtatttttttcgcctagaatctcgaaatg

SEQ ID NO: 112831 - DNA, 547 bp, Heterodera glycines
  Promoter: Source sequence=SeqID_10398; Location=1..547; Strand=+; Gene=SeqID_73593
catatccgctctttcttttatggatcttattaaaccccctttccgcgttttaaccgcccaaccagcttattcttggcttataaatttctgatagctcgtaaacgtccttttttataaaaaaaagtccttaaaaacttcgattactctgtaaatttctatctacaaacttcgacatttaaaaatgtatacttctatacgctcggccaaatttctaggctaatttaaagcaatttaacatttaaatgctattgacaccaaacaattaattcgtgtgaaaaaattaaaaagtgccaaagtcacgctttgaaacattttctgactacaaattgttttcaagattgtttgactttttaacaacatttaaaaattgcgtgctgtaagcatttcatttggacaaccacagattaacaatttatgcgaggcgcaaatgagcggtcggggtcgttttcgcgtggccattttcgcgtggccgttttcgcgtggggacgttttcgcgtgagtacctgtttaggactgaaattggtcggatttgtgcaaaacatccatg

SEQ ID NO: 112832 - DNA, 183 bp, Heterodera glycines
  Promoter: Source sequence=SeqID_41236; Location=1166..1348; Strand=-; Gene=SeqID_69416
tttttccctatccctaccgtattttgtgatgtacagtatgcctattctcactaatctcacaaaaatttaatgcattatttatattattttattgccttttaatttgttatttttcatttccaattaaaatgcaatcctatgtatatggcgataaactaaatttagaattaatttttaaatatg

SEQ ID NO: 112833 - DNA, 236 bp, Heterodera glycines
  Promoter: Source sequence=SeqID_45204; Location=991..1226; Strand=-; Gene=SeqID_72548
aaaccctcgtgttgggtttatcgatattttcaataccctcgtgttgggttcgtcaactgctcgtcaaattttaataccctcgtgttgggtttttcttcatccgccttcgtccacgtttacaaattcgtctaaagcactcgtgttgtgctcgccaaacaatcttttataaaaagctcgtgttgctttatacatttggatttttttgttttatctcgtgttgataagacaaaattatg

SEQ ID NO: 112834 - DNA, 982 bp, Heterodera glycines
  Promoter: Source sequence=SeqID_12846; Location=623..1604; Strand=-; Gene=SeqID_76572
aagaaattttaagctcagaatagaaaagccctttagtcctcccaaagaaaaggaaaagccatgaaaaacaaaaaagaaaagaaaatcaggaaaaaaaaaaaacgaaaagccaagctataaaacgaaaagccatgaaaaaaaaaaaaaaaatcaggaaaaaaaaaaaaacgaaaagccaagctataaaacgaaaaggcatgaaaacccaaaaagaaattttaagctcagaatagaaatgccctttagttttaaaaagtaaaggaaaagccatgaaaaacaaaaaagaaaagaaaatcaggaaaaaaaacgaaaagccaagctataaaacgaaaaggcatgaaaacccaaaaagaaattttaagctcagaatagaaaagccctttagttttaaaaagaaaaggaaaagccatgaaaaacaaaaaagaaaagaaaatcaggaaaaaaacgaaaagccaagctataaaacgaaaaggcatgaaaaaaaaaagaaattttaagctaagaaaagaaaagccctcgagttttaaaaagaaaacgaaaagtcatgaaaatcaaaaagaacttttataagctaataaacgaaaagcaaacgaaaaatcatgaaaatgaaaaataaattttaagctaagaaaagaaaagcccccacccgagttttaaaaagaaaacgaaaagccaagcaataaaaaaaaataaaataaaaatagattttatagaataaaaaaaaaaaaaaggaaagcagtgcgagtatggaaaaaaggaaatgaaaaacattgaaaaataaattttaaagctaagaaaagaaaagaaaaagccgatgaaacgaaaagcgaaaagccatggaaaaataaatagcaggcgaaaaaaaagtaaacgaaaagccaaacaatgaaaaaactttgttccgcaattattctattatattgatttttttttttttttttttacagcgaaaaaaataaataaattgtattttattgtaatg

SEQ ID NO: 112835 - DNA, 427 bp, Heterodera glycines
  Promoter: Source sequence=SeqID_21780; Location=1394..1820; Strand=-; Gene=SeqID_52387
attgggagcagtgttactccaagaaaatggcccggtggcccccccggcgagagcgttaaataaacatgagacaaattacccctctatagagagagaagcactaggattggtctattccgtcaaggaattttccccttacatcgttggatcggggacaacaaaattgataaccgattgcagtgctttgacgggaatgatgaaaacaaaagaattaaaagggaggttagaaaaatatcagataactctgcaaagctttgatttggaaattatttatcgccctggcagaaaaaacaaggtggccgattttttatcacggtacaatgtgccaggaattgattgttcaattgaaaatgaggaggaaaataaaaaccaaataattttatcggcagtagaccgaagcggggaagcaaaataaaatgaaaaaatg

SEQ ID NO: 112836 - DNA, 149 bp, Heterodera glycines
  Promoter: Source sequence=SeqID_32566; Location=322..470; Strand=+; Gene=SeqID_62875
ttttctgccattttcgtcagattggtccatctctgtggcgaggtggtcacttgcgcattgctcgaccgtttcttccgccattttccccgcgttcactgtgccaatctctactcaatttccgagacccatggcaaattaattccaaaatg

SEQ ID NO: 112837 - DNA, 197 bp, Heterodera glycines
  Promoter: Source sequence=SeqID_2231; Location=1..197; Strand=+; Gene= SeqID_78614
ttataatagtaaaactcccgctcatgattaaaaaaaatggaaactaataaaaaggaaaatgatctcaggcaaaaagtgaagaagatggggaagttaatgcaccaagacatcctacattctttaagacgaattaaaaatgtaaaattatatttttattttattttttcaacgatttttcaaattaatttttcactatg

SEQ ID NO: 112838 - DNA, 87 bp, Heterodera glycines
  Promoter: Source sequence=SeqID_27049; Location=449..535; Strand=+; Gene=SeqID_57774
ttctcgctgcacacgtgcactatttgaaccgtggtcgcttccagcttgagctgcatccgaaagctctatcacggacgctgaaaaatg

SEQ ID NO: 112839 - DNA, 1003 bp, Heterodera glycines
  Promoter: Source sequence=SeqID_6482; Location=443..1445; Strand=+; Gene=SeqID_61750
tcaatgtttgccttttcttttattatttttgccgctttttcggcactttttgaacattcaattcgccgtttcatttgcttctgatcagtttctttctgagagttcgtcggaagcgaaccaatgcgaattttcacttcaaaaggtcccaggactgagcccactggtgaaaactgatcggaacggacgtttgtgccgaggagaagtcaaattgccattctgtcggggattgtgcaaaagcaaagaggtgggcaaaggacggggagggagcttaaggagcttaattcctttcccaacactttgtccacaaattgcttttctgtggcactgtgtatttgaatatttctcacttcgtttctttgtttttagtccggtacccatgcttttcctcaccgcgaacaagaaggtgcggtgcgttcgtcttccttttttgattatcattttatttcaacatttttggaccaaattcagcatatttttgtggcattgttactgacaatgcgcaaatgaaaaatgtgactttggacgaatgtgaggagggcgcggacgaagaagcgcgcctcgtgcaaatatccaccgcaacggaatgcaaatgcatcaaaatgacataatttcccgtacatttaataaagtagtttattttaattgattgaattctcaattaaatgcttttgccctttgtcgtcgcattttttcaatttaaaaataaatgacaaatgcaccttttaatctcgaaatggcaccttaatttccaaatgactgataaatacaatgaaacataaagcaatgcattttaattgcattgagtaatcgacgctcaattcagagcgaatgaatttctgacattttggtgattgttggccgaggagaagcatttaaatgaacattcaaaagcacctttcaagtcattaccataacaaatgggattgattaattgttctttgttgaatgcctaaattattcatttttattttttaattttttttattcattttaattaaagatg

SEQ ID NO: 112840 - DNA, 978 bp, Heterodera glycines
  misc_feature (74)..(74): n is a, c, g, or t
  Promoter: Source sequence=SeqID_25143; Location=1..978; Strand=+; Gene=SeqID_55867
gccagggaacggatttatatgtggccaaaaaagctccaaaaatatgtgctaaaaagctcaaaaaaggccaacantatgtgccaaaaattgaaaaaaaactgtcaaaaaataagttactttctcaaaaatcacattttttatcaatttcgctagtacaattctaatcaaaaacatttcaattctttgtgacgtaaatatttttctcgcttcaaagatttatttatttttctgttttcattgataaaatttaaattttgccttaaaaatgaaaaaagtcataaaaaggtcaattcaaaaagtgcaaaaagagaaaaaactaaaatttttgtacatttttgtacatttttacaagaatttgagtgcaaaaaaagctacttttgtaaaaaaaattaaaaaaaaaatccccaaatatgtgctaaaactactgaaaaccaaaatatggtttcattttaatgaatatgcttgatgccattttcaaaaaagccgaaagacagccatattaatttataaattgaaacccactcgtaataattaagttaattttaaacaaaaaaaaatgaaaactgaaaattttcaaacaaaaaaaataaaaatatatcccaaaaatgacattttataaattaaaattatttatgacgcactatgaatttctttgatgaggatatatatatataagacaaagatgtaaaggttgcaatcattaatgctgtcaaaatggcatcggcatttggcatagatatgcttttagctgtccaattgcaacaacaaaggcaataagtgcgattgatgctctatgtccgaaacacacccattttcggaccaattaactcaccatttcccaaaccaggagaagttggacgacaaagccaatctcaacttggcggagggaagagatcggcgaatttggcacaaggcagtcaacgagggcgacacggttggacgagttgagcgagtgcaaacgagaacgaaagaagaatg

SEQ ID NO: 112841 - DNA, 132 bp, Heterodera glycines
  Promoter: Source sequence=SeqID_16228; Location=913..1044; Strand=-; Gene=SeqID_80603
ttgccaatccaaaagtgaattaattagagatttacaaatgctaatccgattaacctcgagattggcctatccccgagagcaatggaccaaaaaaaaaaaagatattctatttgctgacaccaattcccaatg

SEQ ID NO: 112842 - DNA, 307 bp, Heterodera glycines
  Promoter: Source sequence=SeqID_12272; Location=1..307; Strand=+; Gene=SeqID_75862
acgcatgcttggatatcaatttttgacaagaaaattcgttgaaaatattttagaaattaaaatttttatatttttgatgcggtggaagcgtgggacatcgtttatccgttttagttttacaatttgtcaaacaaaaagttgggatggcttttaattgcataatcataattcagccacttcacggccaccaacactgcaacaacaacaaaatacgccttccacaagcggaacaacaacttcttgcattgtcaaaaatccgtcatcctttcacccgaaatctgcaccgcctgctgagagaaagcgcatg

SEQ ID NO: 112843 - DNA, 886 bp, Heterodera glycines
  misc_feature (521)..(521): n is a, c, g, or t
  Promoter: Source sequence=SeqID_21971; Location=429..1314; Strand=-; Gene=SeqID_52603
tggtgccaatagccgtcccagactttttcaactttccgagcttgcacagttgtaggattccggttgctgctgttgcagttcattggacttaaaaatgtttctggactcataaagtgcaattgcgaaatacgatttggccaaaaaaaaaacgagtccaagtttgtccgtcctccggaccttgggataatcatgtatatgttcctcgtctgtccaggatcttgttcaataaaattatggtgcataaagtcaaggatgagtgaggatggctaattgattggactcataaaagtcaattagactcacaaaatgcaattgaagcgtccttaggcctattagcccacttgggcccaaatatgccggtttacaatgaattgcctttaattatgtgccattctcttgccaacatttcttttgtttcagttcgttcatttggcacagaggacagacccgcgcctgtgcccgtgccggtaaaaattaatttttttttttaatgggcttgaaaatttaaacgaatttccgtntaaaaaatgccaggcacgcgctgaagtgtatgatttcatcatcttcaaggccagcgacatcaaggatttgatcggtttgttacttgggttgtgttgttttgcttcaaaatgttcgatggttttgcaaatttgacatttatttcaaccaattccgaatgtttaacctaaattttcaataattgcctaatctttgaatgtgccaaaaaaaaaatttagttaatcaaatgggagacccgacaatggcgctgcacattgttgcccaattattaaattaattaggaaccacaattagttaccattgccaggaacacgaaaaaaagccgagattttctggtcccgtctcttaaatgtatgtcttaaaaatg

SEQ ID NO: 112844 - DNA, 235 bp, Heterodera glycines
  misc_feature (22)..(22): n is a, c, g, or t
  Promoter: Source sequence=SeqID_6023; Location=1014..1248; Strand=-; Gene=SeqID_60042
aaaaaaagatctaaaaaataanttggacaaatggtcaaaatcttttatcatcaggacaaaaggtcgaaaataaaaatgagggtcttaaaaaattaaattgggaaaaatgataaataatttgggacatattgccgacaaatagtaaaaatccaggaattagcgccaaaaattagtcattaagacaaatgataaaaaaaacaaccaccgacaattactaaataaaccctttcagatg

SEQ ID NO: 112845 - DNA, 67 bp, Heterodera glycines
  Promoter: Source sequence=SeqID_255; Location=1319..1385; Strand=-; Gene=SeqID_79773
tttaactaacaaaacgattttaagagtcataaatcattttttatccaaatacctaactccattcatg

SEQ ID NO: 112846 - DNA, 79 bp, Heterodera glycines
  Promoter: Source sequence=SeqID_27221; Location=910..988; Strand=-; Gene=SeqID_57906
agtgggaccaattaacaattaattaactaattagtcaatcatttaaaatataattttttagactttgacgggacaaatg

SEQ ID NO: 112847 - DNA, 214 bp, Heterodera glycines
  Promoter: Source sequence=SeqID_17402; Location=400..613; Strand=-; Gene=SeqID_81881
cctgaatttgaaaaacaataaacaaaacgccaaaaaagtttatattattactaaaatgcttaattcatttaagcagggattaattgtttatggcatttgaagcaacaatttcattttgttaataattaattacattttaaagcatttagcacaacagaaaatggcaaaaaaagttgtttatttttaaaaaaatagaaaaatccagcgccacatg

SEQ ID NO: 112848 - DNA, 643 bp, Heterodera glycines
  Promoter: Source sequence=SeqID_42375; Location=1..643; Strand=+; Gene=SeqID_70280
tttatacgaggttgccgtttaaaacattggcatttgcccgcaaaaccgaggcttttcttttttaaatgaaagtgagattttaaatttgcggaaatctttcctcaaatactgtaacatttcattctgtttttcatcaataaaatgaaccaactttttaaattttagtgtgcgaaggtgggcagtgggcgagggcgtatgaaagtccagaaaataggtacaggttccggatgctttttaacttgtcattttttcagctggactaagccccggccaataagacccgaataaaaaaaaacaattattttgctgtcaatttttcaaataaattccatataaattaaatgatattattttatgaaacaaaaagataaaaaagtgatatttttgccaaatcattttattttaattttccatttttaagtttatttttttatttatttgtttttcttttttttgcgactgactttttgctcacttgaacagaaataggaattaattcaacgagaatcgaaataaaaatctccgattcgcaagtaattttccttttctttcaaatgattatttgacgcatggcggccatttaaaaagttttgtctgattttttaaaagaattaaaatcggattaatttattttattcaaatg

SEQ ID NO: 112849 - DNA, 1003 bp, Heterodera glycines
  misc_feature (39)..(40): n is a, c, g, or t
  Promoter: Source sequence=SeqID_2968; Location=4734..5736; Strand=+; Gene=SeqID_82560
gagaattgatttgggctattgaatgataccaagaatgtnnctaatttggttgactttgacataaggttatagccagttctttgttgaaaatttcaatttggtgttttttaaataacgacatagcaccgacccatttcatggtctaagtacgggacggagttttttacgctcatgtaaatgcgtcagtggaaaatgcgccataaaaatgcgtctgtaataagttattttaaataaacttatgtagcataaagtattgttgtacaaaaggttaaaattttgtacaacctcgttttaagtgtaattcaataaataaattttgaaaattatcaaaacccaaaggcgacaaacatactgtaactggattattgtcaatttgtaaccatatcaattaacattaccgtatcttatttcaaaattttgtttacggaagagtaaattgtaaaaaaaaattttttctttaaatccacaaatttattttgcacaaaaataaagcccttactggaaagaaattcacatgtttttaatatgaaaaattgccaacattcataaatccacacacagtttttgaagacgagacggtgcatatgccggaaacagaaaaaaatcatcaatattcatttatggatatattttttaaaaataatttataaaaaaatatcctattccacaaaatgaaaaaaaaaattgagaaaatgtgaaattattttcactataatcataagaataaaaattgtttttttttaaatttaattatcataatagaaaaatatttttagttattacatctatatttcgaatatgaaatttgaaaaattaattctattacataaggcattgtatttgagtaagtgaattaaaaaaaatatatatatatataaatattaaaaatatataaatatataaataaaataaatatatttttaaataaaagtaaatttaattattttttacattaattaattgtttgcttttaaataaagtgacgagaatcatcagcacaatg

SEQ ID NO: 112850 - DNA, 312 bp, Heterodera glycines
  misc_feature (13)..(13): n is a, c, g, or t
  Promoter: Source sequence=SeqID_14817; Location=1..312; Strand=+; Gene=SeqID_78969
ttaaatttaaatntctgaattataattaattacatatttaaaatttataaatactatttttcatgaatatgattttgaaaaaatttaacaattttttttccttataatttcacagacctctggtcaactcaatagagtctgagcaagcgctatatttgaattatttgtattcgtgccaaaaaatctttccttttttggacatttcgctttttattttactaagtaaagcagccttgcaaaatgaatgtatgttttatataaatcactaaattctatttgtttttcacagttccctccggcgttctgacaatg

SEQ ID NO: 112851 - DNA, 51 bp, Heterodera glycines
  misc_feature (19)..(19): n is a, c, g, or t
  Promoter: Source sequence=SeqID_11304; Location=2330..2380; Strand=-; Gene=SeqID_74682
ggggggcgtcaatcggtcnggtcggttgtatttcccaaagcggcgctcatg

SEQ ID NO: 112852 - DNA, 100 bp, Heterodera glycines
  Promoter: Source sequence=SeqID_7307; Location=1275..1374; Strand=-; Gene=SeqID_64410
ggtaaaaccaaaaaaaagtaacaaatttcggaaagtgaaaattgtgccgaaatcatcagaaaaggaagtaacatgagaacataaacatagcaaaagaatg

SEQ ID NO: 112853 - DNA, 454 bp, Heterodera glycines
  Promoter: Source sequence=SeqID_41551; Location=1..454; Strand=+; Gene=SeqID_69638
aggtcagaggcacaaatgaatttttattcgaagcactcttacagagagtctttaaaaacccgaaaatgtaaaacaaaaatcttaaagttaatcataattattgcttaaaaattcggtaagttaattttaaatgaatgtaaataatataaaaataaaaaaggttaaaaataaaatattacttcataaatgctaataacaagttaattgaaaaagtattcataaacttacataagtaatggcaaatatgtgaaatttagttacatgaaaaatttacttaataggaatatatgcaaaaattaataacatgctcttttataaaaccgaaaataaacaaataaataaaatatcaatctaaatatttgctttctataacaacactgaaaatttattacagcttaaagcagtataaattaaatcattattcataatattactaaagaatttactacaaatg

SEQ ID NO: 112854 - DNA, 508 bp, Heterodera glycines
  Promoter: Source sequence=SeqID_1672; Location=1872..2379; Strand=-; Gene=SeqID_75229
gcactttcaatgtcgattttgtttgtttttttgaaaaaattgacggcatataattttttaaaatttctgttcacctacaaagaagtgtttgcgttgcgaatttttcggacctaataacaaatgcaaaggtgtatgcaaaaataaaacaaagaatatttttttaaattcagcctacacattgacattaatgctaatctcctcataattattggaagccacacatgcgacatgagcgccgagcagtggagtgtcagcgacgtgtgacccagctaaaacggcgtgcagttgagacgtggaaagcgccggctacaattcgtgtacaagtcttgcagaacacaacaacaccaatgttagctgcttttccgaataaagctgcgacaaaaaggtcaacttttcctaatttttatgccaaaatttgatttgttcatttggattttgattacgtactgccttctcacttcaagtgtgaagcgttgaacacgtatgcctcaagcgattgtcaaagatg

SEQ ID NO: 112855 - DNA, 707 bp, Heterodera glycines
  Promoter: Source sequence=SeqID_26311; Location=1..707; Strand=+; Gene=SeqID_57056
acatgttaattcccgggcatgatttacgtgttaatacactgtcatgattcacgtgttaattcacggtcatgtgcgtttaatttacagtcattattcagtgtcaatttacgggttaaatcacgtatcaattcacgctcataattcaagtgtcaattcagggtcatgatttacttgtaaattcacgggcatgatttacgtgttaatacacggtcatgatttacgttttacttcacgggcatgatttacgtgttaatacacagtcattattcacgtgtcaatttaggggttaattcacgtgacaattcacagtcatgatttacgtgttaattcaaaatcatgatttatgtgttaatttacggtaatgattcaaatgttaattcccgggcatgatttacgtgttaatacacggtcgggattcacgtgttaattcacggtcatgtacgtttaatttacagtcattattcacgtgtcaatttacggcttaaagcacgtgtcaattcagctcattattcacatttcaatttacgggttaaatcacgtgtcaattcagggtcatgatttacttgtaaattcacgatcatgatttacgtgttactttacgggcatgatttacgtgttaatacacattcatgattcacgtgttaattcacggtcatgatttacatgttaattcccgggcatgatttacgtgttaatacacggtcatg

SEQ ID NO: 112856 - DNA, 75 bp, Heterodera glycines
  Promoter: Source sequence=SeqID_8631; Location=1390..1464; Strand=+; Gene=SeqID_68728
aaaaaaaaatgaatttttgtaatgatttgtgccaatcacaatttcatttaattttcagcttcatcgaccaaaatg

SEQ ID NO: 112857 - DNA, 551 bp, Heterodera glycines
  Promoter: Source sequence=SeqID_19802; Location=271..821; Strand=+; Gene=SeqID_84538
tcatttgcataaagttggtcaacaaccgtctaagcattcaatgaaaagaaagttttcgcaaggcgcacaaaattgggggaagtgtttttgaatgaaaacaaaatttcttgcccttaaaaatgaataatttttggctttttggaatagaagccggtgaaaattttatgcaaaactattgaagcaacgaatcgaaatttttaaatttacaagaaatataatgccaagttctcttgattttttttgctttcaaggacgtccttgttattcaaggacgaaccagagccggccgattttacacgtactttcattcatcatttctgttgtctttggacaatgaaaatttaagagaccaagatagacaagaaaaagctagatattttcatttgtccaataattttgattttttcatttttttttcaaaaattttggaaaaaacctaaattctttaagacacatataaaacgcagagaatgttagcgccatcctcagcctcagcagaacaaaatcacaaaatgttgatgccctccccaacaaaacatcacaaaaaaatg

SEQ ID NO: 112858 - DNA, 398 bp, Heterodera glycines
  Promoter: Source sequence=SeqID_5960; Location=1111..1508; Strand=-; Gene=SeqID_59840
cattttaaaggttcaggattttctttaattccaatactttcgagtgtaaagaaatcagagggaattatttcagactgggtacaaaaattgatcagatgattttggggtaattgagtattaggatggggtttgccggccacaattggacccaaaagagtttgtacgaggtgatagccgcttgaaattctttgaacgggggtgggttctaactcgtaataataatcagcacctaacaaaatacaccggatgatgtcagtaagtgaatacgcttgggtttaaattgaggttttgttaaccaaaaggattttatcagaatatatccgcaggttcgacttaaagagtgtgtcatcataatctacgataaacacatcagcagaacaatatgctttctcaaaatg

SEQ ID NO: 112859 - DNA, 580 bp, Heterodera glycines
  misc_feature (50)..(50): n is a, c, g, or t
  misc_feature (57)..(57): n is a, c, g, or t
  Promoter: Source sequence=SeqID_14279; Location=492..1071; Strand=-; Gene=SeqID_78298
taaaatttatttatcgcaaatataatgttttttttattttttttattttntaatatntattctttaatttaaaactttttccaaaatttcctttgtcgacgaatgccatcaaaagaacaaccacaaaaatgcaagaataataaaaacgcatttttttaagaatgtttgtgtttttatatgtgatttatttttgtggaaattttctcattttatatttcccaaaatttatttgatatctttcaaaatatttatgggattttctttcacatttcgtataaaggtttatttggaaatgattacattgaaataagaaataattgcataacaaatatttgaataaattgtgatataatcaaaaattaatgaatgaataaatgaatattttagtggtttaaaaattatacaaatttgcttctttttccgtgaaccaaaaatgtaggaaaagaatcccactgaatatggggaagaagcaaaattaaaaattgaacaaaaaataattggcaaaaacattggaaattttgtcaaaaaagagacgaaaagtgaaaatattcaggaaaataacaggaaaaagataaaaatg

SEQ ID NO: 112860 - DNA, 126 bp, Heterodera glycines; identical to SEQ ID NO: 103918
  Promoter: Source sequence=SeqID_43342; Location=302..427; Strand=-; Gene=SeqID_71042

SEQ ID NO: 112861 - DNA, 90 bp, Heterodera glycines
  Promoter: Source sequence=SeqID_8105; Location=1260..1349; Strand=-; Gene=SeqID_66988
agtgcgttttcttcgctttgttttgattggcattccgtcttttttttacttttcaccttttgccttttcagtctcaaattgggcggcatg

SEQ ID NO: 112862 - DNA, 216 bp, Heterodera glycines
  Promoter: Source sequence=SeqID_1455; Location=3925..4140; Strand=-; Gene=SeqID_73646
atttggcaaaagttcatttgtcgtttgtttcctttccccataatgccgttgtattatacgtgctaaataatgtgcctatcctttagcgtattgtctcaaacaaataaattatttttctttgtcgcttgtatcatttcgacattgcttttatttgcatatttaaatgttttttgcattgtttttctattcatttttcatcacattaagccgcaaatg

SEQ ID NO: 112863 - DNA, 562 bp, Heterodera glycines
  Promoter: Source sequence=SeqID_30914; Location=381..942; Strand=+; Gene=SeqID_61286
tatgacagaaacttaacaaaaaggacaaaaattaaataagacatgtaaaaaaatatgcaaaatttcacctctaccaaaaaggggggtaatagtaaagtttatcccccccctttttcaaaaaaaaaattaaaatttttaaaagtgcttaaaaacaggttttagggggttttcggggtcgctgatcacgaatccgacatccatttcaaccaattccgaaccccggacccgaattcgaacaaaaaatcaaaatttcatttttcaccaaaatgcatatttattgcacaaaatcgatccaaacaaagaagaaaatgttctataaattgacaatactgcgcatgtttggaaataaaaataaaattaaaagcgattgaaagcctgtttttacaacggaatttcttgattaaagattaaactgcaaaaaaatgagacctatgtaggaaaaataaaacaaaagttttttttgtttatttggcgaattgttgtttgatgcaaatttcaaatatattactatttactttttatatggtcatctcccaattttggaggaaccgcttttcttatg

SEQ ID NO: 112864 - DNA, 143 bp, Heterodera glycines
  Promoter: Source sequence=SeqID_24082; Location=1..143; Strand=+; Gene=SeqID_54778
accgagtactttcatcgcctacagtcgaaacgaatttccgtttttactattgaaattcacacaccatttggtgaatttgttaaatttcactggggaagttgtattcttacattacattttaagaaaagtatattttaaaaatg

SEQ ID NO: 112865 - DNA, 299 bp, Heterodera glycines
  Promoter: Source sequence=SeqID_18667; Location=1772..2070; Strand=-; Gene=SeqID_47533
ggtaaatagtttctatttttagcattcgaatcgcaggggctgtccagtcgattgcggattcggtaacaaaggcaaagtttgtcggaactacgaaattgggcatcgatgaatgtgtgctcttccagattctacaggtttttctccctttttctgtttaatgtaatttttcgtttcagtcccttcgttctttggtcctttcgcccggcgggcgccacctaaccaatgaaacattatgcgaaattttgcagtgctgttttcgcattggtctcgagtcttcactacccgaactgcttcgaatg

SEQ ID NO: 112866 - DNA, 569 bp, Heterodera glycines
  Promoter: Source sequence=SeqID_35957; Location=1..569; Strand=+; Gene=SeqID_65409
tatgagattgtagttcatgccaatgcgtttgataagttcggtttttcaattggcgtcaattcaaaaagtttgttcagcagatgctcctaattgacgacataagcgagtcccgaggtaataatcatcacttctaattagcgggggctcaaatttgaattggtaaaaattatttcattcgaaaaagataaattgtgtatgcacaaccgcgcaaatgaaaattttcatgttaaaagtcggaatgatttccaataaacgtcaattattggaagcagggaacggcacttctgtgaaaataaaatttgcaattgggctatgtttttcacctgacaaattggaatatgagactgaccgagaataaaaaaggattaattttgaataaaaattgaaaactttttgtaattttctaattattttttaatttaaaaaattttcattgttaataaaatttaatttttctagcttaagtcccggtcattcattcacctgtttctcacgtgctaattcccttaataatcattttaagattcaaaaaagcattttcttttttcagtttcctatttctcagtatg

SEQ ID NO: 112867 - DNA, 500 bp, Heterodera glycines
  Promoter: Source sequence=SeqID_18980; Location=1..500; Strand=+; Gene=SeqID_83717
catgggctaaactttgacttcgagtttcgaaaactttgggtttttgaaatgcctaaaaatctctcattaaaaactttttttaagaaattattcagggtcggaggtgaccaaaagaaattttttttttcttaaaatcttgataacaaacagcataaatattcatttaaatcaaagaatgtgaacaaatttaaagtcagttaaatcattttttttacaagaaaattcgaaacaaaaaatctgtaattttttcttctttttttcgtactattttttgttaatttaaatgtatttgtttgtttacacttttatgacctttttgcgccaatttttattggacaccattctcaattcaattattttgtgtgaacaattaattgccttatttgtgcacaattttttttcctctaatttcaatggaaaatttatttttatttttcaatttcatctatttttaaattcaaaataaaactttaaatttaatttaattaagttttccaatg

SEQ ID NO: 112868 - DNA, 456 bp, Heterodera glycines
  Promoter: Source sequence=SeqID_4108; Location=1362..1817; Strand=-; Gene=SeqID_53217
ttttttcaaaataaagaaaatgctttctgttatcgaatatatattataaaaaattgaaattaatttatttatattaaaatgaaaaattggaaataaatttcatcagtgcatataaatgaatgaacatttgctgttttgcattgaaatgttcgccttttatagggggctttggtaaccaaaagtaattaggcaaaattatgtcacccagcaattaaaattttttttcaataaataaattgatattattaaattaacgacaacaggttgaaaaagcctcacactgaataaaggaaacaaaacaacatcagaataataaataaataaataaataaaagtggaatttatttattcgtttttgaagcatttttttgaattttccaccccttcgccctgctccgctttttgcttatataacagtgaatcggcgcggtattcagtgatcaccagcggattatg

SEQ ID NO: 112869 - DNA, 61 bp, Heterodera glycines
  Promoter: Source sequence=SeqID_3380; Location=3289..3349; Strand=-; Gene=SeqID_84460
gctgaaacagagggggaaattcgaacaacagttcgggatttctgaccaggtcggcaatatg

SEQ ID NO: 112870 - DNA, 76 bp, Heterodera glycines
  Promoter: Source sequence=SeqID_17769; Location=1..76; Strand=+; Gene= SeqID_82312
tgatcagacaaatgtgtcaattccaatagatgtgatcaatgaaagtgccaattcactgatcagtccattagttatg

SEQ ID NO: 112871 - DNA, 71 bp, Heterodera glycines
  Promoter: Source sequence=SeqID_42690; Location=1..71; Strand=+; Gene= SeqID_70515
tcctttcattatgcttattccattccccctccccccccactcttctacagtatgccgagttcaacgcaatg

SEQ ID NO: 112872 - DNA, 164 bp, Heterodera glycines
  Promoter: Source sequence=SeqID_20482; Location=1031..1194; Strand=-; Gene=SeqID_51021
aatttttgttatacaaataaagaaatttgacgtttcactctttaaaaagttgattttgtaattttttaaggacatttgaaaagcgagcttgaagaattttttgtagtcacaaaactttttttgtacaacatgttcgcttttagaaatgaaattttattataatg

SEQ ID NO: 112873 - DNA, 129 bp, Heterodera glycines
  Promoter: Source sequence=SeqID_13027; Location=1709..1837; Strand=-; Gene=SeqID_76808
ttaagtttcaaaaaagttatgacctgagaaactcaaaaaaccaatggtttttttgaatatttttggtcacaactttcttgaaacttaacgaaattttctgaaattttacatgattatagaaaacatatg

SEQ ID NO: 112874 - DNA, 349 bp, Heterodera glycines
  Promoter: Source sequence=SeqID_20255; Location=886..1234; Strand=-; Gene=SeqID_85058
aaatttttgggaaaaaattatttaaaaaaaatcggaatcgcaattaatcggattttgggccataatcgtaatcggttttaaaaccgtatcggatttttggccataatcggaatcggcgatttaatcggaatcggattttgtctggctcggcacatccctggtgtgcgggttggctgattgtctagcctacactccggtgcgggttagctgtctgactagcctacatgcttcactcaaattgaacaaatgtgagagttaaccaataaaatactgaaattctcctattgtttggtattatttttagtgggggggggggggtgtagttctgattattaatgcttaattaatg

SEQ ID NO: 112875 - DNA, 762 bp, Heterodera glycines
  Promoter: Source sequence=SeqID_2758; Location=1788..2549; Strand=+; Gene=SeqID_81447
tgctttttaatgggggggggtaatcgtaattttttaattatttttaaattgctttagaaattttttataatttatttttatttgtttcccacttatttgggtctatttttatttactttaattaatataattgttttttaaattattttttattttttcgccaattttccatttaattatttttatgcagcttttataacacaaatcagaaaaattctgattattcggatcacgactgaataattagaagtattgctggtagtttccgcaacgtttcaggattgttccttaaccggatttattcatgtgcaaaacagtaccggaagcataactggagttaaaatttaagaattagtcaaaaaccgaattagcctcctgaaaaaagttgcaaaaacttgaaaatgttaaaactttaaggttcggaaacccatttaaaatttttctttgtcccccgcaacaatattttggtcaactgcataattatatttattgcttaaattttgtaaatttaatttttgtttaaaatttatttttgagaatatttactatttttaaaatattttcgaaattatttttaaagtttaaaatatggaacaaaagtttaatcaaaatgaacctaaaacaacgaatgcagaaaaaataaaggtattttgttaaaaaaaaataaaattgaatcaattatgattttaattttataaaaattaataaatattattaattaatttgtgcttttaaatattttgtaaggttgcaacagaaatg

SEQ ID NO: 112876 - DNA, 85 bp, Heterodera glycines
  Promoter: Source sequence=SeqID_33952; Location=646..730; Strand=-; Gene=SeqID_63876
ttcaaattgccgggttgcggatcgcggtcacgctccacccctggtaagaaatttaaaagcgaaattccgacattaaagcagaatg

SEQ ID NO: 112877 - DNA, 768 bp, Heterodera glycines
  Promoter: Source sequence=SeqID_18015; Location=1380..2147; Strand=-; Gene=SeqID_82591
ctcacgtaaaaactggattttttcaaagagaacaatttcccttgattttttgtgttatgaaaaaatcccaaaaatttctgggtaaatttaaaattgccaaaatttctatacaaactttgtacatttatttcctagaaaatttttgctcacaaattgcctaataaatgcgattacaatttttgtttgaaaagtattattttgttccctattcatattgtgtgtagtgtttatttgattaaagaaataaataaatttttacttctctatgattgctgagggtaacaaaaacaaattaaaaggaaatacaatatctaattagtgttggcagtcgacataatcaataaatatattttcgcgcaatttatcacttccggtggcatcatccgatgatttatgattaattaataaaatataaatttaaaaaaatattttatgttttagcatgtttaatagtttttcgatcgtatagaaaattgtacacccataataatcgcctgaaaaaattttagaaaattacacccctatgaattgaaaaaaatttttcaaaaattgattcccgaaaattttttttttcttggtaaaaatttgtattcaaaaaattttttaaaatattatttaattttatttacaattaagatataatccaaattaagtgttttagttaactttttacgttgttttgttaccaaaaaagcgttaataaaaaattttatttgcttattttagtgcatatttcgcgattttttcagcagaggatagcgtaaaatg

SEQ ID NO: 112878 - DNA, 154 bp, Heterodera glycines
  Promoter: Source sequence=SeqID_38964; Location=720..873; Strand=-; Gene=SeqID_67643
actgaaaaccctgattttatattaaatgatcattttttcaaaaaagagtaattttggccacttgtaatggacggggggtggattttgtttcgaaatagttaattttcatgattttttgtaattaaatgttccgagaatttcggagtcattaatg

SEQ ID NO: 112879 - DNA, 301 bp, Heterodera glycines
  Promoter: Source sequence=SeqID_10202; Location=1819..2119; Strand=-; Gene=SeqID_73320
ggtatgccaatggtggcgcatcagattatccgattcccgaattttgaatctgaagcatctctatgaaggcactttggtatcacggcgctgtaggcgaatttcatgggaaggccaatcaacctagtgtgaggcaaccccaatggaaaatttcaaaaaaatatggaaaatgccaatgaaatttgttcccctcggtcccttggttttggcgagaaaagaaacatataatttaaaaaaaaactcatttacataggagctcagctcgaggacacttacaccttggaccattacggcattcagaatg

SEQ ID NO: 112880 - DNA, 514 bp, Heterodera glycines
  Promoter: Source sequence=SeqID_24407; Location=1..514; Strand=+; Gene=SeqID_55133
ttaattttctgtcacagcgttttcaaaacgatcagctgcgcacaaactgaattccatcgtcaaatcggcggagtgcactcgccgacggacatttgccgtaattaaaatttaatttaaaataaaaaatagaacttttttaaattaatgaacttcaattaaaaaaacgaaccaaattttgctgttttttgtaaatatttctttttttcatttcactattcaaatcttttagcaagttcagccaagtgtttaataaatttctcaaaaatcatacaaatttctgtgattggcaaataaaaggtccacaaaaaaatgtgtccacaaaatttgaattaaatgttttttttgaattttcaaataaatttattttttcatttttccaggcaatttttgttgcgattttctgatgaacgtggaaggcccaaccaaagacacagagtgttcccgaaaatgtgccaaagcatcgtttgccattggcacatccatcaaaaaacagctgagggacttgcggaggatg

SEQ ID NO: 112881 - DNA, 73 bp, Heterodera glycines
  Promoter: Source sequence=SeqID_37613; Location=738..810; Strand=+; Gene=SeqID_66636
gttcaccatctttcgggtctcagcgcatacgctctgtctccgccccatcgcatgcgatcgagacgggactatg

SEQ ID NO: 112882 - DNA, 247 bp, Heterodera glycines
  misc_feature (58)..(58): n is a, c, g, or t
  misc_feature (103)..(103): n is a, c, g, or t
  misc_feature (110)..(110): n is a, c, g, or t
  misc_feature (234)..(234): n is a, c, g, or t
  Promoter: Source sequence=SeqID_41970; Location=994..1240; Strand=-; Gene=SeqID_69995
tttaaagaaaattttaaattcaatgatttatcctatgtctgctaagaatacgggattngaagaatatagtaggaccttatggaagggttgttagtgaaagtgnaagatanaaataggtatatgatggtttgaaattttgtttaaaattttaagtaaaataaaagagattgttttgtgtaaaaagagatttgatattaggtttatgtattaatagagataaagaaatagtatgtnaaaatgagagatg

SEQ ID NO: 112883 - DNA, 1003 bp, Heterodera glycines
  Promoter: Source sequence=SeqID_346; Location=5818..6820; Strand=-; Gene=SeqID_83550
aagaaacgcccaaagtggcggttttaagaaacgcccacctggcggttttaagaaacgccctggcggttttaagaaacgccctggcggttttaagaaacgcccaatgtggcggtttttaagaaacgacctagcaccgaattaaattacctcaaaacaaagattctttattttatatattcatccgtttaattcgttgaagacaaattaagaaagataaagaaatatttcaaaatccaagaaagaaatccgaaaattagcgacaaaaataattgataataaattgcaaattggctatggaacgctaagaatttggaaaaagaaattttcttaagttttggagagtaattctcgagggtgttaatttaacttccctggttttcttttagcacctataacttgaacgaaaattacttcagcaaatctcttaaaattaaaagatataacatttaataacaaattttaatttaaaaaaatataaaatattttgaagaattgatttaattgttcggtttacgtggcagattaatatttgtaaagataaataaaatgagatacttttccgttttggggccaaagctgattatttttttttaaatcaacagcaagctaatagaattgcagatccattcgaagagatattaactcaaattatggcatttatgcctcagaaataatttggtgagtagctttagcaattctccgcgccctctgttgattaaaaaaataaataaataaataaaataattttggccccaaaacggaaaagtacctaaaatgaatattaacattaaatatattcatttgaaggaataaattcataaatttttttatatatatattaataaatatcctaagattatgtggcatttaatgatattttttacaattttctttgattttggaattgaatccggcaaaatccgaacaaattttaatgaaatattcggcgaagaatgggacaaaaatgaatgtgaagaaattttgataaaaactgaacgaaatg

SEQ ID NO: 112884 - DNA, 597 bp, Heterodera glycines
  Promoter: Source sequence=SeqID_7217; Location=1306..1902; Strand=-; Gene=SeqID_64176
ttgttttcatcttcagttttgggtggtcaaattatttaatcggtttttgcttaagcatttaaattgttcaactaaattttcttcaattaaaggcccactcattaaatcaataattaattattatttattaattgctttaattgttttatttattgctcacattttgctcctccgctctgttgaaaatcagctttctcccacttagcaatgcctttggtgcctttttccgctgttttgcgcgttttgcgtccaaaatgaaagtcggactttcgcaatgggacaccggcgaccgcggggatgtcgcagtgcgactgccgaggccattttttggcccgacgaagcgcaaaaaacgccgaaagtgcgcactcgcagcgcgacgcattgagtcgtggaaactgggaataattaaataaattacatcaatttgtaaactaattattaattaatgtcaccaaatggccgccatcggaataaggttaaggccaacggcgagcacaaagtcaaatgcctgtgaatattcgacgttgaaatggtctttgttgtaggcaattcgcagcataacaaaatcgaacagcaaattgctgaagcgaaaaaatg

SEQ ID NO: 112885 - DNA, 354 bp, Heterodera glycines
  Promoter: Source sequence=SeqID_33300; Location=590..943; Strand=-; Gene=SeqID_63402
ttttaatatttcaatgaatttcttttgatgataaatttcaaaaattttatttttcttttcaagaactaacccaattttagaggccaatatttatattgaggaccctgacatttggggcccaacaataattattgttagctcatatttattgctccccaattcgctgagaaaatgaaaatataataaatgaattatataaaaaaatggtgtatcttattgatcatataatgattaaaattgttaagaattgattgaataatttagccaggctataaaattaataattacaaaattcattgcgtaaaatattttttttaataaaaataattcattaaatttttataaaaaatcatg

SEQ ID NO: 112886 - DNA, 789 bp, Heterodera glycines
  Promoter: Source sequence=SeqID_7078; Location=136..924; Strand=-; Gene=SeqID_63781
gcaaatgatggtagctgaaccatttctagtccagtttaggtcccatatttggcttactaaaattttatttcgacataaaacacttgccataggggtttcatgatagtttatcattgataggcactcatggcttcatatcgtttcgctacaagtcgtttcgtctactaatagtaaaatggatacttttaagaccgtccttcgttcaacaactttaagaattgagtctaaaattttattgttcttcgatggagaccatatttaaaaaatgaacaaaagcaatctgtgatcacaagaaaaaattgtgacaataatgaaaaatttgagacgatttttgttaaagatttaatttgggttttgaaagttgaggtaagaaattatcactattcatcgattctttatccttcctatggcaggccttactcacctcaattgggtacaatttcaaagcgaaatgacgcattttcattgagttgtcgagacgacttgtagccaaatgactgaccgattcatttaattccgattctcatgacccgaaactcgaacaaaaagtcgcaaaattccactttttcggtgtcttatgctatcattcatcttgtaaaggtctgtttgttgtaacagttctcccctcccctgcttcacagagaggaagcggaaaaccgggcacagaacgagaaggagcgcaaagaacacctggactgcttggtcaagttgttgcccaccgaaccagatgagagcgagccggaagtgattacaatccgtcttcgcttcccaaacggtcaagccaagatg

SEQ ID NO: 112887 - DNA, 372 bp, Heterodera glycines
  Promoter: Source sequence=SeqID_18225; Location=791..1162; Strand=-; Gene=SeqID_82821
agtaagagtaaagattaaataattgaataatctaatttaaatgtaattttttcaactttttcatagtgaaatttgacttttttttttgccggcggtgtcaaaccgccagggaaaattttgaaagtttagttgcgagatttgtaaacagattttcaccaaaaatattaattttggatcaaattttaatttctaaattcggatcgttaaaatcagtgcaaataaaaataagtacacttggaagcatgacgaaatttttcgtatcttaatttaatctcggcaatcgggcaatcgaagtcggcattccgtcacatccttggttaaaaagaaaaataaaattggaaaggaaaacggatggaaaaaggaagagaaatg

SEQ ID NO: 112888 - DNA, 1003 bp, Heterodera glycines
  Promoter: Source sequence=SeqID_101; Location=7866..8868; Strand=-; Gene=SeqID_68297
cttttgaagtgttgttgttgttgcacaatgaagggatgatgatgataaacgcaaatagttgtgttctaaaaaatgaaaaagcataaaaacataaataatgaaatgaattataaattttaaaaatagggaaaagcaattttttgggtttttttgattaaattccaagtttagattgtccagcaggaaaattctgtgagaaacagtcaattttgattgaaaaaacaattggaaaaattcgggttaattatattttgcgtactctgtaacacaaaaaattaaatcagaacattaaggactgaatagaggagggaacaagtaagcaaagcatataggcgtaatgcaaaaaatgtcagtccaatgagaaaaacacctccttatatagagagaaaaccttggaatttgggcaatggtacctacctacgttactacctaacttttgccctcccttgttgcgtcgtactataaatattgtgcccccttttcctcccttttcattcactcatttttcttttatgagtgttttactatgttttttgtgaatttcataaacttcactgtttcaaaaagacatatttcttatcttaaccagtaaatacccaacccgaattccaaaaattatcgacatcgacctgaaagtttatcagagtttccctggcctatactaccaaatttgaacctaaatttatcaaatttttttttacaaaaactgcaatttccctatttttaaatttataattcatttcattatgtattgtttttatgttttttccttttttagaacagaactatttgcgtttatcatcatcatcccttcattgtgcaataacaacaacacttcaaaagcgacctcatcgccgtttctcatcgttcattcgtccgtccgtccttcacatcaattcgctcgccgttttcgcaatggcacgtcgacgcatccaaaaggtggcaaatgacaactctctgatcaaccaatgctttaaatgttttgatccatttgcaggaaatg

SEQ ID NO: 112889 - DNA, 103 bp, Heterodera glycines
  Promoter: Source sequence=SeqID_25393; Location=33..135; Strand=+; Gene=SeqID_56142
ggtaaccccttaaaatggattaatcgcttcgctaaggctttctctttaattgtttccctgttcagggcccgtttgtcgttctgtggaaatgcttgtccaaatg

SEQ ID NO: 112890 - DNA, 242 bp, Heterodera glycines
  misc_feature (83)..(83): n is a, c, g, or t
  misc_feature (91)..(91): n is a, c, g, or t
  misc_feature (93)..(93): n is a, c, g, or t
  Promoter: Source sequence=SeqID_8741; Location=1..242; Strand=+; Gene= SeqID_69049
ttaaagtagattttatatctgctaaattaaaaaccaatcataggagttcaggtaggcaatcaacccttctctattctttaacnaaaaattntnagggatgcgcatttcacggtcgttatttcggaaaaaattttttttataaaatataaattttaggttgcccaaaatgctttaaatcattccatgtttgtcccaatggaaatacggctgaggaaaattttttgaagacgggaaacagaatg

SEQ ID NO: 112891 - DNA, 846 bp, Heterodera glycines
  misc_feature (183)..(183): n is a, c, g, or t
  Promoter: Source sequence=SeqID_1614; Location=3186..4031; Strand=-; Gene=SeqID_74837
agctaactaatcctagtcttttagttataaaataatgattagatatatgaaaaaaacatattatttttgtaaattagatattagatgttcctaagcattattaaaaaacctaggcccaggcctggatccaggcctcaaagagccaggatttttttctggacctcgctttttgtccaggaaatncaggtccaggtctaacatggaattccaggtccaggctcaggcttttttcaataagtcggtctttactaattttttaagccattagattgaggacaaattttgattaatatacatgagaattcaacaggttcttggtccatcaatttaaataaatatttttttttaactttattttttgggataaaaattcttttttgataaaatttccaattttctgtgtttttttttttacatttttatgacttatttcagcgccctggcaacggtgaatttgggaagaaacatgcaatttttttttgcgttaattcataggttatcatcataaaaaacacacattttttgaacttccttcctttatctttttaattcaaaaaacttaaaaacattaaaatgaattttcttttaaaaattaaattaattaaaataatcaaataataacaattaaattttcttttctttttatttcatttaaatagtttttaatattacaaaattttaaataaccaattaaattaaatgaacccaaataaaatgaaatgtctttttcattatttaacaatttttcacttgccttaattaaaaatattaactatcattttatagaaaaattttttttttattttgattttagtttctctagctccattccctagcatgaaaatg

SEQ ID NO: 112892 - DNA, 396 bp, Heterodera glycines; identical to SEQ ID NO: 109417
  Promoter: Source sequence=SeqID_13577; Location=768..1163; Strand=-; Gene=SeqID_77479

SEQ ID NO: 112893 - DNA, 117 bp, Heterodera glycines
  Promoter: Source sequence=SeqID_44796; Location=1..117; Strand=+; Gene=SeqID_72215
tttatattattattcatcattttttcatgcacatttcaaaggcaataacatcagtgagttaaataatcaaggtaattaatttgtctaatcatttttaattagggagaagacaaaatg

SEQ ID NO: 112894 - DNA, 1003 bp, Heterodera glycines
  Promoter: Source sequence=SeqID_7516; Location=1219..2221; Strand=-; Gene=SeqID_65089
gcacgaaaacattcattttcttcatcaaactttagtttttcatgacgaatttcggtttcgattttttattttgttttatttcggacggtaattgcctatttttgagtccgaatttaacaaaagaaaaagtcgtagagttttcagtccgctgactggccagcagggctaaaaatttaattcatagaaatggagagcctgtattacgattcttcaaattaattaaatgaattttgtttttgtttatttttctcaagaatccttcccttttcttcactttctcgaggctttaatcgcggctttttcatcaattttctcataagtcctggtttttctttaccattgcatttcacatacagtacatacctggcaaatttcgttttatttgaattgaatttcttaattttccttttttttgccattttcataaattcggaggaactaaatttttccaagggtttgtctgtgtttgaatgattcattgaattgggcggattctgctgcagtttcccaatttgctttttcttcttaactgttttcattaattaaatttataattaattaattaattatttttccattttctaattagtgtcaattaaatgattgcctctttctttctttgtcattcattacaaaaattcattttctttactgcacaaattttgtgccctttttttttacttcgtttccattcgctaattaagccaaaaaatgatatttttgctaaaccgtgcgatgcgacgtgaaaactgctcaaaaactggtccgtccgtcccccgaccgtccgattgacctccaaaacttcgacaattaattggccgagccccccccccccccccctccccaaatttcgtcccgcccaatggtccattaaaacatataaaatgtgcgagaatcagttcctttgcacatcatttactaattattttctaattaattgtttaatttaattatttttaaatcattgagttaattttcagttccatttttaggtcagaaaatg

SEQ ID NO: 112895 - DNA, 818 bp, Heterodera glycines
  misc_feature (213)..(213): n is a, c, g, or t
  misc_feature (252)..(252): n is a, c, g, or t
  misc_feature (286)..(286): n is a, c, g, or t
  Promoter: Source sequence=SeqID_10843; Location=1422..2239; Strand=-; Gene=SeqID_74113
ataggacagacaattaaaaatttggcactagtacagttggtacgccaaaaaatggttttaaaatcatataaaaaatgtttctagagtttccgggggcgttgattatgaatccgatctcaatttctactaattcagagttcctgactcaaattcgaacatttggtcgaaaatcaaaaaaattttcatgaaagttgaagcagtgaaattattaanatggtccatttcagtggaatagctgttctttaaattttntagctaatcaattgacgtaaaaaaaccctataanatatttttatacgagtttaaaacaattttttgtgggcgtaccaactgcaactagtaccaaaattttccatcctttggcactttaagagtcaaattttgactttttaactgaaaaatttttaccacaaaatttcggtttcaaaatttaagacgcagaaaaagtaatgcctcaatttcttgtgtacacttcgctaaattcaactcattagtcatgagattgcaaattcataatttgggttctttttagacctccccatcacgatgtgacattttgggcaatgattgtgagccggtcagagatttgttgcgaaaggcggaggccttggttcgctgctgttctccatgcgtatgccggcacccatccgaacttgtaaaaataactttatttactaaattataacatttttagtcccggaaaatagagaccgaatctttatatgatacaaatcctgaaatatttaacagaatatgtgccaaaaatgatgcaatttgtgctaaaaccaaaaaatgtgcgaaaatatatgctcaaaatg

SEQ ID NO: 112896 - DNA, 175 bp, Heterodera glycines
  Promoter: Source sequence=SeqID_1199; Location=563..737; Strand=+; Gene=SeqID_69786
agttgagagtgacgcgaactgttcaattttggttggaaatgaccaattgctttgttacgatatccaaattgggtggaaattcttttggttacgttttgccattggtctcaaaaagatttgtttgtgcttttcttcgttcaattccccttcctttctcatcagagtttatcggatg

SEQ ID NO: 112897 - DNA, 379 bp, Heterodera glycines
  Promoter: Source sequence=SeqID_8722; Location=3051..3429; Strand=+; Gene=SeqID_46634
ttgtcatgaaataatttaagatcttaaaggcagtaaaaataaagagaaaatgagtcattagcagtcaaccaatctaatcgaatttaaagcatatgaaaaagacacgaaaagcattaattaagaaagaaaccgtgatggttttaggtcaagagctaacaaataaatgaataagccgaacgaaaaccggaatttttaaaatttattttgttggcattatgtttatattttattttggcatcacctagccacagttttccgacaaagtttgagcaaaatcgtttaggtacctaattactgaattgcttttctcttttatattaccgccgctatgagttcaaaatttatttttaggtataagagaacaacagtattaattatg

SEQ ID NO: 112898 - DNA, 199 bp, Heterodera glycines
  Promoter: Source sequence=SeqID_5428; Location=1..199; Strand=+; Gene= SeqID_57988
aaattttaaaattattttcgaaaaaattaatagagactacgaatcaaatatcctagagttgaaaaatttttaaaaattttcttaattaaatttttgtaataaaatggcgctggaacaaaaaccgaatggtttgattcatttaaaaaattttaaaaattattaaaattaaatttaaaaattggaaattttacagcaaatg

SEQ ID NO: 112899 - DNA, 1003 bp, Heterodera glycines
  Promoter: Source sequence=SeqID_15211; Location=462..1464; Strand=-; Gene=SeqID_79411
gtggtttttctgattttattttaattttatagctgttctctgtacatttcattgtgtgttcattttcttaatttttccgctcattttgtcacttaattaggtaattaggtgggctgactgattcttcaaatacaaatatatttaataaaaaatattcaaaaataattaattaattatttataatttaatgcttttttgcctttttatatttgtattgttaatcataaacaattcaacggacaaaacattgtcagttaatctttgtaaaaaacttcggccaacttttactgaaatatttggcgaaaaatgggcaaatgaaataattggagaaaatgaaaaaaaatttttcttttccgtcaccgtataaatatttcgatgtgacagaacattgaccaaaaaacatgcttgagtaattaaacgcaatcaaaataaatattattagtgttttttgcttgtcttcgtgtctgtcgcgcctaattaccctccccccccccggcgattgttttgtgactgacaaataattgtaaaaattttatgatttatataaatttaaattttttaggctttaggctctaaaaagaaaaacctagaaaataggccctaataactcgaaaagtaccttaacaaccaccaaaaaacaacaacaacttgtttttcgtgtatttcagaccatagggagctcagcaaataaaaattgaagccctagtgatgaagtgtgaaaacatccaatgggacgtaattacgaaatggcatttgaaattatgatgaaattcatggctttaattattttaatattatttattaatattttattattaagaaaatctattgatgatcagtttcacttattgatcgcatttttggcaatgcttctccacattcattaaaaattaaataaaaaattattttccgaagaaattagcttaattttaatacaaatatatatatattaaaaatattaaaaacttattaattaattaattatttattttttttagtgatg

SEQ ID NO: 112900 - DNA, 144 bp, Heterodera glycines
  misc_feature (126)..(126): n is a, c, g, or t
  Promoter: Source sequence=SeqID_18957; Location=1612..1755; Strand=+; Gene=SeqID_83688
tcttaaaaataacaaaatttattcgcaaatttttaaaaaaacgataaattgtaagacaaatggacaaattccgggtttattgtacgttttatatggttttattttattttaaaaatttccaattanagaggcatgaaaaaaatg

SEQ ID NO: 112901 - DNA, 328 bp, Heterodera glycines
  Promoter: Source sequence=SeqID_29536; Location=1..328; Strand=+; Gene=SeqID_60028
agagaaaagaccgaaggtggaagagagagaaggtggagggaagagagagagagagaagagagagagatggaggagagagagaggagagagatagagagagatggagaggagagagagaggaagtgagtagagtggaacgagaggagagataaaggagagagagggagagagcgagaaagagaaaccgcgatttttcttgagaaacttcactctcgaataaaaaccatgcctaattaagcagtttctgcctgccgtttcggccgccggcttattccaaacccaaacggctggcggcaacgctttgttcaatgcgggcgcaaccgcgatg

SEQ ID NO: 112902 - DNA, 510 bp, Heterodera glycines
  Promoter: Source sequence=SeqID_40932; Location=938..1447; Strand=-; Gene=SeqID_69158
aaatgcgcattttcggtaactaaatacaattgtaaaagtcaattaaaaatgcgcattttcggtaactaaatacaattgtaaaatgtcaaatgaaaaggcgcattttcggtaactaaatacaattgtaaaatgtcaaatgaaaaggcgcattttcggtaaccaaatacaattgtaaaatatcaaatgaaaaggcgcattttcggtaactaaatacaattgtaaaatgtcaaatgaaaaggcgcattttcacgtcactaaatacaattgtaaaatatcaaatggaaaggcgtatttttcgataacaaattacaattgtaaaagtcaattaaaaatgcacattttcggtaactaaatacaattgtaaaatgtcaaatgaaaaggcgcattttcacgtcactaaatacaattgtaaaatatcaaatggaaaggcgtatttttcgataacaaattacaattgtaaaagtcaattaaaaatgcgcattttcggtaactaaatacaattgtaaaatg

SEQ ID NO: 112903 - DNA, 141 bp, Heterodera glycines
  Promoter: Source sequence=SeqID_913; Location=1407..1547; Strand=-; Gene=SeqID_63918
tggtgatagcagttgattcggcagtatatgattcaaatggagatacattcgacccaggaagagcagctgaagatcggtccctcctggcagctttgaagtttcctctatcaattcaaaattgtccaattgttttgctgaatg

SEQ ID NO: 112904 - DNA, 422 bp, Heterodera glycines
  misc_feature (51)..(51): n is a, c, g, or t
  Promoter: Source sequence=SeqID_12678; Location=1539..1960; Strand=-; Gene=SeqID_76357
ggaaaaaaataaattttagagagaaaatctggtgacaaaatatgaaaattnagctcgattttcctaaacagaccttgtcaaggtttcaccgggcgacacttctcggaaccgtcgaacaattctcttaaataaaaaagacactttcgggccaaaattgaggaaaaaacgcaatttgtgctccgacgtggcctaatttagcaaaataaccacaaaaaaaaatgtctgggacgaaaatcagaaaaagtccgtcgtgcccccaccccccgttttttaaatttacggtgctaacatttgttgtacatcctttttgtttgcgtaatttcagtctcattttctccgaccttcgccttttgttgccgggcgacgagcaaaacttggcggaatatcccatcagactgtacgactcggtccaccaaaaaatg

SEQ ID NO: 112905 - DNA, 392 bp, Heterodera glycines
  misc_feature (35)..(35): n is a, c, g, or t
  misc_feature (55)..(55): n is a, c, g, or t
  misc_feature (109)..(109): n is a, c, g, or t
  Promoter: Source sequence=SeqID_27849; Location=1..392; Strand=+; Gene=SeqID_58525
ctgaggcccgtggagcatatgcaactcagagtacngagcagtacttctggacacnccgaaggaacgtcgtttggaggtgttttttattgacaaataaattcaattcaanaggggtgatatgattaatatttttataaattaaagcatttcgatgctctgaaaactccgcaggaatgctttcacattattttttcgttcagggcgattggtcacccgtcgggtcgacttgtactttatgtgctcctccgtcagctccacaaaacctacggctgtcatcagaattcgacattgctgtggggagcggggaaagcagttcaaaggcaacgacagcattccacgaagacggccaatggcactccgttggcatttgttgggaagccccggcgcaaatg

SEQ ID NO: 112906 - DNA, 783 bp, Heterodera glycines
  misc_feature (180)..(180): n is a, c, g, or t
  Promoter: Source sequence=SeqID_25714; Location=302..1084; Strand=-; Gene=SeqID_56455
atagccgacgccacaacgccgctaccctgatcgccgacagcaaccacctgtgcgatactcgccccgttgagatcatttaaaaggggaggtgtttgggtggtcaaccccgagagataaaagtacacaaatgcattcattctccctttgcatgtgtctatttcttttcctctccattttccncactctctaattagtgtgtcttcctttttttatgtacgaccctattgatttattatgtccattgcatgtcctttcccctcattcattcagttgctttttatgcacttatttcacttcgcctaaatatttgttctcctccaatttatttattccgcttccgacttcgcatatttatttaaattgcttaatttatttgttctacaaataaacttttattgagtcggttcaaagggtgtaccgacatttcgccaacttgacatctcgccaactgacatctcgccaacttgacatctcgccaactgacatctcgccaactgacatttcgccaactcagccaaaaacattcatttcgccaactcaaccaaaaacattcataaaaaaattaaagaaaaaaagtaaaaagagtaaaaaaatgctgtgttaatatcaaatacagccctattccagtttacacgtccaatcagtgaccatcatcatttcttatgtactaacttttttcatatttgttcattccaaccatttttggatcaatcaaagcttaagaattcctttcacttttttataatttcgtttctagcgtaattcagattctagcaagaaatg

SEQ ID NO: 112907 - DNA, 1003 bp, Heterodera glycines
  Promoter: Source sequence=SeqID_12999; Location=2074..3076; Strand=-; Gene=SeqID_76771
attgaatttataattatcaaattgaatttataattattcaaattgaatttataattatcaaattgaatttataattattcaaattgaatttataattatcaaattgaatttataattattcaaattgaatttataattatcaaattgaatttataattattcaaattgaatttataattatcaaattgaatttataattattcaaattgaatttataattatcaaattgaatttataattattcaaattgaatttataattatcaaattgaatttataattattcaaattgaatttataattatcaaattgaatttataattattcaaattgaatttataattattttcaaaattgcgtcaggaccaatcaactcaactaggtgatgatgaaatccatttttcaataaaaattttttattttcgttgaaagctttttttgataatttaaaaaagggtttttaaagtttgtcttttaaaaggtagattttttaaaatacttatttgtattttcttttgaattgcgaaaaacttagatttttgaaaaagctagcgtttttttttaaatttttgaccattttccatattgagagtcccaatttattattttttttaaagtagaatttttgattttttcccattgtgagttgtcggtcctaaaagcctatttgtccctggagccgagttggcctcagatttgtcaaaattatttttaattttttagagaatttctatcgatgcagtccgaaagcaattagccgcaattgaaaagagttcgttttgcttaatttttggctgaaaatatgtcactcactattcgtcactatttcggaatttttgccactatttcttcactattttggcatttttactcactattttagttaactattttgggatttttcgtcactaaaagttgcttcactagtaattacctagttcgaattctgtactttaccaataatttttctattttaagcattttttttgttgttgcagaaaatg

SEQ ID NO: 112908 - DNA, 137 bp, Heterodera glycines
  Promoter: Source sequence=SeqID_41104; Location=161..297; Strand=+; Gene=SeqID_69300
ttccaaaaccatgcacatcaccttcatcggtggtgactggtgctgtgtgtcgatggacagctgggccgaaggcagtttccggttggtgacaagctcacgcgctctgctgatctcctccagtgtacggcttggaaatg

SEQ ID NO: 112909 - DNA, 1003 bp, Heterodera glycines
  Promoter: Source sequence=SeqID_22593; Location=450..1452; Strand=-; Gene=SeqID_53258
ttaatgaaataaataaatgaattagtgatgatgatgagcataattaggttgttggacaattaattgcccgcccattattaattgatttgcgggatacgaggaacaacggcagcagcaggtggttattgggtcactcagtcataataactattattatattatttattttttgaaaaatgcaagattataaaagtttttttccttagagaactttgcagattaatttcgttatattctacgatactgtatttcttaagatggtgataatgctttacagtacacgcactaccatatttgattggtataacttattaaaaagagtaaatatctaaatttaggacggcttcttatgacgcaaaaataaaagctggaccgttttctttattatttattgaacacagaatttatattataattattattataattcaatagggttggtcgggaccgggaatttttggcaaaacagggacttcggtactcagttgcccgtgtccaggtcccggtcccgtacaattctataattcaataaccaatcaatgttaatttaggaaacctttattaaatttgcaacaaataaaatttgaaatgacaaaattttggcattgtgatggcaaagtggtgaaagaatttgaaatggcaaaatgttggcattgtgttcgcaaaactggaaaaagatttgaaatgacaaatttggcattgtgttggaaaagtggggaaagaatttgaaatgacaaaatgttggcattgtgttcgaaaaactggaaaaagatttgaaatgacaaatttggcattgtgttggcaaagtggggaaagaatttgaaatggcaaaatgttagcattgtgttcgcaaactggaaaaagatttgaaatgacaaatttggcattgtgttggcattgtggtgaaagaatttgaaatggcaaattgttggcattgtgctcgcaaaactggaaaaagatttgaaatgacaaatttggcattgtgatgaaagaattttaaatg

SEQ ID NO: 112910 - DNA, 90 bp, Heterodera glycines
  Promoter: Source sequence=SeqID_4485; Location=3917..4006; Strand=-; Gene=SeqID_54627
ttttcaattcaaattaaattttataaacaaaaagatggacaaaacaatgtcgaaaaagatgcgaaactggtgaacattgtctgtgaaatg

SEQ ID NO: 112911 - DNA, 864 bp, Heterodera glycines
  Promoter: Source sequence=SeqID_5747; Location=1029..1892; Strand=-; Gene=SeqID_59105
aaaatttttaggtcgattcttaggggtgtattttttggttttattgcatttttgttaaagaattttccaaaaaatgtcgaaatagtgacaaaacgccaaaatagtgatttttaactattttagtgccgactcgtcgccaaaatagtgatttctagtgaccgataatgacatcagaatcgaaaatttttaatgcagaaatgcgttttttgagctcctttcttcaaatcaatcgagcaaaaaatttagttaaaacctaaaattcacagccctaattatgtcttcccttcattcatttgcattttatatttgttccccaagttatttgtgactttctttccttctccaagaaattaaatatttaattggacacaccgtttcataaaacgagatgtgtaccaataaatagagagtgccagagaaaaacattatcttttttctctaattttttgtctccttttggcgtactatctaatatttttattattaggaaaaacaacatttacttcgaacagcataacttttttttcctcaggcagaatttcttttaattttgtataccgatagagaaaaaaatatagaattgttcaatcgcttttttaaagaaaacaatcgcttttatttaacttaaattttaattttaaagcaaaatttaattaaatggcaaaaagaaaaattgtgtgcaagcttaatgcaattaaatcggcacaaaaacgggtgaaaaatcgagagcagcgacaggccaatattgcgagggccagagaaacccgatggactaagaaaagcgagttttttcagcaatttaaactcaaaaaatcatttctttgagtttcagccactccacagtcgaaccccaatgccgaaatg

SEQ ID NO: 112912 - DNA, 761 bp, Heterodera glycines
  Promoter: Source sequence=SeqID_31610; Location=1017..1777; Strand=-; Gene=SeqID_61931
gaaaaacctatcatgaatttttacaactaaaatttccataaaattttccctcaaaaattcacccgctaaaaactcccaatttatttaattggctcaatttgcattccgtcaaatgatgaagcaaagcaaaaaataatcataatgatatgttactaaaaataatttccgatttctctccgtctcatttctaattagcctaattaattcttaaaccgtacaaaattcagacagcaaacacttctcattaagacaaacacacaaattatttgtaaataaacattattttgagtaaatatttttttgattttattgctctgctgtcaaataataaattaactcgtcgataataaatcattacatttcattgagaattgtctttctttttaggtcgtttttttcaaaaatttattttttaatttaaacccattttttaagagataatccctcggataacacatattattgatagttttttttatatatgccaaagaatattaaacgccattttacaacggtcgccgtttgcgacttaaacaccaattctaattcaaatgaatttaaagaggccgatttggaaacgtcgaattggcttgtcaacctatttgaacgcttgtaatattttaaaaatgagttcaaattccaatttttttttcgttttggggtaaaattttcaaaattacaaaaaaaaaaaaattaggcctgatttcgcctttcaaagaggttattatattgcttacaaaggcctcaatctgctttcaatg

SEQ ID NO: 112913 - DNA, 279 bp, Heterodera glycines
  Promoter: Source sequence=SeqID_9481; Location=2392..2670; Strand=-; Gene=SeqID_71578
agctgcctcaggcgggcggcgacgcttcctcttgctcaattctcaacggcattcttctcggattggaagcattttccgagcagacggcgctgcagcggaaagctgcggacaaaatgtgtgtggactttgagtggtcgcttatatattggacagcttgaattgagattgcgaagtgctggaaggactgcttcaagccagaagaatgtcgcggaggccaacaaagggaccgaatcgacggagactgaagggaaatcagagacgacggactccaatcagatg

SEQ ID NO: 112914 - DNA, 82 bp, Heterodera glycines
  Promoter: Source sequence=SeqID_11327; Location=279..360; Strand=+; Gene=SeqID_74712
acttaaaatttaatgagttcaaatattttaattaatttccatttcaaaaaattatattttttaaagatctgataacaaaatg

SEQ ID NO: 112915 - DNA, 102 bp, Heterodera glycines
  Promoter: Source sequence=SeqID_36373; Location=1..102; Strand=+; Gene=SeqID_65703
ttttttatcataaataatttatgcctgtgcaagacactgacaaattttttcagatttttgaccattggcgccaaaaaacactttatagcgtgcgccaaaatg

SEQ ID NO: 112916 - DNA, 131 bp, Heterodera glycines
  Promoter: Source sequence=SeqID_39279; Location=181..311; Strand=+; Gene=SeqID_67885
ggtaatgatggactaatggatcaaatccattgccaaattagccaattaacttattttatttagtttagttattttatgttttccgccttttagatgagtgtgcccatagcctcggcttcgtccgtgccatg

SEQ ID NO: 112917 - DNA, 356 bp, Heterodera glycines
  misc_feature (136)..(136): n is a, c, g, or t
  Promoter: Source sequence=SeqID_15694; Location=2960..3315; Strand=-; Gene=SeqID_80004
agtatttgtgttattttttaatgattaaagagtgagtttgttttgaattgtttaatttaatttgaaaaaattttaataaaaatgggagttagaaaaaatgattggaggagaaatgggagaaggagaaaagatggangtaatattttatttgttagattttatttaaagttttattgaggtttttgaaaaaaaattttttggggtattttggggtatgaaagaaaaaattttaaaagatttttgtttgaatttagttattttgtagaaaaattagaaaatgttggatttcgatttggagtcgtttttaaatgaatttttcggtgcccattcccctaagctcgatttgtttcaggatg

SEQ ID NO: 112918 - DNA, 179 bp, Heterodera glycines
  Promoter: Source sequence=SeqID_13898; Location=650..828; Strand=+; Gene=SeqID_77849
aggcatattattaaaatgatttgatttttaaatgttgagaaattatcacttaaattaaaaaaatatgtattttttacattttactcgtaggtaaattattttaccgtcacctgttcattactcattttcaaaaacacaaatttattttttgaaaattcattgttcgtggttgcgaaatg

SEQ ID NO: 112919 - DNA, 104 bp, Heterodera glycines
  Promoter: Source sequence=SeqID_35549; Location=1..104; Strand=+; Gene=SeqID_46433
aattagtgcattatttaatggcaaaactcgccaacaacttctattcaaatttttttaatttttaaaattattttctaatcattaatatttaattcctaattatg

SEQ ID NO: 112920 - DNA, 261 bp, Heterodera glycines
  Promoter: Source sequence=SeqID_840; Location=4236..4496; Strand=+; Gene=SeqID_62547
ttctgacgactaaaaaattttggcaatcggaattccggtggactcaaaaaatttcggaaatcgtaagtccgagcccaaaaattataggaaatcggcattccgacacatcagtgttactatgaatgtttatacctttttatggttctcaaaagaaaaaaaagttatgatccaaaaactcgcttccggcgattttttgtcctctgttccgaaatagaagcttgctccatatgaaaaagcgcatttgtttaagtgtacaagatg

SEQ ID NO: 112921 - DNA, 53 bp, Heterodera glycines
  Promoter: Source sequence=SeqID_1491; Location=947..999; Strand=+; Gene=SeqID_73907
aaattttgtaaaaccaaaaaaaaaaaaagaaaattttgtccaaattaaagatg

SEQ ID NO: 112922 - DNA, 217 bp, Heterodera glycines
  Promoter: Source sequence=SeqID_19770; Location=1..217; Strand=+; Gene=SeqID_84505
agacctgaccttaaatcggcaaaaatcggatatggaagtttgacctactttctggcccttttcttattatgtccagttcttgaaaacagagatttgacctcgagacccagtctgattatcaaaaccgagaccatagaccaaaaccgtgagaccggagactgcagcaaaaaacacgattcttttaatccacccccccccccccccctctgcacagatg

SEQ ID NO: 112923 - DNA, 390 bp, Heterodera glycines
  Promoter: Source sequence=SeqID_26562; Location=1..390; Strand=+; Gene=SeqID_57299
aatgccgaaatgtcttgtttccgccgattttgacgtctttcttgaagccatttattaaaatagatcaaaaaatttttaccttaaaaacgatttcaactgccatattcgtgatcagtatggattcatttttaggcacaaaaaatcgcgataggcacaataaaaaggcagaaaaaatcgcattctgaatctatttcgaccaattccggattcggaaaatccaatctcgaaaacttattcttattcagaaaatttttgtcattctgtttgttgcaattttcaaaaaatgtaatgcggattcctcttgatcccgctcaaacctacgatattaattttttagatattagatactttttatccattttcacataaatactctcttacttcaaaatg

SEQ ID NO: 112924 - DNA, 729 bp, Heterodera glycines
  Promoter: Source sequence=SeqID_5483; Location=1..729; Strand=+; Gene= SeqID_58206
attggcaatcgcttttgccaaaagtcggcttttatcctactcactaatcccttattccaacattgtccaacttttcccccctcccatttccttttttctttttcccaaagtttgcttttctctctttcaatcgctgcgcttttcttttgccgcttttagacacgaaaagtcattttcggccatcgcttaatctcgcctcacttcttcgcctcatccgtcatcgtcatcattccctttttaaaattgtccttcatttatcgttgttcatccttcgcaacaaacatttggcacttattttaatcattatccatccatcatttatcagtaattatttaaaccgttgcctatcaattggcacttttccatttgtctgatgaactttttttgttgtgctgctgaaatgctgtgcatcttctaattttgggtgtcgtcatttgtcatttttttactccttttgcaattttcgattttccacttaattgggctcattatgtgctttttcatgccaatttatgtggtttttcatgccaattaaattcaaataaagcaacaatccccataattttgctttctctcgcgcacaaatccgcaattagcattctttgagaagaccctcggctaatttgttccccatgctgcgcttaattagtgaagaaattgtgccgcattgtctgaagcaatcattttgacccggacgaaatttggcattggcactcacttttgagtatg

SEQ ID NO: 112925 - DNA, 718 bp, Heterodera glycines
  Promoter: Source sequence=SeqID_38378; Location=1..718; Strand=+; Gene=SeqID_67208
ccaatttgaagtcggtcccttccattccttcgtccgacgactcgccgtttgtttaatcgagaaaatagacggaaattttgtcgatttttgtcgtttatggaccaaatttctacaaattttgcgtcatcattgggagtacaatttgaacttgccaaagtcagtctcgccgattcctcctttaggtatttactttgcttttgagttgtcagttttgacactgatgaaaggccccaattgtcgtgctgtctcctgcaccaaaaactccaaatgattaacttttgcatttcggtgaagaaacgaaagcacaaagaaatggaagcgaacgaaacggagaatttgggcggaagtgccaaagatttgccagcaaatcgaaacactgcgggtaaattcggtgagattagtgggaaaaccgaccgaagacagaccgatttttaattgcatcttgttaaattgggagtgaatttacattatcattttggttcgttgaaattactctcttaagacgacgagtttttcgatgcgattgaatcattcgatcaatttgacgtcgccacttcgtcggagtgccctcgggggagaagccttccactcgattcgaatgaatttttaaagagcaatccaaaccaacgaatttttgttccttttactcaggtggtcattaattgtaagtaaattcgctgaatattaccgcaaagccctttaggaggagggcccaatg

SEQ ID NO: 112926 - DNA, 66 bp, Heterodera glycines
  Promoter: Source sequence=SeqID_21985; Location=820..885; Strand=-; Gene=SeqID_52616
agtaattttagcagctcataaatgaatatgtcttcaaattccaggtacattgaccaaaatgtgatg

SEQ ID NO: 112927 - DNA, 110 bp, Heterodera glycines; identical to SEQ ID NO: 98226
  Promoter: Source sequence=SeqID_18586; Location=264..373; Strand=-; Gene=SeqID_83220

SEQ ID NO: 112928 - DNA, 767 bp, Heterodera glycines
  Promoter: Source sequence=SeqID_29708; Location=1..767; Strand=+; Gene=SeqID_60179
gaaaagcgatgcgcaacaccgaaacgcttgtgttgccaatagtggaaaatgaaccggaggagcaggaactgcttgtaaaagcaacgtcagaaaaaccatttatcttttccccggaattttggtttagcccgcgttggcaaaggctgttgacgatttcccaatgacttgtgccattttggtgcgccggcacggacttttcgtttggggaccgaattggcaaaaaaccaaagtgatgctggaatgtgttgaatatttgttggaaatatgctgggagatgagaagaaatggaatgtgatgttcaattgtttaaacggattacaatttgtttatttgattcacaaaaaaaatcaaaacattaggttttattttattaggtatttctcatttttctttcattttccatagttaataaaatttggtatccgacttgcctatgttggacaccgcgattcaattttgggctcccagtgcaaataagtttattatttatttagtaatcagaacgccaaaactttgcaaaacttaaaattttcttgggattttcccttgtaaaaatggaagagccgatctcgagttaaaaactagacagctaaaaaataaactgtgattcgatagagggtcaaaatatgggcctatgcaaatttcaaagaaaatcacaactgtagaaaaaaaaattcaactggcaaagttttttctttttctctcattttgacgcactatttccattagatttattttctttaattagttagctaaaattctcaatg

SEQ ID NO: 112929 - DNA, 718 bp, Heterodera glycines
  misc_feature (94)..(94): n is a, c, g, or t
  misc_feature (176)..(176): n is a, c, g, or t
  Promoter: Source sequence=SeqID_10641; Location=4154..4871; Strand=-; Gene=SeqID_73882
atttgtatcagttgcagaattgaggcgatggttggcggagaaagttttttccttttgtttggcgggtgccatttagaaaaaatattttgtaatntagtagcctaaataaaggaaattttttaaaaaattaaaacaaaaattgggcgtaaagaataaatgaatcgcaaaattccatnttttctgtcaattatgtattatgatgatttagaattttcggatggaaaggaagtgctctctgttttcaatttatttattcaattagaatccccggcgggggttttgtttcaacctcatttttttccaaaaaatggcgatttttttaaacttttcgtcaaaaaattgtaaattcatctgtcttttagtcattactccttatttttaatcttttacgaatgacggacgagcggaactcatcagcatcattaatgaagtcaggaagcaattcaaattttacgcaaaatcatttaaaattttcgggtgaaaattttctttttttacaaactgaaggccattggtcgattttaatacatttataaagagagagaaacagcaaagatttaaggaaatatatctccattttttcaattccattttcatgactataaaagtgtttgctttttctatttgcctctcattatcaaaaacatttccaacgcaattaatcgtctctttgtgacatccttcataatacgcaaattgtgccaattgccgcaaaatg

SEQ ID NO: 112930 - DNA, 296 bp, Heterodera glycines
  Promoter: Source sequence=SeqID_8947; Location=2200..2495; Strand=-; Gene=SeqID_69768
ccttgtcaggaagaaagcaaatttgaatttttaagtaaaatttttaattaactttgagggctattaagtaaatgtatttgtaaaaaatttgattttttgttcgaataaagttttggccattcaccgaacggggtcccgattttcgacccctgattaaatatggcttagggatcgaacaaattgggaaatgttatcggagagaaaattcacaaaattttcttaatccaatttgaaatactcgaattttatttttgaaaatttaattccgagagacctggccgttgcgcaacaaaatg

SEQ ID NO: 112931 - DNA, 178 bp, Heterodera glycines
  Promoter: Source sequence=SeqID_5698; Location=1522..1699; Strand=-; Gene=SeqID_58949
agtatgcaaaaacaactgctgaatgatcattgctctgaattaattgtataaaacgaattatagtttcaaaagctctaaacaaccaaaaaatggggccaaagatgggaagggaatggacggactgtctaaacaattaataagtcagtgatttaattaattgttgcaattaattgaaatg

SEQ ID NO: 112932 - DNA, 195 bp, Heterodera glycines
  Promoter: Source sequence=SeqID_28027; Location=648..842; Strand=+; Gene=SeqID_58687
ggtgaagctgatttatttgcaaatgcaaataaaaaagctatcaaaaaacggtcagaatttataaataaactcaacgactttgccagcatagaaatttggacgcagaaaaaaataaggtgatagataaatttttaaaaaattgctaattgattaattataattttatatgattaggttgccaatgaatgcaaaatg

SEQ ID NO: 112933 - DNA, 1003 bp, Heterodera glycines
  Promoter: Source sequence=SeqID_8833; Location=2..1004; Strand=+; Gene=SeqID_69358
gccattttatgagaaagtaaaaataaaaatttctcacttctataaatattattaaaatttgccaaataatcttattttcttttaaacaaaactaaatttaacaaaattattatccaatagaatcaaaaacaatctattcaactgcatcatcatcacttgcaaccgtcatgatcaagtgaattagaaaatcctagcaagtttattggtagaaatgaaaaattatttaatgcaaaatttagaaataacaaaataattgtaatgaataaaactaattctttaattttaaatataaacaacaaataaaagatacagcaatgatttttaaaagatggaaaaacttttgcttttttatttaatagataaaaaagttattttaaaaatttacaaataagatatgaaattatttataaaatatattatacattgaagctataaacataaatgcaaaagaaagtggggggtctgagtgaaaaattagtgatgaaaattggagttaaagggaaaaaattaagaaataatcataaatatattctttcaaagaaacaataccaatgtgcaaatggcctagtggctagtctccttgacttttcccttcttctttcccctggttcaatccctctacacaaattaaaatattttaaattttctttttgtataatcatgtgatttatgtttaatgtaattttttgattttaatggaaaaatatttaaaaagctcatttggcaaaaatggctaaaattttacaatagaaccttggggtgatctacacccacacaccaagcttcatttggaaattccacggtcacttgccgacccttcctttgtcagaattgaacttttaaaaaaatttcaaagattacatttattttaatatcttttttttatcaatatcttcttataattaattttaattaatataatttttgttttaaaaagctcattttatttttaaaaaggagagaatcgaattttgtactttgaattcaaaaaatttatgaaatg

SEQ ID NO: 112934 - DNA, 284 bp, Heterodera glycines
  Promoter: Source sequence=SeqID_12161; Location=613..896; Strand=+; Gene=SeqID_75733
gggaaccgacgaagaaaatcttggaattttcacacaagtctgaaattgtgagttggctgttttctttgctaattgttcattatttgttggattaggatgtgtcggtgctccccggcggttatttaaccaaagttcgcattgcctgctgcattttgcgctttctgaccgatgaacagatgaggacaatgttcaacattagcatagaccaattttagtaagtcatcatcggcactgaattccattataatttacgtaactcttttagcggaaatttcgtcactatg

SEQ ID NO: 112935 - DNA, 1003 bp, Heterodera glycines
  Promoter: Source sequence=SeqID_7290; Location=3268..4270; Strand=-; Gene=SeqID_64370
gtccagcctctctttgggacttgggtttctactagttttccagcacatcctcccccccccccccgggggaggggggagggcaaatcgttaatccctccctcccccatccacccctcccactcatcaatgaatgtgtttgacacatttttgacctttttgacacgaatatcacaattgataaatactcccctccccctcccctcttttgatggcaaataataattataatttgtttatttgctttctcgacgacccaatctcaaatctcgacgcacagcagttgcaaacaaattttgtccaattcaagacatggcttgatgatggtcatagttcttcctaaccccaactttgacaccagttcattcccatcttagcccccaattctcggcacaaatttttgattttttgacattctcaaggcattttcacggcgatgccattctccccaaggattctctcctccatttatggcattttgtttgagaatggaggactaaaatagtgccgtggatgagattggttggtctttgctctcgtcgtttattttcgctgtccgtccgtccgttcgatgagtgaaaataaagatgaaaatgaatcccatttttaattcctctcccattttccattgccccccagggaattaacggacggatttattattttattattattattagtttgcggtccaccgattttggaaagtccaaaaatggcgcccccccccccggcacggcggacggacaaaagattagccatcggcggaaaagcgacgcgacgccctccgccgccaattgttggccttttttagtgttcccacgggaattcacgcactcacacaaagcacaaatacagcaatttattttgttggggattgaattggatgcgaaacgaacgaaaatggaataaaaaatggggaaaaatattaaaaaattgaaaataaatgtaaaacattaattttcaaaaataatttaaaatggttttaagggggaaaaaactgcaaatg

SEQ ID NO: 112936 - DNA, 89 bp, Heterodera glycines
  Promoter: Source sequence=SeqID_21190; Location=201..289; Strand=+; Gene=SeqID_51779
ggtccgtcggactttgaaaatttggccgaaatgcgttggctttagactcggcccattggcacaacgaatggggccaattgagggaaatg

SEQ ID NO: 112937 - DNA, 513 bp, Heterodera glycines
  Promoter: Source sequence=SeqID_9712; Location=2485..2997; Strand=+; Gene=SeqID_72453
tgggttactaatcgtggtaattggtgtataattgatggaataaaggtgctaagaatggcttagctaaaatttcgagatgaataaaaattacaattaacgggcacataaatgtcggtgaaatgaggaacaaaaatccaactaaatttgtatggaattataagagtgcaatctaatttaaaattaaagtcttaattaaaaataatcacctgtattaattgcttaacacatacaggccacattaaatcaattattgtaaattaattaattaaatttaaattaattactgaatatattagtaaaaatgaacattagttaatgtgttttttatgacgttgtttgacgcttataaaatgaaaaaattcttagtattaattaagtcaattagctatgagctaaaaaataattatattaaattttgcagccttattggcaacggattaggtcatttttatgccctcattagaggcatttaggtaaatattaaacctttcttacagagaaaaaaaatacatg

SEQ ID NO: 112938 - DNA, 282 bp, Heterodera glycines
  Promoter: Source sequence=SeqID_23061; Location=335..616; Strand=-; Gene=SeqID_53765
tctaaaataaaatcattttttgttctaattttatgatttatttgttttctgttgactaaatagtcgcttcttatagcaaatattaatttatatttgcgtagcttcaaatgagcattctgccttcaatttcgaagggaactgaatttttttataataaattgatagagagcaaaaagcacaattgtataatattcaaaaaatttatctatgcatttgttgaatgttcctaaacccgatcaaattttttaaacctttatatgaaaacatttattgcaggaaatg

SEQ ID NO: 112939 - DNA, 697 bp, Heterodera glycines
  Promoter: Source sequence=SeqID_14836; Location=597..1293; Strand=-; Gene=SeqID_78986
tcttaaaaagggggggggaatacgagaaaatcaggaaaattcattgaaaattggaaaactttcataaaaacagtatttttagaagtgccaaatggctcggttgtgcattaatttgcaacaattagggaaaatctgctgaccaatcgcgtcatttttacgatgtgtctttggcaattccgcgcctcctcaaaatttccctaaatttacccggagccccgacatttgtgcctgttggaaatgttaaattggcgttttgacctttttaattattttcatatttgtactttgttctccacgccctttccccccttctcattgtgtttataaggagaccattcccctcctttttggactcttccctcattcattcgtttttattattatttgcatttgtccaccgaccgatcaataaatatttttattctttgtgtgttcaattggaggaacacaacaaattggcgcagtcagcagccatcttctctactgaagacactgcaattcatcgaaaaccaatagcacccaggtggtgtgaggtctgctaatatagcagttcaattcaactaaaaaccaaaagacacaattgtggtgaggttccgcaatacgcggttttatcttcaaatcttcaaaaatccttaacactcagcaagtgtagggagccaccaggtgtggttatttggatttcaacaatttggcaatg

SEQ ID NO: 112940 - DNA, 734 bp, Heterodera glycines
  Promoter: Source sequence=SeqID_2170; Location=383..1116; Strand=+; Gene=SeqID_78247
ttgcgctaaacaaaattaattttaaggcaggtggagcaaaaaaagtgtaaattacaaattgacaaattaaatttttcgttaaaaaattcctattccagacggatttccgttaaaattgacaggatcgggaatcctttttccgttcgctttttctttattcccgtttccgtaaattttttaccgggctctattttaataaaaataaattggcattttgtttcatataattctgttggtggttgagctgacactaatgattggatcagcccatttaagttctcaattcgtttcacttcattcactttagcattcacattcgtccttttcaaaatcttcttctctcagtattcttattattaaattttttttgtactgtcggtggtaggctccttttgaattttttttttttgttttcaaaagacatcctagggttttcggggtcgttcgaaaatttgaattttcgaacttttgttcgaattcaggtccggggttcgaaattggtcgaaatagatgccagattcgtgacagcggccccgaaaaccctaggaagcttaacaaaaaaaatttaaaaaaaaggggggggggtaccatcgacagtattaccgaaatgcctattgtaagtttatcaatctttatttggcctcatttgatcagaggcccaggcatacaaaaaaaaatccgatacaaaagtggcatttaatcatagtaatattctagttatattcagatatatg

SEQ ID NO: 112941 - DNA, 147 bp, Heterodera glycines
  Promoter: Source sequence=SeqID_5161; Location=1..147; Strand=+; Gene= SeqID_57111
aaaataaataatatatatttagtccctttttcatagtaatcaaagttgtaaataactgcctaataaaatatagtaaatcttattgtaaaatgctgttaaggtatttatttgctatagaattcgtaattaatgattatttaaattatg

SEQ ID NO: 112942 - DNA, 189 bp, Heterodera glycines
  Promoter: Source sequence=SeqID_40627; Location=1..189; Strand=+; Gene=SeqID_68898
tccataaaccatggtaaaatttgatttaatccattttactttcaaaattaatttatttatacgaatgttttgccattgaccccaaaaatgccgaatttgagcggaacattccccccaaataattaatcattttttgttgttttcagtgaccatttgctgtccaaacatctccaatccgatgtcccaatg

SEQ ID NO: 112943 - DNA, 262 bp, Heterodera glycines
  Promoter: Source sequence=SeqID_35001; Location=1..262; Strand=+; Gene=SeqID_64667
ttttggtttggttttagctttagttatttttaatttacttttttggcttattttttcaattaagctattaaaacacaattaattttatttgcatttttgtttatttgaaaaataatcaataaataatggtttatttttcaaataattatttaaattatatatataatattttctttgcttttaaaaatttcaatttgtaaaataataatttttccaattttttattaccaatttttcggcccaatttcagcacattgccatg

SEQ ID NO: 112944 - DNA, 340 bp, Heterodera glycines
  Promoter: Source sequence=SeqID_480; Location=8698..9037; Strand=+; Gene=SeqID_53920
atttttcaccattactgacactgtggccctctcttttgccggtgtgtctcgtgccatgtcattatttcccctttttgctcattgttatgtttacacttatttctttaccaatccgacgtgtcattttgctatccgtttttcatgccctgtgataattttttgtattattgtattttgttcgccttattattgtacacttttttcactttgtgttaataaatccaagtcatttaatgtaaaccttaacaatcaatggttttttcccccttagaatatttaattttttttatgactattatcaacaatactgtgtccatttagggttacatcgctggcaatg

SEQ ID NO: 112945 - DNA, 325 bp, Heterodera glycines
  Promoter: Source sequence=SeqID_18766; Location=818..1142; Strand=-; Gene=SeqID_83445
aaatttacttttaattcgatttttttctggtccttttgtggcgattttcactgagactcagtgcggatcacgctcggacttcttccgtagcccgtagtctcgccacacctactggccgccgtagtcgagtgtgcggcggttttctagcgcaattgaaaaatcttttacacatcctataaaattctaaaattctcatcgccatgaacaatcgcaggagcatcaacgacaacgagcggtagtggcaccgacagcaactggagcagtagtacaacaaaaagctgagcgcttgccaaccggtgaagccgagggtggtggtggcacaatg

SEQ ID NO: 112946 - DNA, 945 bp, Heterodera glycines
  Promoter: Source sequence=SeqID_8662; Location=722..1666; Strand=+; Gene=SeqID_68802
tctctaaaaaattgagatttttaaaaattaaaaaattcatttggttttattaaaagcataaaagaatcttagtaaatattttaataatccttttttaattacggaagtttttaaaaaatatattttgttaaatcataggcagaagaaatatttattttattttcatttacataataaaaatttggataaacatttctttttatgtaaatatgaaaaaataaatttgccaataatttggcattttatcattgaaaaagaccatcatcagaagagtagaaaaattttaaaaaatcaatttaaagttgatcagtcaaattccttcttcactttataaaaaatattttttccccatttttgttcgttagaaaatcataaaaatcaaaaaaattaaaattggcactgacgaatttaaaaaatgtcattaattgatagttagaaaactattaatgtaatctattgaatgatagcataaagtattattaatttggttgaattttagcaaagttatgaaattatgtgttttacattttttgtttgttttcctaccccttgtccggtttaagaaacgcccttagtgggcggaatttaagaaaaggcctctagcaccatagttctaagccttcaggtgctatgacgttactcaaaaaaccattaaaataaagtattttttgataagtaaatttattgaaaacaaccttcaaactcactggttcttaatttattccggcccaatcctgatgatttcaaatttgatgcctggaggtgtataaaaatacggaaaactcataaatgccgaacagatttatttggatacgaaattgaggaagcccccgaccatattctccttcctacaactttcgaagactgtaatcaaatggcaacttacaaaaaatgtgaatttggtattttttatcaggggaaattggtcaaaaacatacaaatatg

SEQ ID NO: 112947 - DNA, 330 bp, Heterodera glycines
  Promoter: Source sequence=SeqID_28988; Location=420..749; Strand=-; Gene=SeqID_46142
tcacaaaaatacaactgttattggttcaaacgccgcggacgcggcaaacataaaaagcgatcactccaaattctcattctttttataggaatataaaacgccataaagtaaaaaaagaataaaaattgctgaacccatttaggctaactgctaaccaatgtaatgataacgtgaatcattccgctttggtgtcagtattcactgcatataattttgaaatgcctaaagctttgtttttgattttttattacctacctaattgtttttaaaagatatttcatcatttaaattgcagcattttaatttcttccgacaaaaagacaaaaaatg

SEQ ID NO: 112948 - DNA, 1003 bp, Heterodera glycines
  Promoter: Source sequence=SeqID_14297; Location=541..1543; Strand=+; Gene=SeqID_78323
tttcctcccttctctctatttctctgcattgcttgtctctttttttctctcttctctttctctatatttctttgtctttctcgtcaatttctctgtcttgctttgctctcgttcttttctttgttttctttctctgagtttctctgtcttattttcctttaaaaatttctttgtttcttttcctctgttctctttcgtctatttctctgtcttgctttgctctctttcttttctctattttctttctctgaatttctctgtcttcttcttgtcaatttctctatcttgcattgctctcttttttttctctgagtttctctgtcttattttccttaaaatttctttgtttcttttcttctgttctctctttcttgtctatttctctgctttgtttctttttcttttccctcttctctttctcctacgccattttataaaatgtgctttggttggtgttttgttgtgaataaaacaaatatcaaactgaaaaagcagtagcagcagaagaactgacagacacatgcacaaaccctttcttttttgacaccgatttttattattttaaaaatatttatttatttttattattatccataaatacactaacccaaagaagtcttgcctcaaacatataaaattgttcaatgcttaatactagggctataattagatagaaatgctattttgagcccctttcttcatagcatatgcgcagaaaaatatgcaaaagcatagaatttatagtcctaattattacataataaaagtcagaattatcgttgtaaatattttagatgtctttttcaaatacccaaaagaagaattcccatattttttttaatgactgagttttggattccgaattgaatgatttgtaaaaagttacgcgcaaaaagtctttcgcaaaattaaaataattcatgcttactttctgtattatatgtatttttttttttgtcattttagcacaattttgtttaacaataaattttttgaaaaaatg

SEQ ID NO: 112949 - DNA, 177 bp, Heterodera glycines
  Promoter: Source sequence=SeqID_1491; Location=3653..3829; Strand=-; Gene=SeqID_73908
tggcaggagaatgaaattggaatgaggttgaaaaattttacttttatatgcgcaaaagtgtggccacgcctacacacaccatttgaaaacagtcacggttttagacacgcccactaaaagccaaaacattttgcctgccaaaaacccagaatcattttaccaatttttgtcaaaatg

SEQ ID NO: 112950 - DNA, 264 bp, Heterodera glycines
  Promoter: Source sequence=SeqID_10091; Location=1023..1286; Strand=+; Gene=SeqID_73157
gctaattagtagggatgggtgtaatttatagaaatgtatttttaaaaagaaaatttaaatattttaatttttcataaacataaatctcatcctaagtgattagcatacgaaatggcattttaattatattcacaaaaataaaaattgtattttttatttggatgtcggaatacatacatacatatatttataatttacaaaccataaatttatttaaattattgccattgaattgaaagcaaaatttgaggctgctcaacgatg

SEQ ID NO: 112951 - DNA, 527 bp, Heterodera glycines
  Promoter: Source sequence=SeqID_21792; Location=957..1483; Strand=-; Gene=SeqID_52404
ttttatttttgttcatttccgatgtgtttttcgttgctttttgggttttctaaatttactttaaaatttgttaattcacattttggtccaaccaaattttcacgttactttttctgttttagggcccggatttctcgtaggaaatttgcgtcagctaattaatttgatgatttttttgaaacgggttactaaggtttgttaattttaaaatatgtaggaaggatgaatgaggagcaaaaagctaagatgtctgcccattctgcgcttatttattcagaaaaagagagagaattcaaatccgggccctaaaacagataccattttctcaactcagaaatggctatcattatcaattattgaacttggcatccttttgattgtatttttacagttaaataccgtatcccatttctaccctaccatattttctggggccgattttgttgttttttctagacaaaattgattgtgacttcaactagttcaaaaaccgtattttgcttttgccccctcactatacattaatg

SEQ ID NO: 112952 - DNA, 828 bp, Heterodera glycines
  Promoter: Source sequence=SeqID_10957; Location=1..828; Strand=+; Gene=SeqID_74262
aggcttggaaatctcgctaagatttgttcgataattattcctaaaatgggaaaataattttaggaatcaaaggcccaacgctaataaaatattcccatttttttaggggaggcgaaagccaacaaaaatgaatgaatatgtaatgattgttcagattccgttttcccacacaacaattttggatggcaaataaagtaaaatggcaataattaatttgcataaataataaatgtttttgtcggtgctcgagagtcgagattctgtgggtgccgcaagtttatcgccggaagcgaagggtcaggggagaaaatggtgaaaaaattatgtcaagaattacatttggactcaaatttgtgtccattaaattttctaatttaaaaataaaatcttattctatcattatcatcaattttgaaagtttgcgggaaattaatttaaatttgctgggattttgttaataaatttgctcaaatgcggcaaaaaattgccataatttttctcaaaagtaaagcaaattcatcattcgacagctcgggaatggatatgtcaaatgaaaagtgcaaaaaaatagtttcaagaataattttccgtaaattttccaattatttaccttcaaaaacaaaaataattttcaataaattttcaaattttttaccatttcttcttcaaaatttccaaaaatttctcccttggttttttgaaatgctaaattttagtcaattggagacgaaatttccaaaaaaaaaaatagactctacaaaattttacgatttcctccgttttcctttttttgaatccctccattacatttaacttaccatcgccatg

SEQ ID NO: 112953 - DNA, 289 bp, Heterodera glycines
  Promoter: Source sequence=SeqID_7637; Location=165..453; Strand=+; Gene=SeqID_65488
tttgggcttaatccttttcaaataaacaattttcaccggaaaaatttccaaaaattagccaacaaatatgccatggacaaatggcactttgttaatttagtcgctgtgagtgaatccccgcctctgaaaatggctttttcggcttagtcatccgctctttcattctttcgatgctgcgttctcatctcttttctcatggcttttctgatactaataaagcttcatttcttcagcaaaaaaaaaaacttttccaattttccctcaaattttctttcgaattcaaaaaatg

SEQ ID NO: 112954 - DNA, 221 bp, Heterodera glycines
  Promoter: Source sequence=SeqID_20059; Location=1111..1331; Strand=-; Gene=SeqID_84843
tgttggtcagttgaatgttttcttcattcctaagaaatgtatttagagaaaagaggaagttgaaagcggttgccttcaagcagaacgttttgagtcgtttcttgacactgaagaactttttgcccaagtcgctgaagaagagaatttggcaagcacattttacaataaatgtttgtatttcaattgtaaacattttcagcagcacacggcagttttgcatg

SEQ ID NO: 112955 - DNA, 126 bp, Heterodera glycines; identical to SEQ ID NO: 103918
  Promoter: Source sequence=SeqID_27298; Location=309..434; Strand=-; Gene=SeqID_57978

SEQ ID NO: 112956 - DNA, 72 bp, Heterodera glycines
  Promoter: Source sequence=SeqID_13173; Location=2382..2453; Strand=-; Gene=SeqID_76997
tttttctctctcggcgctgtcgtcccaacaaattttccctgggaggaaaagcaccgataaaacactgaaatg

SEQ ID NO: 112957 - DNA, 173 bp, Heterodera glycines
  Promoter: Source sequence=SeqID_3418; Location=1475..1647; Strand=-; Gene=SeqID_84613
tctcaagagtgggcaattttcgtttggacggatggattgagtcagaacaaaaagggctagaaatacatggatgtgtatggcatgcttgctcaaagtgttatccggatgatagtgaagtaatgccttgtggcaaaaccgcagcccgaatccgagagcggaataaactaaggatg

SEQ ID NO: 112958 - DNA, 449 bp, Heterodera glycines
  Promoter: Source sequence=SeqID_17788; Location=1..449; Strand=+; Gene=SeqID_82325
gactgctgcggttttggcgctgctggtgcggctgctgctggtggtgcattctgacaaaagatgttcggatccacacggcccagcgtctcaatacttcggatgatgttctgaaatgggacagaggacacgaattatttggttggaccttctgcaagctgaacctgttgctcttactcggaacgaattgcgatccccccagcctttgcctgctgcggattaggatctgaaaaaatgaatttggttagaatatttgctgaccatgaaccactgggccattttttcgtgcttttttgggttttttgtgactttggcgattttttatgacctttttagtcgattttttgaagatttctagtgacttaaattcaccgccctatcattttccagaaaaccgaccagttgctcacgttcaacaacagcgccattctcaacaacatcgcaccaaaatg

SEQ ID NO: 112959 - DNA, 901 bp, Heterodera glycines
  misc_feature (83)..(83): n is a, c, g, or t
  Promoter: Source sequence=SeqID_8033; Location=1..901; Strand=+; Gene= SeqID_66764
caaattgcagcggtcgcgaatcgcggatcgaggaaaaaaatgtcgcgaatcgcggatcacgcatcgcaatcgcggtcgcgtcncagcgctggtgcgcaattgcagcccattctctgccaaactccgcaggaggaaacaccgaaaatcaatggaattgcttcgcttggggacgccaccccaaaaaacgaagccaaaaaatattcttttctaaaaaaatactctcacaacgaaaaaatgtagatttaacacactgttttcgcgacggtctacacctgactgcttaacggttccccctgaactgctaggcccagctgactaaattcggcaccaatccctcagacgcctagttttttaagggtaattttaatagagttttcgcattgtcatatctttatgaacaatagtttatgcctttttaattttcttctttatttgaatacatttttttaattttgaacgattgttttttaaattttagcattttgcttttttgtcctttttattatttacaagtcttttgttaatatattacttaaactaatgcatttttataatcttctcaatttcgtttctttttatgttctacaacctttaacttttccatttattcatgtaaatggagtaaaacttgttgatatttattagaattcgccttgttcgattttttgcctttaatttttattatgcgtttttttctttcgatgttttatctccgtcatttcattgtatcacattttcacggtctttgtgttttttttttcaagttcctctcactccgtttttcggagaatcctctacagataccacataatcctctagattttttttgattatctttttcatcattttgttaatttttgatcattattctccaatataggtggtgctttatgataaaatg

SEQ ID NO: 112960 - DNA, 204 bp, Heterodera glycines
  Promoter: Source sequence=SeqID_42701; Location=941..1144; Strand=-; Gene=SeqID_70526
gaacaatccccaaaaaataaatttaattacaagactgggcgtaattacggattacggaaattttcccagtaattacggattacgggttacggatttttgcaatttttgtgtaattttatcccgtaactatgtagaactttggattatttttcgagacgatttccagccctgtttgattaagaatttggacttttggatgaaatg

SEQ ID NO: 112961 - DNA, 1003 bp, Heterodera glycines
  Promoter: Source sequence=SeqID_2137; Location=2416..3418; Strand=-; Gene=SeqID_78034
tgaactttttctaatgtttttgataaattttccaaaatctttttaacatttttataatgagaaggcaaaattgggtaattaatttcctggctgttataaagcaatacgccgagcagggacatgccctgctctatacctagaaaatttttaaaaaatatataaaaatttgttgaaaaatattttttggccattccccgaccggggccaagcccacgatccccgacaattttgcgatcaccgaatccgatccatgaggattttagtggaaaaattagtgacatacaaaggacatttcaatcaacctatttgaatattggttttttattgttacttaattttaatttttttaatttaattaacaaaattagcaaaatttccaattttctgtcgtcggcagctccgtcagacctatgattcttgataatttttagaattacacaagattttgtaattttaagtctttttttttgcaaaaaatgaatggaaacacaaataaaacgttttctagaataaattttcaaattagagttttcagggtcgctgctcactattataacatttattttggcactgatttcatctgttcataaatttgacttaattccatgcatttcaaaaatatataaaattaaaataatgaaacgaatcagtaagcaggtggacataaatgcaattaattttataaaaccgatcaaattcatttaaatttagttgaatctttgatcagatgacatcaaatagaacaaaaatgaaaaacccccttaattccttaattattgtttatctcgtattaattactccccaattcgttgagaaaagcaaaatataaataaattgaattattattaaaatgttgtagcatattgatgatataatgaataaacgtggttgataattgattgaatatataatttagccagtcttaaaattaataattacaaattcattgggaaataaacattttttatgaaaattattctttatttttttacaaaacatcatg

SEQ ID NO: 112962 - DNA, 114 bp, Heterodera glycines
  Promoter: Source sequence=SeqID_6340; Location=180..293; Strand=+; Gene=SeqID_61191
tttgcccgaattgaaagttggccgagcgcaacagcagcaaagcgcggccggcgcatcggccggcggcgatggtaagggaaaaaagtgggagagagggaggaggacgaggagatg

SEQ ID NO: 112963 - DNA, 557 bp, Heterodera glycines
  Promoter: Source sequence=SeqID_20268; Location=673..1229; Strand=-; Gene=SeqID_85074
tttattaatagcaaacaatttgataaaatatttttaaatgattttgttgttttaccctgggcaaaagtaaaaatttggtttttattttcgtttccatggcaatcaaagaatttaaaagtgtttttaaaaagtgaatttgaaaacaaaatgataaaaattgttaaaatgaaaatttttcacaattaaaataattttattagaattttaattaataaatatttttttattctttaaccattcattttctcacattctttttttggagaaaacggaaatcgatatcatgttttgcaacgttttcacatgtcccaggctcaagtaacccgcaaattggtatgctgatcacggaatgcaattcactttatgagtaattacgtaattaaacaagtttatatgtcctaattaattagttaattaatatagaaaacaaatggagaaaaatatttattataactttttattttatgccttttttgctgtgttagaaaatcaataagcttgttatttgttaattgctctaaatttgtcgggaaatgtcgcgcgaagtgaacaaaatg

SEQ ID NO: 112964 - DNA, 242 bp, Heterodera glycines
  Promoter: Source sequence=SeqID_28265; Location=1459..1700; Strand=-; Gene=SeqID_58899
ttttatcgctcatgaaatcgccagtcccccccccccctttgttgtgcacagcgtcggttgctggcagccgacaacacaatcttttctttgttgggtatacggcgttggttcgcccctcctccaccctccccgctatttgccttttcgtttttaattctgcgcagcgatcatatattgtgattcgatattttttgggatttttacccgttttaaatgcttacaaatattttatttagaatatg

SEQ ID NO: 112965 - DNA, 478 bp, Heterodera glycines
  Promoter: Source sequence=SeqID_33963; Location=1..478; Strand=+; Gene=SeqID_63884
ctgtttgccgtcatggtcctcaaattggatccaggagaaagactttgttggcccggatgttggccaaagcagtgcgggaaatggtggccgaaggcaatcgctaatcaaaaattttgtagaaaaaaattttggtggtttttcaaagaaatggctaaaggaagagcagcagcgaacagagcccaaaaataaatgtttaacaataaaaaatactagcaataataatagcaataaaagtcgccgatcgctgcttcaaatgctccccattaaataattgatcatctgaacccattcattcatcatttgtgcgtatgtgaaatgttagccaaaattaaactttagaaaacccaagaaaggaaactcggaaattcggaaacgaaatcggaaattatataaacacaaaattgttataatttcttcaactggcataaatatgtttttaaattcgaattcaaatgtgtgtgcgtccacattaaaaatg

SEQ ID NO: 112966 - DNA, 147 bp, Heterodera glycines
  Promoter: Source sequence=SeqID_44492; Location=1..147; Strand=+; Gene=SeqID_71976
aatagatattccagaaaaatggctatctcttctttcgagaaattttctatgcagcacacgctctcgaacatgaaacgaagtgcggtgctccatgcccattttatcgttcaaataatttttatatataatagatattccagaaaaatg

SEQ ID NO: 112967 - DNA, 828 bp, Heterodera glycines
  Promoter: Source sequence=SeqID_25257; Location=619..1446; Strand=-; Gene=SeqID_56006
tattaatgtgagcaaatttattttgtattaatttataattatttgtatttctcataaatggaaagttattttattttaataattattgtaaataattgagttgcattctttaattaattatttgcaaacaaattaattaatataaattttattttatacaaaaaaattgcatcaaatgtttctaatttttttttaattctcttccttttcgttcttccaaggtcggggacattttaatctttgttcttacaaatttttatcgtatgaaaactttaaattattaataattaaatcaattttataacaaaataatataaattgtacaaatttataatgttcattaaataaattaattaaatatttacatttaatatttaagcattttacaaaatgattttttagtttcttataatttatttatgaaaattttagatacaagtaatttaatttgttttatttaattaattattgcgcataaaaaaaattgattagattgtgagctttaattcaatcgtaggcaatcgttttttattttcataaaaaaatatataataatttttattattttttttatttcaaaattgaaataaactttaatataaaataattgttttattatattgatcttaataaattatttaactttaaataactacatgaataaataattaaatgcggaagaaagatgcacgagtttttacacatctctgcttcgttaaatttttcttcgtcctcgtattcgttgcgagataatatatttcatattatttaatataagaaaaattaagtaaatataattcatctctagcatcattggccacacacatg

SEQ ID NO: 112968 - DNA, 77 bp, Heterodera glycines
  Promoter: Source sequence=SeqID_3866; Location=2759..2835; Strand=-; Gene=SeqID_52214
tctttgtcaccgattttgcgataaagcacttaattcgtgctcttgaaaaccctgaaatttcggtgggattggaaatg

SEQ ID NO: 112969 - DNA, 221 bp, Heterodera glycines
  misc_feature (9)..(9): n is a, c, g, or t
  Promoter: Source sequence=SeqID_43668; Location=1..221; Strand=+; Gene=SeqID_71290
tcaaaaaanagtcttgacatcaaaaattaaaatggaaatacattggcaatttcttaattttattttgaaaaatataaaaattaagacattctttttcttccaccaaaattcatgtccttgaaaacaatgatttccacatgtccttgaaagtcccaaattaacaataatccctttagcaattagaacaaattaattttttcttttttttccaaaaaataatg

SEQ ID NO: 112970 - DNA, 402 bp, Heterodera glycines
  Promoter: Source sequence=SeqID_2531; Location=3166..3567; Strand=+; Gene=SeqID_80225
ggtaaaaacccacgcgcaaattggcaaaaaaaaaaagaaaacatcatgcgtacccagcaaattgccctacggcattttgtatgccgaatgcatgccaaaaacataaaaaatggggggcgggggaggaaaagccggggccaaaaccaaatccgatccgtctcattttcattgtgcgcgccaatgccttggggcataaaaaagtgcatcatccgcccaccgccccctttaattgcttatgaattcagctggaaaaagcagcaaaaaatggtgggcggagggggcggacaatggtagctaacaataagggaggtgcttcttcttcttctgcgcgggaagtgtgccgttcagcagcaggtggccgccccttcaattgcacaggagtgatgggtttggcacaaaatg

SEQ ID NO: 112971 - DNA, 1003 bp, Heterodera glycines
  Promoter: Source sequence=SeqID_13386; Location=237..1239; Strand=+; Gene=SeqID_77267
gtgaaacaattgaatggctgtggaataagagacgattggactttaataggtattgcaattaacttaattaagttagatttgtacgagaaaatttaatgaactcttgtttttaatttgattctcaagaattaaaatgcatggaatgattgcttcctcaaaaaaaaaaaaaaaatttgaaagcaaaaattccgctgaatcttgaattttctcgtcctaaaagtttagtaaattaaaaagtgatagctaatttacaatttttattaaattttgaagagctgaaagtgaccgaaccaatgaaaaaactacccaaaaaaagggagcacaatcaccgaattgcttaacatcaattggttctttcaattaattttccttcatacataaatgtataaatttctaccaaattattatttttttgcatgggattaacagaaatatgagaacggaaaaacgggacaggagataaaaagataggtagtttgaatatggaacgaacttttctctgaagtgatctgtaagtgatctctctcaaaaatggcagttatttaaaatcgtcaaaattgaccaaatccaaataagtaattgtatttttaaatgtggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcaagatttggacattttgtgggtcagcggttacatttcgtccaacctgaccctatttcaccactcatttttctcatatatttatttgtttactgcttttgacttacctacacttactctttttagcttcaaatttttgtggaatgacctgattttttttgttttgtgtttcgaaattcactaccactttcattcaccagaaaatg

SEQ ID NO: 112972 - DNA, 241 bp, Heterodera glycines
  Promoter: Source sequence=SeqID_7247; Location=3526..3766; Strand=-; Gene=SeqID_64247
aaacaggataataaaaagttaaaaagatagtttgcaaccggaaattttggctgacagacagatgagtataaagttttaacaattttaataggctctcagaacctttggggcaccctgcatttttactgacataactcttaaaatatatagaaaatgtttacagaagtaaaattttagcgttttttggaatggcgtaacagaagaacaaagaatatttgaatatgccaaagaattgcctatg

SEQ ID NO: 112973 - DNA, 58 bp, Heterodera glycines
  Promoter: Source sequence=SeqID_5017; Location=2744..2801; Strand=-; Gene=SeqID_56579
tgcttcccaaaaagggaaacacggccaaattggtgcacacgccgctgacggacaaatg

SEQ ID NO: 112974 - DNA, 310 bp, Heterodera glycines
  Promoter: Source sequence=SeqID_14613; Location=1308..1617; Strand=+; Gene=SeqID_78696
ttttttagggttccaagttttaaatttttgggggttttagccgcattataaattgaaaaaaagagaaagtaatgggatttagttaagaaacaagtttaatttttgcaataatgaaattcgggcggggcatttttaggagccaagaataattaatgcatttttaattcaatttttttttggggggttttccgactgattttgaaatgtctaaaatagtgattttttttagcttcttttgactcctattggaacccatttacacatttaacttcctccaaatccgctttttaatgcaattttttagaaaatg

SEQ ID NO: 112975 - DNA, 237 bp, Heterodera glycines
  Promoter: Source sequence=SeqID_7034; Location=438..674; Strand=+; Gene=SeqID_63639
agaaattttctatgcaacaaacgctctcgaacatgaaacgaagtgcggtgcgccgtggccattttatttttcaaataatttttaaatttaatagatattccagaaaaatggctatctcttttttttgagaaattttctatgcaacaaacgctctcgaacatgaaacgaagtgcggtgcgccgtggccattttatttttcaaataatttttaaatttaatagatattccagaaaaatg

SEQ ID NO: 112976 - DNA, 802 bp, Heterodera glycines
  Promoter: Source sequence=SeqID_20736; Location=994..1795; Strand=-; Gene=SeqID_51303
ttccattgcataacgaaaaaggaagaagccacaagcaaatacgaaacaccagtcagcagaatggcaaatggttgttgtgagtagaaatgaatttggcctaatgaatagaacgtttaaatacccaaaaatgtccatttttgacacaaaaattctgtcaacgcaactgaaagtgacggaaattctggacttaaaattcagacggatttgattgttttctctgtgatttgcgtggattttaacaaattcatttttgtccatatttcattatgtttcttccatttttgggcatttgcaaaattcgaaaattgtctctttttccatgtttaaaatattaaaaatttgttatatatctttctcttgatattaaatattttaattttattatttatttttgttttcgtgaaagttactatttttcgcttttagtcacaaaaattaaagaactaaattttttgtccatattgtcaagtttaccaaattcaaacacttctgcctgtatttttaattttttgtccgtgatccgggcctaataataactagggtttcgtttttgggtgcgctacgtttcacccacccccgagaattaaaaaagctcagataagcacgaaaaacgcgttttccgcttgatttaggatgtctatgattttttatttgcctatttttgtgcctattaatgtctattttgcgattttaggcataagtatttcaattctatctaactaattaacaaaggaattttataacgaaagaaaagaaatgtttaacgaaatttgttttaaatgtattttccgcataagtgatg

SEQ ID NO: 112977 - DNA, 173 bp, Heterodera glycines
  Promoter: Source sequence=SeqID_4890; Location=4025..4197; Strand=+; Gene=SeqID_56105
ttttgacaaaaattgttaaaatgattttgtgtttttggcagacaaactgttttggcttttagtgggcgtgtctaaaaccgtgactcttttcaaatggtgtaggcgtggccacacttttacgcatataaaagtgaaattcttcaacctcatcccactttcattctcctgccatg

SEQ ID NO: 112978 - DNA, 407 bp, Heterodera glycines
  Promoter: Source sequence=SeqID_3169; Location=856..1262; Strand=-; Gene=SeqID_83504
cccccccccccccccccccccccccctgtatgatttcccccctccgccggcaatgtgacattattttattttgtcactttacgattatttctcaccgttcactaatgagatcacatttatccttttgcgtcagccttttaattggatttatttatgattaatataattaattaaaaagcaataaatataaaaaatgtgtgcataaatgctttttataaagataaatcctcaatcgatttgttcatagaattatcactcttaacgaacaatgaaaactgataatataaacacttccatttgctattgacaaattattaggaaaatctcaatgaagaattaataaatataaaattgactgaatctaaattttttaaaattttgccaatattctcagataaagtttcatg

SEQ ID NO: 112979 - DNA, 155 bp, Heterodera glycines
  Promoter: Source sequence=SeqID_19072; Location=1847..2001; Strand=+; Gene=SeqID_83815
tttatgtcccaggccccggttttttcggtgccctttttcatggaattctgggaaaaagttcaaatccaattttttgagacgaagagaaatctttcatcagagtccgatccaaaatcatattagctttcgagaacataatagcctttctcaaaatg

SEQ ID NO: 112980 - DNA, 1003 bp, Heterodera glycines
  Promoter: Source sequence=SeqID_11591; Location=909..1911; Strand=+; Gene=SeqID_75039
taaccacacaaaaatacgttttattttggtctatagacccacctcccatgaaaaacaagaagatttcgaaaaattggtcgaacaactctctgttttagtctcggcttctgaaaaatgcattagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataatttcaaaaaagcaaattatttgaaaataaatgccatactctcaatggttgattggaatttatttttttctgattgcccggacatagagcttatttaccaaaaatttatgtttttcctaaataatttgataaggaattatgttcccatacaaacaacgaaaaaagttgaaaaactaccagaacatattttgaaactaatcatctatcgtaaacagctttggaaggatattcacaaagaccatataaaaataaaattcttagaagtttcgaaaaaatcgatgtagaaataaagaaattttataaaaatcgcgaaaataagtttttgcggaccttggactctaaaaaacgtttccaatttataaattctttccttaagactaaaaatactatgatacctgcatttactgataaaaatagtctgattctcttctcagataaggaaaagtcgaatgcattagcgcaacaatttttttccgtttttacagatcaaaatctagaacaatttcaatgcatagaaaatcctgaaaaaaatatcgaatattttaacataactccatatgaaatttatttttctctttccaaactttcaaattctaacaatagtaatggaattcccaatatttttttgaaaaattgtaaagaaaatttagtccgacctcttttccatatttttagtttctcattgatg

SEQ ID NO: 112981 - DNA, 174 bp, Heterodera glycines
  Promoter: Source sequence=SeqID_14685; Location=662..835; Strand=-; Gene=SeqID_78796
ttgtcggataaatcccacctgtaaaattattaaaatttaaattttacaaaaatcaaaacttaaattttaaattttactgtcgaaatgcgaaagttttacggaaaagtaactttttatattacacttaattagtttttaagattaccacttgttgatgaagcaattcaaaaaatg

SEQ ID NO: 112982 - DNA, 930 bp, Heterodera glycines
  Promoter: Source sequence=SeqID_21327; Location=932..1861; Strand=-; Gene=SeqID_45638
tctttttggagtaaaaaagattttttcaatcttttactccccatcaatccaacacctaaaacagaaaaccttgccaattgaccattctttcatttacgaaaaaataaattgttccatcgttttttttataaattgtcataaagcatttttactgttgagaaaaatttcgattcccaaatttaaaataaaaaaatgaataaattttcgcatttttgttgattcttttaaatgttggcgtgcaaggaatgcatcggaataaattccaataatttgttaaaaatcaaaatttttgacatttgtcaaatccgggatcgcagccgcacaaaaggcttatgaaaagatggggtaaaaatggtggtacgattgaagattaaaaacgcatggataaaagccgaagttctggggaatgatagtatttcgcgagttgcgatgcggtgcacgctttattttatttgaattaaaaatttttacaacgaatacattttattgaattttcctactgtataattttttatcgtccggtgattcattttcatcagcgtttttggtttcgtaatcacgttaagtggaagtcctatgagcgttatttgcctattttcccctgttattggcttcaataaacctacaaaattagaatttaaacagtttatttagggtatatttctctttcatcttattctatctaaaaaatacaaaaaaaaaatcgacaaaattataaaacaacaaaaaaattgacaaaacaacaaaaaactacctaaaaaacacacatccaactttgttcctcgcgtttctctctgataaaagggtttggtttttctttttgttttaataaagttattcgaattaatccgtcataatcgtttgtttcttccttgttttcgttttcttctctaccaacattttcacactttaagaaaataaaagaaaatg

SEQ ID NO: 112983 - DNA, 334 bp, Heterodera glycines
  Promoter: Source sequence=SeqID_43703; Location=662..995; Strand=-; Gene=SeqID_71312
aataaagggcataggttattttgaagatgtgtcaaagacatgcagcaaataagcctgcataatctaaataagtggaaaatacatgagtatagaatttattttcagaaagtgtcaacagacttttggaaaaatatatttgcaatttatcaacaattttgagaagtgagttagaaatgataatcttcacgattcaaaccaattttcgttgctctaattaaccgcgataaaaacatccgaatcaattaaatagcttctgagataataaggtttatcataaaatttcttttaaaaataaaccctcaattattggtatgaacgctactttccaaacatg

SEQ ID NO: 112984 - DNA, 58 bp, Heterodera glycines
  Promoter: Source sequence=SeqID_1387; Location=555..612; Strand=+; Gene=SeqID_73206
ggttaacaaattggcgttggtttgtaacaaattattctatttgtaataggccattatg

SEQ ID NO: 112985 - DNA, 526 bp, Heterodera glycines
  Promoter: Source sequence=SeqID_10862; Location=1..526; Strand=+; Gene=SeqID_74141
ttttattatatatttttacatatttcattattttattcatatttggtacatattttggacttttttcttacattttttcattttttacatattttgaggatttttttatgaaaaatttttggaaaccctcaaaaaaagccaaaatttcggtaactttttcgttcatatttttatttttttaaatgtaccgctaaaaatcagtaaaaaaagaaatatcgaaaatttatttttaaaaactaaaatgtgattctaagcctatttaggtcaattttatgcaaatttatgcctatttcatcctttacgaggaattttttttccaaaaaataaccatttttaaacttttatttacatattttagtacatatttctgggtttttgcacatgtttatgtacatattttggccagtttttgtacatatttttgacacccattattaattaattttaatttctaattaccaccatatacaataatatcccttttaagctgaaattcagcgtctatgcatttgaaaattctatgatg

SEQ ID NO: 112986 - DNA, 849 bp, Heterodera glycines
  Promoter: Source sequence=SeqID_2792; Location=1..849; Strand=+; Gene= SeqID_81622
tgcaggcctttgttggatttttttttttgcaatggaccatgcattttaacttagtcacattcacatcatttctttcactttttattcgctgaatttttatttttattttttaaatttccatttttgtttctaaataattaattaattaatcattttgccaatttggcttttacttccaaaaatgggttgatttgttacatttgcaatttgttcccaatcacgaacattgttccatcaaatttccaaaattggctgcccaattagtcattcggaacatccatgcaatccccggatttccatgccgggccccgtcacggcatcggctgacttcccctccccccgaggggcccttcccaaatttggccaactcgtcgccccatttgtcctccccatttctcggaatgcctttggccaattcccgcgggaaaaagttctgtggtcgaataaaatgagactaataataggcgcagagcttacaacaaatgcattttggaaacaaatacaaataaaaaattaatattaaaaaataaatttgcactttaaaattcttcgattaatttggacattctaaaaaatattttcctttttaattataaatttcaaaaaagtatttttttttaatttgtcttatttttgttccttttcttcgtcaccttccgctgacaaatctctgccgaatgcgaatagcaaaaaaaagagaagctttctctcgcgcggtataatttggcgcattttgctccatttttcctttccccgccggccccccgggtccaattaatccttcccccccattttccccgtggcacatttttccgtttgttaatcggtttccgctctctgtgacaaatg

SEQ ID NO: 112987 - DNA, 433 bp, Heterodera glycines
  Promoter: Source sequence=SeqID_2082; Location=1785..2217; Strand=-; Gene=SeqID_77759
atccttttgttgattataagacattctaggcggattttcgttggattacttcaaaaacagagatctatataaagaaaataagtgatttgaccgtggttaatatcatcgtcagtgattttcgacagggactaattataatacaggctcaatgttcttaggttacttttcatagttgagtacttattttctacaaaaattggcttcagcacctataatattagtatgtagattttatttagctcttagcagaagaaacataaatatttaaatggctctttcctttctaagacattctccagtgtgacgacatcgtcagtgaattagtacttatagaaattccacggctccgtctccgcgggagatcggagtgcaatgattcatcagtcccttcgaagacaccgtcaagagtccactgccccacgagttggaaatg

SEQ ID NO: 112988 - DNA, 578 bp, Heterodera glycines
  Promoter: Source sequence=SeqID_13504; Location=1199..1776; Strand=-; Gene=SeqID_77401
ccgaaattcaagaccgagccaagcccaaggattcaagaccttcaaatgccccgaaattttatttaaaagggtccagagattcaaaacgaagccatatgccccgggatataggtgaatacttagcgcaggtttacattaagaccttgccacgagattcagtgtttcaagactacggtcgacgtacaacaaattgggaataattcatagggttaggtaaacataaaaaatatacgggacgggattctgttcagtgcgggaatcgtgtaagaaatcccgcgtgaaatcgaacccaagaaaattgagacttttctcgcgtcgagaacgggactctcgaagagatggaatgatgctgttgacaatgacgatgataatgatggtaatagtgccaaaatggaagtgatacggtcattaggtaggaaatgtcaatgccaattctctaattgcggacgtcatctaatgagaaaattggttgtgattggttggttaattttggcaaatgaatgggcccatggcatcacaaagaactgggcggcgtgtgaattttgtaaattaataaaataattatgttgaaggtaatg

SEQ ID NO: 112989 - DNA, 175 bp, Heterodera glycines
  Promoter: Source sequence=SeqID_5838; Location=357..531; Strand=-; Gene=SeqID_59405
agtacgaaaataatttatatgaattttaaataattaatttgacgtataattttgagtaattgcaaaataataataatgtcaataataatggacagatacacttttataggcttaaaattccgatttaagaatgggcaattagtcattttaaaacattttttaggcttattaaatg

SEQ ID NO: 112990 - DNA, 317 bp, Heterodera glycines
  Promoter: Source sequence=SeqID_4349; Location=629..945; Strand=-; Gene=SeqID_54131
gcagggaagaggacgatggaggaggcaggagcggaattaatgagagggaaaaggaaggggaggacggaagaggaggaaggagggggatgaatagcagggaagaggaagacggaagaggaagaaggggcggaatgaatagcagggaagaggacgatggaggaagggcgcggaacgtggacaaagcccaaagaagggtcagaaaaagaagtgcggagacggtattggacttggaacagagaacagacgcagaaaagtcaaacaattctctgtaagacaatcacagtattaatttaagctttgaaagttacttaagaatg

SEQ ID NO: 112991 - DNA, 431 bp, Heterodera glycines
  Promoter: Source sequence=SeqID_9773; Location=1..431; Strand=+; Gene= SeqID_72647
gaaacacgaagaccatttacagattttctgacgacgagctttttttctttttttggcctattacactctatgaaatcctatattttcgatattattttcggcatcattcgaaaacactaagaaaaatatataagtttgaacctgaaaaaagtatcgtctaaaaaacgcataatattatagcattgaaattataaattttgagtgaactcataaaatgtaaaataattttttgctgttctcaacaactcatcgagactcggtcgagaaactgtcctattcattcggtgcaaagaaaataattcgagtggttcgaccaacagccacttttctggacttttatccaatcatttggcttacattgtctttttttttattcctattaaatataaatttgttatttttatattagaaaatgcattttctattaaatg

SEQ ID NO: 112992 - DNA, 590 bp, Heterodera glycines
  Promoter: Source sequence=SeqID_24419; Location=1..590; Strand=+; Gene=SeqID_55145
gtctggctctacccaaccactcacacgattatttgaaatgctacggaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacattttccttctctagtctggctctaccaaacactcacacgatatttgaaatgctaacgaaaaaaattcttgcccaaaaaatg

SEQ ID NO: 112993 - DNA, 352 bp, Heterodera glycines
  Promoter: Source sequence=SeqID_38389; Location=251..602; Strand=-; Gene=SeqID_67216
tcagtttcaaaatgcatttacggtaattatttttaaaaaattcaaagttccgggattttatgagtccattttaagaaattcgaattattttagagtaaattaaggtgtaaaaacaaaaaattaaaaaaaatgttttatattttatttgataaaatatttttgggaaaccaagtaaagaaatatacaaaaaattagtacatgtttaaacttttacaaaaattgtcaattattatttaaaaatttatattttaccccttaaaatcataatggtaaaagccagtataaaattaattttaaaaaacttcaatacattttaaaaaaattttaaatatattacagattccatacaatg

SEQ ID NO: 112994 - DNA, 389 bp, Heterodera glycines
  misc_feature (48)..(48): n is a, c, g, or t
  Promoter: Source sequence=SeqID_42802; Location=1..389; Strand=+; Gene=SeqID_70606
cctagaaatgtgttataagaattttcagaaatttaaatcaataatttncgggaccaaaatgatctaggcgattgcccaaatttgataaagttatttttattttatatatattttttaatatggccccaatttgccgtgaaaatttgcgttcgaccaatttttttttctcccttttttccgaattgtttgatcagcagatttgcacagatccttctctatcccctgctcaaacatttttccccgatgtagagaccggcggacgggctcgggcaaaattttgaaagaaaaaaaaattacagggtccgactcgcactttttaggcatggatccggccggcatttcctaaaattccaggcctccaatttcacccatttgtatttgcagatatg

SEQ ID NO: 112995 - DNA, 1003 bp, Heterodera glycines
  Promoter: Source sequence=SeqID_7877; Location=477..1479; Strand=-; Gene=SeqID_66252
tcaaaaattccaagagtttctcagcctttgacccattggttttcaattctttgcaaaaacattttcgaaagaaaatttttggcgctatattaaagaaaaactcaaaatgttaatatttaatgtgacggaatggaaaattttaattttttggaaaaaatcaattatgctatatttttaaactaaataattttttctaaaattcaaaattgaaaaatttagacactagaatagcgagtttatgaatttttttcggacgtctgaggacatcagcttaaaattggcattgttgtaattctgggttcgtatgattcctcaaaattcttgacatctcaagacatcagttttccgatttccaaatcaaggcaaatctaaaaaatgagtcattactgcaatgccgatttgcatgtcctaattttttattttgtcctgatttagaaatattcaatcgtgtatcctgagatgtccggaatttcgaggaatcattgccaattttggcatgtcccaatattttaaattcgtcctgatttagaaatattcaatcgtgtatcctgagatgtccggaatttcgaggaatcattgccaattttggcatgtcccaatgttttaaacttgtcctgatttggaaatggcattattgggttctaagatgtcctcagttttgatgatcatgagaatttggtccttaaaaatttgtttaaaaggcaaatgaaaactaagacattcattcactctatccataaatttttttattacaaaatatcatcaaataagcagtttttaaatgaatgtttcatattgcaattgcaatcacttaaaaatctcaaattaaaaattgccacgaaaggcctttgaccctctgattttcaattcttttggtatttggtaagacaaacctccgcttaggcctcccaaaatttttggcgcttcctttacatttttttgtcttcttgtccccgattatgctctgatatttataaaacaataatattccaggaaaattatg

SEQ ID NO: 112996 - DNA, 178 bp, Heterodera glycines
  Promoter: Source sequence=SeqID_23521; Location=1087..1264; Strand=-; Gene=SeqID_54213
ccgaaccgatgcgcccagatttatgggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 112997 - DNA, 133 bp, Heterodera glycines
  Promoter: Source sequence=SeqID_13660; Location=1054..1186; Strand=+; Gene=SeqID_77567
ggtttggaattagggataaatttgccagatgccactaatgagtcaaatagcgatgatgaattttgtttagaccctgataaattagaaaatcagttaaatcgcagtggaggaaacaaataaagttttggaaatg

SEQ ID NO: 112998 - DNA, 690 bp, Heterodera glycines
  Promoter: Source sequence=SeqID_9345; Location=655..1344; Strand=-; Gene=SeqID_71067
attgaaggctttaaatgcttaagaaaatttcgataatatttagtttatatagatgaaaacatgtatattactggggttataaattgaaatgttacggcaaaataaagaccactgattctgaaagatcaatcataattcattcgaatacttgagtattaaaaatcatttaatacttttaaaatattgagataaataattaaaatatatgaaaattccaaaacccattcttataaaatcttattgatgaattatgtaagattagttctcaatataatttattaaagataaaatatttattatcattttcatatgaattcacaacttaattaatagatattttcgtcaaaacaaaactattataatttttttaattgaattaatataaaaataattgttctattcgttcaaatatttaaatacatgagatcaaatttaaaataattgttttgaaaatttatattttaagcgtttccgaatgaagaatgcaaatcctaatagctaaaagcatatttaaaaaagtggtttgcttgataaaaccctatgttgattaattgaattataaactgttttcgaaataaatataaaacaaaatacatatataaaaaattataggtatgactgtataaagaatctggagaaatatgatataataaaaagtttatttaatgggactcaaagtaaaacaaaatg

SEQ ID NO: 112999 - DNA, 178 bp, Heterodera glycines
  Promoter: Source sequence=SeqID_27542; Location=528..705; Strand=-; Gene=SeqID_58247
tttcaatggcacgcttaaagggttaaaaaccgaataatgaaaagtgaaatggaaacagagaaaaaattggagaattaattaattaacttttacaatttgaaaataaattaagcattaaaaacaaaatttatttgtttaaaaaaataacaattttcagagcaaacgaccactgaaaatg

SEQ ID NO: 113000 - DNA, 199 bp, Heterodera glycines
  Promoter: Source sequence=SeqID_21646; Location=237..435; Strand=-; Gene=SeqID_52245
taattcaaatccgagacacaaatggaaaaatactaaactgaaaaagcttgcttgattctaaaccttttttcaaaaagcaattgcctttttaacttttcataatgaatttaaatcacagaccgatacaccaaaatatagtatccgaatgattaaatttttacatatttaattttgcaggtatcattaatttttccaaatg

SEQ ID NO: 113001 - DNA, 390 bp, Heterodera glycines
  Promoter: Source sequence=SeqID_21373; Location=1698..2087; Strand=+; Gene=SeqID_51981
tctgcaaacaattataattaacctttaattactctaaaaataaaaatatacaaaaaattcaaatataaaattcaacggttaaaaacataaatttgcatgcgcaatataagtttgttctaaaacaattttattaaagatatgtttggcaccacattcttttagtcgatgtatcgcctcgattcaattcccttttgcataaattgcaacgaacatacattcttcgactgtaaaggttttcaaaaaagctccaacctttagaatttagggtcagggttcgggggttttaaattttccatatttaaaaaaatttatcaagcaaaaaatttaaaaaagtcatttgttaacagaatttcaccaaaaactgccaaatttttgcgatttttagccatg

SEQ ID NO: 113002 - DNA, 266 bp, Heterodera glycines
  Promoter: Source sequence=SeqID_28827; Location=145..410; Strand=-; Gene=SeqID_59410
tatttaagaattaaatctaaaaaataatttttgaggatttttcacttaattttgcagaagaattttttggggtcgattttcaagggtgaattatttttattgcatttttaaataaactttaaaaacgccaaaatatagttttcaaaattttttttaaagtttttaggcttcaaaataaaaatctagaaaacaggcgctaataactgaaaaagtaacattataattttactttgttgcgtttccatcacatattgacacaaaaaatg

SEQ ID NO: 113003 - DNA, 611 bp, Heterodera glycines
  Promoter: Source sequence=SeqID_1656; Location=6346..6956; Strand=-; Gene=SeqID_75110
agctgaagcattggttatgtgtagggaagcaacttttagtgaagaaaaatcccaaaatagtaaactaaaatagtgacgaaaaagtgccaaaataaagaagaaatagtgacaaaaagtccgaaatagtgatggatagtgacataattcttagccaaaaattaagtaaaaataatttttattcactagttgcagttgcaaatgaggtacatttccattaaactatttccttagcaaatactgaacatttttaaatcaaaatttgtcaagaaaaaaaaaatgtggtaagaatttttgagggaattttcatttcataggagtgtattttttaaaaattttcggtagattcttaggggcgtatttttgaaatttttggggtcaattcttatgggtgtattttccgttgagattgccatcttttgaaatatttgtgctcgcatttttttgtttcgttctgtccgctgagaagtgatttttatgccatatttgcatggggagaaaaatgatttggacatttattacttggcacagcctatttttgttaaataatacattcttaattgacaaactatcttggtatatactattcattcctcacaaaatattcacaaatg

SEQ ID NO: 113004 - DNA, 63 bp, Heterodera glycines
  Promoter: Source sequence=SeqID_73; Location=9149..9211; Strand=-; Gene=SeqID_62114
ctggcacaattctcttctcccgtttttgtcatttctttacgaattatgaatatatagaaaatg

SEQ ID NO: 113005 - DNA, 533 bp, Heterodera glycines
  Promoter: Source sequence=SeqID_8274; Location=3280..3812; Strand=-; Gene=SeqID_67521
tttcactttttgtaaaaatttgcatttttataaaattgaactttttgttccaagtctcatttgtttaattctgacaaaatgacgaatttacataattgccatttggcggtttcccgaaggattcgatctccccaaaaatctgggcgcatcggttcatggggactgcccgaagaaccaaaaaaaataaaaatcatttttttcaattgtctatttggggtactcaaacatttatggggagcaaaaacccataataacgcaaattgaaatttgaaaggtgtaattaattattctcacggcacgcaaagtcaatgagacaagaaaatgtgggaaggaaaattaaaattcacgataagttaaaattttagtcacaaaaaggaaatgtaaattagtttgaatttcaaaagttaaccaattttagcgaaacattacgacagaaaaccctaaacttccaactcaatttgttctttcagcaaattaatttaattttgctttattaaattaccctttttgttgactttaattttgtgccaatg

SEQ ID NO: 113006 - DNA, 75 bp, Heterodera glycines
  Promoter: Source sequence=SeqID_5781; Location=1473..1547; Strand=-; Gene=SeqID_59197
ttttcagacttaataaacataaaattataataatgaacttttcttaaaccaaaacaatgaaaacatcaaattatg

SEQ ID NO: 113007 - DNA, 64 bp, Heterodera glycines
  Promoter: Source sequence=SeqID_2497; Location=1..64; Strand=+; Gene =SeqID_80075
actctggggggcgcgaaggaagcgccttacggatcaagacaggtgtattaattgcctcattatg

SEQ ID NO: 113008 - DNA, 539 bp, Heterodera glycines
  Promoter: Source sequence=SeqID_5553; Location=3894..4432; Strand=+; Gene=SeqID_58436
atttatttaataaaaaaaatttgcgttaatcaattcttttgaaatatcaatttttgctttgggtgtagcccacttggcaaagtaggctacaacccgaattcgaacaaaatgtctaaaaatggtggtgaacgcataaacaacagacaattgatgtgaatttgtgtgaaaccgttagcgcgcaaataaattatcaattcactattcattcaaccattatcatatatatgtatttaaattaacgaataaacaagtaaaatttaaatatcctgtgatacctgaaagtgccggtgccattggaaaaatattgagtgtattatatcggtttcttaagtggttgtttatgtgcatttaatttttgatcattttgagtcaattctgtatctgaaaatttcaccaaaatttcaaaaattcccccggcagcgccacaacatttatttcaaaaaattaataaacactagataccggagattttaaatttgcggcatttgaactcaaaattttctgtgggacggaaccgcctaatctcccacttaaaaatg

SEQ ID NO: 113009 - DNA, 299 bp, Heterodera glycines
  Promoter: Source sequence=SeqID_25829; Location=539..837; Strand=-; Gene=SeqID_56596
tccatctattaacattttgttctttactttttaactaatacttagaatcaataataatattatttaatttgatgttaaaggtcagcagcatccatttaaaataaattctcagaataaattaattgaattagcgatggccgacgatgaaatatttgaataaatcggttaattggccccagggtgaccatctcttttgtgagaaaaatggcgcgcagacataaaattacggcaaaaatatgcgcaggcactaaatatggcatttttaaaacccttttaaatgcagccattatacatatatg

SEQ ID NO: 113010 - DNA, 368 bp, Heterodera glycines
  Promoter: Source sequence=SeqID_3653; Location=1504..1871; Strand=-; Gene=SeqID_51297
tagcagcaaattagactttgctgccctaaatttgggtgatcaatttgtaattgtaatatgctgaaattagtaaaggaagaatccggggagattttcgagttttattttcgtcggagatttggtgaagaaaaattaaattgacaaatgccacaacaaattaaagtcaatttagcaccaaaaagtgccaactgaacaaagtgtgaagcatgacaaagtgttcccttgccattaagaaattgctgggctaaaagtgacagaaaaacgcatcctattccaaacttttcaattggtttaacattttaaaattatcgcaaatttttagtgaaaaaataaaaaatatttttggtcatttcgttttcttagaaatg

SEQ ID NO: 113011 - DNA, 1003 bp, Heterodera glycines
  Promoter: Source sequence=SeqID_12043; Location=1214..2216; Strand=+; Gene=SeqID_75575
ttcatatatattttcattttttttacatattttgagtattttttacggaaatttttggaaatcctcaaaaaaaaatccaaaatttcggcaaatatttttgtacatattttcgtttttttacatattttgaaaatttataaagaaaaaataagtttgaaaatgttgcctaaaaataccaaaaaaaagtaatttttagtcattttgtgttgtgggggaccctatcttttgtcaatttcatttttttaaattgataaattaatttattatttaaaacggagtaatttgttaagccagaaaaaaaaattcggagttcttctcggtttatttccttttttgttcgggttaaatttggacaaataatgatgatgttgtattttcttttgaagactgaaaattctttcggctttgtgattacatgccgagaagaaggactggtattatatatgtatatgttgctgcccctcttgtatttttacccttggacagttcagtgccaaagatatttggccatttcagtcacggttctgtaattcttcagggattcgttgccgcaaaaattctagggttcttttattacaaaatgagagacaccgattgttatgtattttatcgggtttttggacctgggctatgaatgatattttgcttattatgttagtgtttttccttgtaaaaaatcatttttaacgtccatttaaaattgcttaaagacattaacatgtgaacacaaaatccatattgcattttgcaatagctaaaatgcccgtctttttggtttccatcacccctccaccggccaatcttcggcagcaattagcgctgtcagcaatgaaattttaattccttttctaaacaaccaatttaatttcccaaaaaattcacattttattgccaaaaaatttacccaaaaattcatattttatgccaaaatctccttttttaattgagaagaaattatcggtgtctttttacgctgtcggattttttgaaggtgctcaggatg

SEQ ID NO: 113012 - DNA, 341 bp, Heterodera glycines
  Promoter: Source sequence=SeqID_27714; Location=1..341; Strand=+; Gene=SeqID_58380
gcacggatcgagccggggataagaccattggaaagagcagctcgagctttacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 113013 - DNA, 462 bp, Heterodera glycines
  Promoter: Source sequence=SeqID_10438; Location=466..927; Strand=-; Gene=SeqID_73637
aaatccgttccctattgatgaacaagggcacattatttttcggaatgaacaaaaatgtattttattggctgatgtttttcaaaagtcatttttgtacaatgacttactcagccatgaaaaccctaatcagatcacagacattgaatttaatgtctataatatttggaatttattgaaaaaactccctagaagaaattcgacatcgcctgatggcatcccttacttatccctgtcttcaaaaaaggagagacagataatcccataaattatcgccccatttcactaacttgtactttatgcagggtaatggaaaaaataataaagctagaaatacttaaatttttgaataaaaatcaattttttagtccatttcagtttggattcctgagacaaagatatttattctgattgtgtcgccaattaattgtcaaaacggcagtgtgctaattgcagcaaaaaatg

SEQ ID NO: 113014 - DNA, 907 bp, Heterodera glycines
  Promoter: Source sequence=SeqID_21804; Location=1283..2189; Strand=-; Gene=SeqID_52431
ggaaagtggtatccgtttctctgggaaaaatcgttaaaaaatcctaaaattcaaaaacccgaaaaccgttttttaggcctagctcgaaaaattttcaaaattttcgaaattttaaaacttggttggatagcctttcaaatactacacatttttgctcagaaacaatttttcggtcaaagcaacccctggcgagttattcgcctggtactgaagtgtacattttgagcacacttcaattagccaagcgtgcaggccagggggtggctctaataaaaaaataaaaaataccagcatgtagaggacagttgtggggagtgccctcacagcgggcactttttaattcgggttttagaaaaaaagttaggggccttcaaacgcaagaaaaagtgagaaatcggtccccgggactcagtcgtccgcgctgaatttttttctatagttttcccggattctcctcaaaaagttgtaagacccttccaccagtttcagacccgtcccattagccgttaagctcaaattagtttttgaaacgaaactccttgtcaatataacgtatatactagcgggtgcgtgaaccgtcggctatttagctgggaaaaagcgcttcgcgctttgggagcttcgctacctaggctgtgaagcgattcaaattgattgaatttgttggagagatttttttgaatttttaaaaaattattaggggtttttagtccacatcgaggctcaagacgggcgcttcgcgcccgttttttagcttgttaggccgcttcgcggcctcagtcgggcgcttcgcgcccgtttttcaaaatttgttgaccttacagggattagaagaggtaccactgtgattaggagaggtacaacggtgattagaagaggtacaaaagtgattagtagaggtacaatg

SEQ ID NO: 113015 - DNA, 172 bp, Heterodera glycines
  Promoter: Source sequence=SeqID_18696; Location=2532..2703; Strand=-; Gene=SeqID_83364
tttattcgattaattgacgttttatttttttatgactattaaaaatatgcaaagaaaaatttattttttatttatgacgtaaatttattatatttttcgtatgcataatattttagctttattattcatttaattttttttttaatttatttttttagtgccataataaatg

SEQ ID NO: 113016 - DNA, 1003 bp, Heterodera glycines
  Promoter: Source sequence=SeqID_6539; Location=638..1640; Strand=+; Gene=SeqID_61932
cgtttgtttttaaagaatttttgttgttttttaaggcaatgtgccaaacttttttaaaaaatttttctcagtgacgaaatgatcggccacccttattttaactattttgagattttgattttatgacaaaatttaaccaatcacacgttttatgaacaaaattttaaaccaatcaattcatttaaatttgatttaaaaaaataattttgagttatgtaaagagtgaagtgataaaaatatggagttactcgtttttgtgggacagacgttcaggctgaataataacttcaaatgacccatttgattataaatgaagatagatggtgcttcgcgatcttggatcggattcaaaagctaaaatgataaatttcacggttatgtatctcatccactctgttccgatgattgttttccccattattagttttagagctccaaatttcgttaattgaagccttggtgctacctcaaatgggtctgaagattcagacccatgcgctttttgtcgcttcgcccacacccatatttttgtcgcttcgacatagcaccgaataaatcggagggggagactaattggttgacctttataattgatattgagcccataaaaacgaataaaataaaatgacagaatggccatgaattggatggtcgtcaaaaggcgtcgtccgtccgtcttcccttacgcttttcccttcggtttgcttttcgtcgctttccccttcggtttgcttttcgtcgctttccccttcggtttgcttttcgtcgctttccccttcggtttgcttttcgtcgctttccccttcggtttgcttttcgtcgcttttcccttcgcttttcgtccgttgtcccccccccccccccgcttcttcttcgttccttccccttttcttcttccgttcccttcacaatcggcttattgtccctccgtcttcgctttgctcttccctctccttcctttgctgttcattttttatttgcagaaagcgatcctcgcccaatg

SEQ ID NO: 113017 - DNA, 670 bp, Heterodera glycines
  Promoter: Source sequence=SeqID_17198; Location=1..670; Strand=+; Gene=SeqID_81661
ggggggttccattcgaggggggggggggcgtataatcgaagaaatacggtatttagctatttttcttcacattttgtttgatgagaaatgcacgaaaaatacaattttagctcggaaattcataggtattatcgtcacaattgtcacatggagccacaggtgctaggtcgaaggacaaaaagtgcaaaatttgttaaaattttgactaaataaactcataacttttctcatgcgcaaccatattgcaaaatcttggtaatacgatagcactcgaaatgcgttattagcttgctaaatttcagaaaatttattatgtgatctagccaaaaaactggaaaaattgtcataacttttgaaagacttaaaaattttttttttaaatttagcaagctaatatgcaattcaagagctatcgtatgatgccaagattgtgcactttggttgagtctaagaaaagttatgagtggattttgtcaaaaatttggcaaattttgcactttttgtctttcggcccattagattatttttgttcacaattttaatttaatttttatatttttccataaattagaatcgttaatttttaggcaaaaaatccgaaatttaaaaaaaagaaatcttaaaaatttaacatatttctcaatctcgcattgcaaacggaagaaaaatg

SEQ ID NO: 113018 - DNA, 128 bp, Heterodera glycines
  Promoter: Source sequence=SeqID_19785; Location=1..128; Strand=+; Gene=SeqID_47608
aatagttttttttttaatctttttaggttttatgtcttgtgctaaaataacatgcaactttaaatttcaaatttagaacagagtattttttgtgttttatgaattaaagaagcgctgtttagtaaatg

SEQ ID NO: 113019 - DNA, 1003 bp, Heterodera glycines
  Promoter: Source sequence=SeqID_2942; Location=1041..2043; Strand=+; Gene=SeqID_82446
cggattgtttggtgctcattttgccaaaatctccaatttatatttgttgtcagtgtttttctcttagtgatctgttgaaaatttggcgaggtcggcccgtcgattagtaactgaaggaatggttgggtggcgaattgggggaagagtctcgccaaatccattcaattcattcaactctctctcacccattctccacaatcgattagtaataaataattaggaaaaacaaagaataatgaatgatattttaattcattttaataatttatagaaaatattgaaacggttttttttataattgtgggctttttcaaaagtaattatgattatctcaccaccataagctacatacgtttgagaacaaatcatttaaaaattttctcatattattaaatttaaacacattatttaatttataaatttaaaatatttaaagattggactgtttcaaaagctcttcagaagtttcccaaggtctcagtcttcatttttttttaaataatgtcaatcctgcggagaataggattgaattcaggagtttttaccgtaaaaatataaatatatgccagcatcagcagtgataggatcttaatccgactctcaaattctgattcccactttctgacatttcagtgtcgggatcatgtcatttcctaaatttcttacaaccctcgggtctgacaaatgagtgtcgattaccgagtcttttgaggaaaaaaaaactgggaatttggtatatgaaatagccgagaataatatattttaaaataaatttcatacattttctaaagtatgatttttggattggtttcccagaaaatttatgtaatataaatcgatcatgtcgaaatgaaaaataaaggataatcgaaaggatctcagataaaagcgaaaatgcacaatttgccattgacttcaaataaatttggattggagtgattcttttcttttgacttggcgcacaatcacttctttgtttcccatttttattccttttcagatg

SEQ ID NO: 113020 - DNA, 315 bp, Heterodera glycines
  Promoter: Source sequence=SeqID_12696; Location=2021..2335; Strand=-; Gene=SeqID_76378
aggggcgatgatgtatcgtaaatgcattatgttaaaaataattcaaattgataaaccgcattattcaaatgtgttttgagtggtagggaaggggtggttgtacgtgtgggtgtttgtgtgtgtgtgtgtgatcatttgttaactggagcgctcgcgagcggtcacattatgtttgtgtcgcacgcatgtgatcatttggtgactggagtgctcgcgagcgctcaattatgttcagatcacacgcgtgtgatcatttgttgatggccgcccgcatgtgatcatttgttggctgtagccgcgggcggtcacattatg

SEQ ID NO: 113021 - DNA, 224 bp, Heterodera glycines
  misc_feature (18)..(19): n is a, c, g, or t
  Promoter: Source sequence=SeqID_29966; Location=1154..1377; Strand=-; Gene=SeqID_60433
ccctaagaattaaatatnnttgttttgaaaaaaatggtttcaaatagcacccaattgtcctcgcttacaaatacatttttcgttttttattaatttaaaagaaaatttttcaatttttgttgctctaagttgcttaggtatttttgatcaatatttgttacatattttgacattttttctcaaatattatttaaatatttcgagattttttgaaaatataaatg

SEQ ID NO: 113022 - DNA, 969 bp, Heterodera glycines
  misc_feature (47)..(47): n is a, c, g, or t
  misc_feature (52)..(52): n is a, c, g, or t
  misc_feature (75)..(75): n is a, c, g, or t
  misc_feature (77)..(77): n is a, c, g, or t
  misc_feature (84)..(84): n is a, c, g, or t
  misc_feature (86)..(87): n is a, c, g, or t
  misc_feature (112)..(112): n is a, c, g, or t
  misc_feature (114)..(114): n is a, c, g, or t
  misc_feature (129)..(129): n is a, c, g, or t
  Promoter: Source sequence=SeqID_30901; Location=1..969; Strand=+; Gene=SeqID_61274
atgaggtcaaacgaatgattcatctaaggaactgatcatgaattagnctagnataacattaacctttaaaaaaangnaatatanannatattataattgttttctttgtatntnagtaatggataaaantttatattatcttcaaagattttataattccctcttacgaagtgtattataaaaaggttaatttgcattaagaaacattaaatgcggaaacattatcagaataattttgaatttgctttaaaatggtgattttacatgcataatttaaaatatggtgtcatttgataaataattaaacgtttcaaacttttgcatttttacaagtttggaaaagtaccggttaaccctggcatcggttgaaaatccaggtccctgtacggtcaccgcggtaccggtcagtaccggtcccagttaattctaaaaattaccggtcccaactactctagtacaattgcttcagatgataaaaaggacctattatatttctacatttttcattagctcggttggtgagaaaaataaaatgaatgaaaaatggtgtgtttggtcatttcgtaaaaatggcaatttacaggttttgcgtgaaaaagtcatcatgactttgttaaaagaatccaaattatataatattctatcataatttcttggattgggcatttattgctatactatatggaaattttaaaaaatttaagttagtttcaaaaaattgtgtccaaaaatgttgaaaaaattgtcgtaactttttgaaaactgaatgaaattttcatcttctaaagtaatacaaaaatcgaataatataaaatattattaatttgctggcatttaatcctctcttctcgggcccacatttatagttagacatgccaatttaaatttatattatccaactcaagggcccgattatgatgtttgtctttatggcacggatcttttaggatggaaagttatataaaaatg

SEQ ID NO: 113023 - DNA, 280 bp, Heterodera glycines
  Promoter: Source sequence=SeqID_42225; Location=608..887; Strand=-; Gene=SeqID_70172
aaaaattattgttgttttttatgtcaaaaaaagtaattttattttaaatttctcataaaaaatcattaaaattaaattttgtttatttaactaataaaaagaggaattagtataaattaaaaattgtaggatagaataaacaattacaaaagtaaaataatgtaattttctttctggacaatatttctcattttcgaaaattcaattttttattggctttaattaggtgttgaaaccttttttcatacaattatactctgtttttctcaaggatattatg

SEQ ID NO: 113024 - DNA, 184 bp, Heterodera glycines
  Promoter: Source sequence=SeqID_12317; Location=573..756; Strand=-; Gene=SeqID_75913
tttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatg

SEQ ID NO: 113025 - DNA, 367 bp, Heterodera glycines
  Promoter: Source sequence=SeqID_10333; Location=1..367; Strand=+; Gene=SeqID_73516
taaatttagtaaacaaaaaaaataaaacgaacatcaaacaaaagttagcaaaaaatctactcgaaaaaatgcaaaccttttttcagcaaagaaaaactatcaaacattttttagtataaaaaatggttttttaaaattatttatttatattatacattaattaaaatttatttatttttagttgaatttgaacccgaggtctaaaaagacgaatttattaaacaactgagccaccaattaagtgaaaagacagccttaatttactagaaatttaaagtaaataaaaataaaaacttaataaaccatataaataaccatttaaataaattaattaaattgtttagtataggaaattaataatttgatg

SEQ ID NO: 113026 - DNA, 482 bp, Heterodera glycines
  Promoter: Source sequence=SeqID_22879; Location=449..930; Strand=-; Gene=SeqID_53588
ttttcttggctttttctccaatctctgggactcaacccaccagcatttcaatcactggcactcaacccaccaacatttcaatcactgaaaatcaagccaccagcattccaatctctgagactcaattctcaggctttccaatcgtgggactcaacccatcagtatttcaatctctgagactcaaaatctccggcattccaaacactgggactcaacccaccaactttcaatgacattccaatctctgggactcaacccaccagcatttcaatctctgagactcaattctcaggctttccaatcgctgggactcaacccaccagcatttcaatctctgggactcaattctcctgcatttcaatcactggcactcaacccaccaacatttcaatcactgggactcaaatctccggcattccaaacaatgggactcaaatctccggcattccaaacactggcactcaacccaccaactttcaatg

SEQ ID NO: 113027 - DNA, 635 bp, Heterodera glycines
  Promoter: Source sequence=SeqID_45369; Location=293..927; Strand=-; Gene=SeqID_72672
aaaggaatttaaaaaattacatgtaatttattgtcttgtaagatttcattatgaaaaggtagaagagagggacacatacccccaaaacgttgtctaacatatagtaaatataaatttcacaccgttactaaccctcccgccaatcattagctgcgagttatgaaagttagaaaaaaattaaaaaatatgttttttcgcttaattaatttcattcttaaatatttttaatcggaatttgttcattcgctgtccgttcgctcattttctgtgatgataaacagattttgcacacaaaataaacaaatgttgaagcgaaatgagaattggtggaatgtatttgcttccatttgcctcccactttctttttctctgcttaaaaatgatttttgttcttatttgttcgaagattttccggattcgatcccaatttcagtgaaaatgccattggcgagagttgggatttttgtttcggaatggaaatttgtttgattttgcaaagcgccgccgcataaaaattccttttgccggaaagtccgtccgatcctaattatgaaaatccataacaaattttgactttttaaaattcattcgtttcaatgcctatcataaattttgatcggttgcccgccgcaatg

SEQ ID NO: 113028 - DNA, 662 bp, Heterodera glycines
  Promoter: Source sequence=SeqID_8859; Location=1..662; Strand=+; Gene= SeqID_69446
ctatgcattttccttcccaggttctattccccattatgcaaataagaaaatgattaataattatattttttacatttagaaatgcgacactttttaaacaagaaaaaaaatgaaacaaggaaatgaaggtgaagaaaagacaacattgacatatgtaccatgaaaaatgtcctattttttgttacccatatctaaattaaacagcaattcatttgcatgaaaaaagacagatattttgggatttataacagcaggaaaatcaagaaaattttccaaaataaagatatcgcaagttaaaataagattatggtgtcaaaaataagcacatttttgtaaacttggcaaaaacccggcctttccttgaattataatcattatgcttttcatatgatccagtttctcaaatagtgtaaatgttattgaatgactaattaattaatttcctgtttaaagtgtatgaaaattaattaagaaataattaaattaaattctgcatatatatggttagtttttcaaatgtccttgacaaaaaattcctgttagatacttgaaatccatatcagtccttggacatggtaatcggatgatgttgattaatttttaagttttttttgttgagaaaataatattattttaataattttttagatttggaagtcatg

SEQ ID NO: 113029 - DNA, 1003 bp, Heterodera glycines
  Promoter: Source sequence=SeqID_11945; Location=882..1884; Strand=+; Gene=SeqID_75465
gaaaattaataaaaatttattaacagttttcaaggatagaaggacttcgataaatttattaaggcattgaattattagagcgaggcacaggataatcccatgccggattttgcggaatctcaacccgtaatcccgattttttgcgaattgtttgattttgcgtgattaatcccgcaaattcggcctggaaaaagagccaacctaaatgacccgggaaaggatacgagaaccgagaccccaaaaaacccgagaaatttctcgacccgggaatcgagaaccgagaaatgttaaagaaattaatttaaagatattttttaagatcataaacacataaaaaaggggtagctcaaacggaatttttgcgtggagtctcaacatcaaagtgacggccttttttgcttttaaaaacgcttttttcgcactttttccaatgccagggttcggattaaaaatttttgaaaataataacatcaacgccaaaaaataagattttaaggtaaaaccaaataccgcaaaaaattcaccaacgttagaaaaaaaattatgacttctgcttttgtccaatctttaacggtcgagaaaaacagtaaaaaaaaatttaaattatagctttttaaacccgagttgggatcccgcaaaattgggcatggcgtcgtccctgccgggctctaataatccaattccatccttaaaatatctgttaagaatttttattaattttcgtttttattttccatatcaattaattaattaatcaaaattcattatttctctccaattattttctgttactgatctgataattcattttctgcatttaatttacatcggaatttctgctgcttttccatcgcttttccttctttttttgtgatgattcattcattttgtctatcaaattgtgatcagaaaaaactgacttttgaatacgaaaagataaatatgtaaaattaaaaaatataatactcacaaaacaattttatctttaagaaaatggcaaatg

SEQ ID NO: 113030 - DNA, 268 bp, Heterodera glycines
  Promoter: Source sequence=SeqID_4643; Location=131..398; Strand=+; Gene=SeqID_55208
agttggaaggatatgcgggaaaattgagagatttggaaaattacgatgattcaattgtccatgttccgtgatgattttattgaatgtttaataaaattattttttttcaatatgtgaagctgagggtgtgtctatagagagaattcggatcacataggagcattaaaaatttgttcgaattttggtcgccattagattagaaattaaaaatttttcctatttcatggttatatttgtgtttagggttaggcaaggggctatataaatg

SEQ ID NO: 113031 - DNA, 141 bp, Heterodera glycines
  Promoter: Source sequence=SeqID_21204; Location=851..991; Strand=-; Gene=SeqID_51793
ttgcaaaatgagatagtgccgtggagaaaggcattcggcgaactgagacagcggggcgaacagctggccaaaagggggcatgaaagcgtagccgagcgaatggaacgggtggagaaccaagcaaaagcattggagggcatg

SEQ ID NO: 113032 - DNA, 63 bp, Heterodera glycines
  Promoter: Source sequence=SeqID_42397; Location=901..963; Strand=-; Gene=SeqID_70294
ttcatgtgttatgttataccacttgggtacagtatcttatggtacccctagttatacagtatg

SEQ ID NO: 113033 - DNA, 1003 bp, Heterodera glycines
  Promoter: Source sequence=SeqID_14023; Location=1530..2532; Strand=+; Gene=SeqID_78000
caaatgcttaaatattatattattaactattaccagagagaaacaccagaaaatggctgatgagagcaataaaaaggacaaaactcacagaataattaattcactaatgcataattaattatatatttattatttgcatgttttatccgtccaaaatcacttctttttttaattcaaaatagcattgtgagaatcgctttcgtcccaatttgggtcgttaaataatgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttcttattataatttcaatttataattcgcaaatgtgcttaatgaggacaactccaaagtcgaacttcgtcgtttttcaaaatccgaatccgtcccctcgacgacaacagaagtgccgctttttaacttaacctcgtcaaatgcaataaacttcccgatttttgtgctgtgaattgactgaactgcttgaactaagcatttaaattctatgccggatgtgaagatgataatattttgccgaaagggtgaaaaaaagaacactaaacaaaaagataattaatgcaataaatgatcaaattttgcgagaagttttcttagtcggttgaaatttgtataatattgttgaaatgaccagccaactttctttttacactcattaaaatttatttgcccaaatacacaaaatacaataattaaataataaacaattaaaaaataacaataattaaaattcgtagtttcaaattcctctctctcccccaaaagattataattattattttcttcgtcctttttttcttatcaatgggccagtctttgattttgggctttgcaaatgaacggagagggaactccgatcatttgaatctgacaaaggccaaacgcagtaaatg

SEQ ID NO: 113034 - DNA, 320 bp, Heterodera glycines
  Promoter: Source sequence=SeqID_4518; Location=683..1002; Strand=+; Gene=SeqID_54743
tgttcaattaagccatcgaaaatgccattttgtgctttttaaggagtttgaggactattccttttttaaaacaatttattaattttttgaaatctgctgttattaattcagctcgatttctattttttcagggtagtgccaataacttttctcattaaaattaatttaaaaactcgaaaattaattgttcattatttttccaaatctttgttttttggcatttttttgttgttatccttcatgggttttcgaaaatttggtaagattagaatctctgctagtttcagttggtcaaatcactttattatttattaataatg

SEQ ID NO: 113035 - DNA, 313 bp, Heterodera glycines
  Promoter: Source sequence=SeqID_5193; Location=1687..1999; Strand=-; Gene=SeqID_57224
cactatgggtcaagcccagtgtcagacaaaattgctcataacgccaaatagcgcatttggcgtaaatttttgcccgctatttcaaaatttacactgaaaatgccttttttgtattttttattttgatctgccataactcgcttcattcccaactaaactgaacaaatttggtatcaacaaaaagtttttgaaaaggagaatctttttctaagcgaatgctaagcaatttgacatcccagaaaaaagttgtgatactttcaaatttttatcacgttataactcaagtcctaaactgctgttttcagcaaaaatg

SEQ ID NO: 113036 - DNA, 671 bp, Heterodera glycines
  misc_feature (6)..(7): n is a, c, g, or t
  misc_feature (36)..(36): n is a, c, g, or t
  Promoter: Source sequence=SeqID_34522; Location=1..671; Strand=+; Gene=SeqID_64294
ataacnnttccttgggtccaccactataaatatacntggaaactttcattttttgttcattcaattcttcaattgttacatgttacatgtcacatgtaaattaaaatccatataatattttttcctttgttcattcaagtctaatttgctacataatacatgtcaacagaaattgcctatgaatagattttaatttcatttttgttcattaaagtcaaaattaattatttgttacatgttacatgtaaacataacttccttgggtccaccactataaatatactggaaactttcattttttgttcattcaattcttcaattgttacatgttacatgtcacatgtaaattaaaatccatataatattttttcctttgttcattcaagtctaatttgctacataatacatgtcaacagaaattgcctatgaatagattttaatttcatttttgttcattaaagtcaaaattaattatttgttacatgttacatgtaaacataacttccttgggtccaccactataaatatactggaaactttcattttttgttcattcaattcttcaattgttacatgttacctaaatgtaacatataaacacaaattccctatgaatagactttaatttaattttcacgttttcaatttttaaagattgcttttattatatg

SEQ ID NO: 113037 - DNA, 54 bp, Heterodera glycines
  Promoter: Source sequence=SeqID_12948; Location=3060..3113; Strand=-; Gene=SeqID_76704
actccgactttttgagaaggccgaattgaaggaaggagaaaagtgcgagcgatg

SEQ ID NO: 113038 - DNA, 69 bp, Heterodera glycines
  Promoter: Source sequence=SeqID_1754; Location=1..69; Strand=+; Gene =SeqID_47015
catactccatccgtgagatcagcgtgcacgccaggcggtcaaatatacccggcggtgccgcaccgcatg

SEQ ID NO: 113039 - DNA, 494 bp, Heterodera glycines
  Promoter: Source sequence=SeqID_10943; Location=1198..1691; Strand=-; Gene=SeqID_74250
tttcataaaaaaaatcttaggaatttcttagcaagaaaatttgaaaaaaaatttttgaaaaaatttcagcgattttttggaaaatttttcaaaaaacttagtattttatcataaattttcgaacgctgaaaaattttttaaaattttttttggaattttgttactaagaattttcccaagaatttttttatgaaaaatttctaggtttgagattttttttttaaattttccgggggaaacgatgaggtaagggggggggggaacgacccagctccatacattttaatgatgactaaaaatcattcgaggaattactaccattgagattgcaaaaaaaaattagaaattgtataatccaatgtaacagttttagcttatttggaatatgagaattgatttgaactcaaaaatggataaacattaaaatttcttaaaaaaccataacgaaatgctctttatcccaccgggttgttgaatgttgtgcacggacaatg

SEQ ID NO: 113040 - DNA, 437 bp, Heterodera glycines
  Promoter: Source sequence=SeqID_18782; Location=1..437; Strand=+; Gene=SeqID_83457
tttaaaaaaaaaaaaaattacccaattttttttgggaatttaagaaggaaaagaaaatccccctttttattatttttaatattctttttatgatgggaaatgatcaaaattaaacggaaaagaaaaaattccatcacaaatcttttaagtaattttggggggaaaatggaaggaaaagaagaggcaataggaaaggaattaaaaaaaagagaaattattggaaaattttataaaataaaagagaaaatttagcaaaagggaagaaaatattcaacaaaagaatgggataaaattattcgaaaatagcgaaaaaattgggaacaaattgccaatatatttataaatggatcaaagaatttggtcttcaaaaacgcagatctttcaaatcaaaaactgatgaagaaaagttagaaattgtacagaaatttattgaaatg

SEQ ID NO: 113041 - DNA, 1003 bp, Heterodera glycines
  Promoter: Source sequence=SeqID_6834; Location=78..1080; Strand=+; Gene=SeqID_63037
tgagaaaaaacatttggtattataaaaattcacaacatctgtgacaaaatcattaaaaaaaagaaagaaaaaatttgtaaggaaaattgtcataattagggggttatcaaaatgtgaactgtggaaggagggaaacgcacgaaaaaccttttacctgcttggtttgttactttaggacgaagtcccatatgcatattttgtgatattttttcgcgatttatatgcatatttaatgtttggatattctggtgggcgttactcaaaaaaccatcaaatgagaaaattttttgatataccgtatttcctcgattataagccccggggcttctattgttcaacccccctccaaagggggcttatattcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttagaattttctatcttcaaaatgaagaagttattacataaattttggaaaaattcgttttttgagaaaaaaaaattaatagcgctgttctgaaaaggttttttgaaaaacacgaaattcttcctctataagcttctgtttattctatatttttataagacttgaaaaaaagtacaaaaataaactgattttggaattcgggatcatagatggaagcaaatggtttttttgtgccatgggttcagatccacttgcctgtaaaaatgttttttagggtttttgagaccactaatcaagaacttggcatccattttgcccaattccaaagccttgatccgaactcgaaaccccaaaaataatttttttttaaatgttgcaggcatgtggatttgaacccatg

SEQ ID NO: 113042 - DNA, 375 bp, Heterodera glycines
  Promoter: Source sequence=SeqID_8694; Location=4189..4563; Strand=-; Gene=SeqID_68872
atgatgaaatgtgatggaataatgaaataaagagaagaatgaacagcattttggcatgaattttggagagaatgaattggtccgaccaattgaaatgttatttggtaattagagtaataaatttcttgtgggagggtgtgagtgttaatttcagccaataatttaaaacggattattaaaatgagtttttcatagatatcccaaaaaatagcaattttagcagaacaaattttattcaattatttattttaattagatatcactgacaaaagattggcaaatttgtatgtaaaagttttgcaaaaaaaggacgcgaatttagtacgacaaaatgaagcggatttatcaacaaggatatttttttaccaaatgatg

SEQ ID NO: 113043 - DNA, 253 bp, Heterodera glycines
  misc_feature (18)..(18): n is a, c, g, or t
  misc_feature (24)..(24): n is a, c, g, or t
  misc_feature (45)..(45): n is a, c, g, or t
  misc_feature (116)..(116): n is a, c, g, or t
  Promoter: Source sequence=SeqID_32835; Location=1..253; Strand=+; Gene=SeqID_63083
agagtcttttataataanagacanaagaataattggggaaaaatntgaaaaaatattcaaaggattttaaaaataaatcattgggccgaaaaaacgaactctttaaacgaactttntggcaatattggagcaaatcaaagcggactatgggcatgctaacagctgcaaattaagcggcagccaaattaatttgacaaatttgggaaaagaaatttccatttttggcaaaattttatacgaaacattgaaaatg

SEQ ID NO: 113044 - DNA, 808 bp, Heterodera glycines
  Promoter: Source sequence=SeqID_38951; Location=233..1040; Strand=-; Gene=SeqID_67633
tgaacggcgaagaaccatcgatgaagcgaaataagtttcggaagacagacaagcgaattttgaatcttattgaaaatttgatgcccaaaatattattgagtctctttggggaatttcaaataattgtgttatgaacccgtgattttgttatttaatgactttttgaaataaacatcagaattttataattgaaatattgagatatgactactttttaacgaaaaaaattctggcggcgagatggccaaaaaacaaggcgcgacgagttggccgcggtgagttggacggcggcgagatagcgccgcggcgagttggccccgcggcgagtttctcgcggtgagatggccgcggcgaagtgaccccgatccgttggtcagcggtcactgcataaaaaatgagaatggcatgtgcgagtcacaaggaaaatgagacaatgcagacaggcatttagggcaaagcgaaacatgcggagaaactaacattctagagagtaaaaggaaaacaaccgcgcactggtgagaacgcagaagaagagcatagaagaaaagcacaaaatgaaatagtgtgcacttaaagagtgggagagatatttgagagaagagaataagcgagacagtgcggtagacactacgccaatctctccggccttcgctctgctttaacgagccaaacacaacaaattccaagccgagaagaccaaaaacattctccagtgtctgctgcggctttccatgctaattactcattgctaattaatcctaaacaccgaattgtcctctgttgctgcgttctattttgcttactaatg

SEQ ID NO: 113045 - DNA, 489 bp, Heterodera glycines
  Promoter: Source sequence=SeqID_3668; Location=1028..1516; Strand=-; Gene=SeqID_45604
gacttagcagtttaggacttgagttatgttgataaaaattgaaaaactcacaattttttcatatgtatcaaattagtttatatttcttagaaaaaaattctccttttcaaaatctttttttagataccaattttgttcagtttagttggagatgaagcgagttatggctgatcatcatcaaaataaacaatgcaaaaaaggcactgatcattgtaaattttgaattagcgcgttaagtcaaaacgctatgacattacaacttttttaaaacaataaaaaacgccataaaaaaaatttaaatcctcacgcctcacaattcagtttagaatcagtagctcatgaaaaaaggaacctaaatacatacatgtagacctaacctctaccgcaattccacacctgaagttataaaaacctattacttccatcacttgactaattcctatttaaagatccaattaattcaaaaaatacttacctatcactagcatg

SEQ ID NO: 113046 - DNA, 524 bp, Heterodera glycines
  Promoter: Source sequence=SeqID_11690; Location=478..1001; Strand=+; Gene=SeqID_75173
attatcccccggggtgattattgttcaacttcctcagaaagggggggattattaaatacgggggagaccgggggattattgttcaacctcctcagaaaggggggggggataattggatgcgggggataatggataattagagataatacggtatatctttcattcgaatgtgaaacagtctcgctaatcccacatttgagcaaaaattttgatcataattctgccaatcactttttccgttctcccatcccttcacagcggatcaacaaccaattgttcctcggctctcattcaaagggcacagcaccgtatgcatatttcaatggccaatacattgacggatcgaaggaaatcatcaaaacagttggccaacattttaagcaatatcagccggttgaaggtgaagaggagctgatgggcacgctcctcgacatgtttaagtgggttgggttgcgtaacatttttttgttgataaggctaattatgctaattaatttggtttacacaattacagtattcttatg

SEQ ID NO: 113047 - DNA, 733 bp, Heterodera glycines
  Promoter: Source sequence=SeqID_16359; Location=816..1548; Strand=-; Gene=SeqID_80746
aaatcagtcagagaacggcaggtttggtgtaaagagggaagcaattactcaattaggggtcaaacaattatgctaagtcactgctcgcttaggacaaagtcgataattatttagaagaagcttttattaaggcgaacataaattaataatatccaatgcgaatgaatgaatgtcaaaaggaatgtccttatataaaaagtttggtgtctgttgtgtgtgtccagtgtttgaatttgtgtggcgttttgtttaatttttgcgttaaaaatgaatttgaaaagaaatgtttggttttgctttttttcatttttgtttaattagtttttgcaaaaagcacagttaaaataaatttctcttttttttttcgtttttaatgacaaaatagtttttgtatgtttattaatgataatgaaatcgcaatgaatgctttctattgcatttcttaagagaaaaagtttttgtttttgttattatcaaaaagcgtctggaaatgaatgctcttaacacttttgtaaagaaaaagaaaatgtttttgtaaatgaattcctttttattgaattaaaattgatttgattagttatgaataaatttatgttagtattatttgtttttgattatgtcaagctcaatggaaatgttattgtttttgatattgcattgaaaaagttttgattcgagaatttgttttgaactttgaaatggaaattttgtttgtttgtaattaaagcggatg

SEQ ID NO: 113048 - DNA, 338 bp, Heterodera glycines
  Promoter: Source sequence=SeqID_34694; Location=1..338; Strand=+; Gene=SeqID_64420
aagctttcgaatgataccaaaattgtccaatttggttggcaaaaacctcttaaaacaattctcaaaaacggcattttttagttttttggacaaaaataaataaaaatattcatgttgcacaacggactcgaaccttcttcctttgtcccttcactatcttacaaaaaccactgagccacacgcaaaactttttcggtacagtagctcagttttggacgctgtgttcactaattgtctgtgattgaatccctaaccaaaaataaagcatctatctaaatccatttcaaagcacttaaatatattttttagcgtttatttgttagtatcagtggaaaatg

SEQ ID NO: 113049 - DNA, 556 bp, Heterodera glycines
  misc_feature (65)..(65): n is a, c, g, or t
  Promoter: Source sequence=SeqID_42540; Location=1..556; Strand=+; Gene=SeqID_70410
gctaactgggatagaaaaactactggtaatattgccttcttagaggttgccaactctatggaacncagaagggaccacctttttaattttcactgagaatcgccaaaatatgggcaaatttgggtcgtacaaatccgaacgaatcattggccatttaagtcatttaaataagtaaattatctttaaattggccaattttgtgactaacaatctgctcgttgtttttcccatcctgcccttagaaatacttggacagtttgcattcattttggactcgctcagttgggccgtcacgtttgaacccccacgttttgtgccctatacatttgtgccccatgtttttttataacttttttctgtcatcccaatcaaacaatgttggtatcactcgtaaagctcttcaatgctttattagccttgcaaaaaaaggattttctagcatattaaattgttatttaaaaatttcaaaaatcttgactcttgcaatttatcatggtgtaactttttaaacaattgccgaattgcgaagcaatagctagaaattcttctaaatatg

SEQ ID NO: 113050 - DNA, 141 bp, Heterodera glycines
  Promoter: Source sequence=SeqID_1562; Location=1617..1757; Strand=-; Gene=SeqID_74472
ttttttggtttataatttgtctgtcgatgctttaaaatgattgatgatgactgaggcgggattgcctttggatttgtgtagcgctcgttaacttgtttccctataaaaacgggaaattgttattgcctatttaacaaaatg

SEQ ID NO: 113051 - DNA, 684 bp, Heterodera glycines
  Promoter: Source sequence=SeqID_27309; Location=1..684; Strand=+; Gene=SeqID_57987
tagaaattccaaatgaatctcataaaattctcctaatttctttctatttttcaaactacattccactaaatttgatcaaaaacgaagatagttatgaattttcgaaatttgactggattttccggggctcaaatttagacgatttttcaaaaatttgtaaccaccttccaaaaagtctgaaaacaaaaataaagtatatattcgagttcagcaccttaaattaggccataaaaatgcattttggctaatttaggagcaaaaaaatttttcatgaaatgcaaaaccatggggtcccccctttggttttgagtttcaaaatcacaattaattttataactttttttaaattcaagataaaaacatgagataaagcacattagattggacttaaaattctctacaaaaaagctcttagacgattttttgataaaatcaactcctgacgagttattgcgccagaactgaaattgaggcctagcaaccaaaaattttctatttccaaaaaaaattttaaaaatttttctgaaaatgacaccaatcgatagagcatgaaaaacggttgcttgaaagtggtctccgttttccccggaaaaatctgtaaaaaataataaaattaaaaaacggaaaattttcgagggggcctagctcgaaaatttctgaaaatttcagaaatccaaaaacatg

SEQ ID NO: 113052 - DNA, 1003 bp, Heterodera glycines
  Promoter: Source sequence=SeqID_2155; Location=2689..3691; Strand=+; Gene=SeqID_78141
cgagcaaaataaatttgaaatttgattgaatgtttctttgtcttttttgtccctgccaatttttcgccgttttcattcaatcgccggtgtttcgtctgctaattgtgttcattatcgactcattaatcatttacttaattatgcgcttcacatttcactaattaatctctctcctctcttccatccgcttcttctccttcttcatcatctacttcagtgtccaataaatcattttgtccgtgtgcctttcattttctcatttaaacaccattacttacttatacaaaaggacaaaaagtgtgaattttgtttatttgtgtctgtgttaaattgatttttgttttatttaatttattattattttttttgaaaaaatatttattttattttatttttttctaaatttgaccaacatttctctgaatattgaacataaaaataaatattttctcgcttctttttcatctttttcttcatttttcatttttcaatttcattttttatctgaacctcaaagaccccaaaacacattttgatggtaaaatttgctctttttttttctaatttatcactctctatcaattaatcaattaattaattatcatccatcccttttttaaatttatttcaattattaatttattattattcatttctttctttctctgtcctccttttgctgctgctgatagaccagtgttagacacccctttcccctcattttcatttttttttaaatttatttttatttaaatttaatttaatcctccgatattattcatattaataataaataaatgcttattctttaaaaaactcacacacatgacaaatgtgttgttggccttctgaatctgtgcgttacacagctttttgtctaaagtctttcgcgacgctataaggtgtaaatattattattaattattttattaaaccaccaaagctggcattttctattggcatagttaacacaccaaacgacagagtttttgaagcggaaatg

SEQ ID NO: 113053 - DNA, 353 bp, Heterodera glycines
  Promoter: Source sequence=SeqID_8937; Location=4964..5316; Strand=-; Gene=SeqID_69717
ttttattttctcgcttttgcacccggttttgtatttcactgaaagcctaaatttgtttgtaaaatttgtttatattttcaggtttgaaacatatttactaatttattatttattcttgcaatatttacataaaatttttattttttcaatttcattattctgattgagtattcatgttcattatttttacaaccaaaaaaactaaattattaaattatatattgttatttaatacaatttcttgtatatacatttttttaattttatttcaaattataaataatattattcttcaagtattttttgattgatatttaattaatcaattaattattatttgctaattacctatg

SEQ ID NO: 113054 - DNA, 755 bp, Heterodera glycines
  Promoter: Source sequence=SeqID_38633; Location=580..1334; Strand=-; Gene=SeqID_67386
aaggcttttagggccattagtcaagagaaggaccaacatataaagcaggcaattgcaactttaattgaattccaaaaagacaatttcaaaatttccattgaaacttttacaagtcttatgggcatttcctacaatgggtttttgtcaatgtcacatacgaagatttttttttaatttaaccaagacttggagacacacttaggcaatgtattgaaacgaagataatcatttaaagaatttttatgcttctgaacagcaaggcaatgaaccaaagttgagaaattgtttaataaattggaaaaatatcccttaatccgccaattttttttctcaaagaatgtcaagtcagaactcaagaaattttgaacgaaattagatgaatcaaagcctttgggtaaattagtcatggtaaaataggactgcacatatgatttgcgcagtagcttaattaatttgtcaaagatttaactcagggctgccatccgtccttgaatggcaaggacgtccttgaaattgggccctctttcttgaaaataaaaaatgtccttggatgccaaggacgtccttgaaaatgaacatttagaaaagttttaaaaaaattcaaagaaatttgagaaatctttgtaattttcaacgatattttgattatattatggcattatgtaaataaaatgcaaattttcaaattttctcatgcttgtgaatgaatttgttacgcaatttttcgcgtttgcgacatattatattttagaatg

SEQ ID NO: 113055 - DNA, 365 bp, Heterodera glycines
  Promoter: Source sequence=SeqID_3457; Location=988..1352; Strand=-; Gene=SeqID_84755
gcctcaaaaaaagttgggtttttggttattttattggttctaacaattcggaaatgctggactatcgaaggcctgaaacgcacgaaaaacatattaaattttaacttttattttgtattttttttaaaaaccatatttgattattttcaaaatttttagcttattggtccgtaaattttcaaaattttcatttctattcttaggcataaaaattcttaatcaaataggtatgggtgccagcactgatattttaccgagataagttgtctgataatattggaatattataaaatcttttttggaagttgcttcgtaattcattttaagttacgaaggctctgagtcgtttgtctcaatatgaaatg

SEQ ID NO: 113056 - DNA, 219 bp, Heterodera glycines
  Promoter: Source sequence=SeqID_860; Location=1..219; Strand=+; Gene =SeqID_62831
aattaaaaaattttaaattattttcaaaagggactcaagcttattccttcacaattaattttttaacacatttattgtcttttcgattaaaaaatacataatttgtaatattattaaatatattatttttatttatttatataatgaatagtctataaaatattaatttatttatttatgttaattgttggctatttttgcacatatttcttcaagatg

SEQ ID NO: 113057 - DNA, 385 bp, Heterodera glycines
  Promoter: Source sequence=SeqID_17436; Location=1186..1570; Strand=-; Gene=SeqID_81920
tttgagagctgaaacatcgtttaagtcaaagcttaaagtgcaaatgctacaccgtccgagattcataataagaaaattattttagttaatgctgataaatttagttttgtgtttttgtatatgaactaatggaaaaaggtaaaagcaaaggaagggaaaacgaattcagctgattaggcacatcataaataggcaattatatgcgttaatctaataattaattgtttaaaaaaataaataattttaatgaataaaaaaattaggtaatttaaaaaatttaaataaaaattattcgccaaagatcactttgacaaaagtcattttacaaattttaattaaatttaaaaaagtacttcgcttatttatgtttttacctgtattaatg

SEQ ID NO: 113058 - DNA, 1003 bp, Heterodera glycines
  Promoter: Source sequence=SeqID_40090; Location=157..1159; Strand=+; Gene=SeqID_68521
ctgacagcgcacaattttttggcaaaagcaactgaagtaaagagcttttatctccgttttaaatcaggctaagaaaaaaagttttgcggtaatgaaaataaatgaattacaaaaaaatgaaaaataatgaaaaaagacagggatttttagggggttgagttaactgaaaaacaatttttttgtattcaaaattcaaatttggcgcgctaaatgacccaattatttccccaaatcctgccagtgctgactcagctgtcatttataaaatgattgatggccaaaaatgcgcattttggacctaaaaaatgacacgtgactggtcatgtgaccgaattatttcgaaatacaatgcaccgcgcggaaaatgagtcagctgtcaaggataaatgccccaactgtcaatgaaatatgcaaacaacagctggaccccgtccatcccgtgacaggcgttccgcctatcacatgagccctccggggccactataaaagctgcaattgcgcaaaaaatttttcttttttcgagaaaaaatattgctttggaaaatatttcgcaaattgaattttaattcaaatttaccaataaaatatttattttatatacaaaaaaagtccaataaaaaaaaacaaaaaaaatgtctcaggcgcaaaaaaaattcctgaccgtcccggctgaaaaaagaaaagaaagaaatataaaaaattatttcaaaaaaagtattaatgaaattaaattaaatgaaaataattatgtcgaaatttcttcgactgaaagatcaatgcctgattatgggatacaagaaaatacaataagatttatttttaaaaacccaaaaaaagaaaaccgtaaagaaatgtcagaaaatttcaaaaaaataatagaaaatatgattaaaaaatcaatgcttaaaaaagaatggggtggaaaacccagcggatttcaattgatttgtattgtgaaatattgaccgaccccataattttgccggcccgagacccaaaaatg

SEQ ID NO: 113059 - DNA, 671 bp, Heterodera glycines
  Promoter: Source sequence=SeqID_18044; Location=532..1202; Strand=-; Gene=SeqID_82628
atcaggacaagtaagaacattaagaattaattaaattagtatggcataatcaataaattataaaattgtttaattatttgaatctaattaggcacgataaaaataatttaatataattcactaaaccttaaccaacaccaatcattaggatatgattctaatgatcggaaattgacaaaaaaatttttagaaaatttcgattttacggtctctaatcaatatatcctatagctgagcgggaccgggactggtactgaaaaaaacctacaaatgaatgcctagccccggatttgaccgggaccgagactagtcccggtgtttcccagccaaaaagtcacggtttttaacccgaaaaattccctgtaccaatttttttttttacaattaccgctctactctaatataacgaacaaataattttcagattttcattggttacaccggaaaaaaacgtgggcaaaatctgccgaaacagaaatgtgttgccataaaattgtatggcaataataaaagacatttttataatggcacaaatgttttgagaaaattaaaaccatttgattcaaaaaatgagcacattgtcaacatgatggactagtaaaattcaaaatttaattagcattaaaaaataatacctaattaaatttgcaatttttagtggcctaattatg

SEQ ID NO: 113060 - DNA, 289 bp, Heterodera glycines
  Promoter: Source sequence=SeqID_9273; Location=1529..1817; Strand=-; Gene=SeqID_70831
atacaaaattttttaatttggtttcgtttaaaaaacgttataacgagtttttctcgaaaaatctgtaaaatcttctcatcgacaattcacataaaatatatttgagagcatgactgttatttatgaaattaaattaccttattttaatcaataaattaattgaacaattaatttgttcttttcacaattaactcttcagctccgttccgttggcttttccactgtttatacgctgagccgtgacgcggtcagtgttgtttttgcggattatcctcgagcacgaaaaatg

SEQ ID NO: 113061 - DNA, 337 bp, Heterodera glycines
  Promoter: Source sequence=SeqID_24430; Location=310..646; Strand=-; Gene=SeqID_55162
ttgctcaattgtcgtcgttttcgttgtacacagagaagggatgattgatgaagatgaattgccggtaattaaataatggaaaaatggcaaccaaatgaatttttgtgccttttatatatgaatttatccgaaaaatttgactcttccgactaaaaaatttgctatttaaggcccacacattttgcttttccacgttcattccgttcattcattccatccacttaattattcgtcctcctccaccgccacttaaatcgtcagtttatttaggtaattaattgttttgctatgtgcattttcattgtgctaattgcccccccccatttttcagcgaatg

SEQ ID NO: 113062 - DNA, 205 bp, Heterodera glycines
  Promoter: Source sequence=SeqID_991; Location=1869..2073; Strand=+; Gene=SeqID_65597
tgtaagccctttttttaatttgcatcaaaatgcttaaataaatattccgtggaagaaaggtctgaggtgtttgctatttaactaccgaaaccttttcatccgttgtccttttttaaacgtgaaatttttgccgtatgatttttttacaaagagaatatccccttctgtaaaattcagttatggttcgcccgccacggaggatatg

SEQ ID NO: 113063 - DNA, 74 bp, Heterodera glycines
  Promoter: Source sequence=SeqID_27137; Location=1094..1167; Strand=-; Gene=SeqID_57842
ctaacaatgtttactgttgcttaggaaagctccgaagtggaattgttatgttcaaaagtcagagccgaggaatg

SEQ ID NO: 113064 - DNA, 66 bp, Heterodera glycines
  Promoter: Source sequence=SeqID_20847; Location=1213..1278; Strand=-; Gene=SeqID_51430
atggagaaacccatttgatactgtagcagtatttgggttatgcaaccaattctaaattaagccatg

SEQ ID NO: 113065 - DNA, 732 bp, Heterodera glycines
  Promoter: Source sequence=SeqID_8392; Location=247..978; Strand=+; Gene=SeqID_67905
ggtgccaaaaagaaaaatgtttaataatacaattttaaaagcattaattcatttataatagaaatttatttaattaaaatttttcattataattaaattggaaatgaattaaaaacaaaaaagagtcagtcaattaaatttattggagggttgggtcaaaatttataaaaatgtaaaacataatcatcatatttaactcgtttttcaataaattctgattcactgaatcattttccggtcacgcccggaaacgggcacatgacaaaaccgggggacggttgtttttcaaaaccgcttttttgcagtgtgctttttccaaaaaacttttggagtattggggggcaggtggtgccaataggcgccgccggtaaaatgtttttataatttttattgcgatttgccaacatatttttccaaaaaatgaccaagtttagcgattttgatttgtcaaaaattgctaattttttgaaaaaaaaaaattcaatagaaattccctatataaaatgccaatcacggatcaaaatcacgaaaaattgaaaaaaaactaataaaacgggggaaaacaatcgggggatcgcccccgcacccctgactggaactgaactcaaaaattggaaaagattttccaattgccagttgatttttttgaattttatttttaataattttttttttcatttttaaaattaatttatttttcaaaattgtcaatattttgtacttttttaaatg

SEQ ID NO: 113066 - DNA, 648 bp, Heterodera glycines
  Promoter: Source sequence=SeqID_29243; Location=1..648; Strand=+; Gene=SeqID_59768
gaatggggatggcacatgtcagcctttacggtgggtgccgaattgcccgcccttttcaagcaaatgcgagggacttagttgcggcacattaactctctctcactcccatataaaaaaagatattttcatttaaaaaccgtcagttcccctttaatataataaattttatcatttttctcctacataaaaatattgttctatttacatacatacatacaagatatattagctatgtattcattaaaaaaaagaaaattgccgcccgaacttctctcggagttggccagtgccttaccctttgactttcgctgggccacaacccgagtttcttcttcttttgattattttgtcaaaaagagacagaaaaaatggatttggaccgaattcattcgggtaaataaacgtttgatgggtttttttagggctcagattggtgaaaagtggaagtaatataatgatcagcggccgctataaaattctcggggatttaaagttattttaaccatttccgacttcattatcattaaatttgaacaaaaaaaacgaggaatttgagttttgacttttttcaagttcgggttagggatagaaattggtcaaaataatgtatgatttgtgttaatctaaaatatattttattaacagatg

SEQ ID NO: 113067 - DNA, 56 bp, Heterodera glycines
  Promoter: Source sequence=SeqID_39772; Location=1..56; Strand=+; Gene= SeqID_68268
ttattcttatcaaataaaatataattttaatttctagaaaaagaaattcagcaatg

SEQ ID NO: 113068 - DNA, 405 bp, Heterodera glycines
  Promoter: Source sequence=SeqID_21153; Location=1051..1455; Strand=-; Gene=SeqID_51734
gatatgtctaaagcatcacctcaagacctaaaaaacaaatttaaaaaattgtgctgccaggataaacggagctctgtatgtcgaactaccgccccggttaacagcaaaattaaaaaaatagttaaaacatagataggagaataaggaacaaatgaaaaattctgtgtctgtacgcgcttttaaagctgttgtctccgcccatcaatcgataatattcggcgaaacaatgcgcaattccttcgggattgcatatggtaacagatgtttgtaatcaatcgataattttcgacgccttttcaaaatttccttaatagggtatatcattcctttctccgtctataagcaatccctaaaagcattcattcgttcacattcatttcctacacactaaaaattcccaaaatg

SEQ ID NO: 113069 - DNA, 593 bp, Heterodera glycines
  Promoter: Source sequence=SeqID_25415; Location=1..593; Strand=+; Gene=SeqID_56157
atagaaatgggggaaaagagagggcagaagcctaagaaaaagcgccgaacagcaaaaaagtaaatgacaaatggacgaaatgtttacgataagtgaaaggggaggaggaaaagcggaggaaaagtccaaaaagttaatagaagaaatacaaagagttgagagagagtatcaacccaagtgagagagagagaggagagagagagagaggagagagagagaaaggagagagaaagagggagggagagagagagagaaaggagagagaaagagggagggagagagagagagaaaggagagagaaagagggagggagagcgagagagaaagagggagggagagcgagagaaaatgaggaaagatagttgacggagggagaaatatagacaaaaaagagaaagagaaataactttatatatttttactcatttttctataattaaaagtcattaaagtgattttcgcccccaggtgaaaccaacggacaatcagccggaaaacggacaaatgctgaggggggcggatgcgcggaaacggagggtgccgctctgtctgttcgtcagacgggcggaagaatcaccacacaattacgaatg

SEQ ID NO: 113070 - DNA, 110 bp, Heterodera glycines; identical to SEQ ID NO: 98226
  Promoter: Source sequence=SeqID_29415; Location=171..280; Strand=-; Gene=SeqID_59916

SEQ ID NO: 113071 - DNA, 1003 bp, Heterodera glycines
  Promoter: Source sequence=SeqID_16638; Location=1393..2395; Strand=+; Gene=SeqID_81048
tgttgatgaaaattctttttaaatgttcatagatctttttcatttaaatcatttaaatgattttaatttcttttctagaaatattttaaataaattaatgatttttttaatgagagtaatttaagcctttttcattagatcatttaaattgtgctaaaataaatgtttaattcaattaattagaacttttggattattttaatggagtttttatcagtaaatttttctggaacttttcttttttgtcagattatttcttttatgtgaatttttgtttggaaagaaaattccttgcgattcactgaatgcttggaatttctactcatatttcaacagaattgatcttcattttcttattaatgctttttaaaagacggatttttttttgttttgaaatttttaatttcttttaattaatttccgtttttaatcaaatgttttaaatggaaaaatttatttaaatgaattatatacctaattatttgtaaaaatttatttcatttttatatattatttcccaaaaattttacgccaattttcgtaccaattccccgcccccctcccatgcccatttgggggtattatcttttcggaggcaaatttgggcgaaaatccgcccaaatcggcggagagttagttgattgtcatcggctaagcattttggatggtcatttgtggtcattttctaacttttttcttattccaataactgaaaaagtatagtttaattattttaaatttacgcaattaaattttcaaaatttttggcgttttcaacgagttacgaatttacgtttttaagcaattttaatgaaaacgaaaatctggaaagcctaggagaaattttagattccgaattttgtacaataaaaataattaaaaaaatatttccacttttcattaaattcccatttttaaaaaattataattaaaaatgaaaacgaaaatttttattgtaaaattagatttttttgaaaatttagcatagtaaaaacagaaaatg

SEQ ID NO: 113072 - DNA, 298 bp, Heterodera glycines
  Promoter: Source sequence=SeqID_37261; Location=933..1230; Strand=-; Gene=SeqID_66365
ttgcctccaccagatcagaacaaaagaagaacgaattaattgaaaacgctacagctgaccaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctaggagctgtcttgatacctgtcctgagtgttttagcccaacatttattagaaaaaataacatcatg

SEQ ID NO: 113073 - DNA, 120 bp, Heterodera glycines
  Promoter: Source sequence=SeqID_19087; Location=1..120; Strand=+; Gene=SeqID_83830
gaattgtgtcctctgggaaaaagttttttttttacaacgaacctggttaaaaatgcattgataaataatttggttaattttcagagtgttacggagcaattgaacagattgacgaaaatg

SEQ ID NO: 113074 - DNA, 466 bp, Heterodera glycines
  Promoter: Source sequence=SeqID_13615; Location=1..466; Strand=+; Gene=SeqID_77519
aatttatttatattaaaatgtaaatttatttagcatacctttaaaattaataaattgtggaaattcaatatttttgaaattttctaaaaaacgctctttaaactaagttttggagtttttaaagtcaattctgaatttatacacaatttttggcattttttgagggttaaaaaccatttttggcagttttttaaggcatattttagtgcatatttgagcatttttcgggtttttagggcatatttgggggatttttagtgcatattttatgcgcatatttggagttttttagtgcatacaacttataaccctagttatgaattttgagaaaacaaaaaatatgattgaatgaatcgataatttaaattccaacaaattttattaagggaaattttttttcaaattttttttgcatttagttcattttatcgcgaaatatgaaaacccaaaacagtgaattcaaatg

SEQ ID NO: 113075 - DNA, 1003 bp, Heterodera glycines
  Promoter: Source sequence=SeqID_28591; Location=100..1102; Strand=+; Gene=SeqID_59186
gtaatcctgttccagccgggcactaaaagcatgccctctgtttggttgaagtgcgaaatttgaaagtgcggaagtgcctatcgaaaaaaactgtcaaatatttgtgcgctgtttaaataaattggaagtttcggtctaaaggaacttggaaaaatgaccatgactatagtaatttaatgaataaattctatcacattttaattataacatttaacaaagtgcatttatttgttagcatttagctactaattctaattttcgtttctttcaagcggttaaatctattcacttccgccgttccctttgtggcactaattcccaataattttatcgcttaattatttatataaataaaaaatatttattttctttatttatattattatacacgacatcatttttattaattatttgtctgttttttgttgataaatcgtgtgactttgatagataatcaattattttttgagctgtcaccagcaatttttgctgacagcgcacaattccattctttgtcggtcggtcggtcgtatgttttccctatctttcgaatgatgtcattgcattttggagggccaataaaagcagttcccttctcctcctttcggccattgtatcacaaagcaaaatatatttccatctgtcattgcattataatatctcagtgaaatcgcccattttaagcttcattaaaaactaaatgctccttaattcgttagaaaagctcaattaagtgaaattattttaattttcattttattagcatttcatataaaattcatttgattttttaaacatttttaattcccatcgttccttaaaatggcctgtgaatgttgtgagttgaatgaatgtgttgttgcgtcgtaataaattgtaaattccttaagcctgctgcaaaaacaaccaatgttgtaccactaactgctgcggaggttctgctgacaaataaacaaatatttccatgccttttaatgcttttttcagattcttgttcatcatg

SEQ ID NO: 113076 - DNA, 176 bp, Heterodera glycines
  Promoter: Source sequence=SeqID_4250; Location=483..658; Strand=+; Gene=SeqID_53762
gctgaaatttattaattttaaatttactttatttatttttgcttgttaaggaattgaaaacgcgcagcaatttgcacgacatgtgggaaaagtgatcacttcgagggtaatacaatgtttttggggttcccaatggattgacttcaaaggtgccacctaatgctccgtacgcaatg

SEQ ID NO: 113077 - DNA, 294 bp, Heterodera glycines; identical to SEQ ID NO: 99762
  Promoter: Source sequence=SeqID_44818; Location=394..687; Strand=-; Gene=SeqID_72231

SEQ ID NO: 113078 - DNA, 1003 bp, Heterodera glycines
  Promoter: Source sequence=SeqID_7566; Location=757..1759; Strand=-; Gene=SeqID_46443
tgtttaagctcaaggccttatcgaaaaaaattgtcaataaaaacaaagtttgtttaatgaatatttacatcaaaaaattaatgacaatttcgaaaaagaaagtcaagtaatttttagaagcttttatttcatgttttgttgctcacttgttgaaccgcacatgagccgttggaaatattttcgccttttcttggcaagttttttcccgaactgtttcacgacagttaattgagtcaattattttcgccagtttcttttatctccaagcgttatttattgcatttcacttaccttggaacaagattacagtaaaataaaatattgttttgtgaatatttacgacaaaaatttatcgacaatttctaaaggggaaggaaaataaatgtttgcctaatatattaatttatattttcaaatgattgaaccgcatctgttgcttatgtttttaatattttttgattttgccatatattttggctttttggaatttttccaatgtccgaaaatttatgtttgcttttacatgataagtaatgatttggttatttttgtatttttcttcttttcatcatgaaagtcatttagccattcatcccctctaatgaaaatagttttctgcagctgatttaacaatatttttctttgcactatacatgtagtatagcactggttgcgccttcaattcccccccccccccccccctccttcctcagtggcggcccttgtttttctgttttcgtcaattcgtctcgactgacttgtttttgttcagccgcaaaaagaaaaaaaaatgagcgaacggttggctgcatcaggtggactagcaatgattagcagaaaagaataaaaagaaatctagtgtttcataattttaattttaaaaggaccacagtaggccccaagtatagtaagaaccaactacggtaatcccaacaataatttttcaacaacgttgttcatcattcaacatacagttaaacgatcttaatgttttgtatatatg

SEQ ID NO: 113079 - DNA, 1003 bp, Heterodera glycines
  Promoter: Source sequence=SeqID_39052; Location=266..1268; Strand=+; Gene=SeqID_67716
atggaaggaagaaaacggcactttcttgcagccaaaaattagaaataattttttcggtagaattaccgaaaaaatatttatataataaaataggaaaatgactaaatcaaattaataaattcaattcaacttttaaaaatttttcgccttcggcatcgccggactaaatattgaaattcttttgtttttcatcataatctcaaaatcaaaatttaaagggaagtcaatttcgagtcattattatgtgaaagtttaacgaataaatgagaatttgaaaaagatgttttttacatttttattatttattgcaataaaataatgctctgctttataaaattggtaatttgccaattaatatttaatacatttaattaatcaaataaataaaagaacacccaaatatagattaaaaatggtcgataacttagcatttaataaatgaatttaaattatatttttattttcataatattgatttaaaaatgattttaaaagtttaaatatttgtcgatttaaaaacaatttttatacttataaaatggaatatcgatggcttttcgtcgtcccccccccccgaattattgttgtacttttttttaatcataaaatgctggcctgtcatttttatgttatttttgactaatatacaattttattatttgtttgccaattagtcatatcggagaaaaacatttatttcttcatttttccactttttcagttttttcttccatacagaatttttgttactaatggcccttcaatgcttttatttgtcaatcagtcacattcgtcgaaacatttacgttgccattttcacgcatattaattcgttcaccaaaattaatgtattactaattgcatgggtgtgagagcaaacgccaaaacagccctttaaaaagcgcacaaattggagcaccaaatcattcattccgctcaaaaattaccaatttcctccccacaaaattacccaattctcattaacaaacctacgaaaaaaatg

SEQ ID NO: 113080 - DNA, 131 bp, Heterodera glycines
  Promoter: Source sequence=SeqID_3620; Location=3392..3522; Strand=-; Gene=SeqID_51147
tgtaaaaaaaaaaattaaaaattttaaaaaatcccaaaaatttccattttaaaggttttactcaccctcttgacctactcaaagtgcatcttcagacacaacaacagggcaaattgtctttgcccggaatg

SEQ ID NO: 113081 - DNA, 1003 bp, Heterodera glycines
  Promoter: Source sequence=SeqID_14289; Location=631..1633; Strand=+; Gene=SeqID_78313
cattaacggacattttcggcccagtttttttttggtgcggcctaagccaaaatcggacttttgcggcccgcgacatttgcgtcccggacattggcggaccgtttcttaagggcaattttcgtaccttgtcgacccaatttttttttaaattttgagtcccaagccaaaatcggacatttgcggcccaacatttacggcccgacattggtgtcccggacatttgcggcccatttcttaagatacattttcggaacattttaggccatttttttttttgaattttgcgtcccaagccaaaatcggacatttgcggcccaacatttacggcccgacattggtgtcccggacatttgcggcccatttcttaagatacattatcggaacattttaggcccaattttttttattgaattttgcgtcctaagccaaaatcggacatttgcggcccgatatttacggcttcacccaaatttcaccatcggtagcggcataaattacttagcatgggcacataagggagtaaatttatgagacttttcggtaaaatgttaactcctatctgtgcggatcctttttgcgtgaggactgcaaaatgcccaaattgttacttttttatacctcccaaatagttgaagcgctatttttggatattctgtgggcttttcattgaggttttaaaactcacatgtgactgccccaaaccgtaaggtacctactttgcttcatcatttaaacgcatatagtatcgctttattttttgaacattcatgcttatttttcttgatttaattaatatttctttgattttttcatttcatttgaaatttaaataactgcactaattatatgtgtttttgttgaaatggaatcatttaaccctgatacaaaaattagctttaaaattgaacaaaattgaaccattttctacattttcccaacaacgaactggtactaaaaaacggtgtcccaacactttgaataatgggcaatttgaaataaaatg

SEQ ID NO: 113082 - DNA, 68 bp, Heterodera glycines
  Promoter: Source sequence=SeqID_19568; Location=1..68; Strand=+; Gene= SeqID_84302
gtaaaagaattttttaaattaaattgaattagattacttttattatttttaaaaaattttagcgcatg

SEQ ID NO: 113083 - DNA, 110 bp, Heterodera glycines
  Promoter: Source sequence=SeqID_25591; Location=1..110; Strand=+; Gene=SeqID_56329
tttcactgaaaattagccaatttataggtaaaattttgaaaaattttatagggaatttaatccaattcttaggggtgtaaaagtcgcttttcgcgccaaaaagcgaaatg

SEQ ID NO: 113084 - DNA, 1003 bp, Heterodera glycines
  Promoter: Source sequence=SeqID_1434; Location=1832..2834; Strand=+; Gene=SeqID_73530
tttaaatgtcattcgtatctaagtgtttgtgttggcctgcttaatgaaaaaatttaattcggtaaaaaaaattgtaacgaaattagtttttaataattacaatttttatgttattttttattttcattcaatgctttcgaatgcggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatacacaaaaaaatcagagcaaaaaaagtttgaattactgggtttttgagttccttctggccataacttttttgaaacttaaccaaaatttttgagattttgcaaattaataataaacacatagagctatcgaacaacaccaacaattcttaatttaattgacagtgaacaaagttatggttcaaaaagtcttccgacgacgtttcggccgacgacgttttggggtgcaccgtttcgaatgatattaataaataaattgaaatttttattgggaaatgctcttttgttttctcctttatttgttaattgtattacgtcaagatcgttcaggcgcgtttcttagatatgccatagggctagaaaaacaaaaattcatttttatataaatataaaagatttggcaaatatttgaattaataaatttgtgtttgaagttttaattttttgaaatgatacaaatttaaaattttaaaggaaaatttttcataaattgtttaacatttttcatttttttccacttggcgcatttacgaaacgcactaacacaaaatttcttaaatgcttacaaaaatgtttattttaaattcaacacttcttttctagatcttttttttattttgaagtataggaataaaacctaaaaccgaaaagtgcattttattttaattaaattcaaaagatttaattttaaattaatcagcgctatg

SEQ ID NO: 113085 - DNA, 1003 bp, Heterodera glycines
  Promoter: Source sequence=SeqID_31317; Location=594..1596; Strand=-; Gene=SeqID_61687
gtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 113086 - DNA, 698 bp, Heterodera glycines
  misc_feature (20)..(20): n is a, c, g, or t
  Promoter: Source sequence=SeqID_43926; Location=1..698; Strand=+; Gene=SeqID_71495
ttcaaaaaaccaaatattcncaacttttcttggccataaatttgttcaaaattgacgaattttttttaaaattttgcaggctaatagagcatgttaagagcattcgaatgataccaagaatgttgaatttggttgacaaagaaaaaagttatagtgcaaaaacatgctggggccgaaccgtgccggggccaaactgaggttgaccggtttagggggtgcaccaatacaaaaaaatttaaaatttcaataaaattattattatatattagccttttacatatttgcgcattttccattttttttttaaagaaatttttgccaaagaatttgccaagcttcaattgaatggccacgaagctgatgggtgtgcgttggttaacacaattgccaaatgctttcaaataaccaaaaagtcggagcttgcacgcaatttttatcaaattgctgccaaaatgcagtaaacattaatttgaatacaaattaattaccccactaattaatcactaattaggccctcaaatgtcactgttaaaaatttggaccaaacacaattggccttggtcaaaacggaagcaaattacgacgacaattttccagaagaattaaaagcaattgaacacaaattggaaattgccgaattaaagggttattttccataaaaaatttttttataaatttattttttaggcgatgaaatg

SEQ ID NO: 113087 - DNA, 568 bp, Heterodera glycines
  Promoter: Source sequence=SeqID_2123; Location=1139..1706; Strand=-; Gene=SeqID_77974
ttcttcaaaatcaaaacatttatgtaggggaacctggcaattttattatgtaatcgaattgttacggttgtttaaacgtataattacacgtgtgctagtttctgtttggacttatacctgaataccggcttagtggggtccgaaatatcaagagtcccgtctaattctgtttaagctcataaaattttaagtgtttgcacagatcgagccttgtaatgttataagctataaataatacatatgtatggcattgatattgaattaattgtaatgagtttagcaaaataagcatgcttaatcgaatgaatattcgttaaagaactttctatttcctaacttgattaaattttctatgcttttaaattagatggttgcaattcatagacaattaaaaatatttttattttttaactctttaagttggtgcccaaacttcccggtgcccaaatttctggtgcccaaacttcccggtgcccaaacttccgccccccctaggggcgaacactcaaaatagggattttaagggtcgaataggggcgttaaaaggcaaaatttcgaaaaaaaaatg

SEQ ID NO: 113088 - DNA, 106 bp, Heterodera glycines
  Promoter: Source sequence=SeqID_11550; Location=3630..3735; Strand=-; Gene=SeqID_74985
aaaaaacagcaaaatttctttggattgtttattcaattccattgccattttttaaattatgccatttttatatgtttttaattttacaaatttttgttttaaaatg

SEQ ID NO: 113089 - DNA, 199 bp, Heterodera glycines
  Promoter: Source sequence=SeqID_849; Location=1684..1882; Strand=-; Gene=SeqID_62629
agtaatgcttgaagacagagcaattcatattataatagataaatttgctaaaaggcataaaaataatacacttcttaattcaatttgcaaatagcataagctaattagtcaattaatttccactaattaccccttcccccgcacttaaaaagccattctcttcgatccgctgctccaccctcaaaatcttgccgtgatg

SEQ ID NO: 113090 - DNA, 110 bp, Heterodera glycines; identical to SEQ ID NO: 98226
  Promoter: Source sequence=SeqID_5872; Location=140..249; Strand=-; Gene=SeqID_59505

SEQ ID NO: 113091 - DNA, 850 bp, Heterodera glycines
  Promoter: Source sequence=SeqID_9799; Location=547..1396; Strand=-; Gene=SeqID_72737
tttattcggaagcggtgagtcgtctgggggacccacgcgcctccctcactggtagcaccggatggtttgttttgccattccggcaaacggttcatcgacgacgacaatgaggagtgatcgacgacgacagcagctgcagtgcctgcgggcaaagtaatggcgccggaggagagaatgtttagggtacccgcctgcgggcacaatacagtcaagcgcttagtgatcacttttaaatgagactgatcagaatttgaatttaagttgaagataaagaacaatttacaaatactttaaaagtgctaatgatcagaattttaatttgagttaatcagcagaaaatttacataacttatgagcagtgtgccaaagttcaaaatgcgtcattagagaaacatgataattcagaaaattgtgaaataagtgctctatgaattaaatactagcggatgtttattaatttacattacggccaaattaaatttcaatgattttttgagttatttttaatgagttcaatgttcgtccaattagtgcccatttcaaagttcaaagattgcgaaaaattttcttgttattcgccattcattacttggccgtgagaacggaggccgcggcagcgctcttcatttagcggagatgcgatcagttcacataatttacgtgagaacattggcgatgttcattacacattcattaaaatagagcgacattcgcggaaatttttccactgtttttattggccattcattttatgatttaccacattttcaattagaaacgaatatattttttttttgttgttaagcaatcgaaaacaagtaattgtactctcttcccaactaaagcaatg

SEQ ID NO: 113092 - DNA, 110 bp, Heterodera glycines
  Promoter: Source sequence=SeqID_14373; Location=1171..1280; Strand=-; Gene=SeqID_47195
tgttgatgggatttggcaaattaagctcaggaaaaaaacagggtgtttaaactatagtaattcggaccctatatattataaacttgtaaatttttaagcttgatgctatg

SEQ ID NO: 113093 - DNA, 245 bp, Heterodera glycines
  Promoter: Source sequence=SeqID_15142; Location=1749..1993; Strand=+; Gene=SeqID_79332
aacatcacaaacaacggcgaaaccggagctagtggaaccttgagtcaaaaagaacacaaccacctcccagcacctcagaaacaacaagtgtataaatttaaaaccaaataattaatgctttgttaaaggcagagtcaaggcgacagaaaatcaaagaaagtgtcctggtcgagccgtgtctgaagcccacacgacttttggctaaagtgaggcgatcagcaacggatgaagcctttgttgccatg

SEQ ID NO: 113094 - DNA, 171 bp, Heterodera glycines
  misc_feature (25)..(25): n is a, c, g, or t
  Promoter: Source sequence=SeqID_27871; Location=1..171; Strand=+; Gene=SeqID_58542
atccaagtagggacagcaaaagccncgtttcttcggcaatctcttcccttgtctcacttttaatttctttagttcgctcgtttgactaaatgtcccaataaaattgtgaggcgaatctctctgaacttcaaacatcgtccgtcgccttggcctcgcattttgccggggatg

SEQ ID NO: 113095 - DNA, 1003 bp, Heterodera glycines
  Promoter: Source sequence=SeqID_1816; Location=3677..4679; Strand=-; Gene=SeqID_76150
accgaaaccgactgaccgaaataatcaaaaaaccgaaacaatcgaccgacttttatgaaaaatctaaaaataaaaccgaatggcgaattgaagagacataactagggctgggatttttaggtttttacctatttttttgcggcttagttatgatgagagaagcccaaaaatagcattttctcctaacaattttcgatttagagcgactttttagcacataaaaacacctaaaacgggggttagcacctattttggcatttgcgaattttagcacctattttggcgttttggcacctaaaatagtttacaacctattttggcatttttcgaatttttagcagctattttggcatttttgagaaaaattcttaaggaaaatacaaaaaattgaaaaatagacccctaaatttcgactttctttccactttttttttgcggcttagttatgatgagagaagcccaaaaatagcattttctccgaacaattttcgatttagagcgactttttagcacctaaaaacacctaaaactggatttcggtcaagcacctattttggcatttttcgagttttagcacgtattttggcctttttccagaaatttcatagcaaaaatgcaataaaattgaaaaacacaccccctaagaacctgcccaaaaaattgtttttaaatatacccctaaatatttaccaaaatttcagaaaatattcccctaagaaacaaaaaatttccccaaaaattcatccacaatatttattatttattttcttgaccaattgcaattgtgtgggcgaaattgataaaaaaattagtcgcttttggaatttttgtacataaagacactggatttttccaatttttaacacctattttcgcacctattttgggatttttagcacctaaaaatcccagccctagacataacccgttaataacaatttttggcatagtatactgtttgaaattctcaggtttttgaaaagattatcactatttcactatg

SEQ ID NO: 113096 - DNA, 56 bp, Heterodera glycines
  Promoter: Source sequence=SeqID_16741; Location=1064..1119; Strand=-; Gene=SeqID_81152
agttcgttcatccaattcgttaatattttcctaattttattcacttttcaggtatg

SEQ ID NO: 113097 - DNA, 306 bp, Heterodera glycines
  Promoter: Source sequence=SeqID_19364; Location=1726..2031; Strand=-; Gene=SeqID_84095
tccgctcaaccttacatctaattcattgaaaatatttttttacaaatattttattttttttataaaagaaaaacaaatttggcacatttttgatggtgctgctgaccattggcacccccacaaataaaaatgatgcaaacgaataattcaccttaatcacatttttaagcttaaaagccagcaatgtaaacaaaattccaccttgcaataacacttataagcaaagattgagcaaatgaatttaaaaaaatcattttcataaaatttattctcttcccataaaattttcattttccttcaaaaatg

SEQ ID NO: 113098 - DNA, 191 bp, Heterodera glycines
  Promoter: Source sequence=SeqID_24857; Location=1..191; Strand=+; Gene=SeqID_55602
gagaaaagtagcaaatacctagtttcataagataaaatagttcttacagattctttctacaaatcattcgacaaataatgacttacaaaaacgtggaacgccaatttctgcaatgattcctttgttcagagtgatttgctttgcacttgaagaaggcgatttgaaacatgtaaaaaaggcaattaccgatg

SEQ ID NO: 113099 - DNA, 132 bp, Heterodera glycines
  Promoter: Source sequence=SeqID_6296; Location=130..261; Strand=+; Gene=SeqID_61061
ggcacgaatattttagtccatccttttagttcctgactgggtttacacctaactcattgtcagaatactttggcggaaaaggacctaaacaaggacgggaagatcgacctcggagagtttatgggagacatg

SEQ ID NO: 113100 - DNA, 462 bp, Heterodera glycines
  Promoter: Source sequence=SeqID_9373; Location=1366..1827; Strand=-; Gene=SeqID_71142
cctggaagaaagagtggaaagatcttgttgatcagccaagtcattaggctgattattattaataatgaatttgacaaaaaaataatgtagatttatttggtaaaatgaaaaattcaagcgatggaacccggcggtgccaataggcgccgggggaaaaattttgaaaattttaatgaaatttgtcaacaagttttaactcaaaaatttcaaaaataataaaaaataaatatgaacatttttttgacattgataattttttttgtgaaagtacattttttaaaaatagactgatttgacccttatttttcgacacattaattattttctaaattttaataatggcatttttcccacttttgggttttcattaggcatttcataacgcaccaatggacgaacacatcgaatcacgcccaaccaatcgtaatagacgagcccaaattgggcgaacagctcggaatg

SEQ ID NO: 113101 - DNA, 904 bp, Heterodera glycines
  Promoter: Source sequence=SeqID_14409; Location=1607..2510; Strand=-; Gene=SeqID_78447
cctgaaaaatccaattaacatgatttaaatactacttgatgagagaagcacgaaaatcacattttctccgaacaattttcgatttagaacgactttctagcacctaaaacacataaaacgggggctagcacctattttggtattttcgaaaactttaagcacctattttggccttttttcagaaattccataaaaattgtaataagaacgaaaaatacacccctaaaatcgatcctaaaaatttcagaaaaagacaaccttaaaaattgaccagaaattcagaaaatataccctctaagaaattaaaaattttcgcaaaaatgtgtctccaaaatttattatttattttcttgacaaagttgcagttgtgcgggagaaattgataaaaaaaattagttaacttttgggattttttttttgcataaagacattggagtttccaatttttagcacctattttgcacttttttggcttaacaaagtatgaaaatttggcttctcttcagtttctttagcttctttccaatctttttcttgttgttggctccataacaaggcgatgattttatgttttaaaaattctaaattttagttcacaattttatgcaaaatctcacatgctaattattttttatttgtttttttgttacattttgcatgaaattttattgtggtaaacaaaaatagagataagtaatttaaatcaaaacaataataaagattcttcaatttaaaattgatacatttatcaaaaaaaaaccttcccaatcaggcccatcacacaaaaaactgattcaatttcaattaataattcaagaaaggacctatcatttctcaaaatgggggaataacaatttcattctcgtgctccattgaatgaaaaagcaaattttaaggaaaaatg

SEQ ID NO: 113102 - DNA, 137 bp, Heterodera glycines
  Promoter: Source sequence=SeqID_10107; Location=1798..1934; Strand=-; Gene=SeqID_73188
tttttttacgttcacatttttggttaagctagtgaagcgagtccgccatgaaatcgaattgctgccgccagtgccgctaacgcttcagtcctccattgtttcgtcccgaagaatgaagtgtgcatgagcgcacaatg

SEQ ID NO: 113103 - DNA, 129 bp, Heterodera glycines
  Promoter: Source sequence=SeqID_13615; Location=2874..3002; Strand=-; Gene=SeqID_77520
ttcatttatcgcattcgttcgattcgttgttaatcctctgattgtgacttttattcagttatttggttcgtattttaatttcttataaattttgactattatttttactcgcagcgaacttttaaaatg

SEQ ID NO: 113104 - DNA, 1003 bp, Heterodera glycines
  Promoter: Source sequence=SeqID_2902; Location=846..1848; Strand=+; Gene=SeqID_82272
ccgtgccaatcctccccccacccaatttccgccaaatccctccaatggattcgcccgttcgatacctaaaatgggccaatggcggcacctcggcgtaaaactgtggcaaaatcgtcgcaactgaagaaaaaacaaaatgtggacacattttcgggcaaggatcaaacgaatgttgaaatgtgtcttctgtttttgactctttcgcacatatggcaaacatttaaaaaggcaaattacacattttccttctttctctcgttttatggcatcaaaaattaaaggatttcaaaaatttgagcgtaattggagttattctgctgcgagtccatgcattttgtgccttccatcaacataaggtgccgacgataaaatgttgttgtgtttggagaaagtgtacctctgctgagcggcgtcggcactctcaccgagagagacaaatgttagccccgggggaggcgggggcggttaagtgtgccgagggaaaagctcgggggtaggggaggggggcaagtcgaatgctgggggagggcttctccgagggtcagattgtgtttccagcagcagcagggagcagcaatggcaccgctggcaaaggaaaggcgacactgttttagcctttgggcttcacgccccccaggcaaaaacccacggcacggccgaccctcaaggcacacgaatattaaaaatgccttcctccaattgtcatgtttgcacacccatttgatggaccagcagcaaaagggttaaacggaaaagggcggggaaaaagtgccaaattattcgcgaatttggctacaaattgtgtttatttgggaaaagggtcatcttttctcactgatttgctctgcttctgatttattcctcacatctgttagtgaaatgctccaaattcccttgggcaattttcagtttatgacaaagtacgctttgggagagaaatctttgccccccccaaacgattgaccaaaataaacaaacaattaactaaaattgaccactaatg

SEQ ID NO: 113105 - DNA, 664 bp, Heterodera glycines
  Promoter: Source sequence=SeqID_6672; Location=370..1033; Strand=-; Gene=SeqID_62435
ttttcgtaccgccgttttcgtacgagtggatatgcaaaaagaaaaattgcattcaaataatttgttaattttttttaattacttttaatgttttgacagttaagcttttattaactacaaaatgaaccagcagcaagtaattaaaacaaaactaaataatgataaattggtgcatgatggtgcatagaaaaagaagtatcgcgatgccgacgcacggattcttcgtcgcgtcaaacgctataacgatatcaataacaatattgtccctcaaaatgatcacaattatgccaatgccaatgtcaatcccgaaaaccttaacaattttctcgctggtattttccgaaattaatagatgcgacctagtttgtcccggattttgttattattataaagttatgaattttctacaaaattttatgaatgggaaacaaaaaatgataaattttggttttattagttcttaagtttttctatttgaatctgacgcttgtacaagaactcgtacgaaaatgtcccccgtacgaaaacggcggtacgaaaacgacccccctgcggtacgaaaacgtccccgtacgaaaacggcggtacgaaaacgacccccctgcggtacgaaaacgtccccgtacgaaaacggcggtacgaaaacgtccccggtacgaaaatg

SEQ ID NO: 113106 - DNA, 64 bp, Heterodera glycines
  Promoter: Source sequence=SeqID_42093; Location=687..750; Strand=-; Gene=SeqID_70075
aagcgaattgacaacagcgacagataaaaactttctccaagtgccaaaacgaccttcaaaaatg

SEQ ID NO: 113107 - DNA, 443 bp, Heterodera glycines
  Promoter: Source sequence=SeqID_23683; Location=1099..1541; Strand=-; Gene=SeqID_54379
ctttatacaatttcccattgattctttcaaattacatttgtttctttctgttctcctcctcctttttaggtcatcgttttgccgtaaattgtttaatcctttcataattataatattaagttgaacaatcttttattaggaagtcatttttcaataaatttattttaatcaaaaatattttctataaaaaattgaaattcaatttttactgccataggcattttgttaaaaatgaataaaacaatgcgcatcaattttgtgccattgtcttcccctgaccattttgtgatttcgaattttccaaaaaaaaaaacagaaatgaggggggggggggctttgacattaaattattcattgtttttggcatggaatacgattaattatcttgtagaacaaaggcatttagccgatatttatctacgatttcgactttgcctatcatg

SEQ ID NO: 113108 - DNA, 111 bp, Heterodera glycines
  Promoter: Source sequence=SeqID_4695; Location=2643..2753; Strand=-; Gene=SeqID_55433
agtttgcttccctgtgattttagcctgttttttttgttgctttgtcagtttttatttgttccgcgcttggggaagagttgggacggtaattggaggaacaaaaacgggatg

SEQ ID NO: 113109 - DNA, 118 bp, Heterodera glycines
  Promoter: Source sequence=SeqID_9965; Location=1486..1603; Strand=-; Gene=SeqID_73006
ttgccttttcgtttttaattctgcgcagcaatcatatattgtgattcgatatttttttggatttttacccgttttaaatgcttacaaatattttatttagaatatgtcgaaaaaaatg

SEQ ID NO: 113110 - DNA, 293 bp, Heterodera glycines
  Promoter: Source sequence=SeqID_41269; Location=1222..1514; Strand=-; Gene=SeqID_69436
tgcgctaggttcgatgaaactttttaaaatataagcctcccccgtgtggcctgtttaaaaaggaattaaaaatttttaacatatttattcatctcccttttgatagaaaaaacatcagagagccttaattaacctgtaaataaagttttgtgtgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 113111 - DNA, 1003 bp, Heterodera glycines
  Promoter: Source sequence=SeqID_621; Location=812..1814; Strand=+; Gene=SeqID_57658
ttcacattcattactaacttctcttttttttttgctccccttttcccatttttgaattcctaagcgaaattttttttacattcgattagggtatcttaaattcctacataatttgttaaatacatatgtacatacataaacacacaaacaaatataattagctaattaaataattaaatttcatggtacttttctttttagacactccctgatgctttgtcatggacagaaattttgttgaatccatatgtaatcttgatcgtataaatttcgcttttccttaaaggatttggattgggaattttgccctagtcggacctttttaaaatatggggatcatcttcccacctaatccctgcgtttttcccattttttaaatatcttcgtggtcagtacgtagcgtaagccggtccttggtcatcaacaatttgccgaacgcccaactcaacggcccgcccatggatcagcttgtccgacggatggccgtataaaagaaagacgaatgaacgatgctcaccttcttccactaccattttccaaagtccaatttctttccccaaaatttccttctgctatccaattttcaaagatcgtattcaagtgatcattttcatttcacatttaattttcttggtgtgtaataaaggttttgcgttgtaaaaccttcttgcgttcaaagcaattgtgtgccatcccggccactcgaactccctgacattctcagggacggtcttaagccgatccggcaaattataataaaataaaaccaaaacaaaaaaaatatttttccaatcacttcattttcacataaaattttcatttcccaaaacgaatcaaaagttttggattcagccgcctcggttgacgtctgttctttaaaccgggtcagacgaagtcgaaacaaccgcagtcagcggccacagattaagagtctggtgctcttagattcgacagcattttcaaaattccgccaaaaatcataaaaaaggtccaacgatcaatg

SEQ ID NO: 113112 - DNA, 90 bp, Heterodera glycines
  Promoter: Source sequence=SeqID_23345; Location=1..90; Strand=+; Gene= SeqID_54058
cttgctttcattctcatttctcctccgctccttcatttttttcatttttccatttcctttttcaattttcaatttttctttttttagatg

SEQ ID NO: 113113 - DNA, 171 bp, Heterodera glycines
  Promoter: Source sequence=SeqID_13149; Location=1..171; Strand=+; Gene=SeqID_76962
atccatggccattcttctcaaccgcagcaatacgtttcgtcctttttgctgaaaatacaaacgcaatatcatcaacagaaaagagacggaggtcatcaacagcaagaggaagccgaaacagtatcaggagaacaaccgcagcagcaaacgctgacggatgagcacgacatg

SEQ ID NO: 113114 - DNA, 279 bp, Heterodera glycines
  Promoter: Source sequence=SeqID_7847; Location=4613..4891; Strand=+; Gene=SeqID_66146
aacttatttcttgaagatttcaaatcatttctgtcattaataccgactaaataatccactcgctcctttgttgcctctttgtaaatttagccctgtttgcacataaccgaaaattggtccaactatccataaaatttatggcatataattacaacctataattattcgtttttaattatattttaaaattttgcaatttaaataaatttttaaccaatgataaattaattcattaataaaatgctaaattaataatgttttttaaaatttttagagatg

SEQ ID NO: 113115 - DNA, 154 bp, Heterodera glycines
  Promoter: Source sequence=SeqID_3755; Location=419..572; Strand=+; Gene=SeqID_51740
ggtattaatatgatggaattatctttttttttgtttcgttttcattgcagaagagcacagagtttctctgacgccatccgctgctgcaaatttggtcaaaaagggcatgaaagtgcaggttgagcaaggggctggtgtattggcgtcagtaatg

SEQ ID NO: 113116 - DNA, 200 bp, Heterodera glycines
  Promoter: Source sequence=SeqID_28692; Location=290..489; Strand=-; Gene=SeqID_59276
agtgggttttgattatggcattcagcagctttgatcaaatcagtgctttggtcaattcaacccccccccccccccccccgttttaaggctttttggaggaccgccaatgcgttaattgcggtgtcactagcacacccttgtggaggcgcgacgcccaggggcattatttgtgcaacgcttgtggcctttaccaaaaaatg

SEQ ID NO: 113117 - DNA, 132 bp, Heterodera glycines
  Promoter: Source sequence=SeqID_12343; Location=273..404; Strand=-; Gene=SeqID_75939
aaggataattcaaaatcaataaatatagaaagctcttataattcgtaatttatatattacatgtaataaaattgcccacgcataactaatttacatttgaatttacatattttttagattttttaataaatg

SEQ ID NO: 113118 - DNA, 255 bp, Heterodera glycines
  Promoter: Source sequence=SeqID_42236; Location=1..255; Strand=+; Gene=SeqID_70183
tgcgttggatttttgctccccataattgcgtgagtaccccaaacggacacttgaataaatcgatttttttatttcataaatattttttcagaaagtgctctaaagcgcaccaaattttatttacaagttaattttagcactctgatgctttagtatcaaaaaggaagatggagaaaaatttttttaaaaatttttccttatattttggttatatcgttttgcttttggtggggtgcttggaacagtggaatcatg

SEQ ID NO: 113119 - DNA, 210 bp, Heterodera glycines
  Promoter: Source sequence=SeqID_18120; Location=1..210; Strand=+; Gene=SeqID_82700
gttgaaaattgagttttgggaataaaaattaatttctttatatttttaattaaagtgcgaattttgtgggctgagatttgcgcagaaaggaaatctgaacagccacatccgcactcacaccggtgaaaaaccgtttgaggtgagttacggatttggattttttgactttattatttcttttgcaaaaaatagtgcaatttttatggcatg

SEQ ID NO: 113120 - DNA, 89 bp, Heterodera glycines
  Promoter: Source sequence=SeqID_10357; Location=1..89; Strand=+; Gene= SeqID_73537
atgccaaggacattcttatataattggtattgctttttgatttggttccttcaagttaaaaacaaacaacaataacaacaacaacaatg

SEQ ID NO: 113121 - DNA, 96 bp, Heterodera glycines
  Promoter: Source sequence=SeqID_14591; Location=392..487; Strand=-; Gene=SeqID_78662
ggttgggcaattgcaagagacctcttaactcgttaattaattaattaattacttcttcaaaggatttctgatctgccttggcaaatcaacaaaatg

SEQ ID NO: 113122 - DNA, 1003 bp, Heterodera glycines
  Promoter: Source sequence=SeqID_5099; Location=4409..5411; Strand=+; Gene=SeqID_45979
ttgcaaaattgcttcaaatcttttatttttacaattaatttaatcaaaaatcattaaaaattatatttttcgcctccaattatcatctttaaaaattttggtgaggaaattaacaaatcgtaaatttcagtgcactcgggatcaaaaaatcagatttttaagaattttttgcggcgtatttttccaaaaaacttttgggaaatgggcgagggggagggtccggcggtgccgataggtgccgccgggaaaaatttgtgattttagtacgatttgttaacagatttttgtccaaaaaatgaccaaattttgccataaattttatatttttttgtaaaatagtgacattaggccataaaattttaaaattatgagtttgtttaagaaatcagaacaaattttggtcgttaccccaaaatcagagcatttctgacaaatcagaacagatcgcatccctgctttttggtgccttaattgtgagctcaagccataactttatggccggcggtgttgataagcgccgccgggaatttttttttgtaattttaatgctatttgttagcagattttgtctaaaaataccaaattttgagattttgggctaattttttaagaaaagatagctttttggggggtcggttgtgccgataggcgccgccggaggaaaattttaagaatttttaatgaattttgttaaaaaaatggccaactgaattcaataaattttgaatttgaacagtcgcagcggtgagaatcgttttttgatgaaaagggatggccacccgaactttattattttatgtgttattattatttgttcagtaaggccaatttaatttctgtcaaaattcattgaaaagttatgaggagaaaatattattaaaatttaatcaaatttattcagctttaatttttcaatggaaaacggacggaatggcctttataagccgaacaaattaacagaagaatatcataaatttaaatttaaattaaacaaaatcaaatg

SEQ ID NO: 113123 - DNA, 1003 bp, Heterodera glycines
  Promoter: Source sequence=SeqID_10184; Location=686..1688; Strand=+; Gene=SeqID_73298
caaattaaaactgacctgtttaaaactttccacctaaatttgatcccgcaagtggcacgtcaatatcccaattgcatataaatattccactcgaacacaggcaaaacatgagatgtagcatttatattgctttttctatccatcaaaggctttttctttcattttttattactatcataacatgctttttattcaaaacaaatatcaaaaccaaatcagattcttttcatattataagcaaggaaaagtacaaaaaacttttttaagtaacaaacctttttcattcaaacgaattctaatgcatttttttaaccaaacaattctccattatcgtttacataagcaaaacaaaagctttcacatcaaaatcaaatcaattaacaaaaacgaaaatttagacaaaaaaataatgataacagcaaacccacaaattttttcttacacacaaaaacagaaccttcatataccggattttccactcaaacaaacacaaaaatgtgctcattattttattaattattttatataataaaagatgggttataaataaggaagggatgcgagacaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgccccctctcacccgccgctgcccgcgtagacagacaatcagacagtgcactattttcccacctttccctcgctctacttttttcaaatacatttttaacgcaaaacaattacaaaacgccacacaaattcaaacactggacacacacaacagacactcaactttattatataagattttgtcaatgtccgttgccatccctcgttttaagtgcaaattataataaatacaaaaatctatctccaaatggaagacattacgacacataagtcagttcatcatg

SEQ ID NO: 113124 - DNA, 158 bp, Heterodera glycines
  Promoter: Source sequence=SeqID_22890; Location=1057..1214; Strand=-; Gene=SeqID_53598
atgggcaaaggataaatggaacaaaaggaaaatataacctgtccaagagaccacccaattggtcgaattgttcctgtaccccccatcagacccggaaaggttcgcgctctattcacttatgcgtcactttcctggagacccagacccatcttaagatg

SEQ ID NO: 113125 - DNA, 343 bp, Heterodera glycines
  Promoter: Source sequence=SeqID_5761; Location=1..343; Strand=+; Gene= SeqID_59146
aatagtaaaaaccggtaattgccattaaggatggtttaatatattttcccgagactcttgagcattttttttaaaacacaaacacctccttccattagagcaaatctcgaagcttttgtgactgattttccaataccggcaaccattaaaaatagcggtttcaatttctggaccaaaatccaggaaaatccagatccaggaaaaatccagggtgccgaaaaatagcctggatcttgacctagatcaaggaaaaattcaggcctggatccaggtcgaggccgacctctaattaccaaggcattttgtaattaattaattttcccattttcagagtcaaattatg

SEQ ID NO: 113126 - DNA, 282 bp, Heterodera glycines
  Promoter: Source sequence=SeqID_45380; Location=324..605; Strand=+; Gene=SeqID_72678
attgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatg

SEQ ID NO: 113127 - DNA, 616 bp, Heterodera glycines
  Promoter: Source sequence=SeqID_8884; Location=206..821; Strand=-; Gene=SeqID_69523
aaaaaggaaattttgaaaatgttgtaaaaatagcaagaaaggtgattttaaggggtgcatttacaatcttcttgtattttttttacaaatttttctcaaaaagccaaaatatgtgccaaacctcgaaatatgtgccatatgttttttgtgccaaaacgtcaaaatttttatgtttttatatgtaagtcgctgaaatcaaaaattgttcggagaaaatgctattttgggcttctctcgccataataaagccgcaaaagaaataaaacatgaaattcgggctcaagaaataacattaataaaaaataaaagaaaaaataatggcaaaaaaaaaactaaatcaaatgcacaaaacaataataaattaaacaatattcatctagaataatttgtctcaaaaaagcgttgttctgataagcagcagcctaagtgatcaaccgagcgccgctgtgccgaaaatgttgttgtttggtcctcgtccgcctccatctactactgcttctggttttcatgccgttgttgctgctgctgctgcttcttcggctttcgattgtgccaacaagtcgtcgtcgcggcaaatgtgttgtcgccgctggcggcgcccaacgttctcggcatg

SEQ ID NO: 113128 - DNA, 196 bp, Heterodera glycines
  Promoter: Source sequence=SeqID_31879; Location=1540..1735; Strand=-; Gene=SeqID_62187
ttttcgaaagagaaaacatttagaaaataataaaaaagaaatatttgcaatgttttaagggatgcaattttaattggatcgatattcaatttaagatttgccaatcacttccaccaatttagtgacgacaattatttaaaaattacactctcgcaaaatcgagacaaataattagagaccggaattctcaaaaatg

SEQ ID NO: 113129 - DNA, 250 bp, Heterodera glycines
  Promoter: Source sequence=SeqID_19436; Location=880..1129; Strand=+; Gene=SeqID_84159
tttcccccatgttgtttcactgcttttccaaccattttttttgtttctatttttctattctttttccccattatgtttcagtcccaataactctcatcatcgattcccattgcgtctcatcgattttccgttggtcatttccagtgtttttagtaaacaaaaaaatccacaaacttatttacttttttcttataaaatttcttgtttcttttttctcaatttacattacaatctgaattttataaaaatg

SEQ ID NO: 113130 - DNA, 195 bp, Heterodera glycines
  Promoter: Source sequence=SeqID_14040; Location=376..570; Strand=-; Gene=SeqID_78017
ttttacaatttccgaaattgtcgtgagaaaataatttttttaaatcttatgctcttttttattcgttgtaaagctttccccgggaaaaaggaaaggcttaagctgaaaatgacaacagcagaaatggaaaaacagtagaccaatagaaataatctttcatggttttaaaagattaaatttcagttaaaatttatg

SEQ ID NO: 113131 - DNA, 596 bp, Heterodera glycines
  Promoter: Source sequence=SeqID_8618; Location=1..596; Strand=+; Gene= SeqID_68693
aaaagccgatcattagggggtgtaaaaaagtctcggtctcgagtctcgaaagtctcaaagaccgagaccgagactgaaaacccgagaccgagactcgagaccgagaccaaaaaaaccgagacttttctcgagttgagactcgagaccgagactctcgaacatcactagtagcgactaatcactgaactgctgcaagcactgcttaagcagcgtatagggatcagataattgtcgggacattggcaggtgctaaaggaatatgttttcaacaatttctgaagaaataaacatgctttgtattaagttcccggtcccgggttttgaaaagctcaggtcccgatcccggtcccggcaatttgggccggaaaaacgggactaaatttcattaatgaaactgccccaaatttgaaaaaattaataattttgtggcgaaatgtctttagttcaaagtttaaagatagaactgagaaataaattcagattttgatacatacataccattattttttattttgaaatccttaaaatgtattttagaaatgaatacatcaatctggaaaataggtttatttgaaaagtcaaaggatggcaaaatg

SEQ ID NO: 113132 - DNA, 140 bp, Heterodera glycines
  Promoter: Source sequence=SeqID_27972; Location=1..140; Strand=+; Gene=SeqID_58632
ctctttctccctcccctttctatctctccctcccttttctctcattctctctcactctccgcccctccccatttattccgttctctcaggtgaccaatattccccaatctgtcgacccggacggtcttttgctgacaatg

SEQ ID NO: 113133 - DNA, 851 bp, Heterodera glycines
  Promoter: Source sequence=SeqID_15096; Location=2758..3608; Strand=-; Gene=SeqID_79273
gaatataaatgatcagcaaaagagagaataattttacaatttgatgcaatcaaaaaaaaattgaagcaaaaaggaaaatatgaaaacaaaaaccaaagcaaaattgagagaaaaattgcacaattattggggacaaatagaaaattaatacaaaaatggaaaaacaaattaaatttaaagaaaaagaacagaatgaaaaagagtttttatgagatgaaaaagcgcaaattcattgaacgatttgatgaatttagagaattatatagccaaggcaaacaaaaagaatttgtgaaggaattgggcatttctgacattgataaaatggaaaaaagaattgttgccaaaagacaataaaagtaagcgaatttctaactttttaaaattatttattattttcagcgctaattaaaccttcaaattatgacaaattaaaaaaagatgaagcaatattttgaaattaaaggaaaattttaattttatttgtttaattaattaaaaaagcaatttacaacatttgttggatatgaagccaattatggtcaattaattatttttttgaattatgtgcccaaaaaaaaatcattttgagtaaattgctacactttccttttaatttattttttccataaaataaattattttataaattattattttttgcaataattatttcttaaaaaatctgagtaaaaaattgatttccatattatgtataaattacgtcgtgaatcacatattaatttttaaaatattgttgaaaagaaaaataattgcgtaataacatttaatgcgaataaaacattaaataaattcatttaatgcaataaattcaatttccaaaagtaaaaatg

SEQ ID NO: 113134 - DNA, 394 bp, Heterodera glycines
  misc_feature (23)..(23): n is a, c, g, or t
  Promoter: Source sequence=SeqID_1788; Location=1..394; Strand=+; Gene= SeqID_75975
gatgatgatgatgatgtgtgttnggcgaaatgaatgccgaaaaaatttggctataatggcgaaatgttaaaaaatggcacagttaaaaaattgatcaacattggatcggtgatcagactattttatgtgatcaaaaataaatgatttgaggtcgaagattggttaaaaaagagggcgggggattatgctatatttttattgaaatgccgaaaatttttcaaaaaatcggatttttatcgaaatgatcgtcatacagtaatgctaacgaaatctatgtggcctacagtaaccatcaacagtgacataaacaatttaaaataaataccaaagtgccaaatctataacaattagcttcatgctgcgaccaatgggtgtaaaaaagcgccaaaaaatg

SEQ ID NO: 113135 - DNA, 84 bp, Heterodera glycines
  Promoter: Source sequence=SeqID_11370; Location=429..512; Strand=-; Gene=SeqID_74761
agtaaacattttattggacacataaccgtaaaattctactcgaaaattaaggcgagactcgagaaaataagcgacgggaaaatg

SEQ ID NO: 113136 - DNA, 473 bp, Heterodera glycines
  Promoter: Source sequence=SeqID_2217; Location=2406..2878; Strand=+; Gene=SeqID_78525
tttttggcgacaaaaaatgtgtgatggcatgtcccctgaggacgaaaatggggagggaattgggagacaaagaaagcaagagatggacatggacaccaactactgaatcaccattttttgatattttatttacaacgttcagtctttccttcctctatctctctcttttttcattcattttcattgtatctttttttttaaatttgttatcatgtttttctgtcctttgtttatgccaaatgtatttacctagttattttttaagaataaaaaatataaaatttgtttttcccatacaaaaattattggtaatgcttttttgttgttgtccatatgcgttttttcttccatcgatttgtgttgttcgttttaatatttttcgtgtccactgattttactgtgcatcgaaaggacagaaaagaaggaaaaggcgggcaaaggaccgaccgaccgaagacgccaccgccgcaatg

SEQ ID NO: 113137 - DNA, 1003 bp, Heterodera glycines
  Promoter: Source sequence=SeqID_10967; Location=2810..3812; Strand=+; Gene=SeqID_74276
tccattccaccccgcctcttatttttggcaatcataggctccaaagaccaaaattcattccgaattattcctgaaatattttgcctttctttcaaccaaacgcaaaatcatattaaatgccaaaaaccaaaagtttttctttaattattttttcccatgcctgcgggccggacaaaagaattgcttgcatgaaattgctaatgatctttctgctattgagtttgaacgttcaaatcgtagagtccccacaagaaaatcaaactaaaggaatttcagtggataaagaaatttgtgaccatttttgtgcccatccatgccagccgactaatttaatttttccaaccgaagagagaaatgcaactttgggttggacttgtgtacacctaaagccaaaaattgtccctcaaagttggtcctcatttttctcgaaaaatgcttggacaattggcggcatcatttttactattgccggcatttccttttgtgtaattcgcgcatatttgtggtcaattgaacccgattcaattgaaattaatgtttgaaatttcttttcaaaatttgcaatttccccgcttttgactgcgtttttaattaattccatatgaccaaagttttgcagtgcccccccccccccattttttttctctccgtgccaaatatggcagccgacggaaagcaattcatctcccgtcccctctcccgttttttgctcttccccgtcgcgacattagctttttgcggcgatgaatctcccctgccgctcgggagaaaaacgttttttgccttttttttcccattagctcgccgctgttgtaacatttgaaaaaataaattgcatttttgctgtaacgcccatcgtccactcggacccgtcgttatttaaggccggctcatccttcagaaaagccatttcttgccttcattctcacttttcctccgctccatcattttttttcatttttccatttcctttttcaattttcaatttttctttttttagatg

SEQ ID NO: 113138 - DNA, 1003 bp, Heterodera glycines
  Promoter: Source sequence=SeqID_5054; Location=1700..2702; Strand=+; Gene=SeqID_56740
tatatatatatatatatatatttatatacataatcatatgagttggcggttttaagaaacgcccaaagtggcggttttaagaaacgcacacctggcggttttaagaaacgccctggcggttttaagaaacgcccaatgtggcggtttttaagaaacgtcccagcaccaacgaaaacactatactgagaaaaaatatccgggaaccgcactttctttttatggataatatcaatcccgcattccgtgttttcaaatgctcatccagcttcatccatattttattatgtgctgttattagatgattagagcctataagtcagtcactcagatttgtttgctgcgcaacttaaatttatagaatagaaattttttgggattcctgtacataaattgtacaatctttttatttatttaaaattgcatttttaaattgtaatgtaaaaatcaatcaatgcaatcaatgcatacttctaaattgtatagtaaatacgtcatttgcacataatgcgcttcattaaaacacgtcaattaagcctactctatttgttgaataatgccaattgtggccctctcaaagtgcctctccccatgtttcatgccaattttgcctctccccacaatgatgccaattttgcctcacgccctctctatctctccctttctctctcactttctctctctctctctccctttctctcgctctctccccgatgccatttttgcctctccccatgttttcgtgcaaataattttgcttctttgttgtcaattttgcatgcctctttcctcttgtttcatgccttatttcggccctctcattataatgccaacgtgtgatttattgaaaaaattctctgcaatataattttgcataaaagcaaatataattcaatttggcatcatttttttgttgctcattttggtgatattgaaagagattcttttccttacaaagctttaaaatagtaaaaaaaaatttagatttttttttgaaattgaaatg

SEQ ID NO: 113139 - DNA, 305 bp, Heterodera glycines
  Promoter: Source sequence=SeqID_333; Location=1..305; Strand=+; Gene =SeqID_82791
atggaatccgtttgcatcatcccaacttgccgtgtgtcttctaatttggaggcggtgatcacaaaacctttttcccgcttgaaattctcactattatgttttagatgtttttcattatttaatttttgttgtttttaaaataaatttgttgcgtaaaatttttgtccattttaatttagatgaaaatttcaaactgtactgttatttttaaaattaattccttggacacgcaacagtttttggctattgcacaacgtggaattaatacagaatataatccacgccgtttccacgcaatcatcatg

SEQ ID NO: 113140 - DNA, 201 bp, Heterodera glycines
  misc_feature (21)..(21): n is a, c, g, or t
  Promoter: Source sequence=SeqID_13705; Location=2477..2677; Strand=-; Gene=SeqID_77622
tgccgaaggaattcaatactnttgatttaaaaaaagtgtgtttagttaatcattccttacgagatttgcgcactcaaatcggcgaaattagaagtggaaaactcaagaaatctaaacaaaattgacaatgaaagtcttaaaagtaattatacacaaattctcagcggaagtcagctgataagaataattgcaaatgcaatg

SEQ ID NO: 113141 - DNA, 108 bp, Heterodera glycines
  Promoter: Source sequence=SeqID_23872; Location=1327..1434; Strand=+; Gene=SeqID_54559
ttcttcctcatccctttcctctcccaaatgtgcccaaagattattcacctttttgcccatttaaaagttcccattttccctctgtttttagcacatttttcaataatg

SEQ ID NO: 113142 - DNA, 484 bp, Heterodera glycines
  Promoter: Source sequence=SeqID_8175; Location=672..1155; Strand=-; Gene=SeqID_67211
ttcccggcttttaccacgtttggtacatcggctgcactctctgcggacggcccggctacagtttcgagaatttgccaactttcacaaagcccaactttccctactaacaataaataaacaatgtccagtacttctcttaaaattcggcaacacattcgagattttcatttttaggtttattttagcgataacccacaaaatattaaaaaacaaaataatgtgaagattaaaaaatgaagttgaaattgtcggaaatgtaagggcagagagaaattaaaagagagagagaagtacttaccattggcgtagtcaatttaccaatgccttttgcagtgaaaatagagcttttggatttaaatacgaactaaaattggaaatcgactccatcttttgtcggccaatttacccttcaattggtcatttgacccttctgatcatttgtccgccaatgatatcaacatctttttttttctacatcagaatg

SEQ ID NO: 113143 - DNA, 874 bp, Heterodera glycines
  misc_feature (6)..(6): n is a, c, g, or t
  Promoter: Source sequence=SeqID_16376; Location=1..874; Strand=+; Gene=SeqID_80764
aataantttgttgaatttatatttataaaattgtcgttccctttttataaaataaaattgcgaaattctgaccagacaattctccacatattctattagcccatcaatttcaaacttttgttcatttagtacaataaaattggtaatgagaaggaattaaattttgaaataaatgagaagaacaattggtcccataaaaaaatacatgagggaattcaaattttaaaaggacaaacggacattgtaagaattcggaaagaatttgacgccattttcttaaaaaaattttgatttgtccacaaaatccgtgccctttcctgatcaaatcatttgctttgttcctgtttatttaagggcattccaatggcatagggagtaaagaaaaaacaaaaaaaaacagccaatttgttttgaaatgcaaattatgtctctaaaatattaggtcattaatactgatcgcgaatctgaaattctaatcgttgttgccctttcccacgtattattgatctgattgtgaaggaagaggtttgacagcaaccgagttttgctgtgtcatcgctgaggacggcctgcatttgtttattatctaggcgataataaacaactttttgttggacctgctaacagtttgacactgttagtagtgagaaattttgcgccgctgattttgtgtcttggcgacacatttcagttcatccacgcgcatccactctgtttagtagcttggcgctgctaacaattgagtggcgaacgacacgtcatttaaaacgagtactctcgagctgaagggaaagtccacgagctgtggttaagatgggcgacgcaatccaacaactcactgcggcaatccagcaattattggcaaatcaaaatg

SEQ ID NO: 113144 - DNA, 60 bp, Heterodera glycines
  Promoter: Source sequence=SeqID_14646; Location=885..944; Strand=+; Gene=SeqID_78741
tctgaacagtccctcaattcaataaaacattatgaattgcattacctccaatttcgaatg

SEQ ID NO: 113145 - DNA, 352 bp, Heterodera glycines
  Promoter: Source sequence=SeqID_31495; Location=987..1338; Strand=+; Gene=SeqID_61826
tttcggattttcgcacattttggaactctgctagaatttcggacacccttgaaaaaatttccgaaattttgaggcttaaaatttgatatgcaacgggacggatgtgatatgattaattacaattaatgtctttcccctcccctcacttttgggcctcatttgtgcgcctttcccttcgccgtcggcggccgacatcaaagaaagcgacggactttcacattgacacgcgctggtgataattgcgtttattcgccgtttaaaaatatttaaaaaatgtgcctctaactgttttttatttgcgcgtttaatgacttttggcttttttaattgcctaaaaacagggaagaggatg

SEQ ID NO: 113146 - DNA, 440 bp, Heterodera glycines
  Promoter: Source sequence=SeqID_40821; Location=1..440; Strand=+; Gene=SeqID_69054
ccaattggccccgtcattgctcagcgaatgtccatcacttcactgtgtctctttcaatgatggcattctcacttttccacccgatgacagtgccaatgcgtcggatggctaagcggtggccaaatggttgttcacgccttgtttgtatggtgtgccgaaggtgatcagatgctttgtgaattcaccgctggatcaatggtcgtcaacgatagaacagattaaagcggtgattatccttatttaattaagctttctatgattttttgtcccatttttaggcattttccaatgcttctttggttactttttgcattcactttctaatttcttctccgctgtgctatttgatcggatcaacgaagtgacttgggagcaattgacacttcaattgttgcctcttccgttgtctaattgcacgggatggaagaaattggaaaatg

SEQ ID NO: 113147 - DNA, 152 bp, Heterodera glycines
  Promoter: Source sequence=SeqID_5287; Location=772..923; Strand=-; Gene=SeqID_57578
tagtggacccatagtgttgctacctaattgtctttttttataagcagtaattaaatttcttaatgtgttttatgcaataaatttttaaataccaatttcagagcaaaaaaccataatattccttggttctctacattttcctacacaaaatg

SEQ ID NO: 113148 - DNA, 741 bp, Heterodera glycines
  Promoter: Source sequence=SeqID_27320; Location=1..741; Strand=+; Gene=SeqID_58002
gctttctgatctgatcagcagtggtcgatcacttccctcactaagaaccaacgatagaagtttcttctccaaagcattcctgtaagtgttttacttgggtatattacatatactgtagaatagatatcccctacaaattaataatgtttttttagtcgacccaacaaaattttgcttcaatttggcaccgtaccactgccaattaggctgagaaagcattggcaaaaatttggcttcgttcatgccagaaaatatgacagaaattgtaatttttaaattaaaatagatttataatttttcaatttatttaggctttttctctcctgttcagtgcatgttgttattcagagacggctccaagctgaaggacagtcatttgtttcggcacttcagccaaccgaacccattttcactttttattttctcgcacattctgaagccagaacaatcatataagccaagaaataggccactcagaaatcagaattatcttttcgattttgcccaataattcttttaaaaaggatagattttcacagataaattttatttgtaatttatttgtacagcttcgattttcattgtatgaataaaaattatcaataaattttgttaaaatattcaaaatgcatttttttgtagtttttttggaaattttgaggctttttgtgatttatagagaaaagcagcctcgttactgtcaaaatattgttaacaaattacattaaaaattccaaaatg

SEQ ID NO: 113149 - DNA, 1003 bp, Heterodera glycines
  Promoter: Source sequence=SeqID_8957; Location=1850..2852; Strand=-; Gene=SeqID_69807
taaataaaacaaatattgatgcacaaatctgaagcctcttcattgacatttataacagaattgaataaaattataaattgtgaaataaattttttttcagttgaaaagtttaaacaaattcacacgaaaaaaatactaaaacttaagcaataaaggtaaaataaaatacttatttataacaaaatgattaacaattaaagaattttaaatatttataaaattttattagactcattctcagaagggcagggactcagagtctggaaaatatcaatgtccgaaattaagttaaaaagaaaattttaaaaaaataaccaatagatgtattcttataacaacgaaaaaaaagtattagaaattttcaaaataaatttattgaaaaagtaaatgttgccatttagtaaactatttaaatttttgtaagaaataacatttgaaataatatttatttaaatattttagtttggaataacttaaaaaattttactttgaattgccagaacttaacatagaaataaataaattttaaattttctcgctagacaaaaaaaaaacaaattaaaaataccagtatattggaaattttggctacatccagaatttcatttaaaatattcatttcttctcttcaacaaatatttatttgttatttttggggggattttggacagttttaaaaaattttaaaagataaaagattacaaatagaaaaagtaactaaaagatatattcttataaattatttacactaaaaaagcaaaaaggactttgtcaagaaaataggtgagcatcagggatgggccaaattgaaaaataaaaagcaaatttgcgaaactgaaaaatgcgaaatgaaaaaaaagcgaaatgcgaaaagccaaaatatgcgaaaatgcgaaatgcgaaaagcgaaattttttttaaaaattttaccaatagctttttaggttgtgatgcaaaaaaaatctgcattttccggttcgatctttttctcagataaaaaatg

SEQ ID NO: 113150 - DNA, 142 bp, Heterodera glycines
  Promoter: Source sequence=SeqID_2187; Location=1510..1651; Strand=+; Gene=SeqID_78363
aattattgtttttttttaaatttataaaaaatgtgaataaaatattaaaaaatttaatggtgtattttattaaaaaccctagagaaaccggaataaaaaacatctttaagattagttggtgaccataaacttgtttgtcatg

SEQ ID NO: 113151 - DNA, 375 bp, Heterodera glycines
  Promoter: Source sequence=SeqID_2303; Location=1080..1454; Strand=+; Gene=SeqID_79004
ttttatgccattttttgttttgttatttatttctatgtaaagtgagacataacacatataaggaaaattatagaataaattggggctaatttttgatgttcttgcgataaaacccaatgaaacattagaggatttagtctatgaatttatttttctattttaacaaaaatttatattttttaaataaaaataaaatgattcgttaaaaaattaaattttatgccaaattatgaggtcaaaggctatcatttcgtcatctttattcaggaaaatccatatatattaaaattaacttttaaacatatttttcttatttttttttgtttattatatttaattcgcaattttatttggaaattttaagctattcaaatg

SEQ ID NO: 113152 - DNA, 110 bp, Heterodera glycines
  Promoter: Source sequence=SeqID_44342; Location=920..1029; Strand=-; Gene=SeqID_71841
ttgttttctacggcgactaagaaaataattcctggattggcgcccgtaattaaaaatatttaagtatttaaattgtttaatgtatataggtggaaaaaaaagtattgatg

SEQ ID NO: 113153 - DNA, 621 bp, Heterodera glycines
  misc_feature (13)..(13): n is a, c, g, or t
  misc_feature (65)..(65): n is a, c, g, or t
  Promoter: Source sequence=SeqID_17821; Location=1..621; Strand=+; Gene=SeqID_82351
aaaaaaaaaattnttatcatttcagtaaatctcattgacctattaagctgaatttttttaccatncatatcttccaatatttaagaagtatacaaaaataaaagtatagaagaaatatttttttatgaaatttttaacgtcatttgatcctaatttgctgtttcaaaatatagaatcaaaatttaatgcaactgttttctgcacttgataaaaatgtagaaaaattcatgcctataattttcgatgctgatcaaaaaagtcaattgcattaaggtggtgcaattgacttttttgatgagcccaattagtgatactagtatgaatttttatatatatatttttttgctttttaaaaaagtttgatttttttaaaattttgattctataatttggaacagcaaacttggactattttcgtgaaaacacgttaataaaatttttcttctacaatttcattttgtctgcttcttaaatttatggggaagatataattggtaaaattttcagcttgataggtcaatatggactaggtgtaatgacaagaacagactgtatttaatttattagtgttaaatacatcaaaatttaaaattattgtaaattaagctccgtaacacaatg

SEQ ID NO: 113154 - DNA, 73 bp, Heterodera glycines
  Promoter: Source sequence=SeqID_20006; Location=2176..2248; Strand=-; Gene=SeqID_84780
atttgggacatttttgttcgtgaaatttggcccattttttcgacaaacattcaccgtttgcgctttaccgatg

SEQ ID NO: 113155 - DNA, 92 bp, Heterodera glycines
  Promoter: Source sequence=SeqID_2208; Location=2466..2557; Strand=-; Gene=SeqID_78483
cctttaaagtttaaatggaattcttatgttaagagaggaaatggcacggactttctcgtgtaacttggcaaaatgaagaagatccaaacatg

SEQ ID NO: 113156 - DNA, 137 bp, Heterodera glycines
  Promoter: Source sequence=SeqID_14535; Location=2674..2810; Strand=+; Gene=SeqID_78588
tttctcttccgaaaatttgaatcgatcgatcaattttgcctcaggcaattccattcaccggaaatgatcagctgcgtcatcagcctcagaatggcaccgttggcacatcagctggtcttggaaatccatcagcaatg

SEQ ID NO: 113157 - DNA, 338 bp, Heterodera glycines
  misc_feature (175)..(175): n is a, c, g, or t
  Promoter: Source sequence=SeqID_30155; Location=1035..1372; Strand=+; Gene=SeqID_60589
aactataatttttttttaaattcagaaaatcaaatcatattaaaaattataaatatattttttcaaaaaaataataatattttcgccaaaatttgaatttttaaatgagtttgtgaaaatatttttaacatttttatgaggaagtttttgcttacaaaaaaaaaagaaaatttanatatctttcattcggttttttgtcaaataaatttttgctgaaacaacaaatactaaataattaaataaaataaaatttagatttttatgattggcatttgtatttatacaagcaattttttgcgctgcattttttggtagcagcaaaagtcaaaataaagatg

SEQ ID NO: 113158 - DNA, 168 bp, Heterodera glycines
  Promoter: Source sequence=SeqID_22204; Location=916..1083; Strand=+; Gene=SeqID_52866
aactgggcaattaaaaccaaattaattaattaattaattaaatttgtaaagaaattaattaaataaacaacaaattaatttcctcctttctcttggttttcatagattcgatcattgctcaattagccttctattttctcgcttaaccccctttttcagaggggaatg

SEQ ID NO: 113159 - DNA, 714 bp, Heterodera glycines
  Promoter: Source sequence=SeqID_2343; Location=3755..4468; Strand=-; Gene=SeqID_79234
gctgaaaaattagtaaaaataaaagtgagtaaaaatgaaacaaaactgagaaatagcaaaatcagtggtgaaaaagatcgatcagatatttaagtgcaaagcggatcactgggaataaaatggtggggagagggagaattatttgatggctaaacaacacgccccatctcagaatgggcggctgtgtgttaagcgaagaaatgcggcaaaaaccaaagcaaagcaaaaggcggattttctggccgtttctcctcatcaaaattccgtaacaaatgttgttgcacaccattttcataattcaaaagaaagcgacaacgccacaaataaaatgcaaaatatattattaaaggacggtgtggaaatgaaagtcgatagaaacaaataattttaatctggcaaacttaaaataacattaaaacttcattgaattcatctcaatttccaacaggttcaaaccaaaaaagtgtataaaaaatgatttaagccaaaaaaaaaattgggtccttcccataaatgctgcgctaattagtattgaaaggtaaagttcgaataaaaatcaatcaaaacaaagggaggaacccggagtccttccccttttgtccttttctttgtattcagggaattcatttaaaataaaaaccaactccttgataatcgttttcggaaagagacaccgtgcgatactaactggaggccaatcagataactgaaatg

SEQ ID NO: 113160 - DNA, 265 bp, Heterodera glycines
  Promoter: Source sequence=SeqID_13345; Location=3456..3720; Strand=+; Gene=SeqID_77213
aaaatgcataaaacgggaaggagtgaagacaattcttaaactcaatgatggacgaacacttttacattttcaatggcaattgttaaagttgtgcaaataaatgagcagttttgtaatgtcctatttttggcattcgtttggcgttttgctgtgcgtcattttcaattttttgctaatcctccaatcatttaaattgttttttttctttcgagattaactaaattcaatatcaatttgtataactcacttcaacagaacaaaaatg

SEQ ID NO: 113161 - DNA, 276 bp, Heterodera glycines
  Promoter: Source sequence=SeqID_40101; Location=376..651; Strand=-; Gene=SeqID_68532
ttatgaaaaatacacataaatattctcgattatcatccgttaacagaaattaatacaaaatttttaatgaaaaattcttaaatttctgaataaaaaattcaaaaaattcgtttttcttttttttacataattttttgtttcatcagcctcccttaatcaaaaaaagcacctttttaatgtttttctgtttatttaaagcatgttataatgacagtaaattttcagttttcaatcaaacttgcccctcccccctttgctttgtactgcttgaaaatg

SEQ ID NO: 113162 - DNA, 349 bp, Heterodera glycines
  Promoter: Source sequence=SeqID_6820; Location=2272..2620; Strand=-; Gene=SeqID_62995
ttctgcgcactagaaaatgatgatcaaaaatgaataaaataaacctgaacaattaacaaaaactatatttgcttcttaattttggcgaaatgtttaataaaattcaaataaatgagtggacacaggaaacccggcaaaaaacccaaaaacccggcaaaaacccggcaatttcaaaaacccggcaaaaacccggcacggacccccaaaacccggcaaatgccgggtttccagggcaaaatggcacccctggcctccaaagcacattaaattgattatactgcactcattacaagcaaaaagttattccatttaggtttttgtttttattgataatgattttaggcccatg

SEQ ID NO: 113163 - DNA, 151 bp, Heterodera glycines
  Promoter: Source sequence=SeqID_12980; Location=6000..6150; Strand=-; Gene=SeqID_76741
tctccaaaacaaggcgttgcccgggctgaaaaacggggaccaaatcgcataccatcacaggcaaaaattgaaaataaaaggcgcttaattaattaattgtcagtgattgccttcttaagtggtcgttgaatatttaattaatttttcaatg

SEQ ID NO: 113164 - DNA, 238 bp, Heterodera glycines
  Promoter: Source sequence=SeqID_10267; Location=1..238; Strand=+; Gene=SeqID_73427
cccctaatacggtactggttacgccccggagggcaccaacaaaacactgacgcctctgatgctggccgccgcagcgggaacaagcgaaatggtggagatggtgaaaattttggtaggagcataagaaaattaaattaaaaaaatatttctatcagaatttttgcagttggagagtggcgccgatccgaaccaaatgtgccttcgcaaactcatcgacgcaagaggttcccccaccatg

SEQ ID NO: 113165 - DNA, 643 bp, Heterodera glycines
  Promoter: Source sequence=SeqID_34952; Location=1..643; Strand=+; Gene=SeqID_64635
tttgcatcttgtgtaactaagtgtgaaagccgcttgctttacaaatttggcgaaacaaagtgagagaatggacaaaggagtgccgtaaaaccaggacaaaagaagtgttccgaggtcaccaagaacagatgaacaacccaagaaagcagcttataatgattgtaaaatcaatttattaactgatctaaaaaataagcatgtgaacgggaaatgtgtttacgagaggaggaatgttgtcaaattgtcccgggattttggggcttttaggttatacaatttcaaattattttaaatttaaaatcacatttaaaaaacttaatttgaattgatcaaagagttcaattgacgctttcattttacaaaaaatattcactttaaaatcaattgtatagattattaaattaatttccaaatagatttaacaaaatttgccattttttgcgtcattaaatgtaaaattcaatggaaaaagtggcatataaatgaacccgcagagacccatttctccacaatttgtttatatcttcttacttctatatcatgttgagctgttgatttgtggcttctgttctgaacttatattaataattaatattcattaaattaaacaaaaaatttgttttaatttactttatttaggatg

SEQ ID NO: 113166 - DNA, 150 bp, Heterodera glycines
  Promoter: Source sequence=SeqID_24115; Location=1134..1283; Strand=-; Gene=SeqID_54817
aaaggattctcaacggcaaacgaatgtcgaatcatcatcgggcggaacgacacgtaaccctttcgaaccgatggaagtgcttcccggagacctcgagccagaaattcctttgaggaattggcacgccaggagaaatttgataaggaaatg

SEQ ID NO: 113167 - DNA, 592 bp, Heterodera glycines
  Promoter: Source sequence=SeqID_6645; Location=1470..2061; Strand=-; Gene=SeqID_62315
atcatgccgaaacgatgtgccgcgaaacgatgataatgatgaaatggtgccacattcttacgaaaaaatgttttccgtgtcatttccgagtgtccatccgttcgatttcccgaaaatttcccaaaattttttttgtaattttgccattttcccgcccgtcaaatcacaagcgaattgtgtgcccggctctacccctaaattactcaattaggtgtgattgctttcccaatttaccaatattcgcatcgattggcccgtcggtccctacttaaaattggattttgccgaaattgccgtctaaaattaaaaaaaaaagtgaaattttcaaattgaaaaaatttattgcccttttattatcactttgtttttgttttaccgtttgcatttcgcataataacaataatacattttaccacattttattgttcatttggaattcgattttgatttgtcccaacaaaatcaaattgtacatttttaaaaatttaatctatttatatttttttaaattaatctatttaatttattttttaaatttatttagcattttttctatttttataaaatgcttccgccgggcgaatggcgcatg

SEQ ID NO: 113168 - DNA, 658 bp, Heterodera glycines
  misc_feature (10)..(11): n is a, c, g, or t
  Promoter: Source sequence=SeqID_19380; Location=1..658; Strand=+; Gene=SeqID_84104
cccccccccnncccgaacccaaaaaagtaaaaaaatttcagtaattttttttaaattttaaacaattttcttaacaagagtgcattaaaatactcaaaaattttcctggcggcgcctatcggcaccgccggacccccattttatcataattttgtaaaattgaggccaaaatgacaaaaaatagtaattttttggcgaaaaattttccaaaataagctcctaattcgggatttcaaaaaaagcaaaaatacacccctaaaaatcgaatttttgacttcagccccccccctccccgaagccaagggtctggctacggccttaatgagaagttcgtttctcatacaattttgaaaaatatttcaacaattttttatttggaaacattaaaaagaaactttattcagcattaattattttttttaaatcgctagaaaaattacaaaaatatttataaattttgtaaaaatttttatataggggaggggaaacagtgcaccctgaaaagtatgtaatttcaaaaaaaaaggttaatgttattatttttggcccggttttccagccaacacccactcgggaatgggatttgtccatttacatttaactatttaattaaattattttttcccatttgaaatgagtgttttttctacccaaaatg

SEQ ID NO: 113169 - DNA, 147 bp, Heterodera glycines
  Promoter: Source sequence=SeqID_26272; Location=886..1032; Strand=-; Gene=SeqID_57021
aaaaaaaaaaaaaaaaaaattttttttggttttctttaaaaaaacgaaagctttttatttgattgtgcttctgacataaatttaatgttaggttgcctatgaaattttttgccgaaaacctaataaaataactttttttttaaaatg

SEQ ID NO: 113170 - DNA, 644 bp, Heterodera glycines
  Promoter: Source sequence=SeqID_12150; Location=533..1176; Strand=-; Gene=SeqID_75727
tctctttggcaaaaatcggtcggttggtcggctcgaaatttggcgggcattgaaaggcgaagggcccgaactgatcgaccgatttgaggacggattctacaaaaagttggcatttccccatacggcgccgcccgacgctttcatcacattcaaaagcatttgcataaggttttgcttacaaacagagagaattgggactttgttttattgtaatgccgaagttgggtccccatttggcacgaatttttaaaatcctaaaattacgggatgttttacccagggtttccgatccgctgatcacgaatacattgcctaaacccggataggaactcgaacaaagttggagacagaatttaccgaatttttctatttatggcacaattattggattttttgccgtctaatttttcggaaaaacatttgattgaaaatgccggggacaaatttttttatcgtaggtcgattttccaaaatttaattaaaaaaaaaaaattttgccatggtaattgaattggtttcttttcaggtacattgatcatactgtcgtggcctttctgcaccgcattcgtcgcctcttccgtcactcggccattgcccttaaaatggtcatttggccacagtccgtccgcgcatggcacgtcatg

SEQ ID NO: 113171 - DNA, 933 bp, Heterodera glycines
  Promoter: Source sequence=SeqID_781; Location=4943..5875; Strand=-; Gene=SeqID_61115
tttggtgtttgaacaatttaagaatgatctaaacacacacacacttattttttattatatgtatatataaaatagaaaatgtaggtattttgaaacaatttatgaaattaaacaaatggctgacaattttcaaaaatttgatgaaaaacatttgcaattcagacacccgttcacgctgacaatctcggggagcacggggagtggaaaatcggaatgggtgctgcgaatgctgaggaatgtgaatgcgctagtttcggaacccatctccgagattttctattgttatggggagttgaacccaaatataatacagctacagaaaagtggacacatcggcggctgtagggttgttgtacatgctggaagcccaaccgaagagcaggttaaccggcgcgcaaaagagagtgatggaaaactgctgatggtgctggatgatctcatggttggtatggggcaacaatttcttgacactgtgttcacccggggatcgcacaattggggggttagcgttgtgttggtcactcaacatttgttcgcgaaagaactacgggttgcgcgcaacaactcgcactatctggtgctgatgcgtaacccggcaggggcgctccaagtgcgcacactcgcctcgcagctatttccaacgaaaaacaactatttcacggaagcataccgagatgcaaccgaaaagcagtttggctacctattgattgacatgcaccccgagagtccggaattgctgcgcctaaaaacgaatatatatggagagcagggcgggctccccccattggtttatgttgcaaaatgaagcatgtaaaaggaagaagacgtacagttaaacataatatgaatgttagcccgctgatgttgaaaaatgctgacttcttacgccactttcgctctaaatatcgctcaaaaagcagtcagcgccaaatg

SEQ ID NO: 113172 - DNA, 287 bp, Heterodera glycines
  Promoter: Source sequence=SeqID_7306; Location=906..1192; Strand=+; Gene=SeqID_64409
atgtttaattcagaggatttgttgcaaattgtcacttgaataaattgtttttgtaattgaatatatttattgctgtcaaactctcaagaatatatttcgaattttttactttgactgaatcttcctatattttctcaacttgtgttacaatgacttcatttacccatcattttacatatttgggtttctttcaactcaatgaaaatttggacaagggttcagagtgcctgactgatggtttgcagcgcagaacaatcgaagaacaacttattgacagtgccgaaatg

SEQ ID NO: 113173 - DNA, 454 bp, Heterodera glycines
  misc_feature (36)..(36): n is a, c, g, or t
  misc_feature (84)..(84): n is a, c, g, or t
  misc_feature (102)..(102): n is a, c, g, or t
  misc_feature (131)..(131): n is a, c, g, or t
  Promoter: Source sequence=SeqID_43553; Location=1193..1646; Strand=-; Gene=SeqID_71200
ttattatttgtgtgacatgattggaaaattgcaatntattatcaatatttatgcctaaatccttaattgtatccacaacatttnattatatttccatcaatnttatatatttctttggggtttttattccncaaatgaagtacaaaagtttttttaattgagattctgatttgccatttattgttgcacattttataatttttagaacattataaaatgattgttggcaattttcacaaaatatgacagaatcttggtggattttccaaaattcctcaaaaaaaataccgatttactcttaaaaatctttttttttgaaatttttttttaaaaaataaaatttaactgtaatattaaaaatttgtcttttaacttttttgaaacttaatgaaaatttttgaaaattagcaaattaataataaacacacagagctatcgaacaacaccaacaatg

SEQ ID NO: 113174 - DNA, 390 bp, Heterodera glycines
  Promoter: Source sequence=SeqID_10823; Location=1425..1814; Strand=+; Gene=SeqID_74092
tttcgcttcgcttagccctttctccgcttttcactgggccaatggactcttcgctttgctcccatcagcagaaaaccatgccaattccgagtcggttttccttttctccattaataggccctatcatcctgaaagatttcggggaagcaccagcggacaaaacgagcttttttgtcaagattcctccctccggaattttctccgttcttcagagtgctcattgtttcgcttcttcgctcgttggttgacaatgtgccccttctgaatgccaataaattgcgtgcctttgtcaaaactgaaatttcgcggcaatgcgtctcattttggcaaattgggaaagcgcatttggcatccgcactcactttatgtgtgctacgaatcttgctgatg

SEQ ID NO: 113175 - DNA, 60 bp, Heterodera glycines
  Promoter: Source sequence=SeqID_527; Location=4711..4770; Strand=+; Gene=SeqID_55418
tctataaaataaaaaaaaaaactataaataaaaagaaaattacataaaaaaagtaaaatg

SEQ ID NO: 113176 - DNA, 294 bp, Heterodera glycines
  Promoter: Source sequence=SeqID_10552; Location=1..294; Strand=+; Gene=SeqID_73788
aataaaaaaaccaaaataattttgtattattttcacttgatataaattaaaaatttgaatttttttttaattttttaaaatttcccggttggtcccggttcccggtcccgaaaaaaaatcgaggtcccggtcccggtcccggcttctcaggtcccggcaagtcccggtcccggttttggcaaaaattcccggtcccgtggcactctagtttttcattccaattattattaatttttattgaaataaaattatattttttaaagttattttagtatatgttatttaatagaaatg

SEQ ID NO: 113177 - DNA, 62 bp, Heterodera glycines
  Promoter: Source sequence=SeqID_31156; Location=1..62; Strand=+; Gene= SeqID_61529
tcgttgtatatcagatcgcctggtatgccatcttacaagtccactatctctccgagaagatg

SEQ ID NO: 113178 - DNA, 193 bp, Heterodera glycines
  Promoter: Source sequence=SeqID_21265; Location=344..536; Strand=+; Gene=SeqID_51860
aacagcggctcaaccgtttgtctaatttttcggattttgtttaaatcattttgactcggattgacaggtctcttcgggcggttcgaccagtactcagaatttgcagccaaacctcggactcctgaccatgcattaacagagcatgtaacgacacccgtaacaaatatccctcccgtaaatgaagagcaaaatg

SEQ ID NO: 113179 - DNA, 111 bp, Heterodera glycines
  Promoter: Source sequence=SeqID_13637; Location=1094..1204; Strand=+; Gene=SeqID_77539
atactcataaaaaatacaaataattcaacccacctattctatgaccacattctgaaaaaaatcccagaaatacgaggaaagatatgcttggtcacaataaaataaaaaatg

SEQ ID NO: 113180 - DNA, 326 bp, Heterodera glycines
  Promoter: Source sequence=SeqID_9376; Location=3965..4290; Strand=+; Gene=SeqID_71166
ggtaaatttctcattctgttggattgaactgatcaggacgtctttttgatcaaaaaaggcgcgagctgtcagttttatttttaaaatcaaatttaaaaaatttcctgatcaaaaacattttttgattgaaaatattaattaactatgggtgcaaatttggtgtttaaattttgtttttattttttcaagcttgcaaatatccgcctgctgagctcgacacgaagcaaaagatcacattgggctactatttcaacgaggcaaaaaatcgcattttgcaattttaatttaatttattattatttttaattgtgtttaagtacgtgatg

SEQ ID NO: 113181 - DNA, 630 bp, Heterodera glycines
  Promoter: Source sequence=SeqID_58; Location=4857..5486; Strand=-; Gene=SeqID_57568
tataataacgctgcggacatctacatttttgaattgaaaaaaaattggtaattactctttctttttctccatattgaccatcatactcatactccccccacccttttcttcttccgccacccacctcccccgctacgcgccgctcccctccccttcgtgctcctctctgtgccgatgaatagggcgaggaaatgggcctaagaggatgctactcctccgttccttcaaagacactgacctttcctgtcaaaatactcgcaaatcttactgcaaatcaaaacacattaagaataaatactgatatagtatctttttttcttctctatatggtatttttctcttttttaaatagatgttagacattataaaataaaaatatattttttagaaatatataaaaagtataaaattatttaacacgtgtcttcttaagtaattaaaaatatttaatatgatgcgtataaattatgtaaccggtatcttgaaaaccatcgttagcaagttagacacatgcactctttgcaatttgcattatggtctaatcaaaatatcaaatgatggcaaggaggttagctggttatataaattattattagttgggagtctaacttagttgattaactaaaaatg

SEQ ID NO: 113182 - DNA, 126 bp, Heterodera glycines
  Promoter: Source sequence=SeqID_13085; Location=1749..1874; Strand=-; Gene=SeqID_47101
tcaaaacattggcacttccattgcgcaggtttctttttatgaaaacattagtaaagcttatgtaaatttaatatcaattcttactttgctctaaatgttgtaaaaacaactaatgagttcagaatg

SEQ ID NO: 113183 - DNA, 423 bp, Heterodera glycines
  misc_feature (81)..(81): n is a, c, g, or t
  misc_feature (89)..(91): n is a, c, g, or t
  misc_feature (111)..(112): n is a, c, g, or t
  Promoter: Source sequence=SeqID_1478; Location=1409..1831; Strand=-; Gene=SeqID_73797
cgtgcaaattgaattttgtaaaaaaaaaaaaattttcggtgcttatcgcaaaacagtaaattttaaaattattaaaaaccnaattatannnggagagggaaccgagcccgnntggtttgcaaagtttttgtcaaaaggcgaaatttcaatttctcgatgagcacacattattttttaatttttcaaaattaatgaatttcacgcaaggccgagtttttaatttatggcaatggcgagagtaggctaatgggataataaccaaaaatatttttgcataaaaatgggaccaaatctattaagttagttatatttaagtgaacttacaattagcctaaagttgacttatttaattttaaaatcagacaattattaatataatttataattaattaaaaaataaattaataattttgagagaaaatg

SEQ ID NO: 113184 - DNA, 686 bp, Heterodera glycines
  Promoter: Source sequence=SeqID_44514; Location=329..1014; Strand=-; Gene=SeqID_71995
tggccaattaaattgtgtgatatttttgggagttaattaattaattaattaattaaattttaatacaaattttagttgcgaaaaattaccgtcaattaaattttaatatttttgaaaagaatttttttttttttaataggcattttcaatttcacaaatatatttttctggcaaattaacattttgaaacccatccaaaatacctatttttgttttgttttttcaaattacttttttttcactaatatatgtacaataaatatattttgaaacattttgtttctttttcgtcattttctaatgtgtacataatcaatcacttctaccgtttttaaaagatcacacaaaatattattattatattattattgtttttaaccggtaatgttaagtaattatttttgtttcattatcagtgcgtgcaaaacaaaaattgcaactgaagaaaattttttagtttattttcataattcaaataaattaataaatattattttttaacatatgtaaattgaatgggaaaactcatggttttaatggaaataaattaaacataaagcctgcaattaataaaatcaatttatataataattattttttattttcccattcttaattaattaaattcatataatttataattgcctattaaaattatagaaataatacataatcaattaataatg

SEQ ID NO: 113185 - DNA, 196 bp, Heterodera glycines
  Promoter: Source sequence=SeqID_12980; Location=5313..5508; Strand=-; Gene=SeqID_76742
atttagagggggaaaaagtccgatcattttggcacacttttcccattgtttacgattcattattgatcagatcacatccattttcaaaaatatgtttttgattttgctttttaataatgcttttcctccgttccgtcgcactttttattgctaattcattttaattgccaatttgtctcatttctcggttgaaatg

SEQ ID NO: 113186 - DNA, 627 bp, Heterodera glycines
  Promoter: Source sequence=SeqID_4056; Location=2416..3042; Strand=-; Gene=SeqID_52992
ctaaataaatttaaatgaaaggaaaacagaaaactagtaataaaacgaggattttgaacttatgtcgggtaaaaatatcaatcataggtcccagactcaaactttcataaaaacacctttatagattttctttatttcaaaaatctgccaaaaccccatcttattattgtttgggtaatacccggtaaggtcaggaaaaatgccgagaaagagttacctaaattccgaaatcccacctagaaattcaagtcgaagatttttgtaattttaaaatatatggcgttttgttgtttcacgtggactttattaaacgaggaaaaattttgcaaaattcttaatggaattgcttcatcttctcataaaataccttaagcattttctaacataaattaaaaatataatctctgtattccttagtttctttggccttttcagttgtgctgtatatccatcccaaattactctttcggttttcatcaatcgacctacaacttacaaaaaactcatccaaaaatggcctacagaccaagtgaggttctttaaactatcatcaaaatgtctctttaatccaatttttctcctttttcggatggcggctttctgttggagcagcaaaatgacgaaatg

SEQ ID NO: 113187 - DNA, 1003 bp, Heterodera glycines
  Promoter: Source sequence=SeqID_23357; Location=1162..2164; Strand=-; Gene=SeqID_54070
cttgaaatagcttatcgcgtccttttcggtgttagttcgatttcggaaaatattcaaatttcttaaatcattttgaaataagaaaaaatcattatttatttatttataaaattattatagtatggattttaattaaattaaattttgcctagaaaaactgagacagttaaatcgagttattcaatgttctccattgaaaggttaccgtatttcctgtattagtgttcaaagactaatggtcccatatgattttattatttttgtttttctaatgtgttttaaccctttttagcacaataaatttttttatgtgttagttgaaatttgacgcttttaatttatctcaataagtttggtttttgaaaacctattcttgaatatattcattcatttaattgtgacagtaacaaaactaagctttttaaaatatttttccatctaataaacgattaaaattgttcactaattttggtacaaaaaaattttattcttaatcataataaaaataacaagcaatttagaactttttgcataattcgtttgcgaatttacgcttttagattttttatataaaaattctggaacgttcattattatattaaggtactataacaagttaattttattaagaaactaattaatatctcatattttataagattattaagaagcattaaaacatgaaatattttttaaatattcagttttaatgatttattattttcattatagaacaggttttattttctaatatcttttttattattatgaattttattttttagaagaaaatttaatgtttcaatattcacggtataattattaaatgtttagcttttgattgacaaaaacaaagctatttaaaaaattgaagaaagatgaatagatatgattttaatccgtcttatttttttgattaatttcaggattatatttaaaaatatttttttcttgttgtttttataattattttcaataaataaattctaatatttgagcaatg

SEQ ID NO: 113188 - DNA, 83 bp, Heterodera glycines
  Promoter: Source sequence=SeqID_17527; Location=774..856; Strand=-; Gene=SeqID_82029
accttttaaaaaacggtaaatttaggaaatttaaagcaattttcaattccagcaaattttagtcaaatttcctatttatgatg

SEQ ID NO: 113189 - DNA, 104 bp, Heterodera glycines
  misc_feature (43)..(43): n is a, c, g, or t
  Promoter: Source sequence=SeqID_2634; Location=1401..1504; Strand=-; Gene=SeqID_80834
agcaaatgctcgtcccatttgtttaatggaatatggttgccanataaattttaaatactttttaaaaattaaaaatattttgcttatattttcaggcaccaatg

SEQ ID NO: 113190 - DNA, 636 bp, Heterodera glycines
  Promoter: Source sequence=SeqID_8990; Location=1..636; Strand=+; Gene= SeqID_69927
aatacatgaagtatagaattttgattattgaggccctatttattctttactaaaaaactgaacttatttagaaaaaaaagttttaggggtgccttttcggttttttgtgaaaatgccgaaatatggatgtaaaaatggaaatgtggaaataaaaattcatcctagaagcatcaaaccaagctaaaaatactatttacgtcgtttttaggccgaaatgagtttgcaaaaaaaatatggaaatccatacaaatccggtccctagtgatcacttgtgccttatttagctttgttttcttgtttattaatatttctttattgttttatgcgttcagttaataataaaaaaataattaaatagaaatattatatatttttttcccaaattcctaaaaatcatatgaattttaataagatccggcaatagattaagctgtataatcaatctgatattacaaaaatgaataaataaaattttcattcatagtaaaattgattaatgcatattttcctttattttttttattcataaaaatgtataattcatataattttttcgttatttaatttaatatcactaataagcatattaggatattttttcaaaaatttttttgttttatttttaagattatgatg

SEQ ID NO: 113191 - DNA, 134 bp, Heterodera glycines
  misc_feature (24)..(24): n is a, c, g, or t
  misc_feature (65)..(65): n is a, c, g, or t
  Promoter: Source sequence=SeqID_15875; Location=1756..1889; Strand=-; Gene=SeqID_80207
gccggtttttaggcggaagcatanaattaatttaaatttttgtttcaagaaattatacaaatccncaatatctaattatttatataatttaaaataaatatatttcattaaggcacaaatgttccgaaaatatg

SEQ ID NO: 113192 - DNA, 998 bp, Heterodera glycines
  Promoter: Source sequence=SeqID_12734; Location=368..1365; Strand=+; Gene=SeqID_76434
ttgttttcacttttccgtccgacaaaaagtccttttttccaaaggcattcttttggccaatattttttgtcacttatcgactgctttttttctcaaaaatattttctttactgtaaaaatttattgtaactacaattttttatttttcgcataaaaatactcaaaaataaaattaaaaattgcaatttttttgttaaaaatttattaccaaattcctcttaaatttcaatgattttcccggcgggcatttcgccactgccggacccttacccattcagattttttttaaatacgataaaaattaaataattaatggacttgtgaactcaaattaatatttccacgaaaaaggaaaaaattcgcacaaatttattttaattttaatgtcaaatgctcactttcactgccaaatttgtaatggctgatcgagaatagctgtgggagctgaaaatgctgtgcgagcaatttacgtaaggggccaaatgaaggaaagggtggcaccaaaacaacaatcatccctccattggggttgtggtctagtggctaacaaataagacaacggatccacgtaaagggccccgagcggcggttcaaatccggccttccacaccaatttttcgtctaaataatacatacaaaaaaaaaattgggctaaaaaaaattgccggttttctgctgaaatttttagaaaattttgccgttttttgaactcgtgtgccggttttttgcattgcatcccttggcctttcccgcagcattccccctcttttccctcattttgtccctcttaatgatccatcataacttatgcatctgtcaatgccaatatgttttagtttttacattaaatctttttaccttattttgttttggcattttgcctcttttttcgtccttggttcgtcgcatatttttcgggagtctttccgcgtctccaacccaaaaattggattttgtgggcgacagacgtcggcgcccccgggggaagggaaggaatg

SEQ ID NO: 113193 - DNA, 138 bp, Heterodera glycines
  Promoter: Source sequence=SeqID_7929; Location=1..138; Strand=+; Gene= SeqID_66409
aagcggaccaaaaagaaaagcattggggcgccgacgacgccaattcggctgcaaatttggccaaaggagcaggacaaattgcgcactccggtggggaacagttcgctgccggccaatttgtccgagttgaacaaaatg

SEQ ID NO: 113194 - DNA, 74 bp, Heterodera glycines
  Promoter: Source sequence=SeqID_1857; Location=2463..2536; Strand=+; Gene=SeqID_76395
atcttttggccgataagttcgtcaccatcgagaaggaatttccaccggtcaacaagcggatctgcaaacaaatg

SEQ ID NO: 113195 - DNA, 1003 bp, Heterodera glycines
  Promoter: Source sequence=SeqID_5127; Location=3104..4106; Strand=+; Gene=SeqID_57009
caaagctcacccggactcgaacaaaaatcaaaaactactagtaagtttttcggagtttgcttttttgcttgaatttaggttagacattcaaaattggatataatgggtgtcagatccctggttaacgcccccccccccccgagaacccttcagaatttgggggaaccaaatatactaacaataagtattatatgttacccccgaatttgcaaaaattgaaagaattttattatgtagtgaaaatgtgtaacaaaagttggctgccctgtcagttttggagtgtgaagttttttgtttaaaaaacaaaagatattgatcattatatcctatgcagtttccttacagtttttcaattctgtttttgtttaagcgtaatttttaaattaatgcattttttgctgttggggcactccgaaaaaccataggttgagggcccttttttattcgtgaaaacttgttttatgggttttcgggggtagctaaacacgaatcttacaccaatgttgagaaatctcttacccgaactcgagtgaaatagaaaactaagtttttcggagtttgcttttttgcttgaatttaggttagacattcaaaattggatataatggatgtcagatccctggttaacgccccccgagaacccttcagaatttggggtaaccaaatatacaaacaataagtattatatgttaggtttccttacagtttttcaattctgtttttgtttaagcgtaatttttaaattaaaaacggcaaggtcgcagaaaaaatcagtaaaaacttataaatccggtccctaaattataatttatcccacaacaactcctcgttatattttcattctctgactgccccatgttttttgattcttaggtcaacccgattttggttaatccgccagcccctaactcaaactaatctctccctttcctttttgtctgactaattttcaaacaaaaaaataaaataaattaattgctttctttttattaagcaaaaaatg

SEQ ID NO: 113196 - DNA, 153 bp, Heterodera glycines
  misc_feature (2)..(2): n is a, c, g, or t
  Promoter: Source sequence=SeqID_24868; Location=43..195; Strand=+; Gene=SeqID_55613
tnttgaatggttttcccccgcagaattattttgggaagaacactccgcacgccttgtcaatgcttgaaccaagacagcacgcaccaaacgagaacgacaacaaatgtggacagtaccaatcgaagatgtcacagcagtacaaccgacatcatg

SEQ ID NO: 113197 - DNA, 556 bp, Heterodera glycines
  Promoter: Source sequence=SeqID_6328; Location=3241..3796; Strand=-; Gene=SeqID_61157
gtattaatcattgttttaaaataaaaattaaaaaaaaaataattaaaaaaacttattagaaatttattacttatttcaataaatttcatattaacccaatgattatgttctatcaatgaaaaattcaatattttaaatgtcagaacatatgttgcaacgtagcaaatacaattttatgtgtgccctggcaccatttcatcattttttctctgaatttcactcttaatatatttgtaaaggatgcgtttttctcgccttgcctcataggcagtaaaaaatatacataattatttaattttcatttttacacatgtaaatatattcaccaataattaagcaatgactaaggcatacgcatatgcatatacgcgaccaatacaatacaaatttctccattcatttaacatttcatttacatgtaatatttgagagtttttaattttacatatttatttaatcacgaaatatttgagaatcgtgaatttgcgcgcatctctaatagcttaaattaattaaattaataagtatgtaaaggtgagaaaaattttagaaaatg

SEQ ID NO: 113198 - DNA, 150 bp, Heterodera glycines
  Promoter: Source sequence=SeqID_3187; Location=1..150; Strand=+; Gene= SeqID_83588
tgggagggagttatccttatttttttggcattctgcagatattgataatgtcccgcatattgttaattgtttgctccaattttggggatggaagggggcataaatcattttaaatttcaattttttgaaatggcttagcccggcaaaatg

SEQ ID NO: 113199 - DNA, 167 bp, Heterodera glycines
  Promoter: Source sequence=SeqID_40202; Location=1236..1402; Strand=-; Gene=SeqID_68607
agttggcacaatccgaaatcccttcattcaaatcatcatgaacgaatttgttaaggttggcaagaaacaacgaattttgggcacccgacgtttcggggccgtacggcgagggcaaggataagaaatattggcttttctactgcgtgccagttgacggcacattaatg

SEQ ID NO: 113200 - DNA, 512 bp, Heterodera glycines
  Promoter: Source sequence=SeqID_11757; Location=2191..2702; Strand=-; Gene=SeqID_75255
tacctggctaaaatatcatcataatctctattttttataaaaattacttgaacatatttcacatttattttttcatctttatttttatatttaattttacaatgccccaataggggtttttgaatctaaacaattaacctttctcatttattcgcttttcccgtgctatatctttttcatgcctaccaaatgtccgttgaatgttaatgagaaaaaattgtagtttttagccggttcaaaaaaccccatttcgttcatttgaaaatatgagacattaaatacatagtgtaattgaccgaatattcagaaatacatcattgtgtgattattattcgattccattccaaattattacaacaaatggcgtcctacacttattccgccgccggttcctcggccccggcgggcagcaagaaggacattctgggcaatcttaatcgcgctttctccgcttggcctgacaaattgttgacactttttttttgattacactcaatttatgccacaaaatg

SEQ ID NO: 113201 - DNA, 394 bp, Heterodera glycines
  Promoter: Source sequence=SeqID_41932; Location=1..394; Strand=+; Gene=SeqID_69966
ccttgtggtgacagcaatagttcgcttttctctccataactttgtgagtttggcgcggatcgtgaccttcattagaccattggaaagagcagctcgagctctacaagaaggtatggaaagataaaaatagttatttctgggactttttcagaaatcagaattaattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 113202 - DNA, 291 bp, Heterodera glycines
  Promoter: Source sequence=SeqID_27564; Location=439..729; Strand=+; Gene=SeqID_58263
ggacgttttctgcaacctggattttgctggacctggatttttgtccgggtccaggaaatccaggtccaggtcaaatatgaaaaaaaaccaggtcctgatccaggttaacacaaaaacctggatttccttgacaaaatttttgaacaaattttcaaaaaatgattaaatggatttaaacacattattatagtaaattatagatttttatatgttcctcagcactagaaaaagttttttttcaaaatgtagagctttaaaaattttaatttctctaaaatttcaaggcgtatg

SEQ ID NO: 113203 - DNA, 95 bp, Heterodera glycines
  Promoter: Source sequence=SeqID_28849; Location=1045..1139; Strand=-; Gene=SeqID_59427
taaatatatattaataaataaaatgcaatttagaaatgatcgcaagtttctcagagcagacgatggattgggcattggccaaagggtgcgaaatg

SEQ ID NO: 113204 - DNA, 141 bp, Heterodera glycines
  Promoter: Source sequence=SeqID_3857; Location=427..567; Strand=-; Gene=SeqID_52174
tctgaatattttaataaaatggaaaataatttttaaattaaaactcttaaaaagaattgaaaattatttaaaacgtaaagaaagtaagctaattttttcaaaaactcttacattcttttttttgaaggtgatgaggtgatg

SEQ ID NO: 113205 - DNA, 733 bp, Heterodera glycines
  Promoter: Source sequence=SeqID_42970; Location=1..733; Strand=+; Gene=SeqID_70752
taccaacatttgcctctctagtctggctctaccaaccactcacacgatattgaaatgctaacgaaaaaaattcttgccgaaaaaatggctctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcttggggatttgaccgcaaacttggtaccaacatttgccttctctagtctggctctactaaacactcacacgatatttgaaatgctaacgaaaaaaattcttgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctctcttttttctcctggggatttgaccgcaaacttggtaccaacattttccttctctagtctggctctaccaaacactcacacgatatttgaaatgctaacgaaaaaaattcttgcccaaaaaatggctatctcttttttctcttggggatttgaccgcaaacttggtaccaacatttgccttctctagtctggctctaccaaacactcacacgatatttgaaatgcaaacgaaaaaaattcttgccgaaaaaatg

SEQ ID NO: 113206 - DNA, 191 bp, Heterodera glycines
  Promoter: Source sequence=SeqID_1550; Location=1..191; Strand=+; Gene= SeqID_74403
aaagaaaaccaaagaagaagtaaagaaggatatggaagatgaggaaatgacagcaattgcgtcgatccaccgtaaataataaagtatttaaaagcatgtgattatttgatttagcccttaaacattcatcatgattggaaaccaattttacacagataaagaattaaagctaaaaatgccccttcggtatg

SEQ ID NO: 113207 - DNA, 285 bp, Heterodera glycines
  Promoter: Source sequence=SeqID_8647; Location=1..285; Strand=+; Gene= SeqID_68771
attcgctaaatgtaagctaaacttctcaaaaaagactcttttagaaatcaatttaggagaaaaaggaaaaaaaataaatccaaatttataatattcctaaataaaaccaactaaaaagcgaaactttttcatttttgggtttttcacataaatttaacaattactagaattagtttttttaaaattaatattcttgagaaaagatgctctccttttgatttttataaaattatttttaattcaattttccatctctctcaggtcaaatacccattgtccaaaatg

SEQ ID NO: 113208 - DNA, 999 bp, Heterodera glycines
  Promoter: Source sequence=SeqID_25852; Location=1..999; Strand=+; Gene=SeqID_56623
ttttaatgtaaatcagggatggtatccgtccttgaatggcaaggacgtccttgaaaatgggccctctttcttgaaaataaaaaatgtccttgtatgcaaggacgtccttgaaaatgagcatttggaaaagtttaaaaaagatcaaagaaatttgaaaaatctttgtaattttcaacaatatttatttaaattatggcattatgtcatttaaaaatgtaatttttgagaatttttgaaattttatggcattaagtcactagtcactatttttcttaaaaaattagccaaaaatcgcaaattttggtcatttttggacaaaaatctgtaaacaactcgcattaaaaattacaaatttttccggacccccctatcctcaaaaaaatttttaaaaagcgctccgtaaaaaacccattttataaacaaaaaaagtcgtcgcatggcttaaaatcgcaaaaattaggcagtttttggtgaaaatctgttaacaaattgcattcaaattttcaaaatttttccccggcggatactattataccaaacgaacccccccccccctctataccattcaaatttttaataaaaaatttttattataaaatacttttataactggttactacgtgtcaaaaacttacttacaattaataatatttagctttataataaatacatttaattatacattcctttctttacatatgtacgatttttctttgaattcatttaattttagtcttgtaaaaaacgtaaaaagattaccgttttgcccatccgcgaccgaccatttgctgatatgaattttttatgtacaattgcagcaaattttacttctcatttcttgtcacatataacttttttgatttagattatgtttgaatttatatgatattaatgccctaagcttttgctttcttccagtcttttattaaataaaaattataagtttaaattattttcagtaaattatattatttttttattaattagatttacagaatg

SEQ ID NO: 113209 - DNA, 558 bp, Heterodera glycines
  Promoter: Source sequence=SeqID_9079; Location=2262..2819; Strand=-; Gene=SeqID_70190
gctgaaaaaaataaataaattttcaacaaaaaaaactcaaaattttaccgaaaaatttttcgtccggaaacggtccaacggaattacaagcccatgctgttcagcgcatgctgtgcgcctcaacggacggggcggaacgcgacgtgaaaagcgaccggcggcccaattctccttctctttcactaattaggggcaaattcaatcaatcaattaattaattaactaattaaattattaaaggctcattaaaaatatttatgaaatttacagaaaagacaaaaaagtttaaattattggtataattttgtatagaaattttaaaaaaaaaatactgatcagtaaaaagaacccttatcatttaaaagtatgtgtcttaaacgaggctaataaattatgtataccccatctaaatacggactgattaattggccatatcaaaaattggttcataaaaaccgaaattaattaattaaaatttgtgactccacaaaaaaatgatcaaaagaaaaatatgaaccgtatagcaaaaaataatactaattagaaaatgtgataatg

SEQ ID NO: 113210 - DNA, 111 bp, Heterodera glycines
  Promoter: Source sequence=SeqID_4361; Location=1..111; Strand=+; Gene= SeqID_54176
gataacggcccgtaagcaaagccaataataacgatgaattaattttcatttggtttttcagattacgccttttgctggattgacatgctgcacagaaacccctcaacaatg

SEQ ID NO: 113211 - DNA, 89 bp, Heterodera glycines
  Promoter: Source sequence=SeqID_15976; Location=215..303; Strand=+; Gene=SeqID_80333
ttactcatgatccgcaataataactggacaaaatttttcaattaagccaaattaataaacatttcttcggtatttttttagtaagaatg

SEQ ID NO: 113212 - DNA, 168 bp, Heterodera glycines
  Promoter: Source sequence=SeqID_18410; Location=1..168; Strand=+; Gene=SeqID_83007
cgaattgctcgctcatatttcaacaatatttttgtttcctttcgcagggacattgtgcaccaatcgttcagcgactttggcttcctggtgcctggccgtgtcgcccgttacatcggcgttcagggcgacttggacccgttgttgaccggcaccgccgtgctcgagatg

SEQ ID NO: 113213 - DNA, 150 bp, Heterodera glycines
  Promoter: Source sequence=SeqID_8007; Location=484..633; Strand=+; Gene=SeqID_66675
tctgaatttttatacatcaattgttgaatatttattgcacataaatatgaaaaatatatacataaattttttcaaattagggtaaaatttctcaaatttcttcaaattcgttaaatttaggctaaaaatcttgaaaataagctaaatatg

SEQ ID NO: 113214 - DNA, 206 bp, Heterodera glycines
  Promoter: Source sequence=SeqID_8927; Location=2754..2959; Strand=+; Gene=SeqID_69663
atcattattcattaattggcccctcgattcgagaccaagactgaacccgagattagataattgacccctaagagtcgagacaaaaagcccaaaaatccgagaaatttctcgccccgagaaacgttcaaccaagttgttgtcatcttttcggctaagtgccaacttgccctttcaagatttgatcagctcggcctttctgataaatg

SEQ ID NO: 113215 - DNA, 278 bp, Heterodera glycines
  Promoter: Source sequence=SeqID_16237; Location=610..887; Strand=-; Gene=SeqID_80617
tgtatgtatctggacagaaattaagacgcattaattaggcaaaagccacaaaaggcgttaattgaatatacaatttttgaaatattgtagaaatgatttccagtggcattatgtatgtatacctaattaatgaattgagattaagtttaagggaaggaaaaccgtctatataattctctcctaactaattaatcttcaattttcctgctgtgtttattgttatgtttcaatattcgccttgcttaatttagtaattaattaattcattcgtgtaaatg

SEQ ID NO: 113216 - DNA, 129 bp, Heterodera glycines
  Promoter: Source sequence=SeqID_5320; Location=1404..1532; Strand=-; Gene=SeqID_57666
aataaatgaatgaatgagccgagggcgagaagcagacgcaattaaagaataattatcaaaataaatgatattcaaaatgaacaacttccatcgtcagcagatggtcgccgtttaattgacggcaaaatg

SEQ ID NO: 113217 - DNA, 392 bp, Heterodera glycines
  Promoter: Source sequence=SeqID_2757; Location=1386..1777; Strand=-; Gene=SeqID_81445
aatttaaattttttgaaatttttattaattagtgcgtcagcagcagcaaaatggtccgcaagtggtcgagcaacaattgccatttgtgttctcatcttctgtcgacttcacaccagcgcaaagggcaaaggtggattggtctttctcatttctctctctcactctctgtctctctcacatttcataaagtctgagtgttgatgggcaggccttccctcgtgttggcccccccttcaatgcttatttcggagctgtgaaaagcggtaggcaggccttcccttgtgttggtccccctatagttttttgcttctcatttctctctctctcacacatttcctcatttctttgtgttgataagcctaaccaaaaatatttaaaaattcaggcaaatg

SEQ ID NO: 113218 - DNA, 777 bp, Heterodera glycines
  Promoter: Source sequence=SeqID_4684; Location=5090..5866; Strand=-; Gene=SeqID_55374
ttccgtgttttttccctattttcaacatttttttgtgtccattattcaatccgtttttgctgtttgttgttcggttggccaaacggatgattcactttttgacgttttgttgttttggttcatcgacggcggcggattctccgtttttttttgtttcggcccgccccttcggcagcgtttttccgttttccgctaccatcagccgtcaatataaaaacgcgttcattcgctcattttttatggctcaaaaaatgttttatttaaaagttattttttgaatggtttaggtttcgaataaaaagttttttagtttttttaatcgaaatataccaaaaattatgggttagattgtcttagacaaaaaatgtgggtttttttggggattatttcaatgggggtggcttatcacttatccaaactgaaaaaacttttttttaactaaattttgatatttccgaaaatacagccccccaccccaaattagagcccctctgaaaaaagaaagccctcttcttagtgcgttgaaaaataaagcccctgggctctattttcgggaatacagtaattttcatcacaaattgggttaggaaaaacgatgctcaaaaactaaatgtttttctcgtcttaattgggaggaaatatttgcaaattgtttttgcttttcctaattaatttaatttttgtttttcaaaataaaaatttttttttcatttttaaagaaaatccaattccaaaacactacgccaacaattcgaaccctccgcttgcaacaaaatg

SEQ ID NO: 113219 - DNA, 318 bp, Heterodera glycines
  Promoter: Source sequence=SeqID_33577; Location=1..318; Strand=+; Gene=SeqID_63598
tctaacaagggttgccattcgtccttggatgggcctcgctgattggaaaattgaaagggtccttttttgcaaggtgtccttgcaaattagcatccgaaaaaaactcaaaattttaagatttcaaatttttaccaatgtttttataacttattgcattatttggtgcaaaatatgttaataaatcgcacaaaaaaatcaaaaaaatttttcctggcggcgtctatcggcccattttttggatttttttgaccactttttgtacatgtttttgcaagccctaactacataggtatgttatgcaattaaatcctgttaatg

SEQ ID NO: 113220 - DNA, 380 bp, Heterodera glycines
  Promoter: Source sequence=SeqID_18864; Location=1..380; Strand=+; Gene=SeqID_83567
cttcccttttcacacgcacatttgcaagacacctttggaaacaatttttaatcatacatatatttctagagcaacaagtcactcataaagtggaaaaattaatactataataaaaagaaccaaattaaaactttatatatataattacataatttcgttatttagtcagaatctatgctttttctttttttattcatctcccgtttttccgggactcccggtcccggcctttgttcaaaatactagaactgggagtcctggccaatcctttcgggctcccggtcccatccgagctctagtatttatgacccataacaattaaatttgcattatctattgttatatatacggttaaggattaaaaaatataattcggaatg

SEQ ID NO: 113221 - DNA, 926 bp, Heterodera glycines
  Promoter: Source sequence=SeqID_2513; Location=2332..3257; Strand=-; Gene=SeqID_80163
tttcttgtattttcatcccaggtagacaagttgagtcggacttttgctgactgagatgatcaatataaaatacaaacttttctcctcgtcgaggttacttctttcttcacctcagctttcgcatctttaaaaattttgcctttgttatcaaaatcatctcagtttactttgcttgctaactttattcctctcattattcttttatccccgagagttacacaaatctcaactttaaaaacgttaagcaatttaactcataaaaaaagttgtgagagtttcaaattttcattacgttataactcaaggtctaggcagctctttttaaccaaaatgctaaaatttatttatttttattttttctaaatgtccaaagtgatttgtatctttataagcaaaattattagaatttgcgaattgatgttttttcatgtgttagagacttgaaaaaagaacgccaagatgagaggaaaagaaatattattttttgtttgtcctataacttgaactaacagataaattcaaaaattcaacatagaaatctatgcagaatttttttctctattgatatgcaaagtttaaagcggatttaacatgtagataaaaaggtaaacgtcacgaagtaaatgttgttttttatataggtaattaaaatgaatagatagtacgccaaagtgagaaaaattacaaagaaaaagagaaacgatgaaatactatgcttttctctgcacagtgaagttgacccatagccaaagtgagtctccagagaaattttagtatataaattcatgcgttctcgtatgtccgtcattcactcatttttttgaactccaatttaatcatctctgtttcttacactaactttgtcctctctttaaatgcatatttttattttcagacacacatattatttgaaataaaccaaaatg

SEQ ID NO: 113222 - DNA, 960 bp, Heterodera glycines
  Promoter: Source sequence=SeqID_17472; Location=2380..3339; Strand=-; Gene=SeqID_81959
tcatcatcataagatggtggagtcacgtgttggggattttctttatttttcagttttctgatcaacaaactttgctcccttgatttcatccactgatgggtttgatgttgtttcccttaactttgtccgctcttttctggtctcattttaaggcttacactagtgctgaggaaagctcatcagtgtgaattcacttgtccctaaatatgtgatacatggaaattttctatgttttcattttttgaatagattttacgaccattttgttagccctctttgctaaccattcattttttcaatgaattaagaacaggatctgaaatttcttagccccttcccttatttaaaacgatcttctccttttttacttgaagataattgaagttccattttttgctccccccccccccacttttttggtttagcgaaaaagagaatcatacgagggagagctcgttttcagtgacagaaattctcgtcccatttcaatgacaaacacagagagaaagaactcaataatgcatcagcgtacataaagtgtaaccaaccaaaaaaaattaaaaaaaaaaaccaaaaaaaaaatgctagcaatttttccgcactttgatttttgttatcatcacttatcagccagccccaacagttttcggttttgtgtcttcctatcaacaaaaagggggagcatttgttgacccaccccacctaactttgtgatcgcaaatcgtccaataatttatcactccccctcccgcactcattaaaagcaattatatttgttgcactccaataataatatttgttgcattttcatatcgccatcctcccccaaattttgctaatttgtttttgatttattttttccagcaaaaaccacctgaaaacaaccaattcattctgacgaccaattttttgccatccaacgaaaacagtaacaccacaagcatcaattacggtgcaatg

SEQ ID NO: 113223 - DNA, 276 bp, Heterodera glycines
  Promoter: Source sequence=SeqID_8341; Location=1320..1595; Strand=-; Gene=SeqID_67740
ccccaaaaaccctctacaaaaattttctataaacgatttaaaaaataaaattttttttatggtttctgtaaagtacataagtaccttgtatttaaatacatacctatgtaagtgtgtctgactagcattttacctatttttatataccacctattacctaacacacagacaaaatagttggaaattatgtttaaataggattgattttcgtcactttttcactttcatttgtattaaattaaagagcattgggctgacaatcaaagcgcaacaatg

SEQ ID NO: 113224 - DNA, 148 bp, Heterodera glycines
  Promoter: Source sequence=SeqID_42419; Location=751..898; Strand=-; Gene=SeqID_70314
actctttgaatgattttgcgtcgacttacctctccccaccactaaaaacatacttaatatggaagttttcttagaaatgtcacaattttcatggtggggacttcggaaccacgtgactattttaggagaaactacttttccatagatg

SEQ ID NO: 113225 - DNA, 1003 bp, Heterodera glycines
  Promoter: Source sequence=SeqID_10132; Location=1983..2985; Strand=-; Gene=SeqID_73223
ctcccctgagggcacacacaaaacaaaaattgcttttgggctcatttttcagtttatttatgccacgggaaaatgccaatgcagatatttttcataaaatttcaataaattaaatacatttttttagtgtaaaatttttttatttttttattcctaattatttatttttcgtatttaaagtaatgctttaaaactcaattaataaatttgttatagtttttagtataatttttattatttttgatttaagtattaaaataaaaacaattaaatttattgcgaaaaaactgtttcaaaaataatttataattttttcattttgaaatttcatttaaaataatttttgttttttttgtaacaattttacgtaaataaattttatttattttaactttcttttggcattttaacagctattttggcaaattatttactgttccacaccaaatctgactgttttggcgttctatttttagcgctgttttgaatttcctttgaatacccttggggaaattgggagacttcctcctctgttgaccttcgcttttactccacaaattgccggacatttcatttttggcatccgccccaaaaagttgccaaaaatattcataaaattatgccgcgattttttttttgcaaagattggcactgcacaatgccaaaaaggcgcaaaataagctttttcggtcacttcgtgccaaaaatggtgtgccaaagttgcataaatgccgcccccactttttcatgaccgcacagattggcattgcgttttatatgaaagcgttcaaaaaatacattttcaatattttcttttgcattaatccaaagattttttctcccagcacagtccgttcaaataacaaatgaatttactgtattacataataccgtaaacaaaaataggggttacgatacgattgtactttttgcttttgcgcgcttttctcaactgtaaattgtgtaaaacaacaaattctctggtgaacaaccagtacaaatg

SEQ ID NO: 113226 - DNA, 1003 bp, Heterodera glycines
  Promoter: Source sequence=SeqID_1131; Location=2896..3898; Strand=+; Gene=SeqID_68306
ttttaatttttattttatgctaaaatcaaaattgcttttttatatttacaaatttttttcaaaaattctcagaaaaaaaaatttaaaatctttagttttaggggagcaaaaaagtcaattcttaggggtgtgttttacgaaaggacaacggtggaaaacatattataattttagtcattgaacaaaatgcatataaagattatcataacaagtgtttaagagaattattactaaattctaagaaataaaaaaaactattaatttacttattgttaaaacaatatattgatttttaatttctttataaattcattacatattctgttaattcactgaattaaatcaacgagataaattagtatcaaaaattatggctattaacaatgcattcagatggccgctcacgagaaattaagtcaaatgcaaaaccttaaaaaataaaaacaaacctattcatatatttaataaagtacatttaaattttaaaatttttaattttcattactatcaaatttaagaattctttatgaataaaaaataagtgttcagattttggaaaatataataaaagaaattatttttggatgtatcttagattaatcattatttaaattatttaacaaaaaaaaaattttttcgtaatttactttaagacagaataaataaaaatatataacataagaaaaagatcaaacagattaatggaattcaaacaatattttaaaaatgagtcaaacaatttataagataatctttcggtataaaaaaaaatcaaaaatattcaaaaaaatacatgagaaccgaaatatttaaaaaataataatatttaagtcaagaagatattatagatatttaactcaagtcgaaacaacaattaataaaactaatgattataatagagaaattgacttatgaatcagcaaacgcataaacaaacaatgaaattatcaatatttaatatctttatgggcagttgccaataaatgtattatttttacagatg

SEQ ID NO: 113227 - DNA, 1003 bp, Heterodera glycines
  Promoter: Source sequence=SeqID_2313; Location=7474..8476; Strand=-; Gene=SeqID_79056
gaataaatgtgatattattaattctctttgtgaccaaagcatttttcgttatttttccattaaattttaatatttaattgttttttttgtttctttatttcttttacaaaggttgcaatggctgaagcggaagattccgactttgagagctccaaacttggcaccaaagaatagtgagacagacattaagcatttttaagcaacaattttttgacaataattaataaaaagttgcttgggctttaatttggaacctataaactttggaacatatttatgaaaagctctatctgtgcctgaattttcaaattgtttatttttaaaaaatttattttccgttttcatcaattcgatttaatgagttaaaattaaaatgttcattttcaaaaaaaattttcgaaattttagcttttttgactggaattcctgatttttttccatcaaaatccataaatttatttcaaaaaatgggttccgagagggaaaatgaccattttttggtaaagtacgtaatcagttaagaattccagcctaattctctagaacaaatattatgaagtttaaaaattttcccggatttattgacaatttgccaaaatgacaaaatgaattcatttagttgggacagtttgtacgacttggaattgacaaattttgctgaaaatggcgacgaaggcgaagtttaaaaaaatcattaatttttgtaattagtttttatattttcagatttggttcggccgttccgcggagttgcgcattttgaaattcatcgaacagcaaaatttgcccatttctgccaaaatttgtgacttaggcacgggcaacgggtcactgctacgaaaattggcatggaaattttttaatcgacattatgaagaaaatcccgtcctgaacctgtgtctgggttggatccgggaggcctccgttgtcccgtccctcatgacggagttttttaaatgaaatttttaattttcaaaattccagagatatttcctttatcatg

SEQ ID NO: 113228 - DNA, 230 bp, Heterodera glycines
  Promoter: Source sequence=SeqID_972; Location=3511..3740; Strand=+; Gene=SeqID_46441
gcttccaactcttagtgaaattaagtcgtcgtgccaaaggtcagcagaaaagtgcccaagggaacctcagaataccaagcgagttggctaattgattctgatggaacggacgaaaatgacgaggacgaaagcgaagaagccgaggtaaaagcagcgaatgaaatgggcgagggagaagggtcattcattcgctgtaaaattaggaggaggagagagaggacgaacaaatg

SEQ ID NO: 113229 - DNA, 137 bp, Heterodera glycines
  Promoter: Source sequence=SeqID_19929; Location=1..137; Strand=+; Gene=SeqID_84689
aaattgaccatttcaatggttttttcctctttaattttttataagaaattctgagctgatttcaataattttaatcagttttgctaagccaattcaattccagcgaaaattgtcttaataaattgccttatcaaatg

SEQ ID NO: 113230 - DNA, 1003 bp, Heterodera glycines
  Promoter: Source sequence=SeqID_34544; Location=587..1589; Strand=-; Gene=SeqID_64309
attgtcaaagtgagcaaagcggacactttcagccgaaatttggccaaaaaagtgtcaaacattcacttggtaagacaatgaacatgaatagaaacatttaaatgttttttttttcagttcgaatgggtggaacagactgatttacttggtaagtcttaagtgattttcaatgattttgttgttaaaaatggatttcaaacacgaaacgggatacggtactgaccaaaaacggatgaaattccttacagtataaaacagagaatttgacgggatacggtactgaccaaaaacggatgaaattccttacagtataaaacagagaatttgacgggatacggtactgaccaaaaacggatgaaattccttacagtataaaacagagaattagacgggatacggtattgacgaaaaactgatgaaattccttaaagtacaaaacagagaatttgacgggatacggtactgaccaaaaacggatgaaattccttacagtataaaacagagaatttgacgggatacggtactgaccaaaaaacggatgaaattccttacagtataaaacagagaattagacgggatacggtactgaccaaaaaacgaatgaaattccttacagtatcggccaaaaaaaaactcggaacagaaattgccaaaaatgggatatttatgttttgggtcaaatttaaaaaaaaataaatttatgctggcaggtgccgccaaaaatcggaacttttgggcaaatttcaaaataaaaaataaaaagaaagaaattagtttttttttgaaattgaaaatacaagaaattacgaaagttttcaatttttggacgggcccattccttttttgtgcttattgttcgtctcgcctcccccgaaaagcccatccttcgctgcgtctgttcatctcccactccggctacaactccatgattgagtcggccatccgtggcgtccctttcctggccattccgctgttctttgaccaactccgagtggccaaaatg

SEQ ID NO: 113231 - DNA, 63 bp, Heterodera glycines
  Promoter: Source sequence=SeqID_5256; Location=1..63; Strand=+; Gene =SeqID_57471
ttaaaaacagatacatatttattaatcctatttggtttcatatgtttcctaatcttcaaaatg

SEQ ID NO: 113232 - DNA, 81 bp, Heterodera glycines
  Promoter: Source sequence=SeqID_15115; Location=1..81; Strand=+; Gene= SeqID_79298
ggggctgtcaattactagagcggaatttgggggagggggcagcaactcaacgccgttttcaactgcgtagaagaaaggatg

SEQ ID NO: 113233 - DNA, 749 bp, Heterodera glycines
  Promoter: Source sequence=SeqID_1828; Location=2291..3039; Strand=-; Gene=SeqID_76213
ggtatatttttggcaatggccattaatttggttcaaaattagcaaaaattttttgaaatttggtaggctaatacagaactctttgggctctcgaattatatcaataattaaaaattggttgcttttttagcaatgctattgataaacaaaattaactaatgcttataaaaaaatacaaatttcaataaaactgtttgaataataataataaattttaaataatgcatgctgatttatattgacggatttataaaacgcagccgctggctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccaacgcagcaaacccattttggcggatttataaaatgcgtcagcatgcattttagccattaagtgtttattttttgaataggaaacaagaaaaaacaataatgtatttaaaaagcaaatagtctcaagtttttttttaaagaaataatatttgtaaatttttaagtaaaaaaaagcatttaaaatattttaaactattaataattaatttgtttttcaaattatttttagtaattatg

SEQ ID NO: 113234 - DNA, 74 bp, Heterodera glycines
  Promoter: Source sequence=SeqID_18813; Location=1..74; Strand=+; Gene= SeqID_83496
agaagatccgtgaatacgtgtggcactgatcactccgtcgcatcgcaacaaaaaaaatcggcaacacaaaaatg

SEQ ID NO: 113235 - DNA, 542 bp, Heterodera glycines
  Promoter: Source sequence=SeqID_4133; Location=610..1151; Strand=-; Gene=SeqID_53302
tttagaccaacgcgattaacattgccaaaattaagcgccattttctggctggatcgcttaaattgcttgacagcaaaatgaattatgatgcatttgtccgtccttttactgggggaaaatttgagaaagtaaaatttaaagagaatcgcaaatattagttttgtgttcactttagggcgttcgttccattgcttggtttgttgagaaagcgtagcagcgggcgaacactttttccagttaaagcaaaaaacggattttacgagtctggatggaattcacttcacttaaggaaaggcgttctcatttttatctccgatttcaagaaaaattttcctattatttcacatataagtccgaacatttatttgtatgactcatcgaccccacaataaacgataaattatcaacaacgaaaattgcttccatttcttatttattgatttgttcgtccaagtcgatgttttctttccaatttatgtattaaattgtttctattttttagaatccaaaaataataaaactcgcgaatcatcaacaaaatg

SEQ ID NO: 113236 - DNA, 262 bp, Heterodera glycines
  Promoter: Source sequence=SeqID_361; Location=2974..3235; Strand=-; Gene=SeqID_84434
cctacaagcataaatgcaattaggcttaattggtttaaaaattgccttctttttgagccaaaaactttgtttgttttttattcggagtctttaatttaagcatcggactcgattaataatttcatccaaaaagctgctttgcctagccaaatctcggctcagtcttttcactttttaaattttccaattgcatttgagtgcctggcgtgagtgatcagcccatttttagcaactcaaacccgaaaaagaatcacaaaatatg

SEQ ID NO: 113237 - DNA, 1003 bp, Heterodera glycines
  Promoter: Source sequence=SeqID_9613; Location=545..1547; Strand=+; Gene=SeqID_72091
ttaatttattgttgaaatttattttaattataggaaactagtttttcaatatgaaaaattttatttttcaaagaattactttttcatttgtcagcacagaattggtgaagcggaaatgccgtcgacaacgttttcattatgccaattatttataataattgcacaaaaaaataaataatttttaaatattctatttagggcttatattttagtctctaaaaattgccaaaatagatactaaaaaatagaaaataggctctaaaaagcctcaaatttaggagtgtaaaataacaaaattttagtcaaaaagcaaaaaaattaagccaaatgaattacaattgttgaagccaaaattcttgtcaaaaaacaaattaataattttaagatgaatttttgagaatattttcatttcttagggatgtattttcgtttttgttaaatttttaaataaattttgaacataaggccaaaaggcaaaaacagttttttaaaggtttttagactttaagctctaaaaataaaaaccttgaataggcttacaaggcaacatttcgaactgtaaccacccagatcagtttaaaaccacttctatcgtatagagaatgatcgatttactattgccaatttttggcttttttggctccggcgccaaaaatgatcagaaaaaagtgatcaaagtttcgaaaaatcgataaaatagtaaaaatttttaaaaattcataaaaaatttaaaaataaagttagagtaactaaacttattttaaagtgatcagcaaacatttctctatcaaatggcatcataaaacaaatttaaataattgaataaaaatgtgttaggtgaacgaatagtttgaaaaaaattcaaaataattcatcatctgtccagcgggtttgaacccatgacaaatggtaaagagtagggttgagcggtaccggtaccggtactggccggtaattaccggtttttttggtaccggtaccggtaccggttttttcaaaaatg

SEQ ID NO: 113238 - DNA, 66 bp, Heterodera glycines; identical to SEQ ID NO: 107353
  Promoter: Source sequence=SeqID_22332; Location=380..445; Strand=+; Gene=SeqID_53011

SEQ ID NO: 113239 - DNA, 549 bp, Heterodera glycines
  Promoter: Source sequence=SeqID_2861; Location=6660..7208; Strand=+; Gene=SeqID_82023
tattagtccaatcgacttttatgagtccaaccaattgaaaatactttgtttttatataataattttttcatgttcgaacaaaccctttatttttggtatcattcgaaagtccatagtctgaataatgtaattatacgagaaaacaagagaattataacatttaaagaaagttacaaatggaaataatcagcatcactcaattcatatcttttttggtaattgcatgaacgctgcgattttatatcttttagcttcgttacacttggtgctttcgaatgataccaaaaagataggtttagctcgaacatgagcaaagttattgtataaaaacgaagtattttcaattgattggactcataaagtgcatttgtgccaaaaaaaaatcgaccattttcgcataaaaaccctgatttttctgaaaatagccatcgattcagtcgaataaaagctcccattttatcaacacaaaatttgccaagtttgtcagcttaacgactaatttgaattagattgacaaaatatttcaccgctttcatttacttcgacatg

SEQ ID NO: 113240 - DNA, 462 bp, Heterodera glycines
  Promoter: Source sequence=SeqID_3733; Location=1652..2113; Strand=-; Gene=SeqID_51666
aaaatagattaaggtgttattagatgtatgtccaacaattaataattttcgaaaggaagttattttattaataaaaaacaaaatttagctggtggaaataaaatgggaaattattttttattaatagccatttttgggccatttcctcctttctaatctatgagcatttttttgatctgaaacattgcatctataggcattaatcgattagatagcaccactttaatttagcagctcggtcgtctcttctcgtaacccgccggaagcccgcaattcccgggtcatatgatttaaaagctttttggcggccggttaattaacctcgcaatttcgctgaatcatttaatagttgatcataaaaaactgataaattttcatggtataacctagtaagtaaaattgtctaatttatttttagacaaaaattggagttgcaaatgttcagcaacatttcaaattatg

SEQ ID NO: 113241 - DNA, 248 bp, Heterodera glycines
  Promoter: Source sequence=SeqID_2963; Location=819..1066; Strand=+; Gene=SeqID_82528
ttagtgcgaccaagccccgaagggccagtcagcgaaccaattttattgccctttgttcgcgccaatccctaaatggccaggggcagggaactccgaacaacagacgcgttgctgatgaacagaggacaatcccaccgtagccaaccttctgtttggaaaaagggaacttcgaacaattagcactgctaattaatcaaaggacaatcctcttttacaaacagttagctgggatacaaggccagaaaatg

SEQ ID NO: 113242 - DNA, 105 bp, Heterodera glycines
  Promoter: Source sequence=SeqID_6530; Location=2711..2815; Strand=+; Gene=SeqID_61910
aaaaaatcaaggtccagattaggcacaaaaacctggacttcttggatattaatcaaaaatttaaattgataaataacaaaaatttttaatttaaggcccaaaatg

SEQ ID NO: 113243 - DNA, 57 bp, Heterodera glycines
  Promoter: Source sequence=SeqID_16392; Location=1069..1125; Strand=-; Gene=SeqID_80785
agttaaaaataattttgtttttttctaaaattacaatttttaaagcctcccctaatg

SEQ ID NO: 113244 - DNA, 334 bp, Heterodera glycines
  Promoter: Source sequence=SeqID_12794; Location=717..1050; Strand=-; Gene=SeqID_76527
tcgctatttctccctctcacccgatttgaaaaagtgatcaaaaaagcacacggcgccgttccttctgctgctttcaaaaccgatcaaccgaatcaaaacgggggggggggggtggggcattccaaatttcgtatcatcattccgcttttacacactgctgatcaagccagcttcctctccgcccccattaagcttaaactctctctctgtctacaccgccgccatcattcactccataccttcccccccccccattaccccttgtaatggctgatcgaaaatagctgtgggagctcaaattgctgtgcgagcaaaaaagacaggggccaaaatg

SEQ ID NO: 113245 - DNA, 895 bp, Heterodera glycines
  Promoter: Source sequence=SeqID_20104; Location=1..895; Strand=+; Gene=SeqID_84892
gattcggtatttcaaaataactaaccaccagataaattcaatttgattttctaatattgtttataaaacatgaaaatgccgataagcgcagtgatagcagatgcacaaaaaatcgcgaaatatgcacctaaaaaggcataaaaatgcaaaataggcaatcgaaataatgatgtttttatcttttcttagtagatttgaatttgatttacatcattaaaatataaaagagaataaactattatggtgcattgtttattgattaatttattatttatttttagctttttgttaaattgtctttttatgattttcagattaaattttgatttagtttttgccgacgcttatttgggcatttttttaaaaagtagttttcttttccagttttttaattattttaactaattttatattttatttatatgcttattttatttcctgaacttcattatctttttgttagggatgcgatttttagggacaaaaaatcgcgaaataggcactaaaaataacaaaataggcattaaataggcataaaaatcctcaagaaaaaacatttaaatattggggatcaatttttgtgaaaattttttcgattcttaatggtttattttctgaattttttcagatcgattattaggggtgtatttttcttttttattgcatttttgttaaggatttttccgaaaatcctgaaaaagactcaaaaaatgccaaaataggcacaaaactaggcatttcggcattaagcacaaaacgtattaagtgcgcagaaattttaggcatttccctaaaaaatggagtcaatatttttttatcaattttaatatttaaaattattttttaatgttaattatttattttttctaaattttaggcatttccctaaaaaatg

SEQ ID NO: 113246 - DNA, 728 bp, Heterodera glycines
  misc_feature (26)..(26): n is a, c, g, or t
  Promoter: Source sequence=SeqID_23801; Location=1..728; Strand=+; Gene=SeqID_54505
tttggatttcatttttttaatctctntgttttatacaataaatttttcaaaataaaattgcatgcaatgtttaaatatatttttatttgaatttagtaaatatatatatatatatttattttatattattaacagggattctttttttatgtaagaaaaatcgcgaaatatgtaaataaaatatgtataaaaaatgctaaaatatgtatgaaatatgtacaaaaaccccaaaatatgtactaaaacatgtaaataaaaattttttaaaggttattttttggaaaaaaaattcttcgtaaaaagtgaaacagaggcataaaatgccataaacatgaccaaaataggcttagaatcaccttttaatatatcaacaattaatttttgatatatcattttttgaaaaaaaaattcgattttttagggatacattttcacaaaaaatttctgtaaattctcaaaaatcctcaaattatgtaaaaaaaaatgaaaatatgtacgaaaaagtccaaaatatgtataaaaatatgtacatatgtaataagtagaaaaatcccaaatatgtaaataaaagtcccaacttttgttcgcaaacacaaaaaaaaaagttttttttctactaattaggctatggagaatccaggaaaaaatatgtattcacataaaaaaagaatccctgattattaaacattctctgtaattctttttgttttattttgctaaataaaatg

SEQ ID NO: 113247 - DNA, 606 bp, Heterodera glycines
  Promoter: Source sequence=SeqID_3529; Location=1508..2113; Strand=-; Gene=SeqID_85049
gcacctcacgaaggatcctacagagaagcgacgcttcctaaacattgtcccttccgccggttgacctcgagccgagcaaattccattggggaatggcgaagggccgcgcctggtcaaagtgcagccgaatgtccctctccaagttcgtccgcaattccatcagctgattttcgtcagtttcgccatagttcacagtttcgggctttgggtaaggagaattttgaactgtaaaaacagattttgatggaaaaacctgaagggatgggaagagagcggaggaagggaaaagaggcgcccaattggcccttttggccaagtcaaagtccaattgggacggatgagacgcattttggaggttcacataaacattattgtcagacaaaacagtgccaacagagagaaatggacacgtcgaatcggagagatcaaaatgatggcctggggataattagcggaaatgtgattagccttttatagcaggacaaaatgacgaccatttgagggaatgattagccatcggtcgccgtcggggaatttgacgtaaaccgcggcggagttgggcccatcgggcagagaggagccgagaaggagcaaagcagacaaatg

SEQ ID NO: 113248 - DNA, 285 bp, Heterodera glycines
  Promoter: Source sequence=SeqID_44353; Location=590..874; Strand=-; Gene=SeqID_71852
tggaataaattttggaactgcgctgcctaacggcggtgcttaaagtgcgctaaaaatgatcaaatgattatcaatttttatttttcttaattccaaagtgaattcgaaacgcaaaaatttaatcataattcatgtggtaaaaaatgcatttaaaaataaaaaaattcttgaatttgcttctgaattttttaattttaaatagaaaattcctttttctgaaattcacaataacaatttggcgaagaaattcattgaaatttttataaagcattttgattaaaaatg

SEQ ID NO: 113249 - DNA, 89 bp, Heterodera glycines
  Promoter: Source sequence=SeqID_14263; Location=901..989; Strand=-; Gene=SeqID_78282
tagtgcgaaaaactaccctttaatattgattaatatttttatatgactttttacataaatttatttcattttaatatatttttttaatg

SEQ ID NO: 113250 - DNA, 1003 bp, Heterodera glycines
  Promoter: Source sequence=SeqID_6420; Location=1449..2451; Strand=-; Gene=SeqID_61505
aaatttctaaagaaagatagtaatttagaaaaaaaatttttagcaatttaaatgcaagatttcgttaaatggggctgactttttgatcggaaagaaatatgtaaatttatactttatttgaattttagaatttttcatttaaattaataagtaaaaaaaagaataatatccaatttttcatgccatgggctttctatttaatactcaaaaagtaaaaagattgaaaaataaattttggccaaaaatacgccgttattttgcttgtgtaagcgaccgcatttagtttccctaaaaagtgtgtgtgtgccgtgccatttcccatcgcattcagtggcaaattccacccatttttatgccaattcctcacatttagcagcacaaaagcagtcagtcagtgtggggggggggacacatcaatcacacgcaaaaattagaccaaaaagggtccatttttggggccaaactcgaaaatttgtacatatacaaagtaaaaatgacaattacggtggcaaaatttggtcgataatatttgaaaatgccaaattgaatgcttaaattggtaacacaattaagggcggcatcaacccaaacaaagaacataatgaatgggctttaattgcgtgatgcttattgaatttattatgggaaaataaatgtttgaacaaatgtgttcaaatggagctttttaaattgattttcatataaaattcaacacaaagtgcatgatttgacttaacaatttcaatgaaaagaatatcctaattataaaaaaaaataataatttaattaacaaatgccgaactgttttcattgactaatgttggtatatttaacggggaatgtttgaacaaatgtgttcaaatgagctttttaaattgattcaacatacatagctggcatgatttaaaaacaatttcagtgaaaaaaagattttcttaaaaattaaaatagattttctattaaaaatatttttaaaaaatagtgatttaatttaaaaaaaatg

SEQ ID NO: 113251 - DNA, 107 bp, Heterodera glycines
  Promoter: Source sequence=SeqID_15915; Location=289..395; Strand=-; Gene=SeqID_80259
tggcgcgaattaacatcatcggcagagagcgaactttggggacggtcagcagaaagaggggcagacgaaatggaacggcggacgaacggaactaaggaaagagaatg

SEQ ID NO: 113252 - DNA, 1003 bp, Heterodera glycines
  Promoter: Source sequence=SeqID_17836; Location=145..1147; Strand=+; Gene=SeqID_82368
aaaaatagatcatttatcgcttctgcagggacttagttggttctttttttggattaatttccttctttgttggggttcaattcgttctcatagcgttatgtatttgaatatatttttaaaaattttgcttaaaactatcatcattataagtaaataaagctcaaaatttttttaaataaataattttcctcttttaatacataaaagttacaaaaaattgttatttttttacaatttaactaatattcctaaaaattgaactttttgtataaattctgtaaacaacttggctcaaaatcacaatcgttttttgaacaataatttttagaaaacaattcgattaaaattaaatttttatcttaggccatctcagaatatatacaaaaatggaatttgcgaaaacaagttagaaaaattttaaggcctaacttcggttaagcctgccaaaaattgtgaaaagggtcttcagaacaaggcctcacattcagttaacacgctttaaacaagcatttcttaatttatatgaaatttttgctgtatttataatatgggatagaagcaatgcaagtgtaacgaacaaatcatgaacactctcttctttactctcgtttctatggccctttttgtctctctgcttcgtttttgtttctttcttcctttattaacggactctcacttattctctgttctctgccacctgtggtctctcgctctctctctttctctctctctttctgtctctctctcgccctctctctctctgcattcaaaataaaacactatttccttctgtagaaaaccaaagcatgagcccattttttgcacgacggccattgcaaaccacgccaattcgtcttaaaatttccgtcttttgatcccttaaaaattaaattttcattttcctttccccattttgtaatgattaccaaattttgacggttttccattaattaattaataaataaaaatgttaatgctcagcagcaaatttgttcgaagaatg

SEQ ID NO: 113253 - DNA, 253 bp, Heterodera glycines
  Promoter: Source sequence=SeqID_13105; Location=1700..1952; Strand=-; Gene=SeqID_76898
tacgtttgcttaaaaaatattaaatttacttcattcataattttctctatcaaatttaaataaaatttctttttttttcaaaaaaataatttactctgctttcatatccagccaattctattgatttatttgcatatcaattgaaaatattatataattattagctataaattatttttaaaaaatttgccgtcgtcactttttagttttttatttaacatttattacataaaatataataaatatcgaaatg

SEQ ID NO: 113254 - DNA, 206 bp, Heterodera glycines
  Promoter: Source sequence=SeqID_395; Location=1250..1455; Strand=-; Gene=SeqID_51349
tatttcgctcatggttaatcaaaaatgctatataatattaacaaaatgagaaatattagcagttaaaactttctttcaaaagtttttactttttcatccctacaataagttttgaatcttttacgatttctttttgttatcgaaaattaatttttaacaaattttctcatcatttttcatagccgctgagaaggaacgataaaatg

SEQ ID NO: 113255 - DNA, 290 bp, Heterodera glycines
  Promoter: Source sequence=SeqID_14909; Location=1369..1658; Strand=+; Gene=SeqID_79070
atctgcgtgctttctcttcggcagttgtggcggtggcggtggagggggcaagtggtacactggtgtcggggtctgcgtacaagcattggagcgaaaaccatggtcaacgttaaaaacacggcctttgtttcgaatcttacaattttaaaatttgtttcttgaattttaaaagcccaaaaaaatgatgatgatgcaggtcagaaggaaatgggtaaataaatgccaacaccgattaccgagacttttcattttctttcgttttttatcctatttccctctccaatattatg

SEQ ID NO: 113256 - DNA, 773 bp, Heterodera glycines
  Promoter: Source sequence=SeqID_9501; Location=1..773; Strand=+; Gene= SeqID_71649
aaccctatctttttggtatcattcgaaagcacaaagtctatagaacctaaaatacataaaatctcagcgtttaggcaattgccaaaaaagatatggttaattaagtaattgttgattgttttcgtttgtaaatttctttaaagcttagcattctcttgtttttttttgtattattacattcgtcagactttgttgcgttcgaatgttaccaaaaatatagtaatgtacgttgtcgaattgtttcgaattttttagagcatcaggttaggtaaatcggtttttaaaatggttaaaaagtatgtggttaaaaagtatgccactttgtctatcaaatgaaaatttttttttcatttttttgagaataatggaaaaatatgaatgtgattctattttggtttctgcacgtgattcaataaatcgcgtccaaatttcctgtcccaaaaattggaataggatgtcaaaatgttattttgtaaaagcgatcgatggtttcgtgcataaattaaagcctccgatgtcccttctcccctccccaccacttcttttatctctcatttccctttttcaaaattttcagtggtttgctgctcccatcacaatttatgaaaaactttgttttttttggtaattttaggctcccaagaaaaactgaaatttattttaggcaaattcggctgtctgatacaaattatccttgaaaaaaagaaagggggccaattaaaattgttggtgttccagtttatgtttcgtcggcactgcgctttggccaaatg

SEQ ID NO: 113257 - DNA, 294 bp, Heterodera glycines; identical to SEQ ID NO: 99762
  Promoter: Source sequence=SeqID_20956; Location=686..979; Strand=-; Gene=SeqID_51536

SEQ ID NO: 113258 - DNA, 588 bp, Heterodera glycines
  Promoter: Source sequence=SeqID_9321; Location=777..1364; Strand=+; Gene=SeqID_70991
agttatgttttttttcaaaagacatgaaatcatatttccgagcgttttcgggatcactggtcacgaatctccgggtcggggcgaatttgatcgaaattaatgtcaaaatcggattaattcctaagaatttttttaggaaaaatttctaggtttgaaaattaaaaaaaaattttcggaggggaaacgacgggggaaatgaagtgcaccccctaagacaaccttagttcaagaaaaaaaaattttttttttttaaaggggaggggggtaccatcgacagtattaccattttttaaataaaaacttttgtatgtaccgtattgtctctaattatcgcccggggggataaatggagacggagggataattagagatattatacggtattgtgtgtttgttcatcacaggtacattgaccattccgtcattgcatttctccatgcaaacaagcaactttgggacaccaaaggcaccaccgtgtatttttgtgtggactcggatggcaccgaaagtgacgcacatcagctgcagcatcagcagaattgggatgtgttggcccgcgaaatttggcccatcttttcggcaaatatg

SEQ ID NO: 113259 - DNA, 79 bp, Heterodera glycines
  Promoter: Source sequence=SeqID_6905; Location=2256..2334; Strand=-; Gene=SeqID_63249
actcctcaaattcgtctttcgattatcgcctcttttgttgcattttgagcaatattttgttaaaaattgtttatagatg

SEQ ID NO: 113260 - DNA, 1003 bp, Heterodera glycines
  Promoter: Source sequence=SeqID_4662; Location=449..1451; Strand=+; Gene=SeqID_55273
ccgcaagtgtcagcgccgcaaaagtcggcgccgcaaatgtcgcatcaccgaaaacatcttggaacttttcatcccaattaaaccctaaccaatcaatccaaaattagggtaattcataaaaaaacaattgggtttcgctccgacccttttagcatccatccatttggcaattcgatcgctttgcaattttcaagccgatcaaaccgattgtcagtggcaccagcagctaattgattaattaataaatttgtcgattttgaccggaaccaaatgattttatgttgttctcgcttcacccttttgcacccacttttgtgccctttcccgcttttgctcatccccacaatcattgtccgactgcttacaaaataatgagttgctgctgatcaatacgacaaatgaaccaggaattgagcgaccttaggacggaacactcacggagagaaaaataatcggcgaattaaacacagagagtggataaatcagtaacaggagcaaaatcattttagaatcatcgattatttaagccgtgtcgagcgacgagaccgagcagtacagatagacatgggtgctgcttctgatttgtttggtacgcaaaatcgttttcacctgcgagaggccatccgttgtttttcagcagccgcaaaaacaaatgggatcgcaactgctggccatatttgaagtccgcaaaaaatgatttttttggcaatttaagtcctaccgatcggagactattccgagtcaccatgacttatcgctttaattcacgacgcaatgacaagcggtcaatttgaagcatttcatgagcaaatgcacgagttattattcgccattttgagccgggctcgcagtgccagtgaaaatgcgacgagggcacaccgcgagacgaagtcgggccaactctttgagcagtttggctagtggtttatgatgatggccgacggggagaaatgccaaaacgaactgcggagaagagcagaaacattgctgtgggaaaaagatg

SEQ ID NO: 113261 - DNA, 159 bp, Heterodera glycines
  Promoter: Source sequence=SeqID_14776; Location=179..337; Strand=+; Gene=SeqID_78914
aatggtttgtcagtcggtcgaccatttgtctttgtttgttttgtccgtccgtttggacattttaggcaatcgacggatcgcgacagacgcaataagccaaagttcacccaaagtgcgctcagagcgaacgccaatcgtccgcttcgggtggcggagatg

SEQ ID NO: 113262 - DNA, 184 bp, Heterodera glycines
  Promoter: Source sequence=SeqID_361; Location=2475..2658; Strand=+; Gene=SeqID_84435
gctgaacaatcaaaatgtttggcgaattcatcaaaattttaaattgtcaaattttttccgtttcgtcgccctataaatactctttccaaaatcagttttggcaatccaataaaatttctcttaataaaaaaatactcttcaaataaataatcattcctagctgcttttggtttgatcacaaatg

SEQ ID NO: 113263 - DNA, 59 bp, Heterodera glycines
  Promoter: Source sequence=SeqID_29265; Location=1..59; Strand=+; Gene= SeqID_59793
tcggagtcaagtctcggtctcgagtctcgggaatttttcggtctcgagcatcactaatg

SEQ ID NO: 113264 - DNA, 96 bp, Heterodera glycines
  Promoter: Source sequence=SeqID_19054; Location=947..1042; Strand=+; Gene=SeqID_83794
ttgcgctcggatagcccttggtctaaaaaaatattatttctttaaaataaaaaatagtctacatttttcttgacagtttctatgtccttgaatatg

SEQ ID NO: 113265 - DNA, 209 bp, Heterodera glycines
  Promoter: Source sequence=SeqID_34963; Location=166..374; Strand=+; Gene=SeqID_64645
aattttttaggcatcaaaatccaaacccaggtttttttttgctgtgatgctgtttttttctaaagtagagacaaaaaattgtcataattttctttaaattttccgttgaaattttacaatattttagacaaagtttcaaaaaaaattttatgtaacgaatttttttgaagcggaaatttctatttcaatatagcttctactgagaaatg

SEQ ID NO: 113266 - DNA, 829 bp, Heterodera glycines
  Promoter: Source sequence=SeqID_13292; Location=3980..4808; Strand=-; Gene=SeqID_77133
ttcaaaaaataaaaattaaatttaaaataaaaagacaaaatttgtaaaccgttggaaacgaaaaatgaaaatgtacgataaataaacggacaattaatttaatcgtattgattttctccatcattcctttgtaaataataaaattttatttatcagttttattttaatgaaaataaaaaagttattcacttttataattcattttttgatgcttcatttttaatttttgatttccttaatgttgtctgaattcaatcaacaaaatattttttcgtttgtaactttcccaactaatttaattttgaatttctattttcaattaaattaataatattaaatttattatttgttgttttttcaactcatttttcgtgcacatttgtcgatgaccttttaacattttcggctgatgactggtagaacggcggctaatctttgagactgatcaatcattttgttccgtcagtccgtcgtttgcgcttccccccccccccaataaaaacaaaatattttttattagtccaacatcgatttgcgcgaacacaacacatcgaattccccaacagaatgtccgtcccgtcaaaagtccgtccgccgcgatggcctttcctttttcagctaattcattaatgaaagcctttgttaaaagcaacgcaaaatgatgaccttgtggaaggagtgaatgctttaaagtgcaaaaataaattttaaaaagggacaaaaaaggtaaagcattggcctataaaatgccaatggcccatcaaaatggaaggaacaacaacagttggccaacaaaagtcactcttttcaacgccttttgccacaaatg

SEQ ID NO: 113267 - DNA, 222 bp, Heterodera glycines
  Promoter: Source sequence=SeqID_19394; Location=1..222; Strand=+; Gene=SeqID_84118
agaatatcggttttttcgagttcgagattaggaggtctatattgatattagattcgttatcagcaaccccgaaaacccacgggaacacctttcaccattattctaacgccgtataaatgaggcacaactctgtgtaatatatcgaagtcttacaattagtgttacatagtattaaataccgatttttgttggaagaatggactattgaagatccaaacgatg

SEQ ID NO: 113268 - DNA, 83 bp, Heterodera glycines
  Promoter: Source sequence=SeqID_26284; Location=1..83; Strand=+; Gene= SeqID_57032
cctgttcacccaaggatccggaaaggttcgcgctctattcacttatgcgccactttcccggtgaccctgaccatcttaaaatg

SEQ ID NO: 113269 - DNA, 777 bp, Heterodera glycines
  Promoter: Source sequence=SeqID_12173; Location=1173..1949; Strand=-; Gene=SeqID_75749
tttttataaagttcaacctaaaccattgttgttttatgtgtaattttttgtaaatttttgtatagtgaatttcatattcttggcatttacatacatgtgcatgtacatggaaattgagaatggaatgaaaaatcaaaaacgctaactcatcgaaagaaacccaaaaataaaaaataaaaatttttggtttgtatgtattttggcattttctctgaagcgagagagagagagagtagagagtgagaaaaataaattcttgcagacagaaaaaggtcgcagagaacaaacaatgccttcgggaagggaaattatggtggatttctgaaagcagaagggggcggagggcgtcaagggattttgggatgaacagcagctgaaggaagggatggcaacagaagagagggagagagagagggagcgaaggcgtcttcttccttcgtcctttctgttgctttgctgcctcggcgtgggcgggggggggggagagcaaagagagcgttgtacagtgaggggaggagagcgattcagccatttttgtcctaatagttgtgtccgctctgctggaccttcattttcgtgagattcgaatggccgtcctctgtccactctttcccaatgcgaattcgttttatccattatttacgaggttcgctactttcccttgcttaaagaaaaaatatgacagtcgactttggttgaatttatttgcttttaggtttcatatttgttatattgacataagtatctaattagcactttgttattttctgcaaaatg

SEQ ID NO: 113270 - DNA, 562 bp, Heterodera glycines
  Promoter: Source sequence=SeqID_44668; Location=1..562; Strand=+; Gene=SeqID_72122
aaaaatttttaaaaaatttttttcttttcctttttgatagaaaaagcatcagagagcttttatttatcttttaattaacatttggtggctttcagagcactttctgaaaaaatctttatgattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcaaatttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 113271 - DNA, 727 bp, Heterodera glycines
  Promoter: Source sequence=SeqID_7192; Location=1400..2126; Strand=-; Gene=SeqID_64100
tatttgcaatttcttaaagccgataattttattgatttattataaaattagagtatttttatttaaaaccggtactttatttaaaaagttcgaacaccagcgggcgccggacttttcgacagaaggaatttttacaacaaaggacattttccagaaatattataaattttatgaggtgacttttcgacaatagatttttcaaaagtaaaagcaatcatgtttcaatttagggggttaatgtaaagttttatacaaaaagaaacaaaattaagccaaattagtattgagatacaaatatttcaaacaaaaatttttaagaaaatatataaataaatttgatcaaaatatgtatttttaaactttataaaaaactagaaaatagttgctataatcgaagagtagcttaacaagcgtactttcgggccacttaaagctcaggaaaaaaggtaaaaccaaaaaaacgtattcctaatatttatttagaaatacaaattaatgctaatttaaaagaaatttaataaaactgacaaaccataatttatttttatgtttactgtcgaaaagtccattattttttgtttattgtcgaaaagtccttcactatcgaaaagcccgttgctgtcgaaaaatcgggagctacaccagcttgttatcttgagaaataagggaaaaaagaatgtgggattggttattttaaaaaataatattaacttttaagccaataatg

SEQ ID NO: 113272 - DNA, 65 bp, Heterodera glycines
  Promoter: Source sequence=SeqID_9182; Location=3270..3334; Strand=-; Gene=SeqID_70508
tagcacgatacgagtcgtcgccgtggcatttaatgccacgactaagaccgtacaaccaaaaaatg

SEQ ID NO: 113273 - DNA, 1003 bp, Heterodera glycines
  Promoter: Source sequence=SeqID_5540; Location=194..1196; Strand=+; Gene=SeqID_58390
taaaaaaatcacaaccaataacgaaaattttctcgttaccataaacgtacatattgtgcatgtcataatgcttgtagagttccgtcagtggcaaatttggtcaaacttgacgacatctcacacatcggtttcgccgaaaattcctccattggctgacgctaaatttttttaattaaatacagaagggaaacaaatgtgagagtgggcttcgtcagtacgaggtctctcttttctagaaaaaaagttctgtttcagccctgactcgtatacagaacaaagtaatcatcctggtgggtctcatgaagcccatgaggcattaacaaacaagaaccacgaagccaggctaaagccaccagcaaaccggatcaggacattttctcctgggcttcgctcaaatttgtttttaattatctaatttaaagccttaaaacatttaagaagtatttaaaaactcgaaaaattattcttgaattagtttttcaaaaaaaaattttgaaatttttcataaaaatttttaacgattttctttttgattaactaaatgtaagctagaaatttttcaaaaaaattagggagtcggggaagtaaagtgcaccccgagcaaaccaacaacggctggtgcttcctgccaaacacagagagaaacggcaacaagttgcgttacctgaaatggtcaattttgaaaaaagtgtatatgtagccaaaagcaaaagtatcatgtccaggtacgggccatgcatggacaaaggagtcatgcatttagcatttacaaagtaaagaaaatcacgccccccacccggttcctcaaaggacaaatttaaaccattgaaaaaaatacaaaattttcctacgaacttacaaaagaaatttttttaattttgtcaaataaattgaatatgcgcaaaattatataaaatttgtttgcaagccttttaaaattggggtaggtaagcaaaaaatgagataaattgtatgttttttttttgctaaattatagtcaatg

SEQ ID NO: 113274 - DNA, 541 bp, Heterodera glycines
  Promoter: Source sequence=SeqID_880; Location=2134..2674; Strand=-; Gene=SeqID_63216
catcaaaacgtgtgttttgaagggcattgtttgtcacaaagggtcagcaaattaattaaacaaataaatttatttattttaaaatcattttttattattaataaaatgttaaaattttaaataatttatttttataagtaaatatatttattattattaatacaatgagtaattaattatatttcaagcatttttatttttattaaattataagttcatatatttaaatgcatttatttttattattaaattaaaaacttaattatatttaatacatttatttattagaggaggagtcaattaaataagcataaaatttataagaataatgaatgcatttgttgtttttttaaatattgccacataattactattcttgtaatatttaaattagataaaaacccgaaattatacgatttttaaaaagcaataaaattataatgaaaggcaaaaaatttttaaaaaaggaattttatttgaaaatcattaccaaaatacaaaattttttgctagagtgactttctgttttgtcggcaaaatg

SEQ ID NO: 113275 - DNA, 204 bp, Heterodera glycines
  Promoter: Source sequence=SeqID_10576; Location=2569..2772; Strand=-; Gene=SeqID_46883
tttttcaatcgcttttttaaacaaaacaagggaccccccttttggtgactaactcacagaccactaagacgaaaaaacccacttaattgtacttggagcccaaaattgaatcgccgtgattaaaaaaaattaaatttctttttttttggtagggtaaaataaaaggttgagctttatgttttcatgaatcaacgaagcgaaatg

SEQ ID NO: 113276 - DNA, 1003 bp, Heterodera glycines
  Promoter: Source sequence=SeqID_31167; Location=353..1355; Strand=-; Gene=SeqID_61542
aaaaaaacaattaaatatcacaatatttaaataaataaattatctaaaactcaagaaaattgataaaaacaaataaaataccactattaaatgtatcaaataatttcttcattcagccaaacattaatttgacaaaatatttcaatctaaattacataattaattttttgaatattttcactcatttttctttattctaaaatttttcaaaatttattttttaactttttaatgcaaaagcaaaaacattaattgattagttttatacgaataaatgccaatttataagttaattatttatctttttttcgactttttatgaaattttgttactcgacaaataaatttttttcctaattttttccatccataccctacaatttttgttttttgaatttcctctccgatccctgactttttgatccgctaactttgcgggcaatttcatctccgatccccgacttttctctccccgccgattgtcggagtgtacttctatgtttaaattaatcatttacattccattttatgcatttttatttgaatattaaataaatatatattgtatatttcaagaaattattgtctcttaatccctgcaatttaatccctacttttgctatacaactcaatttttttcccatttacaaattgtcaatcatctgcatcccattttattgaagcagaaagaatgtgtcgaggattatgggggaaacacctcttctgctgttgttggaaaagatttgtgcagtcaattaattatacacaaattacggttgtggtcctaatgaattttgcacatggtattagaacaattttagttgtaaccagtactttctcatagcaaaaaaaaaattgaggataaatagtttgtacaattaaaatattatcaataactaatttgatttttttaaatattctaactttcaatcacttttttaatgaaaatttttgtaaataaaataaatttttaaattagaaaaaattattttaacagaaaatg

SEQ ID NO: 113277 - DNA, 1003 bp, Heterodera glycines
  Promoter: Source sequence=SeqID_13656; Location=417..1419; Strand=+; Gene=SeqID_77556
ttttattatatttataaatttgtttttaaaattatattttgcaattaatggttagtatttagagcacaccatttgtccggattacggtagccccccccacacttatgggaggggtgcatggccaactgagcgccagccatttgagcgccaaaatttttcagtactgaagcaaaaccttttgcgcgacttttcttgcaaacccaaacctattgtaagggggtgcgcggcttttttcttactgcgcgacttttttgctgcgcgactttatttacattattttaattaattttaaattcaatttaaacatctaaaggtcaaaatatcttaacgtgttgaatttaaatgcatttaaaatttatcaaaaattccccgcaccgagcggatccgaaccacggagggggtagccagactgacgtactacccattcggccacattggcaatgggtgataaacattaatttgctctcataaagggaaaaattgacgtcaccagcggggggaggggggcgagagcgtgtggcaagaagggcgggggtgttgaaaaggtgccaaataaacaaatcaattaaataatttccaatttacgtttttaaagacaaaatgaagcgagggactatataataaaaataatattattaaaataattataaaaatgtttaaataactaataattatttcaaaaaaaaatattttaagtgaaaattaacaataattttaactttatttatttctcattaatttttagagtttaatttatcgtttgctgtcgggtgttttttactaataaaataatttacttgaatttattgatttgtctgttcatttttatctgctcaaaaataattacagcaaccgttcaggtgttgaactttgtttattttgccgtataattttaatttcgcatccttgcgctgcccctcactctcacctgctcattactttattccaataaattaaatttcaattaatgttatttaacatttggacacaaaaacaaatcatg

SEQ ID NO: 113278 - DNA, 666 bp, Heterodera glycines
  Promoter: Source sequence=SeqID_4; Location=1274..1939; Strand=-; Gene=SeqID_50783
cgcagataaagctgaaaaattgaagaaaatatttaaaattttttgttgaatttttacattttttttttgttgggggcgtcgtcgttttttgacatggccaaaaaataacccaaagagtgatggcccaatcgaccaacagcagaaaagtgcagcaacaaaatgagaaaaatttagggagaacgaatgaaatgaggaggaggaaacgaaaaaagggaccacataaaagcaagcaaataaataaattaattgtctcttatgtatgtcatgggaatttttttttggggggggggggaaccactttaactactaccaaattctttagacaatctttcaattatcctaaaccaattggccaacaaaaaaaatcgagaaaaataaatgagtatgtatattatagaaggaatgaattaacaagcatttctgagagaaaataagcacaacaattgagatcgatcatttctcaaatacaataatattcatttccatacacttaatcagacgacatctttgttgcttctatccgcttcttcttttcttccatcactttttcttctgctgctcaccgcactaaaaaaagaaatgcgtatttttgtttaaggtatagtgagtaaacatacgcggctggagcggtccttctggcgttcaacgtaatccgattttgccatg

SEQ ID NO: 113279 - DNA, 231 bp, Heterodera glycines; identical to SEQ ID NO: 104497
  Promoter: Source sequence=SeqID_34311; Location=402..632; Strand=-; Gene=SeqID_64133

SEQ ID NO: 113280 - DNA, 912 bp, Heterodera glycines
  Promoter: Source sequence=SeqID_21002; Location=1953..2864; Strand=-; Gene=SeqID_51580
tttggtgctcgtcgccatgcgcgacattgacagcgacgaggagttgctgtacgactacggggagcggcggccctccgtgctggcggttaacccgtggattttgggctcataggtggcgaggaatgtgcctctattgtgttttcatttcgtctggcggcgtgacaaggttggtccaaacccccaaagctcaagcccatcagtaggcaggctaatgacagagcccttacattgaaagaaagaaatttctaaaatttttaataaaaaaccctttctctctcattgttatattaattgtcatacatcccaatcaatcattgacaaatttccgtaaaattttcaaaagcttcctttggtcattcctttccgatcactaaccatcaaaggaaagcaatgacgacattgcgcatttgttgaacattcttcgcgcccgcggtgccatcgacggcggactccgttacgcgcccaccaatggcatgatcagtgccatggcagctgatcaaatttcttctcaaatgcgctccattgagccggttggcatttaagcagattggcacacaatgccaagccaattaaacaccttttgtccaataaaggagaaagtgccgacattgagcgggaaaacaaagcaattggctgatcagcaacaatttccattgccagagtttctctcgctgcacgacggacggcacattctcgacaaaacacaacggcaggtaaaactgatcagagtttttggtcccattgtgttttcttttcctaaacccattttcggcggcattttaaagttccgccactttaatctcggtttagtttttgccggacggaggaggagggaaatcgtcgggggcgaataaaagtgccggcgatcggaaggacggctttttgggtgccgtccgacaattgcatcaaatg

SEQ ID NO: 113281 - DNA, 682 bp, Heterodera glycines
  Promoter: Source sequence=SeqID_96; Location=1..682; Strand=+; Gene =SeqID_66802
aaaaatttgcggatttttttttattattttacttttccccgaatagcttttcagaaggcagctaagaatttttttttgaaaaaatcgaaaatttccagaaattctggaataacttttttcttttatgtgataacaaactcaaataaatcccataaaattctctttatttttctctatttttaaagctttattatagttaaatcgatgaaaccatcaccgagttatgaatttttccaatattaactcaaatttccaagatccaaaacattctcaaaaaatacagtatttttacatgattccaataattatgaaacttaaaatagacatcatctttgtatcgaacacatcaatatccaccagcataatgtttttgaaacgccttcgccgaaacgccatggacccaaattaataaggcaaaggaattcaggggttgctaaaagcaatgagttctgagtaggaaattttctgtgccacatttacactatattttaatcgcctgtgaatttttaacctttgatttatttttattcatttttattacggtattcattttgtattttttatttgatcaaatttatttgtttgttttcatttttgcaccatgtaagagtactaatgtgccgttggtttgctcgataaataaataaaataaaaaaaaattaaaaagaaaattattcgaatg

SEQ ID NO: 113282 - DNA, 125 bp, Heterodera glycines
  Promoter: Source sequence=SeqID_16549; Location=2018..2142; Strand=-; Gene=SeqID_80958
ttcattcataatttttttttaaattccaatttaatcatctcaatttacttacaccaactttatcctctctttaaatgcatatttttattttcagacatacatattatttgaaataaaccaaaatg

SEQ ID NO: 113283 - DNA, 325 bp, Heterodera glycines
  Promoter: Source sequence=SeqID_19596; Location=886..1210; Strand=-; Gene=SeqID_84334
tgtgagcgttccggtttacacacttaaaatgttttttgagcgctttttatagtgtgactcactgagtcccggcgggaattggtacttcattctcagcactttttcagattgaaaaagagcaagctaattatttttccaaccattttaaaccttttacatcgattctgaccgttttaagcatttttgagtttagggactatgctcaatatttgcctaatctttttttccctctaaaggttcgtgttccgtgtttgcaaaacattcaattttgctgagcaataattcgcccgtcattttttattatgaaatttcggtcaaaaatatg

SEQ ID NO: 113284 - DNA, 419 bp, Heterodera glycines
  Promoter: Source sequence=SeqID_12449; Location=1..419; Strand=+; Gene=SeqID_76077
gattaatcaaaaaaagatcaattttacccaaacacttggaatgtatttgatttgcgttgtatgggcgaaaaatgataaagaatgagatttttgggaatttttatgcaaaaacacacttgatttttccaatttttaacacatattttagcacatattttggcatttttggggtttttagcacatatttcagcattttttagcacatattttattacatatttcaggatttttagcacataaaaatcccatccctagtcatttcgctttaattaataaaaatgtacaaaacaattctctaaatgggcttaattttgccgggacttaagtcccgctctgctacaatttaaattaagtattcatagactatatatatttaaaataatgaaactccctttttttggcagtttaattaaagtatg

SEQ ID NO: 113285 - DNA, 388 bp, Heterodera glycines
  Promoter: Source sequence=SeqID_42663; Location=285..672; Strand=-; Gene=SeqID_70500
tttctctttctaatctataaattatctgccgtccttattgcaaattaagcggctttattcggtataaatgcggacggtaatagaatctgggaaataaaaactcggaaaatcgttgatgtagcctaacgctcaaatgatatgtaaatttttaatttaaaacaataaattttaaggaaagaaaatttaaagcaatctggggtaaaaattaattgtgtgagaatttcgcggtacgggagcctaatgcagaaatcccgcaaaaaagtagctaagccaaaaaggatagtggcgagaggcatataaaatgtgccgctaccaatataccacaaaataagtaaaattgtttttatcttagacatgcccaaggggatttactcaagtctacacaatg

SEQ ID NO: 113286 - DNA, 409 bp, Heterodera glycines
  misc_feature (7)..(7): n is a, c, g, or t
  Promoter: Source sequence=SeqID_25296; Location=1341..1749; Strand=-; Gene=SeqID_56048
aataaantttgaaaaataattaattttttaattaatttaatttctggcatttaagtctggtgatgtccaattccaattgccaccaatgttttacataaaaccggataacaaatcactgagcacaatttgctttgtgccgcatggatttgatatccacgccaaaattttgggacaatttcaatgcgatttgaccaaaggaaagttatgcagtgacaattcaatttattgcatcttttgcaaggcaaaaaatatgaaaaataaataaataaaaattgttaaaatttttaaatattttcttcagaatcctttggtgaactttttgaaaaagaatcatttgactgtgccaaaattggaaataaaatttatgggcaatcatttcaatgtgaattttattgtcattccgcaaatg

SEQ ID NO: 113287 - DNA, 1003 bp, Heterodera glycines
  Promoter: Source sequence=SeqID_7480; Location=1018..2020; Strand=+; Gene=SeqID_64953
ttgaatgttgcatttgaaaaattgaggaaaagggaaaattccaaagaaaacagaatcaacagcaaagtgaaaacaccgaaagggaatggccaattgaggacaattgttttttcgaaggctggggaggaattggccgactcaacaggtccaacgacgaagttgttgaaagccgacacagaacgaaaattgtcagccgttgatggcacaattacgaataaagctgcgtcaagttacgctatcaggcctgttcaaaattgtagttttcgttttttccgcacattttacaggtcaaattatgatattggtctgtgccactgctgattgtccacccttactgccccttttggaagccgaatgccctgccgatggatttgaagcgctgaggacatcgctttgtagagggcgaggatgtcatatcgttgttgatttgaattattttggcgttttgttttagtttttgtgaccctttattttattttgttttgtttggagtatgtgtgatatatgtgctcttcctaaatttgtaattgattgctgtgtgctgttttattaattggaagtaaaagaaagcagtgaaaagagacggcgatttggttttggatttgggatacaattcccctttcccattggactattctttttcctacgacgtggcgctcctgtacaaaggtggctcagcagtggcaataaacgacaaatttggacgagcaacaacgattttaaaaggaaaagtaaatccttctgcaatttgtaacaggaaaagcaaatcctggtctctggaaaagggaaacaaatccctactgaatttcttcattggttgtggaccacaaaatcagtaaaacgggaaaactaaatccctcttcatatcaaaaaaaaaacgcagcttagaaaaggaaaagccgtaaagtgtgaaacaaatcacgaaaatttgtcagttcggtaaattaactccgtctacaaaactgacttcaaaaccgggaaacgaaaatcccatttcaacatg

SEQ ID NO: 113288 - DNA, 408 bp, Heterodera glycines
  Promoter: Source sequence=SeqID_5099; Location=6496..6903; Strand=+; Gene=SeqID_56899
tctgaatttatttattataatttaagaattaaaaaatatattttttattttacattcaagaacacttgtgaagaggaaattgccttcgaaagaattaaaattaaattgtatatgaaataattgtttgccacgttcaattatttttttattttccttttcacataaatattttccaattatgatatcacctatttttgacaattcttctgtccataaggtaaggaaaggggcggaaatgtttttgtgccgttttggcactttgtccacgttaatttggcattcatgtgactcttatgtttttattgccaaatttaatgatgccatcttacctaaattgggttatttaagtcggcatttttcaaacattccaatcccaatttcccattcatctcactcactcataaaatg

SEQ ID NO: 113289 - DNA, 512 bp, Heterodera glycines
  Promoter: Source sequence=SeqID_15276; Location=382..893; Strand=-; Gene=SeqID_79491
aaaatttgggctttttagagcaaagttataagcaaaaattttaattatgatggttttttaagtaacgcccattatgatggtttttaagtaatgacatagcaccaatctgatgagaattaatgaaaggctattaatttgtttaatagataattttatatcaaaaagcatcatgtgggcttttcattaaatgattgaatgacatttgaccatttcaatgtaattaatgaacaccagctgttcctgttctggtactaccaatgtaattattgtaatagaaaatatgcatgaatttaattacgggcacattatgaatttatgaatttaattaccagtacagcgaggccagtaatttgctagagaattactttaatttgtaaggacaatgattattgggtctgtctttgatttttaagccattcctatcaatattaaaagtaatttttctgaaatttacttttaatttgagtggattaaaataagcaaaataacggacttttttctaacaaaaaatg

SEQ ID NO: 113290 - DNA, 512 bp, Heterodera glycines
  Promoter: Source sequence=SeqID_9020; Location=3235..3746; Strand=-; Gene=SeqID_70018
tagagttgcatgttttttttgcgcccgtagcggcttttaagttgccgtgggtaatgggcgaggtggtttttggttagagcattttgaggcggttcttttaaaaaatttgagtccctagcccaaagttgagttggtcatttgtctaaaaatttggtcaaaaaagtcggctttcgcagtgagtgggagattttgggggtaattgagtgcgtagagcttgatatttgtttttaaatgggttaaacaatgttttgacaggtctaacaatgtttgggagtagtgggacaaagtgtcgacaagtcggtcaaaatgtcgaaatttttaacgtgatcaaaatgaagtttttttttgtaattttttatgttttgaggcatagaaacagccttctgggcttttttgcgcgagtttagggcaactgaaacggttaaagatggacgaaacgatcacgaagaagccggccaaataaattattaaaaaattctatttatcccccccccccccccggcacataaatg

SEQ ID NO: 113291 - DNA, 449 bp, Heterodera glycines
  Promoter: Source sequence=SeqID_2674; Location=1552..2000; Strand=-; Gene=SeqID_81013
atatttaaaatattaaatttttttatttgtaagttatgtacggcctctaaacggattaaaattgattaattacatctgtgtccaaatttttggtggccaaatataaagtttaatcctttgactaattaccgcgtatgtgtattctcggccctaactatggacaaaacccttagtctttgtggtcctgtgcccctaatctgatgattgattgacacattcgttttgatcgtcgcattgtatgtcccccacaaccgcgccctatggcaacaaatgttctttgtgacatccatcactgagtgaaagggcggtgccggagtttggaccaaatgatctcattctgccattcttgcaccattttcctccgttcgcttcgtttttttttcgctacataattttaaataaaataatccaaatgagcaacttcaacaacagccacaataatacctatg

SEQ ID NO: 113292 - DNA, 377 bp, Heterodera glycines
  Promoter: Source sequence=SeqID_26606; Location=1..377; Strand=+; Gene=SeqID_57346
cgttttcgcgtgcttccttgtcgcgtggccattttcgcgtggccgtcgcgtggccgttttcgcgtggttgcatataaaagagaattcataactcacatttatttaacgaaaatttgtttcactcttttttctaacgaatatttattttataattaagtgagtttataaacttaattaaggctgtttcaattatataatatggaccagcagcaaaaaattaaaacaaaacgaaacaaagttaagttagaacatgacggcgcactctatgttttcgaccaattgagcgctggttgggtatttccaatttgctactgtcttttaacatcgaagtgtgccgcaatttatacgcgcatgttacagcttcttttggaacgatg

SEQ ID NO: 113293 - DNA, 1003 bp, Heterodera glycines
  Promoter: Source sequence=SeqID_32306; Location=284..1286; Strand=+; Gene=SeqID_62609
gcaaaacgatataaccaaaatataaggaaaaattttttaaaaaaatttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcataaatccaacgcagaattaaagtaaaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacctgtaaataaagttttgtgtgtttcagagcactttctgaaaaaatacttatgaattaattttgcaaaaaataaatacaaacgaaagactcagattttccaaaatttttttgagccagctatg

SEQ ID NO: 113294 - DNA, 139 bp, Heterodera glycines
  Promoter: Source sequence=SeqID_44120; Location=782..920; Strand=-; Gene=SeqID_71654
gatatctcttctccacctccacaatttcttttcttaaaatttttcttcttttttttagttgtttttgttcatagtcttcaaatcaattctaatgatttcctttccccttcaatttttagcggcagcggatttcaaaatg

SEQ ID NO: 113295 - DNA, 110 bp, Heterodera glycines; identical to SEQ ID NO: 98226
  Promoter: Source sequence=SeqID_30516; Location=513..622; Strand=+; Gene=SeqID_60926

SEQ ID NO: 113296 - DNA, 392 bp, Heterodera glycines
  Promoter: Source sequence=SeqID_36245; Location=1..392; Strand=+; Gene=SeqID_65616
ttgctttaagtcaaataacaacaatttaaaatttaaaaatatttacattttctatttttgttttatttttaataatgtccacgtgtacatatttattatgccttaattaaatgtacttttagtcaattaatgaccattgaacccaaatttcagccaaaaacgcaatttttcataaagaagacgaagaaaatgctggcgccgataatgagtaaattgaggagggagggataatgaaaagctaatgaaatataaaatatttaattagtttaaatatttaaagaggaataaacttaatttaaattttgcaattgatcattggtgcttatttttgcctttagccaaggagatgaagctgttcccgtcccaaccgcttccgtcccgcgttaaaaatg

SEQ ID NO: 113297 - DNA, 85 bp, Heterodera glycines
  Promoter: Source sequence=SeqID_27575; Location=256..340; Strand=+; Gene=SeqID_58268
agtgagttttttttttttttaaattgaaccaaccaaatattaagaaatcaaaactcttcgcaaccaagtgggtcgccaaacgatg

SEQ ID NO: 113298 - DNA, 1003 bp, Heterodera glycines
  Promoter: Source sequence=SeqID_234; Location=9515..10517; Strand=+; Gene=SeqID_79026
tttacatactagccattttttattttattgtgaccaagcatatctttcctcgtatttctgggatttttttcagaatgtggtcatagaataggtgggttgatttatttgtattttttatgagtattatgtaaggatattttcgacaaaacataaccaattccgagtttcatgaggctgttcgaattgggcataatttttccatcatttccccaattctcggccaatcaattaattgattgcctttctcatgaccctcattcattcgccctatttttccctcgtcattatcattgtgatttcgccaaatgtgggcctcctacgcatcttccccccatttttgcccatcatcatcattgtgttcatgccaaagtgggcctcccactcatttcttcgccccaattctgcacatttctgtaaaatcgtatagttccacgtcgaaatgccctcccgattacgcccgtcaaatcccattcacatgcattggacacagtgcactcaagcccgttcagcaatccaatcaccgcgcactcaatcaattgtgccggtactcatctcatcaacaggtggattacaaaatccgcacaaatttccttgagtatttggtttcaaggccaatacttttagaaataagggaaggggtcgaaaagtggtttcaaagaattgagtttgagacttcaaggtcttagctttattctcaatcgatcgatcattcatttttagccacaggcttcttggtcttgactaaatttgggtaacggaatcaaagtattgggtttcaaggctcaaacttagtttctgacaaggttttgtagtatcagacttcaaggtcggaactataaacctataggggtctaatccgtgcatttgcccctcgtgccaaactcacacaatcaaaagtgagactgtcaatttgctgttgtgaacaattcaatctgtcaattcaatcgcggcacaaccaatcacaagcaactcaagcaatttaacaagcaattgacaaatcatg

SEQ ID NO: 113299 - DNA, 110 bp, Heterodera glycines; identical to SEQ ID NO: 99093
  Promoter: Source sequence=SeqID_43802; Location=394..503; Strand=-; Gene=SeqID_71387

SEQ ID NO: 113300 - DNA, 1003 bp, Heterodera glycines
  Promoter: Source sequence=SeqID_12941; Location=554..1556; Strand=-; Gene=SeqID_76691
cccgataaaggtttgaaagttaaggtatagtttctaaattaagtgtttaggaccaatagacccacgagaagcatttgcgggtgggcgaacacaagcattttgtttatattttaaaacagaagaaaatacggagattaatttagcggacataatttcgctttacccatcggtttttaataatttcttattttgacatatagttaaatttaggttaattattttacttcatacccagtaaaaacacccataataatcatatcaaaaacccatgacgttatgtggcaataccccgaagacattccctatgacagtataaaaaagtctttgatacactaataaaatagatttaaggcttactaaaagtacgggcaatcccacccaaaaatttaaaaataccattattaccgttccatgccgattcaattttattttttaccaattgctctaaatgttgtcaacgggcaaaacccgattttgtttttgtgaaaaacgttaaaaaatgtaagcatacagacacggaaagagtactacatggagtttttactagtattgaactaaaattaggtagggcaaaatttttaataattaattttttgttatttatgctatggaattaggatataaaatagataaattctacaggtacaataaatcaaaaaaaatattaattcatttttaagggcctaccattttgaagagtttgattcaaattattgctctatggtattgaaaaaaataataaaactgattagaaatttttttataggacgacaagtcaggcgagaatagtcttatacaattttttacaaaaggtggcagctaacccgcaaaataaactcttatactctgatacaggtcccattaatcaaaaatttttttatattttaataattcagatagtgtaatttacaagcaccaaaagtgtaataatcccattgcttttggagaatatttggggtatgaatttttcaatttttttatataaaaaattttaagcgaaatg

SEQ ID NO: 113301 - DNA, 173 bp, Heterodera glycines
  Promoter: Source sequence=SeqID_10153; Location=36..208; Strand=+; Gene=SeqID_73255
tggaattcatttttgtgttttttttgtaggggtccgttgataattctaaatttttgcgtccgtcctaaaaatgaaatttttcgattattatttttttttgttaggctattgctttctaggaaaattgaaataatcatttgcttatatattttgatcatttggttaaaaaaatg

SEQ ID NO: 113302 - DNA, 264 bp, Heterodera glycines
  Promoter: Source sequence=SeqID_14958; Location=1135..1398; Strand=+; Gene=SeqID_47253
taatctgttgaaatacaagagtttaacaagaaaaaaagcacttttacctaattgaaattttaattacctaatttttttttaaattggcattttatccaatttcactaatctgaattactcttgcactcgctcttaatttgactttgcttttgcttgctttgcacttagaaacgtggaaaagaattttaatatgcttttgacattattgtttcttcgttgttcatttttgtcttaaaattgccttttagtcgtctttttcaaatg

SEQ ID NO: 113303 - DNA, 283 bp, Heterodera glycines
  Promoter: Source sequence=SeqID_24555; Location=338..620; Strand=+; Gene=SeqID_55277
agtgagttttcatggggccatggctttcgaaaatgcccaagacgtattgcaccgagatttttgttcacaaaccgagactaggcccctaaaataaatcggcatttcgttggcccctatagaatcggcattttgtggcccgtgtataatcggcatttttgccaacagtgttggacccgcgatatttttggcgatgccggcctgatccctcaattggcaccgacagagtttcccgaaatttgatttttttttccagagcgcgtgccatcaacgtccagccgggatg

SEQ ID NO: 113304 - DNA, 905 bp, Heterodera glycines
  Promoter: Source sequence=SeqID_11662; Location=1153..2057; Strand=+; Gene=SeqID_75125
ttttcgggtgggggggggggaagaatctttggattcaaaaaaggtactttcctgttttggggtcacatgtcaaaaactaaaatttaaaaatgcgcaaattcacagtcgcgtacagtattgtttgggtgcataaatacaataattgttcctaacaataaggctcccgtaaaatgccagtgaaaatttaaatgtcaaaaaacaagttccttttcggacttcagaacgatgttcttatagaattttccctttatacagtacctacaataatatttaatactgcagaactttattttaaaatatttgtatcactgacgcattttccggtcatggttgctaaattctcgtcaaatggatcagcttgagaataggatttgtgagaattctgtcatttttgttgttttttaaaattttggtgtgtgacccaaaaacataaagaacccaaaaaggaaaggttgccatggaaatgccggcgcggggaggggacggtaatcgaaatttacagtaatactaataaaaataaataaagcgcaaaaaattgcaaaattttgaccacttttactcgttgaacacaccacattcatttcacatttaattaggattttttagcaaacgtaaagctcttgagtttagaaagtgatacataattgaaaagctcataacaacacaaaaaggcagtgatcagtacttttgaattaacgcaatatttatatatatatttctttttgaaatgataaaaaatgtaaggttattcgaaaatgaaaatttgattggtccaaaaactcaaattgatacactagtttttttgttggaaccacttttgccattcacaatcgacatgctaggaaagatgagcgaattatctgtcctttatttaaatttaatttgaattcaattttagagagatg

SEQ ID NO: 113305 - DNA, 162 bp, Heterodera glycines
  Promoter: Source sequence=SeqID_15328; Location=2916..3077; Strand=-; Gene=SeqID_79570
ttcgtctgtgaattcattcacaagtttgaaatctgccctgtccatcattcaacagcttgcccagattgagtttaagtgcctcatcaaagtttatctgggattaatttgtttcgaattatattttgctttgttatgttaattattatgtaaaatttagaaatg

SEQ ID NO: 113306 - DNA, 264 bp, Heterodera glycines
  Promoter: Source sequence=SeqID_228; Location=3648..3911; Strand=-; Gene=SeqID_78606
ttattagctaggattatttattttaataaattaaatatatttgaataaaggattgaataaagtgatcttgttctccgtttttatacagattgatgtttgtttaacccagaaaaacaaaaccaagattgttataaatagttgatgcacacttatatttttcagttttattcttcacttcgttaattctgctctttttctccctaaatttacatcttttcttcattaatttttacaatattttagcttttgaatttgattattatg

SEQ ID NO: 113307 - DNA, 141 bp, Heterodera glycines
  Promoter: Source sequence=SeqID_6684; Location=700..840; Strand=+; Gene=SeqID_62474
tttctatgtgccgtatataaaagaatgccaatttaaattcaaacaatgccaaattcactcataaattttcgacgccagtgatcaatgttttcgcggtgataataaaataatttcaggatttttttttaatcaaagaaaatg

SEQ ID NO: 113308 - DNA, 555 bp, Heterodera glycines
  Promoter: Source sequence=SeqID_22754; Location=764..1318; Strand=-; Gene=SeqID_53446
ttatagggttgtacgtgaccgggacctgatactgaaagaacgtacaactgagtacctacgtcccggttttgaccgggaccgggaaaagtctcgggtttttccctattttgccagccaaaaattcccggtttttcaccccgaaaagtactggtcccggtttttcttaaaattcccggacccgtacaactgtaatttgttgtccatattttagctttttgtctatatttttcgtttataatataatgcatattttggtgtttttttgtcaatataaatccgggccctataaataatctaaggataaattctcaaccgaaaacatcggtaaaattctatggtacggtccccgacgagttaaagtaataattatataattttttatattatatattttatttttattttgggctttttctctccgttgtttgcactacattgatcgaaatatcagtgctttgatcaaatcagaatcctttttgcaaattgatcaaaatttgttgtgtgaaattctcgaaagagatgagctgagaagcagtgaaatcgaaatttggaatg

SEQ ID NO: 113309 - DNA, 312 bp, Heterodera glycines
  Promoter: Source sequence=SeqID_18423; Location=2540..2851; Strand=-; Gene=SeqID_83022
cattcacttttggggatgggaattcgcggatgccgcgccccttttcaaccatactaaaatggaattgttttgcgttttatgtgtcacccgaatcctgggaaacacttggaattgtagtgggccctcactcacttcagaatcttaacaaagtgaatgaatttggccatgaaattcccattttgtaattcggaatttatttacttttcagtttactttttgttgccaggcaaccaaaaccaatcggaaatatgcaaaatttagtgcccattattttttccattttaaatcttttcactttctctttcacaaatg

SEQ ID NO: 113310 - DNA, 534 bp, Heterodera glycines
  Promoter: Source sequence=SeqID_13185; Location=1266..1799; Strand=-; Gene=SeqID_77009
atgtaattctctaaaaatacttgagttaatattttcaccaaaaaaatattgtggattcatgaaaaacataaaaaaatattttacagtattttcttccttttttgcattttctagtctaggttattttgaagcttctaggatgctttttttcatttttttttctgtctatcttgagaagaaaagaaatttttttcgaactgttcctttgtttggcgttttgtattttttccctatttttgtttttgaaagtcctaaattttctcagtttttttatctttggaaaaacaacatgggtttgtcgaattttttcattcttagttaaagcatctcttctgggggatttcgcttctaaaaatcctcgccatatcatgaaaataacatccataaaaaggaacaccaaaatgatcaacatattttttatgcaaaataaaatacaaatttatgtttactttttttttgcctgtaaataattcgttgcgtatgattaaaaatagatttttttttagtttttctcggccggctattcatatcatg

SEQ ID NO: 113311 - DNA, 627 bp, Heterodera glycines
  Promoter: Source sequence=SeqID_45230; Location=1..627; Strand=+; Gene=SeqID_72568
ttgcatttgtcgtaattacacctattatgataaattaatgaatatgttttcgtaaatattgaatgtagctattctcgagttgtgtaaaattttattaaataaatttttaaaatgaaaaaaggaatttattaaattaaattcaagaaattgtttttaattttctcctcgcagtctccctaccgtatatacaattaatacttttatttttctcatttatttttcattagtttatattcaatttcatttttctctttctcattatttttttctcaccaccgtaccatttttttcctttactctttgtactctcctaagcgtatgtgctatttctcttcacttaacagtttacggtattttttttctactcctttctctgctaaattatcctcggcgtatgcactatttcatttgtttctcattcttttttgattatttcttcaaatatctattctttctccgcacactacctcctttttctcaattgacaaataaacagatggacaaaaaaattcaacgccatccgtaagatgagcaaaatatgagaaaatgggccaagcttcatttaaaaattagcgccaaaaataaagaaatgtcaatgcttcatttactgccgccaaaggaaagatg

SEQ ID NO: 113312 - DNA, 1003 bp, Heterodera glycines
  Promoter: Source sequence=SeqID_13837; Location=1733..2735; Strand=-; Gene=SeqID_77778
acactctaaaaaaatttttttttctctagattatgtcctattttttttaatgagtgtatggcattatttactcaaaatattcaactaccattattgacttcatttttttcattcgaattttgtatgtgaaccctttctaatagttcattattattattcattatctaacacccaaattgtcccaaccattttggcctcattttgttacttaaatggaaggcatttgccaaattatactgattgaaatttcctacgattattttttttaattgattgattgattgtatcgctttcgaaaaattatcttaattgatcacaacaacaacttttgttaaattgatttaaatatggagatggatgaaaacataaagtttggttttgtttgtacttacaatggcacaataatttttatttggctatatggcaacaaaattgtttttagtgggttaaaaattggttaaatttcgagaaaaaaaactgaaccctctcggtttttttcaaaattttctatggtaattttaggcgcagaaaacgaatctgacatttattttattaatccatttttgagttacgacttaaattttattcattagcgattaacgggagaaaggactcaaaattgtgtgaatagagaggggtaggcacaataaaggtgccaatttataagtgtaaaatactttgaaaaaaatcaaaataaattcatcatttgtcgagcggatccgatcccatggcaaatggtcattaaaatggaagtgaaaattacaataacattaaactaatgtatctttgcttgtgtttttgtttgatctattttttcgggtgttttagtgaaggcgcgctgtcatttcgtcccgcgtcgtttcgccccccaagccaaaatgagtcatttcgtccccaaatttctttttatttataaaatatttagtttttaaagtgttaccactaaaaatttttctgggtttagttaaacaaatcataaatttacgaatttagacgtatgatg

SEQ ID NO: 113313 - DNA, 108 bp, Heterodera glycines
  Promoter: Source sequence=SeqID_17242; Location=1..108; Strand=+; Gene=SeqID_81711
tttaattaatttttttaaaaaatccccaacagctatcgcatcgcggccatcgtcacgagcagaagagcgcgagtggccattcccgtgagctccgggtgcactggcatg

SEQ ID NO: 113314 - DNA, 1003 bp, Heterodera glycines
  Promoter: Source sequence=SeqID_26015; Location=357..1359; Strand=+; Gene=SeqID_56765
acaatgaactttttctaatgtttttgataaattttccaaaatctttttaacatttttataatgagaaggcaaaattgggtaattaatttcctggctgttatgaagcaatacgccgagcagggacatgccctgctctatacctagaaaatttttaaaaaatatataaaaatttgttgaaaaatattttttggccattccccgaccggggccaagcccacgatccccgacaattttgcgatcaccgaatccgatccatgaggattttagtggaaaaattagtgacatacaaaggacattttaatcaacctatttgaatattggttttttattgttacttttttaatttttttaatttaattaacaaaattagcaaaatttccaattttctgtcgtcggcagctccgtaagacctatgattcttgataatttttagaatttacacaagattttgtaattttaagtttttttttgcaaaaaatgaatggaaacacaaataaaacgttttctagaataaattttcaaattagagttttcagggtcgctgctcactattataacatttattttggcactgatttcatctgttcataaatttgacttaattccatgcatttccaaaatatataaaattaaaataatgaaacgaatcagtaagcaggtggacataaatgcaattaattttataaaaccgatcaaattcatttaaatttagttgaatctttgatcagatgacatcaaatagaacaaaaatgaaaaacccccttattccttaattattgtttatctcgtattaattactccccaattcgttgagaaaagcaaaatataaataaatagaattattattaaaatgttgtagcatattgatgatataatgactaaacgtggctaataattgattgaatatataatttagccagtcttaaaattaataattacaaattcattgggaaataaacattttttatgaaaattattctttatttttttacaaaaaatcatg

SEQ ID NO: 113315 - DNA, 83 bp, Heterodera glycines
  Promoter: Source sequence=SeqID_12752; Location=1285..1367; Strand=-; Gene=SeqID_76460
agtgagtttcgtccgttcttcggcttccgatcgcttcgtctgatcagtcaatcattctctcctcttcccatcccaaggtgatg

SEQ ID NO: 113316 - DNA, 53 bp, Heterodera glycines
  misc_feature (42)..(42): n is a, c, g, or t
  Promoter: Source sequence=SeqID_29999; Location=1..53; Strand=+; Gene= SeqID_60457
tcaaaagaaaagtgcaacaaaaatggaacaaagatcatttcnaggattacatg

SEQ ID NO: 113317 - DNA, 592 bp, Heterodera glycines
  Promoter: Source sequence=SeqID_6967; Location=1..592; Strand=+; Gene= SeqID_63432
aaaattaagaaatcataaatcgtagtctctaattaattaagaacattaattctgctgtttgaataattgatgtgatgactttttcaaaaatatactaactatcaaattatcatacccccaatcgctttaggctatcagggattgaaaaaaacccgacataggcacgaatgcctggagcaaaacgtgggataaccttgccaaagatctctaaaataattatagaaaatctaaattggatgttttgattatgtttcacgcatccacacatccattgtactttttctaattgaaagaaagaaaagaaaatattcccaaaattaaaaaatccatgggacgcgtaaaaactcttggaacgcgtagaaattcaatgggacgcgtaaaaaaccatgggacgcttaaaagttcatgggacgcgtattctgaactagaaccgtttttctgccatatctgtcgcttttttctgttaagttaaatttaaggttcacagattcggatgtgaattacattatggctttgaaaattgttgagattgaacccatatgtatttctccatggaaaagttgtgaacatagacaaaacattgtcgaaaatg

SEQ ID NO: 113318 - DNA, 144 bp, Heterodera glycines
  Promoter: Source sequence=SeqID_18152; Location=1..144; Strand=+; Gene=SeqID_82738
attgatttttgccgttgttccatttgccctcttccaacccgtgaaaggggaggagacccattcaccttctctggtatagccccattttcccaaacccataataaaagtattctaattttccataattgttactcggaagctatg

SEQ ID NO: 113319 - DNA, 53 bp, Heterodera glycines
  Promoter: Source sequence=SeqID_12382; Location=858..910; Strand=-; Gene=SeqID_75989
aatctatgctggtgcacttcttgttgcactattctctgttgcccttgtcgatg

SEQ ID NO: 113320 - DNA, 484 bp, Heterodera glycines
  misc_feature (21)..(21): n is a, c, g, or t
  Promoter: Source sequence=SeqID_16779; Location=845..1328; Strand=-; Gene=SeqID_81196
cccccatccctccttgtctcncctcccatccctccttgtctcccctttcccctcccttctttctcactctctctctttctctccttctttctctctctctcatttagatcctccgtctgtttcccttctcttcttcttccctccgcgttcacttctctccattctcttcgtccctgcttttccgtgctaagtctacttcatctgtccaacagctcaaaaagcaacaaaatatcccctcacaatcactttgtcgcgctgtgatcaatgacaatgcgaatggtcagtcgaaaaaggagagcagagagagagagatatggggagagagtgagggaaagaaaagggagggagagcaaagggaggaggagagagtgaggggatgagggaaaacagggagagagagatatggggagagagtgagggagagaaaaaggggggagagtgtcctcctccattcacttttttcagctttacagtacaaataatg

SEQ ID NO: 113321 - DNA, 131 bp, Heterodera glycines
  Promoter: Source sequence=SeqID_10221; Location=2707..2837; Strand=+; Gene=SeqID_73364
ttcttttctatttgtactgtggcgatatggcagaagtgaaaggcgaaattttgttcgaagttttcatagccggtcatcaaatgccttttttattttgttattttttttgtttagctgaccaatacttcatg

SEQ ID NO: 113322 - DNA, 1003 bp, Heterodera glycines
  Promoter: Source sequence=SeqID_4809; Location=836..1838; Strand=+; Gene=SeqID_55795
tcctttggcaactttagctgctttgtgtttcttttcattcctttgtttcatcacaaatcatttgtcactttttcctccgttttctgcccaatttccttgtccaattagcccttaacgcaacaactggccaggctgtttgcgttcagccaaagttcggccaacaaccactccatcgctcattcattaattcattaaacatctgattaacaattcgggaaggccaaagttaagcccgctctcgtttctctctcgtgattaagctaatttcgtctttttccattttctgccaattaatttcgttatgtcccccttaatttgattggaattcgccgtcgtcgacgaaaatgctgacacctgttgattctctcactttggccagcagacgccgccattcccaattttgcccgcttttgttcgagcggaccggaggggggggggggtgaaaaccattgaaacgggagaagcaaaagaatgagagacagcgagagagtgaacatttgaacgttacaaaatttgttgaattgactttttgtttggggtggagcaaatttaaatcaactttctataggcggagaaatggccaaacattaaattggcagtttattttctttaaaaaaacagtttttcattcctgacaatttgtaccctttttattctttctttattttatttccaaactttttaggcatttgatccaaaaaaatgtgggagcttaaagtaaactgcccaatttcttgtcccgcttctcatttttgttgggagccagtcgattatacggcgcccaccatttgtcttgccgggggcatcaatcccaattccttcctaaatcatttgtcgctaggcgaaaacaacgtcattctcgcccttcttcttgtcatggcggggggaatagcactcggatggatttgctgtctcttcttgatctgctgcttccccacttgccttcgtccaattcgtcgtcgtccgtcaaagagccgaaaagagtccgcttccgtcaaagatg

SEQ ID NO: 113323 - DNA, 1003 bp, Heterodera glycines
  Promoter: Source sequence=SeqID_1266; Location=289..1291; Strand=+; Gene=SeqID_71089
taataattttggttatgtaaaattcagtcgcgagtaaagtcgagcttcaaaaaagaatttacattttatttaattaaagcataatgagcgattctgtaaaaattaaaaaaacaaaagataataattaaaaatataatgaaacggtaaatgaattaaaattcatcttttattattttcataagctaaccgcgacgcagacgaagagtttaacgatctacgacaataataatttatttaaataatattgtatttattaatttaaatcaaattaaatatacactgtgtaacattagaatagggacaccctattttttgggagtttgaccacttcccatgagccgatcgagctgaaattttaactgtacgtagcaattctgaaaatatcaagattccgaaagtgagaaaccgaaatgatgacggaaaaatattttacgaattttttttccaattagttcaggttaattttgattattttagaagattttatcaaatgactctagtaaactttttaccttcgttttttctgagcactaattttttaaataattgatgatttcttaaaatagataatattcatctgacttattaaattatattgtaatatatgtacttcgtttaattaaattcatatcactttctccacaaattccatttccacgcaatggcctttgaatgaggtctctacgtcgcgtctccgcgaaggcgcgtcttgttgaaaatggatgtctcaaaaatgaggaaaaatggcttgaattgagccattttttggatagtcggtatttaacaaggcacccctcagcgaatacttgctatagagcaatcattcaaaggccattttgtagagaattttgtgctctttctcttcgtcataatcatcctctacggaaaatttttcccaaccccctagaatttttttttcgaatttactcagattttcgtattttttcaccgcaaaaattttgtgtttaatgccttttttatggcataaaatgaataaaaaatg

SEQ ID NO: 113324 - DNA, 110 bp, Heterodera glycines
  Promoter: Source sequence=SeqID_11778; Location=136..245; Strand=+; Gene=SeqID_75276
agtgtgcattttatagacttgggtatttaatctttctcttagccaattacaaaacattttccattttgaacggcgcgaaatgctttccagcttttgtccatttaaaaatg

SEQ ID NO: 113325 - DNA, 345 bp, Heterodera glycines
  Promoter: Source sequence=SeqID_16474; Location=1307..1651; Strand=-; Gene=SeqID_80874
agttggggagcaaaaaaaaaattcgaattttaaaatccaaaaaatttttttcggaatatataattaattattttgatcgaccgttctacatagctcctctacgaggtagaagctcgtcccgtatcatcggggagcctaaatccgcataaaatttgaataccttcaaagctgttagaatttttttttcgtatttttttcaaaaaaattatttatccgtctctttttttaaatgtcgggtttgcatttcgtcgtttaaaacggtaaagtattaaaaaaaaaatcgattagggctcggcccgtgacatctggcaagaagtcagtcagctgcggaaagtgtcgttgatg

SEQ ID NO: 113326 - DNA, 407 bp, Heterodera glycines
  Promoter: Source sequence=SeqID_14080; Location=1..407; Strand=+; Gene=SeqID_78054
agacaccgaatataaaagcttatttttctatacaccctataaataggaagattttgattatccatgttgccatatttacactatatttttatcacctgtgaatttttaacatttgattgatttatttttattcattttttattacggtattcattttgtattttttatttgaccaactttatttcttgttttctttttggcaccatataagagcactcatgtgcctttggtttgctcgataaattaaattaaaattaaaattaaattaaaacaaaacgaaaaatctaaatctttcataaatgcatgcaaaaaagacaaataaaatttttatagttctccatttttctcttatcacgaattaatcttgctaaaaattatagtgttaaaaattaacaattattcagatg

SEQ ID NO: 113327 - DNA, 721 bp, Heterodera glycines
  Promoter: Source sequence=SeqID_16147; Location=1409..2129; Strand=-; Gene=SeqID_80507
tattacgcaactgccttttttgatggatgagccaaagccttttatccctttcggtttgttcttcgtttagtccttcttcctctaaaggattcgatcttctccgcgtgtcggccgtttttgatggaattgttagaatatgtttcgccgattaacaccagaatttagaaaataaatccagaattttgttgattgtagtcgagaaatttaaaatttaaagaaatatgtcgtcgaagtgtctcagaaaaataaaagatttgttgaactccagtaattgttgattggaaaatgaagtgatgaagtaattaaagaattgttcgtcgattggtgtaataaaaataatgaaacaattggtcgtcgttgattggatgatgattgccaatgtgatcgcaatgtgatcgtctaccgtccctctttgatgtgcatttttgtgtccattttcgtgccctacgaaggcaattaattaattgtccattttctctgtttttcccaatttttcttcatttttcccgtcagttgttgcctcattttgtttcttcgaattcgttttcgcatttttgtttcgttaattgttagtcttttctcgtgatttgccatttgtgtttatttttgtcttgtcccgggactggcatttgttagctgaaatttcttttccccaaccctttttcccctgtgattaattaattaatgagctctgatcaaaaactccaaacgtccagggatg

SEQ ID NO: 113328 - DNA, 56 bp, Heterodera glycines
  Promoter: Source sequence=SeqID_8682; Location=925..980; Strand=-; Gene=SeqID_68839
tttgttgagctttaccagtacaaaatgccttgcaattttagaaacggttcggcatg

SEQ ID NO: 113329 - DNA, 144 bp, Heterodera glycines
  misc_feature (14)..(14): n is a, c, g, or t
  Promoter: Source sequence=SeqID_23962; Location=1..144; Strand=+; Gene=SeqID_54662
aaaattttagtggnccatgaaattcaaaaaaaaaatgcccaccattgccatcatttaaaaaatgccattgctcttacccgccgttcattacggcaccgttggccttcttcggctgtgccatgtcgccgttttgttcaagaaatg

SEQ ID NO: 113330 - DNA, 66 bp, Heterodera glycines
  Promoter: Source sequence=SeqID_15725; Location=3951..4016; Strand=-; Gene=SeqID_80049
aaaactgcacaatcggacgacgaagaaatgtttggcatttgaaaggagaaaaattagggaaaaatg

SEQ ID NO: 113331 - DNA, 136 bp, Heterodera glycines
  Promoter: Source sequence=SeqID_25619; Location=130..265; Strand=+; Gene=SeqID_56368
tgagtacctcctcgccatcagagagcgcgccggatggactcataaaggtcgccggcttcgaactcccaccgccccccacatcggccaagtggtcatcgtcgaagaggacctccgcccccggaatttatggccaatg

SEQ ID NO: 113332 - DNA, 770 bp, Heterodera glycines
  Promoter: Source sequence=SeqID_40671; Location=1..770; Strand=+; Gene=SeqID_68925
tcagaagcgcaccagattttgcaggggcctaaaaaggtcaaggaaaggcgtctctgcgttgatttagcagtagtacctatgaatttaaattttctatgaatttttaaagttttttgaaatttttttaagtgcaaaagtggtggtgtctgcaaaaaattttcaccgggtttaaaaaatctaggaaaattagtaagcatttgtagtgttccgatacgtatccctgcaaaatttggtgagcccctgatcaattacaaattatttatggacgatcaaatttttagaaatttttatttatttttgcataattaattcataaatatttttttcagaaaatgctctgaaacgcaccaaattttatttacatgctagtttaggcactctgatgctttttctatcaaaaagggagatgaataaatttttaaaaatttttaattcctttttaaacaggccaaaaagtttaggcttaacttttttttcataaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaggcgggggggggggggggggcgcccaaaaaaaattttacaatgaaaaaagagaatttggaatgatgagaaacaaaaattattcagtgaagaaaaaagaataatgttaaagcaatttgatcaaatatatgcaaaattaaaaatg

SEQ ID NO: 113333 - DNA, 206 bp, Heterodera glycines
  Promoter: Source sequence=SeqID_23706; Location=1022..1227; Strand=-; Gene=SeqID_54398
tttgtgacccatttaaggtaataaaaaaaaatttaatttaaatatgaaaacggaagattacacaaattataaaatttatttttaatagaattattattattatttatcagtttgagaatcgacgatgaaatttctaaataattcgacattctcccattgatcctggttaaattgaatgtgccaatccctaacttatcccaaaaatg

SEQ ID NO: 113334 - DNA, 649 bp, Heterodera glycines
  Promoter: Source sequence=SeqID_51; Location=423..1071; Strand=-; Gene=SeqID_56549
ttttcataaatattttaaatttaattaattttggactttccatttgaattgtttctcttttcattattctgcacattttggtgttattttaagaatttcctcttttgtaggtcattttcattgccctcccttctgatctttgctttttcccttttttggtcttttcgcccaattttcaaatcattcgctttttccaactcatttttatgattggatttgttctgtttattttagtccctttctttaatccttttgcatgaccaatcaatcaaaaaaaccaattcaattcaaagatttttctttccttcgcaactttttcaaaatttcattaaaattccaattttctgctcaatttcccccattttcctcctccttttttggtctttcttttgttctttcttccgctgatctttccaatttgtccttctcttccttcgtttcgttttgttcttccgtccgtacaaatcggtgccccttccggcgcaaaacgcaaaacgtcgtcggggggcggccacgccaccgaaatgaatcgacggacggacggagggctataaaaaggggcgaaattgggcaaaaaacgtggacagaaagagacttaataacatccaattaaaaaacaaccatcaaaaacaatgaaattcacaaaatg

SEQ ID NO: 113335 - DNA, 177 bp, Heterodera glycines
  Promoter: Source sequence=SeqID_11008; Location=1291..1467; Strand=-; Gene=SeqID_74326
tcatgcaccaatttatcattatttagttttgttttaattacttgctgctggttcaatttgtagttaataaaagcttaactgtcaaaacattaaaagtaatttaaaaaattaacaaattatttgaatgcaattttttttttgcacatccactcgtacgaaaacggcggtacgaaaatg

SEQ ID NO: 113336 - DNA, 149 bp, Heterodera glycines
  Promoter: Source sequence=SeqID_8804; Location=689..837; Strand=+; Gene=SeqID_69278
gccaaaatgagcctctctctgttgatggggccaacaaaaagaaagagtggtctgactctccccccctccccctccccctgcagcgtgtcaatgccgcacccccttccgccgctcattctgtgcctttgtccattctgtgcccggccatg

SEQ ID NO: 113337 - DNA, 809 bp, Heterodera glycines
  Promoter: Source sequence=SeqID_10510; Location=1415..2223; Strand=-; Gene=SeqID_73738
tgttcacccatttttttcaaattggccaatttttggctcaatttcgcgcacaatcttttaattgtttttgcccatttttgctgctgctgctttttttttcaaggtttttgggtcgccgcggggcacacaaaattttcaaaaattgttcaacgacattttaagagcactaccatttaaggtcaaaaagcacattgtccttcaaggacgccctaaatataaaatataattattatgatataaatagttttttttcaacaaattttacacatttttctttttcataattttgttgcaacaaaaaatggggagcaagtttcgcccaccattcgccaattacacaatcattttccgtttttaattttttttaaaattgacgtacatattctctgcgcaaaaatttgtttgttgcttggggaagggcaatgccatttttacaacaatttttaatggatttaacccaaaaaaacagtacaacgccaaaataacgttaattcaattttcgttaggccttattttaagacacattcattaatatgaggggaaaaattattaaaaatattttaaatgccaatttatagataaaaaaaatttttttttttaatttaataaactaattcttatttaaattcaaaatgaacattctgtaaaaagggtaaaattatttaccgacgaggattttaatgttattaaattcgatttaatttttgatcagttttaaataaattgaatatgattttaatgatttttcacatttaaaaatttaataatttcgatttttatttatattataattatcattattataaatg

SEQ ID NO: 113338 - DNA, 194 bp, Heterodera glycines
  Promoter: Source sequence=SeqID_37699; Location=964..1157; Strand=-; Gene=SeqID_66700
ggtataattcacttaaaaacaacattagctatatacctagtcttaattggttgcaaatcgttttccgtttcttcgcgttgcttgggagtcgatgatgaattgttccctttgccatccactcataattcaatagatattattttttagtatcatacgtctcttcgttctcgtcccgctcctccacgactactatg

SEQ ID NO: 113339 - DNA, 353 bp, Heterodera glycines
  Promoter: Source sequence=SeqID_9643; Location=1252..1604; Strand=-; Gene=SeqID_72174
tcaccccggggggtcacaaatttcggggtgagaggaagccaaaaaaaatctcggcctttcccttggggtgcattttccgttcttttatctcctgtcgatgagccttttgttttgatggactactattttcaaaaacccccccaatttttcagtgttctcgagtttttctcggcacaaattttcgaaaattttgcatttttatgagatttcttagtaccgattttggtccaattttaaatttgctttttaattttatttggccattaattcgacgctttccgaaaccgcaggacgatgctaacttcagcagcagcagtgccaatgttgacaatgcgcagcaacagatgacaatg

SEQ ID NO: 113340 - DNA, 768 bp, Heterodera glycines
  Promoter: Source sequence=SeqID_6182; Location=3951..4718; Strand=-; Gene=SeqID_60627
ttttaaattgctaaagaaataagaatttaaagaaatgaacatattttctttaaataaaaaatagaaaaatttgttttataaaaataatcttacaagaaatcgtctcgaaaaaataatccaaaaatcaaattacggatcaaaattacggaaaaatcccaaaaatccgtaacccgtaatccgtaactcccaaaacccgtaatttccgtaatccgcaatccgtaatccgtaattgcgtgcagccctggttggcccacaaatttggccaaatgctttcaaattcattaattgttgttcccccacgatagtaaaattctaagaattgcaaattttgatgttcttcaacaaaaaaaaattcgaaatgaaaaattagaatttttttcttcaaaatttctaggttttttaaattattaaaaaaattttggttttaaaaattttttgattttttaaaattaatctctttaaaacgagttgattttctctacttcttgaaaaatttaaatttttaaatattttttttttacaagggaacggctgagtgattttaaattgttttcaaacttgttagttaaggttttaagatctacatggatttaaatccttaaatttttttgaatttctttaaaatttactaaattcttttctatttaaaatgttaggaaaaggagtccttttgcccccaattagatttaattgacgcaattagtatcgttaagtaactatcgccgtgcctaatttgcactgttttcaacacagagtcgtcgcgacatg

SEQ ID NO: 113341 - DNA, 116 bp, Heterodera glycines; identical to SEQ ID NO: 105272
  Promoter: Source sequence=SeqID_40356; Location=394..509; Strand=-; Gene=SeqID_68717

SEQ ID NO: 113342 - DNA, 93 bp, Heterodera glycines
  Promoter: Source sequence=SeqID_7155; Location=2994..3086; Strand=+; Gene=SeqID_46380
ggtaatttgcattaattacaatttctgaatttcctaaaaagtgttgccttcttcaataaggcatgtctggtggtccccggagaatttgaaatg

SEQ ID NO: 113343 - DNA, 368 bp, Heterodera glycines
  Promoter: Source sequence=SeqID_2997; Location=467..834; Strand=-; Gene=SeqID_82704
aagttaaaaaaaaatatatattttaatataggaaattttttcattaacttttcatattttaaattaaaaatgaataatgttatgaatcaagttcaatggccaaatatttttaagcttcattcttctaaaactaattcaatttttccaatacctttttttccataatttggcgtttttttaaatttaatactcatttatatttccatttcacttctatttttttaaataatattttatttttttttatatttcattcaattaattaattttaactgatttaaatgtcattttgtttttttctctattcactctccattttttcaatacttaatttcacactcccgctgtctatcccatccctccaaatg

SEQ ID NO: 113344 - DNA, 55 bp, Heterodera glycines
  Promoter: Source sequence=SeqID_1386; Location=2274..2328; Strand=+; Gene=SeqID_46839
tgtaagttttgggggagggcaatttttggggttaaataactgattttcaggtatg

SEQ ID NO: 113345 - DNA, 209 bp, Heterodera glycines
  Promoter: Source sequence=SeqID_12817; Location=1461..1669; Strand=-; Gene=SeqID_76542
attttataaaaaacaaaattacgagaaattggaaaatttctggaaaaatactcaaacgatcaaataatctcgaaatttttgcaaatatgctttttaaacgggtgaaaaatttctacatagcggcatttagtgcccctgaaatcgaaaatttatatttttcattcttagaaatgatcgataaaattcaaaaattaccagggtttattatg

SEQ ID NO: 113346 - DNA, 68 bp, Heterodera glycines
  Promoter: Source sequence=SeqID_38816; Location=1..68; Strand=+; Gene= SeqID_67525
gacaagggatcaggtattttgatgtttttttcggaattgctttcgaccacccccgccccgtttagatg

SEQ ID NO: 113347 - DNA, 553 bp, Heterodera glycines
  Promoter: Source sequence=SeqID_28137; Location=1..553; Strand=+; Gene=SeqID_58789
tgtggacagctaaattttgtaaagggtaaagtaaacccgcgaaaagacgagccctacggttgaatttattgaaaaacgggagacaaatccctcaattttcaacggactgtctacaaaaaggggtgaacaaaaacccggaaaacgattcgaggagaagacgaaaagttggatttttttgtaaacgggaaaagcaaatccctcttcacttcaaatctcagcatcggaaaaggaaattgtgaaacaaatcacaaaatttgtcagttcggtaaaatccttcgacaaaactgactctcaaacagggaaactaatcccatttcgacatgcagcaacttcgccaaaacaaaagatcggacaaaggaaattgtatggaacagcaccaaaaacaagaaggacagcaaattggctcgttgaatttgtgctaacgatggaacgacttcctgagctgaaaggaacggaagggacgaaccaaattcgaaaatttttcaaaaaattttcgtcagcaaccgaagaatggacggaaagtcgacgcatttcagcgctagaaagcaaaatg

SEQ ID NO: 113348 - DNA, 1003 bp, Heterodera glycines
  Promoter: Source sequence=SeqID_8509; Location=3212..4214; Strand=-; Gene=SeqID_68338
ttcttctgggcacatttttgaatttaggaaatttttgtaacaaagtgcactcaaattttcaaaattttttcaaaaaattttctcttgggaaaattcccggttggtcccggtcccggcttttctcgcggtcctggtcccggtcgaaaaacttggttccggtcccgatcccgacttttctggtcccggtttttgtcaaaattcccggtcccgaccagccctaataataagcatgaaaaacgcatttctaacttggtttgaggcttctaagtccacttttttcatgctgatttttgctgatttcccgattttttgtgctgatttggcattttggtgctttttttgtgcagtttcgtcattttgagcaactttttaaaatattttcagaaattttcaaaaaatttattaacaaaaatgcaataaaaacgaaaaatacaccccctaagaatcgatccgaaaaatttcagaaaaatacaccactaagaaaccaaaatttattttatttttttgacaagattttgcttttttaaagctcgacttttgaggcatatgccttttttttctccgtactactttatatatattaagcataaataacacatttttcacttggtttgaggcttctacttagacttttattatgccttttttgggattttcgtgccttaaatgccttttttggctttttccgaaaattccttaacaaagacgcaataaaaaagaaaaatacaccctaagaaatgaccaaaaaaaaaaaatttagaaaatacaccactaagaattgaaaaatttttcaaaaattgatcgccaaaatttcttttttttcttgataaaaatttaaggttaaaaaatttttcttattcgaaaaaaattataaaatttttaataatcatttaaatgacccaaattaaatttttttgattaagttttacgagttttgctccctaaaatccttaatagaaaaatttcaaatgctttttttcatgcctttttagggattttcatg

SEQ ID NO: 113349 - DNA, 859 bp, Heterodera glycines
  Promoter: Source sequence=SeqID_6447; Location=424..1282; Strand=-; Gene=SeqID_61603
ttaaaaagtaataataataattttgcctgaattgaaattggctataattttttcctttgccaaccaaaaccaacaattttagtatctttcgatagccctaatatcctttataaacctgcaaaatttcgttaaggttcaaaaaagttcctcactctattaaataattttatgcatatgaaaaagaattaataaatttttatgcctttggatagagagaatattaattatttaaacgtgtattagagaagagtgttgacttagctggtcgataaattattgaattacataaataaaatgatcacttatatcattcttttttaattctatttaaaaaaatagtggacctgccctgctggaataatgttttaaaacctaaattttttgtaataaatatttttgtgaattataaaatattaaaattcaaaatttttaaataggtaattaaattattttttgtatgaaaatatgaccgagagattaaaatttaactgtgatttgggatcagaaatacttttgttgttcgttttgattttgtgggttcgagtcttttttgttttaaagaaacgatttaacatcgttttgttaattttaacgatgtgcataacgccaacgatgttttaacgatgtttttttaaattacgaattatagaattgaaaaggatgtaaatgaaatgcaggtgtttttttatgtaaattgatgcaaatgtgtgttgaacgagggagggggtgggatgggtgggtggaacgaccttttcttcacccgagcgaccagccgacgaaccaccattgattcatcttctagtagtatttgttggccaatagaaccaaaaacatttgtccttttcctcggaattaaatg

SEQ ID NO: 113350 - DNA, 937 bp, Heterodera glycines
  Promoter: Source sequence=SeqID_15930; Location=719..1655; Strand=-; Gene=SeqID_80281
ttttaaataaaaattatactgtaacaacaaagaaatttgaatatagtagcaccaattcagcaaatcaaaacaattctatgtttataaattttcaatattaattaaattaaattataaataaataaaattatttaccacaaatttttgctaaatgttttattcataaatcacacatgctacatgttttattgtattctcatgaaaataaacaaagaaatgaaaatttaaaataaaacaaagaaaatttaaaataaaaatattagacaaaaaaaatgttttttaatttataataataaatcactgtaaaaattaaattattaaaaaatagttaaatgattaaactgcaaaacttattttaagaaataatagaaaatcctaagttaaaataattttccgaacgaagcgaatagtaaactacaaagaaaatgttttatggaaatgaaattttaaaatcgtaaaactaaaatattaggaaatataaatttaatgatttttgattaaacaattatttagcattttttctactaagaaaaatcttatctaaaaagtactttttagatcataaataaaacatattctattttataaattgaaatgaaaaaattcaacatgaaatggaaaaagaattaaaacaaatgcaaacaatataagctaaattaaacgacaaatatgattatttattttagttttccataattgatgcatattcctaataaataaataaaataatttggaaataaataaaaattgttaactcaattttaagaaagtaagatcatttaatgcaaatatgaaatgcctccaaatcgaatttttagaaaacacaatttttgcaaatcacaaaaattacttatataatgcacgtgacgaaaacttttcttatttattaaaaataaattttattttttaatatttagtttaagtaaatttaaatatg

SEQ ID NO: 113351 - DNA, 1003 bp, Heterodera glycines
  Promoter: Source sequence=SeqID_30863; Location=132..1134; Strand=+; Gene=SeqID_61253
atatgttggcattttggcatataaataaatatcgcacatatttcggggtttggcacatattttgcacatattttggcatttttgaaaaaatatctaagaaaaacacaaaaaattcaaaaatgcacccctaaaaatcaactttcttcccatttttataggctctttcaaaatttctttatttatttcgtgtaccgaaaatcgaattcttcattaattcgttactggatatcgaagtttcttgctggcacttactcaactgatggaaaaattatctttaaaaacaatttatcaaaaaaggactaattttatccccaaacacctccaaatgttttttatttgcaattgtgcgggcaaaaatgataaagaatgagttttttggaatttttatgcaaaaataccattggtttttccaatttttagcacatattttgcattttttaacacatatttaggcctttttttagcacatattttattacatatttcaggatttttagcacataaaaatcccagccctactaatcgcataaaaaatggttttaaaaacagaaaaaagagaagaaataatacgattgcatttcggttttattattgttgttaataatgcaagaccaaaagttaacgggggaacgttttattgaccgttttttgttggattatttttcacaatttttgcgttatttaaaggccaattctttctcattttaaacaaaacttaaattatcaaataaaatattgaaattgtcatttttcttcttcaattttgccgcattgttctttttcaatgttttttggtgcgatttgaaattttaaacttaagcttaaaaacttctaatgatttaatttcaatttacgttatttggagttaaacttagctttaaactcagggtatttcaataaaaaacaaatgtttggtggctttatcccccaattttatagtgcttttctgaagcgggcgtctcctgcggcctcgacggagtgtgccgcgatttcgctaagaatg

SEQ ID NO: 113352 - DNA, 886 bp, Heterodera glycines
  Promoter: Source sequence=SeqID_3365; Location=5960..6845; Strand=+; Gene=SeqID_84390
actgtttgatcgctgctgaccagctgttgttgttgtagcaccattggcataattagcgaattggggggacagcggatgattccctggtgccggtgatctgccaatgacggatgtgccaccggccatggccaaaaccgacagaccaatgccggccaatccgatcacaaaaagcattaaaaatttaacgacaaatattttatcagaggcaaataaacatggcttaatttaaaataaagtttgtaattaattttgtcaatctgctcagataattatttattgattaattacacgtgttattagcccccattaaaagccaaacataatcccgaaaatatggggcgtgcttttaatgagaaaatattctttcagtatattcgggatgggattaaaaaaccaacccacacaaattataacaaataaatgtgaataagtggtaaagatttgggaaaaatcacgtgaaagcttttcttccattgcaaatgtaaacttttaaacttttatttttgaaagtgcgaaaatggaacaatcttctttttttattattcatttcaactaaaagcaacagttttgtgcgattgataaaaggaaagtaaactcatataaataaaaaataagaaaaatatccgacaataataaagagttaaaaatatattcaaagatgagaggattctttctatatatacatgaatcaattgagatttaattttcttaaattttaattaagcaaagcgcaatactccgactaaaattgcatatttcttctcttaaaatattttaattgtatcacaaagaagccaatgaaataaaaaagtttactgaattaaatgacaaatttatttaaattcaaaaatatgaatccctaaaaaagtgacgataagccaaaatg

SEQ ID NO: 113353 - DNA, 420 bp, Heterodera glycines
  Promoter: Source sequence=SeqID_43540; Location=572..991; Strand=-; Gene=SeqID_71182
acattcccttttatagacttaactcgaaatataaattaccgtttaaaatttataccttttgcggggcgggtaacaaaaatttggaaccaactcgataaaaaccttatcgaaataataaactcattaaatcaatttaaaaataaaattaaaactatttcatttctgtaagattgaccggaaaaataaaagtcgaattattaattcattaaacaaaaagtgatttggtcattatttttattttttattgatctcacattatattttattttttggcggcgatctcgtttttaattgtttatgcgctttcttgaggacattttaattaatgttttgtcctcaatgtaagcggatttttcccttttgtggactttttctttattgacaaataaataaataaataaaaatcgcagcaaaaaaatg

SEQ ID NO: 113354 - DNA, 1003 bp, Heterodera glycines
  Promoter: Source sequence=SeqID_4193; Location=3059..4061; Strand=-; Gene=SeqID_53546
acaaatttttttcgtttaataattatataattataataagacggtttacttcagttaggccacagccatgtttttggactaaaacttttttctatctcaaccaaattttcagtcatttttggccataactttatttttcggaatttttttggctaatagtggacatttagggctgaataccaaaataattataataatcatcatcacatttacacaatatttaccatttattttgtaatccaaatgtcacattttgtatctatcttatttcccaaacaattgtctctctcctctagtgggcggttctttgatcactccctccacctttgattacccccccccccgcccccgggggcttactctcgatcacttatatacaaatcaggcttctcccccggcagtctctgctcccgagaccgaatcgggaagagggcctaagcattgtgtccttcacccagaataaaggcgtactgtttcttactgtattaatggggaataaaggggtacaaagggttgcactacggtgacgcacgacattcagtgctctcattttaaattttatttttatagggaatttcaacaacttatattcaaatttccattttttatcaaagtattttgcgaatgattggcaaaatgcattggatttctctgctaattttggcaatgcttttgctaatggatggatgccatggacaaaaagtgccggcggattcccgcaaaataatgtcaaaacctgccgaaaaaacacaagaacattctgtcaaagtgccggcggattctggcaaaatcacgcaacattctaaggattctggcaaaatgcccgcccaaatcgctgacgggagagattattttttgtttcaagaatatggataaataaaattcttggcaaaaatagcaaacacaatgaacaagtgaagaaggttattgaagggttaaacaaaaaaaagtgccttttggaggaagttttttacctgcaaaattcaaaggtaaattaaaaatg

SEQ ID NO: 113355 - DNA, 832 bp, Heterodera glycines
  Promoter: Source sequence=SeqID_11236; Location=889..1720; Strand=-; Gene=SeqID_74595
tttttaacagtttatttatcaagccaaaattcttcttttgttcaattaatttggccaaaatggtacgaaataaatctcaataactttcttaaatccgccaagggataggaaaacataaatctaggacataaaaattcatagcttggctcaaattcaaccaaattattcagtagctctagggttctttatcagaatatcaaaaatttttaaatagaataaaaaattatggttataaaatttctaaaaatcttaagtgttttttggcaataacctttttgaaattcaatgaaattttttgaaattttaaaaaggtatgagtaagttaaaaaaaattagacaaaatttaatcactaccccaaaatcagaaaatttcttataaataaagacgtatgaattttttttaaatcattcaaaaaagaaagctaaaaatataaaaaaataaattagaaaaaaaatttaacaaaaggattttaaagttattaaaaaaatagttaagaaaaaaaactctaaatcgaataataaaataaaagtgaagacctgagataagtagcaaactcaatcgcggggggaagtttgggcaccggatgtttgggcaccggaaatttgggcaccaaattaaggattttaaaaataattccaaaaagtttcgttaagtatcaagaaagttataactaaaaatgttcaaaaaaacttggttttttgagcttctcaggtcataactttttataaacttaaagaattttttaaaaattttgcaggataatagaaaacacttagggctatcgaaaaatatcaatattataaaatttgatccattttaggcgaaattatg

SEQ ID NO: 113356 - DNA, 162 bp, Heterodera glycines
  Promoter: Source sequence=SeqID_3661; Location=2008..2169; Strand=-; Gene=SeqID_51316
acacattttcatctttaaatttaataaagagttgtttttgaacctagaatatagagaatcgtttgtaatccgttgtttacttttaatgtctatctcatagacaaattttcatatgtaaagaaaaaactttttcgattgagaaccgcaattacaaaagcaatg

SEQ ID NO: 113357 - DNA, 1003 bp, Heterodera glycines
  misc_feature (86)..(86): n is a, c, g, or t
  misc_feature (128)..(128): n is a, c, g, or t
  Promoter: Source sequence=SeqID_28309; Location=402..1404; Strand=-; Gene=SeqID_58934
gaaaaaatgcataattacaaccagagattgtttactcattggaaaaacactgtcactttcacagcgttcgcattttttgggatttntatgacttttttgagtttttgcgacttttttcgtgatttttntaggcttactgaagcaaaatttgaattttagcgaagaaaatgccgaaaaatacaaagaaattccgaaaaataaaatttcgatcgataaaaaggcaatgaaacctggatgaattttttcttaattgttggaagaatctcttttttatgcccatttaggtacctatttataaaattaagtgcctaaaaatacgatcaaaatgttattctataaattattaaaaatgggattttgttaactttcgcctaatttttcaggacatttttgcattttttacgtgcttttttggactttttttgccttttttatgacttttttgtgactttttggcgatttttatggatttttagtgactttaattcccggccctaatgataatcggaaaagctatgttgtgttttgtaacacttaaactatctgcacaaatataagattcaatttttccatttaattcttttttacgttttgaagccattctttcacggtttttttgcttttctacctgactttcttctacaaaaatttaacgatttaaagccattctttcgcgatttttgcttttcgctctctttttgatcaatattctttttttttcgttgtttcatttttctaagagttgaattattcatttggctagagattgtatatctgtgaatagtctgatacttcatcgtcgtctatatttataatttctattgtttcttcttctatttcaatatcatagtcattctaaagattaaaaatgctcaccgaataagtcaagacaaaaataaacaaacaaatcattaacttttatcaaccaacggtaaaaaattaaactagatttaagatttaccaaacttccaatcgcataaaaaaatgccgaaaaatacaaatg

SEQ ID NO: 113358 - DNA, 207 bp, Heterodera glycines
  Promoter: Source sequence=SeqID_4112; Location=495..701; Strand=+; Gene=SeqID_53231
tctgcaaaatttacaaaaaatatgacaaaacaaaagaaaaaatcaaaatttttaaaataattttccatagatcgaggaaattcatggaagttggaaaaagatacacatccaaattttttacaaagaaatttttttttctgccagtgctaatattcatgtaatggaaaaataattaaaaaataataaaatttaggagtatagcaaatg

SEQ ID NO: 113359 - DNA, 309 bp, Heterodera glycines
  Promoter: Source sequence=SeqID_20971; Location=1..309; Strand=+; Gene=SeqID_45616
gtctctcaaactcaggctaagcaaggatttgagaatctggccgaaaagctcaaccagtgcggaaagggtgggcggcaacggcacaaggcaatcactctgaacaatcgaaaaaataaaaaaaatggtacattgagaggtaaacgacagatcattgatcagctaacacttgcacattaacatttgacaccatacgaagcctataaataggtgagataattttagttttttcacaatcgactacactctcagcaacatacattaaatattttgagagaaacatactaacaaaaaaaaactcagtggaaaatg

SEQ ID NO: 113360 - DNA, 433 bp, Heterodera glycines
  Promoter: Source sequence=SeqID_6267; Location=2667..3099; Strand=-; Gene=SeqID_60957
aggccaacgttaaaagaccaacttgacccataatccggaaatgtggagagaacgaacccttttttgcacattttttttctaaaattgttttttttcggtttgagaaaacgcaatttatgttttcgaacatacagaaattttagtttttttctctaaatcttctcaaaaacaattttcgttcattctctcctcgtttacagatcagattcagcaatagatttggttttttctccttttcatctgttaatttattcattttgcatttaattgttataggaatctcgagtacgataaaagagaatagcaaatttggcataaaggaaaatattgtgagatttatatttaaaaatacagaaaaaaactcaaaaaagaatttcaaaaagataatataatatttaacaaaaaatgcactggaaaaaaacgaaaaaggatg

SEQ ID NO: 113361 - DNA, 362 bp, Heterodera glycines
  Promoter: Source sequence=SeqID_1868; Location=1..362; Strand=+; Gene= SeqID_47077
tggagcgagtgctgttggagtaccagcaattagcgttgggtgtgttgttcccgccttccggcgcgtatgtccttccgtacgttccggcaacggagcaccaaatcaaaaatgtgctgggactgctcaaaaaatgtcctccggccccaccaattagtccgctaattgaccttggcagcggagacggacgcgtcgtaagtgattttctttttattcagataattaaaatgtatttcaattagtaacaattacataattgctcatcattttgtacatttaatgcgcgtgcaatatattacacacctcctaaattgttattgttgttgctgttgttgttacaaaaccacaaattgtaaacggaaatg

SEQ ID NO: 113362 - DNA, 131 bp, Heterodera glycines
  Promoter: Source sequence=SeqID_4691; Location=1..131; Strand=+; Gene= SeqID_55403
aggcagatcagcggcttgttcaggcagatcagcggactgttcaggcagatcagcgggattctcaggcagaaaggcggactgctcaggcagaaaggcggactgctcaggctgaggaggataaccggcaaatg

SEQ ID NO: 113363 - DNA, 254 bp, Heterodera glycines
  Promoter: Source sequence=SeqID_1114; Location=1..254; Strand=+; Gene= SeqID_68071
tggatttggcaaattaatgctggcaaatgggccatttatattagcaacaattgcacgaaatcattttcatgtgctatttcaatgccttacttcaaatatttatttaaaattaaattttcaattcctttttttttacaaaaattacattcaaaaaataattctgctcggtgttaatttgtataatgaaaaaagaggcgttaattcattgaatggcatccaaatattttgctaattttttctggtttttttagatg

SEQ ID NO: 113364 - DNA, 451 bp, Heterodera glycines
  misc_feature (18)..(19): n is a, c, g, or t
  Promoter: Source sequence=SeqID_2764; Location=2370..2820; Strand=-; Gene=SeqID_81464
cgtttatttgtctccacnngctttcaatcagctcaaatctctcttcacaagattttttgggccaaaagaatggccccgaaattgcggtggcggaaatcgatcagacggaacggaacaaaattggccaaagggcacaaggaaaagccgaaaatgaaaagaaaaagcagctgttggcccgggtcaaaagaacggcacaaacaaacgaacggagcaaagcaaaaagtaaagcgagaaaagtgctggcgacggaataaattgaaatgaaaatcgcgatttgtgttattatcgggcggagaaaaagcattttaattgggaaattaattaatttattggtttaaaattatttgttgggtacaatttattatatttgaattaatttgtgaaaataaaaattcattcattaattttttcttaattgtgtttagctcatttccaaaattccccaaaaatg

SEQ ID NO: 113365 - DNA, 164 bp, Heterodera glycines
  Promoter: Source sequence=SeqID_41535; Location=844..1007; Strand=-; Gene=SeqID_69628
ggtcaccgaaagcactcttctagtcacaataaaaaacgcactcattctcagatggttctgtcgcgcaaattggcacttacagtgacttattggctggttctggtgatttctccgatctgatcagagattacctcaccaatcgcaatccctccaaccgagaaatg

SEQ ID NO: 113366 - DNA, 241 bp, Heterodera glycines
  Promoter: Source sequence=SeqID_901; Location=10417..10657; Strand=-; Gene=SeqID_63558
ttgtgagcaggtcgctcctagggttttttgtgacccaaggcgcctcccgcttacacggtcggacccatcgagtttttcgtaactcgtagcgtccttcttcatacactgtaagactcttggtgggtctgaagtcaaactcactttgtccactgtttgttcaacttactgctattttgtgaccccgaaccccacacaatttgttcggaagtcgggtagcagaacccaaaagtgagcaaaaatg

SEQ ID NO: 113367 - DNA, 560 bp, Heterodera glycines
  Promoter: Source sequence=SeqID_22113; Location=1..560; Strand=+; Gene=SeqID_52765
atgaaattcagttgatgtcaaatcgcccgttgggacaattgagtgtcccccagatatggtccataatttaagtgaaaattagtttcctgaaatccttaattatgctgacatgagcatacatctgacattaattttttttttcatatcaaactgtcaaatctaagctttagaatgcaatcattttcaaacaaatataattatgactttcttctgaaaaatccaattacttttttgttatcggctgcttagaaaaagcttttcctcattaagtgcttttgaataatattctaaaaccgccttggcaattgggtttttgataatataaaaattgtaagcatattgaattgacattatcttagtttaggcaatctgtgtgattaaaattattccagatacatgttcagcaacccaagggaaacattaataaactgattttatgaaaaaactaatggatccattttaaaagattgcacaaaaatttactagataattcattttaaaaagttgttaaaattaaaattttattttttatttaaggtaataaatttttcttcaaaatg

SEQ ID NO: 113368 - DNA, 733 bp, Heterodera glycines
  Promoter: Source sequence=SeqID_12196; Location=1684..2416; Strand=-; Gene=SeqID_75772
aaaatttcagtgcaatttggttaaagttttgtaaaaaatgacctattttgtgatttagagccaatttttttaaagaaaaattaaggttttgtcagctctgacggggaaattggaattttaaaatgaatttttgagaaaataatacaagttttcaaaaaaaatttcatttaaattttgaatattcaaaaaagacatcgtttcaaaaaattttctttataaaaattttacaaccaaaaaatgcgcggcgcaccgcgcaacaaaaaaaaaaccgcggccgcgcaccgcacattcaaattgccgcggccgcggatcgcgcaaaaaaaaacgccgcgaatcgcggtcgcgctccagccctggtccggtggcgccgataggctccgccgggaaaattttaaaaactttacacacaatttcttagcagatttaatacaatacttcaataaatatcttattttttcttaccaaaaaagtcattcttacgggtgtaaatatttcgtctttttcgtccaattttgctctgacgaaaacgaaacacgaaacgaaaaaactttggtagacgaaaacgaaacacgaaaacgaaactcaaaaagtgccgaaaatgtaggacgaaacgaaaacgaaacgaaatttcgtccatccctggttccgataggacaccggcaaatcagaaaattgttttgcttaaaactcaaaaaaattttatcgaaatacattgttaaaatttcaggcaatg

SEQ ID NO: 113369 - DNA, 137 bp, Heterodera glycines
  Promoter: Source sequence=SeqID_16631; Location=283..419; Strand=+; Gene=SeqID_47387
ggtccgctgattaatgcctcactttggccaaatggtgcttgttcaggtgcacttacattttgggccccgaggggcgtgtgacgtcttttggggagagacagcaaagcgaagtgattcaatcggtgatcgaaccgatg

SEQ ID NO: 113370 - DNA, 123 bp, Heterodera glycines
  Promoter: Source sequence=SeqID_7225; Location=822..944; Strand=-; Gene=SeqID_64191
tttttggggtttaagggttgaaaaaccatcctgacatccatttcgatcaatcaaacccgagatctggtgttaaaaagaattgaagcgattttgtgtataaaatgtgaattttgttcaaaaatg

SEQ ID NO: 113371 - DNA, 110 bp, Heterodera glycines; identical to SEQ ID NO: 98226
  Promoter: Source sequence=SeqID_17546; Location=702..811; Strand=+; Gene=SeqID_82055

SEQ ID NO: 113372 - DNA, 257 bp, Heterodera glycines
  Promoter: Source sequence=SeqID_31178; Location=1..257; Strand=+; Gene=SeqID_61555
tgcagaatgatttaagccaaatgcatgtgcaaacaatggaaaagttgcccatggtcagggaggaattttgccaaaaaataaatggtatactgtcaattactgtattattgttgttacaattagcttgatgagcatggctgagatttatctgtttatacataggcgttaccttaatgcacaattttaataatatttgtggtgcttttaaattcaaaacgaaagtctgaattttttaattttttattttgccagaaatg

SEQ ID NO: 113373 - DNA, 505 bp, Heterodera glycines
  Promoter: Source sequence=SeqID_8150; Location=2610..3114; Strand=+; Gene=SeqID_67143
aatggcgtcattttgacaattatgacatcaaaaatcgtgcttctttacccgaattcgtcgttgcgctttttacttctcaagtttttcttaatttacgcggcgaggttaaaaagaaatgaaaaaagaaattaattaaaaattaattaatttaatttttgaaaattaaaaagagagagagaaagagagagccaatgggtaattaattaaccaaaaataaatatttaattattcatttagtaaaatcaaataaattgaacatttagaactggtgggatgccaattcaactcgaacaaatcgaagaaaagtcaaaaatgagcccatttttgactaaaaatcccatggaaaatgaaatgaaaatttacacgacgattttcccggagcaaaacgccgcacgattgatcacttatgtaaacgcaaaaataatcagaaaagcaatgatcgaaggcaaataattaattacttaatttaattaaattatcatgcattttagcgctgaacaaaatg

SEQ ID NO: 113374 - DNA, 265 bp, Heterodera glycines
  Promoter: Source sequence=SeqID_22296; Location=183..447; Strand=+; Gene=SeqID_52968
tcctgagccattgaagaacattagtgtaagcattgggactgaaatggccggtccaacaaagtgtttttttcaacaaatgaatcattcaattttgaaaaaatgaatgattgaatggttcattcaactcccatccttttgtttgtgtcgtaagatggtgcaatttcctcccctcccctgccattatgcacagatcgaacgttcatccttcaatgaggtgaagtacaccaagtcattgcccagctcggctgaccgttacgcgaacatg

SEQ ID NO: 113375 - DNA, 63 bp, Heterodera glycines
  Promoter: Source sequence=SeqID_21016; Location=701..763; Strand=+; Gene=SeqID_51595
aatttcaaatttaaatctgaccaaaaaaagagtaatgagtcaaacaaggtcaatttgaatatg

SEQ ID NO: 113376 - DNA, 169 bp, Heterodera glycines
  Promoter: Source sequence=SeqID_129; Location=2274..2442; Strand=-; Gene=SeqID_73717
ggtcggaacaacggaggccatcacaaaccatgttcatgtcttttgttttttcagccaggcagtgctcctcaacaaccagacgctgtacatcagtggccagaccgggatcgcggcggggtcgacgaatgtggtgccgggtggagcgcgagccgaggcgaaacaagcgatg

SEQ ID NO: 113377 - DNA, 711 bp, Heterodera glycines
  Promoter: Source sequence=SeqID_39085; Location=169..879; Strand=+; Gene=SeqID_67738
ttttggctgttaccgtctttttctcaatctctcgcggccgctgctgctagtctgtcctcttccgctgcgtcttccgttgttgccacttctgctttccactctcatctgctacagtaccctctggtcggcaacagtcagtggctttttcagtccacaacacctaccgtacccccaccgctgaccggctgccacggaacatttccttgtgccaatggtactgtaccgtaacaaggatgtctactgtttgtcatcccatattttttcctaattcattataccgtattccttagtgttggttggactacgtttacttttcagtgtccccccccccccctccgtttttgctttttgtcttcaaattgtcccttttttgcgcagtttgaaattttaaattcattttttgaagtgcctttttcgttttcaaaggtgccaatgcgtccgtctcgcctttccctcctccgtcttcttcttcttccgcttttgcgtcgccttcgctttcttcggcgactctttcggcttcaaataatgaatttgtggaccgaagtaaagaataagcttatgtttgtttctcatcattcggctcattttatcttttaaatttccaaattaattaaaatttaagtcggcgagtcggcccgcaaccgttttggccgcccttacatttcgggacggccgctgctgttgtgcgaccggcagaaaatcatcaaaatg

SEQ ID NO: 113378 - DNA, 376 bp, Heterodera glycines
  Promoter: Source sequence=SeqID_14351; Location=1083..1458; Strand=-; Gene=SeqID_78382
ggcactgacgtttgtaatatttcattttatattctgagtttagtgagtatttaattggaaaatctttaaatatcttaatttatttaaagaaattattttttgttttcatttagataatttatttttactttaaaaatggagggaaaatcctttttgaagaccccaaaagaaaaacgacaattgagaaataaaaaaaattatttcagtaataaaaaaaatattccaaatgatttatacggaaatagcaaacacgcaaaaagaaaacaagaaatttggcataaaagaaaatgttataagatttatatttaaaaattccgaagaaaattcaaaagaaaatttcaaaaaaattattgaatatttaacagataaagcaatg

SEQ ID NO: 113379 - DNA, 572 bp, Heterodera glycines
  Promoter: Source sequence=SeqID_16567; Location=1224..1795; Strand=-; Gene=SeqID_80977
gatttcatcatcatccttgaacattgatgtcttaaaattggtttttgtgtttacttctaaatacattcattttaagttcaaatgcatgcccttttaaaaaaataaagcatgtttttttttaccaattttgaattttattatttcttttttttttaaatctgcgctatttatatgtaattttcattaggatgaaaaatttcgaattttagcttttgcattttatatttcttcaattcatctctctacctctctacatacatacaaacagcggtggttttcgaattgatgcatcagaaacgaatgtaagcctttgaattaactataaaaagttttctacaacacgttttttagagcctattaggtttccatttttttacatactcgaaattttattacttcttttttcaatctttcaagcattatttgagcaaaaaaaaatggtttcaaatgttagaacaaacttacaattagtatattttaaagaataacccggttttttcatataaatataattctgtatttcaaggagtttttcgccgggtccgtcagattcaaggacaccgacgcccatg

SEQ ID NO: 113380 - DNA, 788 bp, Heterodera glycines
  Promoter: Source sequence=SeqID_24289; Location=699..1486; Strand=-; Gene=SeqID_55007
tggacaacggcggtgagccgaagcggcagcccgacctgttcagcttcttcgaccaatgaacgtcttggccacgatgtgaatgtgtggggctataaacgatggcacgacattctctttctctgatcagtgatcacttaccccatcttttgctgtttcttttgtccaaatgactttttttattactgtttctccttaaagcgatgaccatttcccattttggattaacccaaatgatcacattgacttgattgatgatgataccctttctctgctgctgatgtccatttatttatacttttttccatttttggccctttttcttcaccaatgcgatgaatcagcgcctttctgtcaattgtctcgatcaatctttctttcttcctccccttctgttgtgctttctttctttcccataccctcgagagtgcttcgttctctaatttttttgtcccttcctctgctcttgaggttgcgcaattccaatccataaaatataagtacctatatgcttacacaacaccgaccattcccttccgcctgtccttgacttttaaggattccaataaaaatgtaaaagcattttttaacaaaataaataccagattgccaatttatgcactaattttttgatttgtaaaatttccaattttctctatgtccccttcggctttgttcgtttgttttggcactaggcagaaaggaggacgcaaaatgccgtgcacaaattgtatggcggaatacacacgacgcagaaaagaagtgggagaactttgttatgatccaaaatg

SEQ ID NO: 113381 - DNA, 87 bp, Heterodera glycines
  Promoter: Source sequence=SeqID_26443; Location=1..87; Strand=+; Gene= SeqID_57176
ggcgaagactttcctgtcgttgttcccaggaaagtggtccattgccaccgtcggttgaccacacgcattcacgacgagaaagtgatg

SEQ ID NO: 113382 - DNA, 1003 bp, Heterodera glycines
  Promoter: Source sequence=SeqID_32145; Location=238..1240; Strand=+; Gene=SeqID_62475
atttagtcagcccctgatcaattacaaattatttatggacgatcaaattttttgaaatttttttaagtgcaaaagtggtgggtgtctgcaaaaaattttcaccgggtttaaaaaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtgtctgcaaaaaattttcaccgggtttaataaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtcttacagcttaacaaggcccaattaagcttatttccagaaaatctcgcatgaattctcatttttaaattttttatagatttttaaatatttggatatttttttggcttaccaaaacttcatcgaacctggctctttctattctcattcaaatcgctccaaattttttttacagcttaactaggcccaattaagcttatttccagaaaatctcgcatgaattctcatttttaaattttttatagatttttaaatgtttggattttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 113383 - DNA, 635 bp, Heterodera glycines
  Promoter: Source sequence=SeqID_43959; Location=152..786; Strand=+; Gene=SeqID_71519
aaatttattttaaaaatcaaaaaaatgtttgaaaaaattaattatttgcttagaagcataaaatccaggcctggatccaggtctaggtcgatctctaatattcactaatgtttcaaaacagtcaagaatcttgaaacaaattcatttttttgcctatttttcaaattttgcattaattgcaatggaaaaaacagaaagaagcaaaattgttttgttttctgtgttctctttggcaaaaatgatttagccaaaaactcacaaaatcaacgccatttccaagtcgttaagaaattcgtaatttgaaaatctttaaatgcttccaaatttagcattttggcaattacaaattttttgtgttttgttgaaaaatttattatatttagtgcaaatttataaggaatttttttaaaaataatattggttgattgatttttattataatctttaaacatttaggcatcgtctcggcaactgtttgagcttggccatatccctccctcattattgggaatctgcttgttgtgccgggaaaatgcacaaatggcaaattttgtaaaaaaaactattacttaggtaatttagcgtattttattttttagcaatgcccaacattgaatgtctcttgtcacaacatg

SEQ ID NO: 113384 - DNA, 300 bp, Heterodera glycines
  Promoter: Source sequence=SeqID_15294; Location=1..300; Strand=+; Gene=SeqID_79518
gaacatcccaaaatcaacgaatgcccgtcacctgctacaattgcggccgagtcggacacatttctcggaattgtgagtcggaaccaatgcaaaggatgtaccatcaaaatgatgagccgccgaaaagggaaaatttatttattggtgccgtaaatttagaacaccgagtctgaaatagaacaattcttcggaaaaacaacgaatttgtcggaaaagggtagacttttggaagaaagcccggctgttggtaaaattttggcggccaaagtttcgattttcggtcgacatttggaagcaatg

SEQ ID NO: 113385 - DNA, 145 bp, Heterodera glycines
  Promoter: Source sequence=SeqID_19167; Location=1646..1790; Strand=-; Gene=SeqID_83914
atttttatagggaaattgccaaatctcgttcagataaaacggcaagaaaaaggatacaacaggggagtggtatagccctgggagctgtcttggtcccggtactgagtgttttagctcaacatttattagaaaaaataacatcatg

SEQ ID NO: 113386 - DNA, 157 bp, Heterodera glycines
  Promoter: Source sequence=SeqID_29591; Location=164..320; Strand=+; Gene=SeqID_60067
agtgcagttgaacgtcaaaagcaccggcgattgtctgaatccgttggcactccgcatttcccccccccccccaatttcagacgtcgacgccctttacgctgcgttggacgcactgaaagtgcactttgacgacgcaaaagaggcgggcgaaacgatg

SEQ ID NO: 113387 - DNA, 418 bp, Heterodera glycines
  Promoter: Source sequence=SeqID_26617; Location=1..418; Strand=+; Gene=SeqID_57359
gaaatgtttttgatttgggttgtatgggcttaaaataataaagaatgagatttttggaaattttattcaaaaccccatttttttttcaattttaacacattttttaccacatttttggcatttttggggtttttacacattatttcagcattttttagcacattttttattacatatttcagaatttttagcacataataatccggcccctatgatttatctccgaaacgaagttagttgtggtaaagaatttatacaattaaaaaataaaaaagcattgaagattttgtataaaaataaaaagatgaaaaatttttttttcaagatgaaacagaatgccaaaataatcaagaaatgaaaatatacataaacccaaagaaaaactgaaaaatccgttaaaattatacagcaaattatg

SEQ ID NO: 113388 - DNA, 300 bp, Heterodera glycines
  Promoter: Source sequence=SeqID_32317; Location=1..300; Strand=+; Gene=SeqID_62621
gagcagctcgagctctacagaaggtatgaaagaaaaaatagtattctgggacttttcagaatcagaattattctccaatgtgccccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 113389 - DNA, 749 bp, Heterodera glycines
  Promoter: Source sequence=SeqID_2055; Location=479..1227; Strand=+; Gene=SeqID_77542
tagttcggcctcacgaattttttgtaattcgtgtcgcttgccttcccgagggtttggccccacggattttttgtaatccgaggcgcttccccggtcccatagttcggccgcacgaattttttgtaattcgtgtcgcttgcctggtttggcccctcggattttttgtaatccgaggcgtctttttccttgctcagttagcccctcgggtttttcgtaacccgaggcgtgttcctttctccagtgaccgacccctcgggttttttgtaaccaaggcgtcccccattgtgagcaggtcgctcctagggtttttgtgacccaaggcgcctctcgcttacacggtcggacccatcgagtttttcgtaactcgtagcgtccttcttcatacactgtaagactcttggtgggtctgaagtcaaactcactttgtccactgtttgtccaacttactgctattttgtgaccccgaaccccacacaatttgttcggaagtcgggtagcagaacccaaaagtgagcaaaaataagggatttttgcgtacaaaaatcgcaatagagctaaaggctcttgagaaggcgaaaacggcaacagaattgtatgctgagccggaccaaactctgacctcattggaaaatgcaattctcctggaaagcgcggcagagagaataaagtcagaggtggaggcagtgaatgccaaaatcgagcaaatttggataaccgcaagcaaatggcatgacgtcatacaaaaaatg

SEQ ID NO: 113390 - DNA, 106 bp, Heterodera glycines
  Promoter: Source sequence=SeqID_24391; Location=470..575; Strand=-; Gene=SeqID_55122
tttcttaaaaaaataaatgtttcacaatgtttcaaaaatgcagttgcgcatccccgggccctttttatgtaattaatggtcccttacccgaatttgacccgaaatg

SEQ ID NO: 113391 - DNA, 845 bp, Heterodera glycines
  misc_feature (13)..(13): n is a, c, g, or t
  Promoter: Source sequence=SeqID_30558; Location=782..1626; Strand=-; Gene=SeqID_60972
aaaatccgcgcantgaaattcagtacccattgcaaaggtgaaaaccaatttggaaatcgaaaaattggttttaatcatggcttctatttattaaggcccatcagattaaaaattagtaaatacaggaatttcataaaaatcgtacaattcacaaaaaaaaaattatttaaactaataaaaagtgataaatagagcgaggatttatatttacaaaaaatcctgaaattttaagcaacaatgcaaaacatttaagaaaatattgaccaaaaatgagaaaaatttagagcaacaaaaaattgaaaattctcttttaattaaaataaaaagggaaaaaaaattgtttacttttgcagttgcaaattaagtgtatgtatttcaagcgttgagataaagtttatatgatttataagattgggtacgacctttttcatttttttttgtaaatttttattttttattatttttaaagttttttatttctaatatctcgaaaagtaggaaaccggtgttaatcttttaatactcatatgaaagccctttttgaaaaaattcttaaaccctaagaattttttgtaaagaatgaattataatcccataattgaatccttttcttaataattaaatatgccgaaatatggatataaaatatggtggacaaaaatctaacttaataaaaaaatttacggatatatttattaatattttttcctccttcttatttgaaactaaaaaaattgctttaatggtcgctattaattaacaataaatgctaagattttgttcgcttacttcaaagaaattattcaaaaataaaaatttgaaatttatagggactaagcctaatg

SEQ ID NO: 113392 - DNA, 120 bp, Heterodera glycines
  Promoter: Source sequence=SeqID_1753; Location=1709..1828; Strand=+; Gene=SeqID_75721
tgtgtttggtgacctttgatgctggaaagagactcaaaagaagaaaaagacaaaaaacataaatagacgaaaaatgttgaaaagaaatatttgctgtgacacacaacacatacacacatg

SEQ ID NO: 113393 - DNA, 64 bp, Heterodera glycines
  Promoter: Source sequence=SeqID_3331; Location=3190..3253; Strand=-; Gene=SeqID_84244
ggcatttctccgtgccacttcttccgccagtttcattattcgaattgatcgtgtgagagcaatg

SEQ ID NO: 113394 - DNA, 97 bp, Heterodera glycines
  Promoter: Source sequence=SeqID_13686; Location=1974..2070; Strand=-; Gene=SeqID_77600
ttttggaaacgatgcgttggacgcatatggattgcgagctttttcaacaccgcttacgaaacaaaacttaagcgccctgcagcgagacctaagaatg

SEQ ID NO: 113395 - DNA, 285 bp, Heterodera glycines
  Promoter: Source sequence=SeqID_3837; Location=2764..3048; Strand=+; Gene=SeqID_52071
tgtctttgcgatacaattcgaagttatatgagtgataacggcccgcaattcacttcaaaggaatttgcgaagttctgtgaagaacgtggcattacgcacacgctcacagcgccataccatccgcaaagcaatggagaagcggagcgattcgtccaaaccttcaagaaaggaatgcttctcaacaagaaggagaaaaattgggaaaacgaactcgcgaaaaaccaatttctgctgaaatatcggatcacaccgcattaagcgacaggacaatcaccggcaaaaatg

SEQ ID NO: 113396 - DNA, 644 bp, Heterodera glycines
  Promoter: Source sequence=SeqID_28871; Location=1..644; Strand=+; Gene=SeqID_59445
tcaaaataaaaaaaatttgctttttgagtttatcagttcataacttttttgaaacttaatgaatttttttgaaatttcgcaggataatagaaaacacttagggctatatatcaacataataaaatttgattcattttgggcgaagttatgaataatttctgtcaaacatttttaatttgatggtttttgggtaacgcccattttgatgggttttgaataagacccggcaccgtcagaaatagaggagtttctaattgttgtggaaatgcggaattttccgcgctttggaactctgccgcatttttgaactcatgcgccgcttttttggttatttgttttggaaaccctggttaaaaattctgcaaaatgctccccgatttttaaaatttaactgaaaaaattaatttgtctttttcttttgctgtggcgccaattttgcactgcaccgattcttcaattgtaccaaaattttcaagctttggttttattatacccgttttccaccaatttcaagccgggcacccccattttgagatcaccacccccatcgattagacataaacaaaatattgaatattattataaaacaaaatgattgaaaataaataaataatataaatttaaaggaaataatcggctcaatg

SEQ ID NO: 113397 - DNA, 57 bp, Heterodera glycines
  misc_feature (2)..(2): n is a, c, g, or t
  Promoter: Source sequence=SeqID_43813; Location=62..118; Strand=+; Gene=SeqID_71394
tntggtgccctcaagggtggcatcgaaggacttaccatgcgctggctgaaaagcatg

SEQ ID NO: 113398 - DNA, 374 bp, Heterodera glycines
  Promoter: Source sequence=SeqID_39400; Location=480..853; Strand=-; Gene=SeqID_46594
agtatcccaaaatcgaattcggatctgggattcggaattggtcgaaatgtatgtcggattcatgatcagtgaccacgaaaacactcgaaaacacatttccaatgacttaagaaaacaaaaaattgtcagtgtgccgcactaaaaataatcatgtccgagaaaaaagttcatatactacgaaacgccaaattaagcttttaaagttttatcgaaggtttattagcattttttgttcaaaaatagttaaaaagctaatccaggcctttttttattatttttctgtcaagcaaactgtaaagccctttccaattttgccttgtgttgatatttttgatttcgctatttcatcaaatccaaccgaacattaaacaatg

SEQ ID NO: 113399 - DNA, 55 bp, Heterodera glycines
  Promoter: Source sequence=SeqID_12529; Location=546..600; Strand=+; Gene=SeqID_76180
ggcaattttattattaatttttaaatatttttaaatttatttttaggaagacatg

SEQ ID NO: 113400 - DNA, 1003 bp, Heterodera glycines
  Promoter: Source sequence=SeqID_21662; Location=470..1472; Strand=-; Gene=SeqID_52266
agtcccaacttttgttcgcaagcacaaaaaagaaagtgtttttcctactatttagagcatgtagaatccaggaaaaaaattctttaaaatccgttatgtattcaggacgatcgcttacaaaattaaatttttcgggtcacgctgcgacagaatgaaatcccgtgggattgcttaattcagcaaattttgccattttcaaaaaataatgcggaattcagaacgatcccgtccacaaaatcccgcgcgggattccgctccatatcgggtctcttctattcagtcttataaagttaaaagagtttttataaattgaaaatttaaaaagatttaatatatagaaaacagtctcagtatattaccttgatattccataatttaatagttaatttgaaaaaatgcatactaattttaagctaaattttaatgcaagcagaaaaaacgcttactttacaccaaattgcttagatcattccatcacggtgatcggacaccaaaaaatggcttgaaagcttttggaaaatattcctttcccttatacaatacattgtcactcttctcatccttagctcctttttcaaaaaataaaaaataaattctcattctcattataataaaaaaatcatttatatgaattctttttgctcagttcggtacggacaaaaagcgttattcatttattatttaataattggaaaagatgtaaaacgtgtaatttcattaattaattggcaggtgccatgaacagaaaggcagacacaaaaaatcacaaatattatgtaaattcagaaacatttaattaaataaattgtcaggtgagctttcggttttatttaagcaaataattcagcattttgccattcgttgttttatctcaaaaaattaattaaataaaattaaacaaaatgaatgacaacacaacgtacaatacggtagtcattaattgaaatatttaaaaattacttttttaaaatttttttgcagttttatttggtcttcaaagatg

SEQ ID NO: 113401 - DNA, 112 bp, Heterodera glycines
  Promoter: Source sequence=SeqID_25874; Location=1209..1320; Strand=-; Gene=SeqID_56647
cgctgtccacaaaggtgaaaaaatgaaaatcctaaaattccactaaattctgtattaaggcttggtgtttgctcgatcttcgacttacaatggacctgtattatgaaaaatg

SEQ ID NO: 113402 - DNA, 981 bp, Heterodera glycines
  Promoter: Source sequence=SeqID_8708; Location=1..981; Strand=+; Gene= SeqID_68916
aggtctgtaaaataaaaatagcccaaaaatccgcaatttttttctctatttaataaattttatttcatctttttatcatttttttgtaaaaagttataaaaataaaagtgattttggaattcgggaccaaaggggggtgcacatggtttttgagtggaaaaatttttctcacaaaaatcttccaaaaatatgtcattagggctatttgaggctgctgatcactaatctgacatcagatttcagttattagatcgttaagccctcagaatccctgtgtgattggggattctgcctcagaatccttgcgtatagagtgatgaatcccatccccttaaacactcttatgtggatggtgaccatccacttagttaatgatatgtggatgtgggcttggtagtgttcagcgaccgaatacggactggatccgtagtccgtatttttcgatccatgtgtgtttttatggacttacgggttttacgggttattgagcccgtaattccatcatacaccgtgtagttaggtgctcagcccgtaacccttacccttatccgtttattcgaaattgatctctaatagtgatgaagatgcttgaaaacgaaaattttccaaatttgtgaccatgattttgatcgaccacaatactttaacaatgatcaatgcttaacctcaagactcgaccgaaaacgaagactcgagacacggattaaggttttaagacgcgagggcacgaatttctccaaaaaattttggtcaaattctctggcgattatgttcaactccccccggcagattatggcatttttggaaatttttcggacccggctttcgcaattacaatcgcccgaattatgttaaatccataataaacctatcttcattagatctgtgaactgttcaattctgctccgacttcggcgctttgttgaagcagtgttgatctacacggatgccgaacaaatacacatagtcgcgcactcaatg

SEQ ID NO: 113403 - DNA, 124 bp, Heterodera glycines
  Promoter: Source sequence=SeqID_32460; Location=1..124; Strand=+; Gene=SeqID_62767
tcaatcggttggtctgatcaattaattgcattcatttgttgcgtttcctttgcattgtccgtttttgccaagatttttgcttttcgtccgttttttcagcttttccttttcccttcccaaaatg

SEQ ID NO: 113404 - DNA, 988 bp, Heterodera glycines
  Promoter: Source sequence=SeqID_11438; Location=1..988; Strand=+; Gene=SeqID_74831
aatagggaaaatatcgtaaatatgtcatatatttaatcaaattctagcttcacatttgcaaacgaaatacatacatttctcaagattttttgaaatttttcattttgttgtcagcgaagatttttcggaagcatacaaaatcattaaaaatttcgcaacatttgggaaaaaaatctattcttataaggtgatgtttttataaaatttgcaaaacactgatccttagtgtgtacttttcgattttgtttttcattaaatttgctgataataaaagagtatttcatgtgattagtggcaatccatggtgacataaaacctgaataattttatgtatgtcaaaaaaatggttgaagaggaagctctgaaattgattgattatgacggtaacactatcataccggtggggcttttcggaaaaacgacaccagaaaccaaaatcccaatttttcttaaaaaaattagtttaaaatctctaaatttggtctttttttatacaaaatctgttaacaaatcacataaaaaatttcaaaaattttcccggcggcgcctatcggcaccgccggccccccaattcccaaagttttttggaaaaagcacgccgcaaaaacattattaatttttaaattttgaataaaatttttcaaaatgctgatttacaaaattttcagttgacaggccttcgtttttatgctaataaaatgttgttttaagtcgttttttcatgtttttattgcgtttccttcgcgctactatcagttttagaaaaaatcttatttttggggtccgaatcttagttttagcctcatctgtccttattttgaaaataaaaacttgaccgccctgggtatgaccgcttaaccgaaaagtaccccaaattctttacataacacccatggtgttttccccctgctgaagttaaattaattaaaatttttagcgttcattttaaaattcaaaacttccaaccaattctcttttcgtcaaaatg

SEQ ID NO: 113405 - DNA, 1003 bp, Heterodera glycines
  Promoter: Source sequence=SeqID_761; Location=23..1025; Strand=+; Gene=SeqID_60649
cggcatggcaatttcaattttgggacaattgtagtacgccaattagagaccggaattcggagaaaacccgtgcccaaagtcaagggatgtgtcaagccaaggggaaaattactgttcttcgatattcgaatcaaaacccacttttaggggtcgggaaatttttttttggaattttgagtgaaacctgacaaagctgcatttgcggctgcaattcggggcaaaaagcgacggagccgtcccaaaagagatgaagacgaagaagcaccattaccgttacattcatcctccatgatgaatttgaataaaatattcgattatttttgcgggctaaataaaacaatattaaatattcccgaaaaatttgcaaaaattatatgggatccttaaaatttaggcatttttcatgcgcccattttcgaatgaatgggggaaacgaaaaattagtcagtccgtgccataattttgtgccaaaaataaaggaagaaatgaccaagataaaaaaatagaattaaaatggtacaaaacatttcatacatcaattagaatttgataaataaatatatatttatttgtgtgtgtgtttgaacgaaaatataaaagagcagacacatcatacagtaaatcaaatcgaccgattcgtactgtaatttttgtaattgttgtcactctcactatctgctggcgcttacgcataaaaagaaagccatacgaatgggttgtttttttgtcatgggaccgaagaaacaaaaatgcatacagaaaacggaattggattggattgatcagctctgatcaccaaacaatgtgacgatttacaacacaattagcagccaattaattgcttggatatgtttttacgataattaatcactttctctctctctcccccattctttccctccgatcaaattaaataacgcccgcccccggctgttctgttgatccgtgtttcagtgaagtgactgggcggaggcctcgagttccggcaacaaatagggaaatg

SEQ ID NO: 113406 - DNA, 653 bp, Heterodera glycines
  misc_feature (19)..(19): n is a, c, g, or t
  Promoter: Source sequence=SeqID_40367; Location=1..653; Strand=+; Gene=SeqID_68727
aaaaattgccattttttangcatcatttttagtttggattaaaaaaatgctttttgaattttacttccctttttttggtgttgaaaattttttaaaaaatttcgaaaactgtatatttttactattttatgcctctaaattaaaagtaaattaaacaatttttcattcattttaaaattaaaaatattttatttattcgagagttaataaaaattaatttgatttcatttttttatatttatttcttaattcataaatttttcatataaaatataatttaaattaaaaattaaaaataaaatttatttattaaaaagttaattttatattttttttatatgtaaaattaaattcttattttttaaattttattatttatagattcattatttgaattttttaaataaaaaatgtaaaaaaaggtttttaatttaattttattacaaaaaataaataaaataaaatttaattattgaaaataacatatgttgaccttaattttattatacatataatgtaaaattttttgtacttccttcaattaaataatttaaacaattatttatttatttttccatttaattcaattaaatttttaaaattaacaaattttagtcataattgttaattatatttttattccctccaaaatg

SEQ ID NO: 113407 - DNA, 1003 bp, Heterodera glycines
  Promoter: Source sequence=SeqID_12071; Location=14..1016; Strand=+; Gene=SeqID_75617
caaccgatgaaaaaggaataatcaaaaggaacttttgggacgattttcacaacaacagattaataaaaaagtcaccagaaaaatttacaatactggtgcaaaataatgttgaaaagcgaattttaaaaacgttttaaaattatgcgaaaatgaataaaaaaatggaaaaaaatggcggaaaactcttcaagcgcaatcaaatttaattcagcgaactggcggtcaatttcccaataaatttcattatatgtcaaattttcatagccaataattatttaattgcttggcgaatttaaaaaaaatataaataaatgtttttttttttaatttaggtggcatgtcctgatctgcctgattctacggatggaaaggtcaaaaaattaggacaaaaactttactgagataaattttaagttaaagaagcatttttagaattttaatgtaatgcagctgaaattctttgtgtttattcagtctatgtattagtcacaacaaaatgagaattaataaaatacttactaagaagtaaacaatttctctttttttgttttaacaaatttttcattttattcaattgttaaagaaaaaaaggtttttgaaaattcttcgtttagtgtgaaaggtcgatcctttggggtgatgtgagggtcccctacttgaggagagaaaaaatcgagccctaatttgtaagacattaatatttttcgatataaaaaaagaaagaattggatagacattaaaaggatcttagtctagatattatgcaaattaaaaaattaaattctttgtcatacatttttgaaactaacctaagttttcagaaaatagggattgagtaaagccttttcaaaaagccaaaattattgacttatctctgaattatataataaattcccaaaaaaattgaaaaaaaaaaattcacagattgcggaaaatcaacatttaatcactatttaatgcatgtatttaacaggaaacactaactgataaaccaacagaaatg

SEQ ID NO: 113408 - DNA, 543 bp, Heterodera glycines
  misc_feature (76)..(76): n is a, c, g, or t
  Promoter: Source sequence=SeqID_23382; Location=1240..1782; Strand=-; Gene=SeqID_45779
gcgacagattcttctttgtgaattttacattttcatagtttcaacccaactggtcacaaactgtgatttatggctntagtcccttaatggctgcctaatccggtaatccaaaaatgggcatttcgcaacatttcgagttttatttgacccattaaaattaattaagccttttcaaatttccgaatttgacttgtcaaaattgcatttcccttacaaagtccgtgcgtcaacaaatgttgttatttctctgttcatcacggttcaaaatgcattaaaagtccttttcggttttgtgtcctcaaattgtgagggggcgggggattaaaatgaatggatgattaatttgaatcatgggtgagacgcattaagggcaaccaacgaatgaaagaaaggtatttaaaaaagggacggacggaaaagggcggccaaatcaaaacgaaacaaacttcaaattaactttaattcaatccgagggcactttgaactgattggacaaaatgcatttttccaatttagcaaaaatttatttgcatattaaaaatg

SEQ ID NO: 113409 - DNA, 584 bp, Heterodera glycines
  Promoter: Source sequence=SeqID_859; Location=4958..5541; Strand=-; Gene=SeqID_62830
cgttcgatcaatagaattccaattcgaattgaagaatgtgctgagaatgaaaatggatttgccgatgattatgcaaagtagttattttcatccctttaattccgtaatttcccattcttttccgctatctcttcgattccgaccaatccgacagcgacaatgccgaagaggaaaacgaagtgtcggtccaaattcaaagccaacccatcggaggccaccgacgcaaaaagacgaaaagctatcggccgattgaaattgtggacggatttccgttgaagcgaaacatgggggcgcagaagtggcgtcgtgtggaaaacagttagtttgtcttttgttcttttcatttgtatctttgcttttagctaggcttttgacgagttttgccgacactcaggacatttgctttgatggttccgatttaatccccgagacgatttctgcgttctcacgccttttgcgagatgaggcaaaaatgaaggtttttggcttactattgcatttgtcccatttgagtgagtcttgcactttttatttaggtttggaatgacttcctggagaaagacgaatcaggacagaaaaagatg

SEQ ID NO: 113410 - DNA, 147 bp, Heterodera glycines
  Promoter: Source sequence=SeqID_22456; Location=1720..1866; Strand=-; Gene=SeqID_53127
aaatcacaaaccggcgaagtgaataaacaattattttattcaagttgtgaagacacaaaataaaaaaataagcgaagagggacggagggcaaagggcaaatattgattgcacaatataagcacaaataaatggatgacaaatgaatg

SEQ ID NO: 113411 - DNA, 470 bp, Heterodera glycines
  Promoter: Source sequence=SeqID_43093; Location=1..470; Strand=+; Gene=SeqID_70857
aagtaaaaattataaaaaatgaaattgaaatacaaaaaaatgactatgatattctcttggtgatgtgggaattggctgaggaattcggacttggcaagtgaatataatttaaaaataatataacaaataaattggggtaaacccaactcatccatagctcatccatgcataaaaatgccatgaccaaaaccgctcaacgtaaaaattctacgatcaagacctcataaaaaatgccaagacaaaaatgccacgacggcgacccgcgtcgtgttgtggatgagttgggcgtgacacaactaaattaattattttatatatgtattaaaaataaattttaaataatcgacaaaaaaaacatttgcacagattttgcaaatatttgtgaagctggaaaaagttataaaaaagaatataacaatgccaatttaattcagaagggattatataatttaaaaagttattccataatg

SEQ ID NO: 113412 - DNA, 1003 bp, Heterodera glycines
  Promoter: Source sequence=SeqID_17259; Location=188..1190; Strand=+; Gene=SeqID_81726
gttccattcaaaaatttttagccgcgaatttttgtgcaatttttatttcaattttagtccattctttttttgaaaatttcatttccatttgcttaattttttccttaattttgttaaatttttccacaatttcttttcttttgatcaattgcttttaaaaatgatcagaattaagtccattatttgttggcaattgttcaatttgatcactatttgttgaagtttctctttctatttccaaattttcattaaataaatgattaaattgttctcttgtaataattgtataattttttcatcattttttgtctcattttggccatccgtttgtccaattatcccattttgatcagtttcattctttccattttcatccgaattttcttcccatcttttgccaaatatttgatcataactttttttcttcctttattccaccagcataaattttattctatctattatattagattattaaaaaatgtataaaaagtatagtttataaagtaatatattagtaatattaattctataaatcactaagtagaagtgtgaagaaaatcattataaaaaaacaagtagaattttctgaagccaagcaataaataaataacagcataaataagggaataaaaatgaatttgtaaaagtatttgtattagattttaatggttttattcagaaatatgaaaattaatataaaatgaatataatttataattacaaaaaaccttaaaaaataaattgatttccttggattttcatcaaagtatgattacaagaaagccctaagtagaattttgaaacatcattataaaaaaataagtagaatttgcttaaataattagcaaaaatttgagaataaaaccaactagaaaaagaatttttttattaattttattcagaaatatgaaaattaaaatattattttcaatattaattttcataaatgcaatttttaatatttatacgagaaagataaacgaagaaaaaagcgttgatg

SEQ ID NO: 113413 - DNA, 280 bp, Heterodera glycines
  Promoter: Source sequence=SeqID_1982; Location=2470..2749; Strand=-; Gene=SeqID_77201
ccttcaaaaacggaatgtgggtattactgtgtgtcaatgatcagtgatcaggtttgcagaaatgtgggcattgacccgaaaattttggttacggcaagcgatcagtgaaagagattagcactgtgtaaggcagtgagtgatcacttaccttcaaaaaaatctggattacggtaagcggtgtaagtcagtgattgatgactttatctccaaaaaatttggattacggtagatgttttctgatccgtaaaaacgttttatgaattatttttgagtgccaatg

SEQ ID NO: 113414 - DNA, 139 bp, Heterodera glycines
  Promoter: Source sequence=SeqID_30010; Location=1299..1437; Strand=-; Gene=SeqID_60464
ttctttttcataaatttttctttttaacaatttatgcgtaagctaaatacagctaaattaataatatgacaaatctgattaaattattaagcaaaattcagtatttaaataaaattgcattgtttgttcattcacaatg

SEQ ID NO: 113415 - DNA, 1003 bp, Heterodera glycines
  Promoter: Source sequence=SeqID_15567; Location=1758..2760; Strand=+; Gene=SeqID_79851
caatggttgatgaaattgttgagaaattacaaggaactaatagacccgccgcctgcaaaaattctgtattgctattcagagatgaatgagtcggttcttgatctgatgaagcggggaattgagacgcacaacggtttgccggatcaagcgttgatccagagccagccgaaaccactgctcctcgtgcttgatgatttaatgttgaatgtgggagcgattttctggatctactgttcacacgtggttcacataactggaatgtcagcgttatttttgtcacccaaagcctatacgggcgtaacattagaacagcgcgagctaacagccattatttggtgctgacaaggaacccgtctggtcaactccaggtcagaacggttgggtcacaacttttcccaaaacgactcaattactttatggaggcgtacaatgaagcgactagtcaaccgttcagttacttggttataaacatgcacccaaatgctccggaaaatgagcggttgacaagcaaaatattccctggggagagccgtgaggtatatttacctgtagaataagcgtaatgaacgaaacaagtgcgcttaaaaactatttaaggaagggaaatttttttggttcgcaaaatgtacgagttcagtccgtccatacattcgcgcaaattctgatttcttcaaaaaattagcctcaacaaaatcggataaaaggaaaaacgatttgctgaaaggcgcatccgtagaacaaattctcggattggttgagatttgtgcaaatattttaaaatttaactttcgcctcaaccggcgacagaggagacgattggccgtgtacgcagactattaccgagcaattgcacgttcacgtagtgagcgcacagccaggcagaggctacaacagggcagcggaatagctttaggagctattttggcgccaattttgagcgttttggctgaacagctggtccagaaaattgttgcaactccatcggcacaacaacaacaaaatg

SEQ ID NO: 113416 - DNA, 932 bp, Heterodera glycines
  Promoter: Source sequence=SeqID_21501; Location=1463..2394; Strand=-; Gene=SeqID_52113
ctcttaatcatgccgtgcacattattcgatagaaactccgcgctcttttgaccgccatttccaccgactcaatacagggggcaccgatgtattgccgaacgaccccacttccctggggtatattagcgttgccgccaagaagctctcgcagaaaataagcagggcccaagccctcctaaaagactggacggttaataaggaaatcaggtagcaggaaaatgctttatatccgggccatgaatggaaatgaggggaatttgtcctctttttgggcggctttttcgcacataatccatgataatatttcgcttaatggtctctccggggtagcgccctggtcttagtcgattggttctccctaattgatcataattactcaattgttatagactctgaaagggtcgtgctaagcaagcggaccgactccgcagcggttccaatttattgccgagaacgaccctacttccctggggtctattagccttgccgccgaaaagctctcgcataaaaaaagcaaagcctaagccctcctaaaagactggacggttatcctttcctccccgagtaagaaatcagggagcaggaatgctgacaaagttagaaaaaaattgacgggatccgggccatgacaccaagagccccaccctgcaaatctccgggcaattcttttcttttttgatttttccgtatgatttgccccgccagcggatgagaagcaaaaacattgtcattacataacaaattaatcactcgccactcattcataataaatgaaaagcaacggactgaaaaaagccaatgttagcatattattcagcattatcgatttgtttattaacgtcaataaaatgagaaaaaattgagcaatattaatataaaaaaacaatattatagaatatttcaaacaaatatttccattttatgtaaaaatg

SEQ ID NO: 113417 - DNA, 273 bp, Heterodera glycines
  Promoter: Source sequence=SeqID_19748; Location=1..273; Strand=+; Gene=SeqID_84491
atatttagcctcgtttaaaatgactggtggggagaaatgcgagcaatttcatagaaacctcagaaaatttcgaggcaaaaaaaaccttgtgataaatcaaaatctgttattttgattttcaagctttacgctatgcctcaaaatgcccacttttaaaagtttcaccgaccttttctggttacagacttgacgctctcttatcagactttcttttcttttagaaatgaccccggcaagttcattagtgttgtgctttctgccctctcggcaatg

SEQ ID NO: 113418 - DNA, 293 bp, Heterodera glycines
  Promoter: Source sequence=SeqID_10241; Location=3649..3941; Strand=-; Gene=SeqID_73389
tcgccggccgaccatggacacgagaagaccgagagcttgttgccgaacgcctcgatctcggggttcaacgggtcagacgacagacgcggcagcacggtcggcgagctcagcgagcggcaaccccactcatcgccattttaaaaatgcgctaaaaatgatcaaacccgtttttagctgaatattctgtcaatatttccctattagaaagtgatcctgtgcattctttcgcctctcctttgtaagtatgtttttgtcagcctactaaaagtgcggcggccgacatcattccgatg

SEQ ID NO: 113419 - DNA, 343 bp, Heterodera glycines
  misc_feature (50)..(51): n is a, c, g, or t
  misc_feature (63)..(63): n is a, c, g, or t
  misc_feature (65)..(65): n is a, c, g, or t
  misc_feature (121)..(121): n is a, c, g, or t
  misc_feature (158)..(158): n is a, c, g, or t
  Promoter: Source sequence=SeqID_27833; Location=1264..1606; Strand=-; Gene=SeqID_58512
agggtcggattttgggcccatttttcacgcaatgccctttttcgggcganncagagccaacangnaccgaagcaaaccttttaagcggagaagagcaggggccgcggacgagccggcgcancagccgcaagcgacgccgagaagagaaacgccaaagngacaggagggaagcgccgcccaggaaaaagcggaggaggaggcggaggagaacgcagccgaggggggaggaaaagggcaaaccgaaacggaagaaaggaagcagcaaaaagaaaccgcccatcggcaagaggaagtcattggacaaaacgaggagaacggaagcagagagaaaggccataaaatg

SEQ ID NO: 113420 - DNA, 982 bp, Heterodera glycines
  Promoter: Source sequence=SeqID_7811; Location=1..982; Strand=+; Gene= SeqID_66048
tgagaaatggaaaagaaaattgaagagagagaaataacacatggaaagacagagcagagggaaggagagagtgtgcgtatttctcggcccttctctccctttttccaacccatcataaatattcgattcattgcctgttccttcactctttcccacgtttccttagccttgcgctcggtcaatacagcgagcaatgaggcctaaccgagctgctgttattgctgattgaaaacttttaccaattacccgccttggcctgcgaaagcggtgccatgtgcaatttttggacgccctccggggcttaaaaacgaagcatttggtttttgcctctttccccgctcatttgaatcgcattagagaaacctcttaaaggaatagcccgtagctcagtcagttaggaaaatttttaggccgctgatcgtgattttaaggacagaatcactgatactgaccgtaactcttaaaaaatttaaattctttttatttctattactaagtatatattatttgattatttattctttattttttattaaattataaattgttcatttgaaaataatcagttaataataattctaaaaaactaatgaatgtgttgaagcgttgccaaaaataaataaaaatgcgatcaatcggtaagacagataatttaattaactcaacttaacaaactacgaattttatttgattttttttttaattttttatttttgatgatgcatttccataaaaattcattgacatcagaagtgatttttattaatgaatgtagctaattaaattattaagaattttattttttatgagatttaaatcctaaaaaaatttcatatttttctcaggcactacattatttatttattaattgtcccccaattataagtaaatacaataaaaaaatgtatgttgccactttcaggcaaaagatcaatataaatggaaaagtcattaaggagttagagttgataaagtaaaaatg

SEQ ID NO: 113421 - DNA, 96 bp, Heterodera glycines
  Promoter: Source sequence=SeqID_18620; Location=1..96; Strand=+; Gene= SeqID_83273
atgcacgaggggcgcgaaaaagtcaaaagtgagattgaacaaacagcggaactatgagggaaaattgtgccgaccgatcagcaacagattgtcatg

SEQ ID NO: 113422 - DNA, 1003 bp, Heterodera glycines
  Promoter: Source sequence=SeqID_3692; Location=378..1380; Strand=+; Gene=SeqID_51468
gcgagtgccaaaaagagtgaatgccaaaacctggactgggaagtttcgtaaaaaaagccttcttggcggctatcgttttataaacgccgcctaggctggcttttgttacgaaacaaaaaagcacaaaaaaaatctttctttttttaaatttaaatgaatgagtggcactcatcaaattaactttttaacctttatgaatgataagagtgataaaaaatgtttaaaaatgtttaaaaaaatcctataaaatgtgagagagaactgcaactgcagcacaagtgctgccacattcacagcgcggcggcggcatcgtctgtacctttgcccaatgttcggttgctgacccatgcaatgtgggcagctgcaacaacggcaagttttttaagaggaaattctgattttatactgagaataaattttctggagtcgagactgagaaaaattaaagtaggggttgttgctccctgaccctcgggcagagaaaagtcacgaatcggcggggaggaaattccccgacaaaagtttgtcggggatgggtggagaaatgaaaattttaaaaaaatgttagggcgagcgacaccttcgttggggaggaaattttcatgaaaagttgagaaaaatattaccaggaatttttctaaaagaaaaatgaagaaacttatttaaaacatgtcagacaaattaaaatttcttagaaaataaaaatttaagttttaagcgtgaatgatataaggaacaaacttagaaaatccaacatacagtatgttcgtttttacaggttttggaaatatttcgtaattaattaatgggaaaaagtcatgaattaaaaatattttgaatattttataatgaaatttataggatgaatattccaaaataatcgaatcctcttcctattagtgtccctgcaaaaatttggttcgtttttgacaaattttagaaaaagtatgggggatatggggaattaaaattttcaaaaaacaaattaattgatggaaaaatg

SEQ ID NO: 113423 - DNA, 476 bp, Heterodera glycines
  Promoter: Source sequence=SeqID_2907; Location=1..476; Strand=+; Gene= SeqID_82286
atgatgagggtgatgacgctgattgcggcgccggtgcctgcctttttcggtgcagttgcgcaacagtttgtcacagcgggcgctttgttgcctttgtcctcccctgaggggtcggtgagaccgtggccaatcgctgccctcctccccccataaagcgttccagctttttctgtatgctttagcttcccgttttggccaaaggggaggaccgccccccgccccgttgtgcagcgtttttggccaagggcccaccccccgtgcccccggggggtgaaaaatttgatggtataataaaagggggcccccgttccacccctcagggaagtgtcagtcggccacaatttttgagccttcaaacaatgttttgtaaacggactgacaacactctttgcccccctccccttgtcattggcgtttttggataaaaaatttaaaattaattattttaggaatttaaatttattttttaagttatg

SEQ ID NO: 113424 - DNA, 68 bp, Heterodera glycines
  Promoter: Source sequence=SeqID_31422; Location=1..68; Strand=+; Gene= SeqID_61775
gcccgagtgagtgggggcaaacaaataaagtgaaaatggaattttttaatttgaattgctaaataatg

SEQ ID NO: 113425 - DNA, 231 bp, Heterodera glycines
  Promoter: Source sequence=SeqID_2659; Location=686..916; Strand=+; Gene=SeqID_80926
aatggtgcgaccaaagaatggatatggattccattacaagtcaatggccaccagatcaaacttgcagccgattcgtgttcacatttgtcgatcatacagcttccggtttggcaaagtttaggcgaaccgaggttggaaaaagttggtaaattagtgggttccttttcgggccacaaattgaagttgttgggaagtttcaagtgtgacgttctgttcagaggagtcacaatg

SEQ ID NO: 113426 - DNA, 148 bp, Heterodera glycines
  Promoter: Source sequence=SeqID_37538; Location=1134..1281; Strand=-; Gene=SeqID_46520
tgtaagtgccataattatttaaattgacgtaattttcaattgtaattgaactctttgataagatttcaaaccgatgtccgagcaacaagtgatccaacaagtgctgcaaaacaaaaagcatgagaaccaaagcgttgccgaaacaatg

SEQ ID NO: 113427 - DNA, 92 bp, Heterodera glycines
  Promoter: Source sequence=SeqID_22574; Location=949..1040; Strand=+; Gene=SeqID_53241
attgatttgttaattattgaataattaatgatgaatgtattaattgtttttcattaattaatcccccttttttaaatacagtgtcatttatg

SEQ ID NO: 113428 - DNA, 747 bp, Heterodera glycines
  Promoter: Source sequence=SeqID_12128; Location=1157..1903; Strand=+; Gene=SeqID_75703
aaacggatgatgagtgatcagagattttggctactggacgaaaggggggataattgaactcattggtgctgggggtgatggatgcgatataaaaaaaaataaaattgagataattgttcaatgtttgttcatcccatgattggtcacacggggctcatttctgagcgcccatctcgccaaaaaccgctttgtctttacaattttaaaatgggtgtggcacctggcccgacttttttgcgtataaatacgggctcaccggatggcaatgttcatttggcatcccattttcaaattcgctattcccatggcaatcaacatctccgacaaaaaatcgttgtgcaaccaaatcctcggccaaacggacctcaccgtgacctcgagtttataaccatcagcggtccacgcctctcgacaccccgcttcattccttttgatgaagcgggccgttgtaggtgttgtaagggaacggagtccgaaattgacactgtgatcacgaaagaaggcatcacgctttggtgcacccgcatagagaaggcccaattcatcccgttcgatgttgtgtatgatttgccgggtcattgttttttccgtctgaaaaataagtctcgtgtgttcaatataccctatggcgacataccctcttctgacacgcacaccactaaacgacggacacacaccaatgaccatcaacacgagctgaagcgcaaagcaaaggtagctcttgacttagtggaggccggactaatg

SEQ ID NO: 113429 - DNA, 230 bp, Heterodera glycines
  misc_feature (14)..(14): n is a, c, g, or t
  Promoter: Source sequence=SeqID_8211; Location=1..230; Strand=+; Gene= SeqID_67323
tcgtttcgatctanttttgtctaacactggggtttgacccatagtgtaaccggtccgcccaaagtcccctaccccccttattccgctattctcaccttttcagtcgctccttcaataaagctaattacctaattaagctttttctttttgctttagttctgtacacaattcaattccgaaagttctttaaccatttttgcacctcaattctgcgaaaacactttttgatg

SEQ ID NO: 113430 - DNA, 652 bp, Heterodera glycines
  Promoter: Source sequence=SeqID_786; Location=2027..2678; Strand=-; Gene=SeqID_61219
caaacaaccagtttttacacatttttggccataacttttttgaaacttatctaaatttttttaaatttgtaaaaataggaatttgagttggattaacaataaataaaatttgaacaattccgtcgttttgcgatcaaaaatgttaaaattttgaccaaaattcaaaaaatatatacaaaaaaatttaggaaacctaatttctgcatcggttgccttggccttacccattcacactgaaatattgttttttcactctaattcactttacctattatctctaattagcccccctcccctatctaaggaggttgaacaataatcatccggggggataattagagatatacggacggtatcagctcaatcaattttgaattaggatacggagaatccaggaaaaaatatatgcatttacaaaaataaggaagccgtgtaaattatgtatgtattgaacaaaatcagcaaaacacccttccccattactctctctttatatacgcataaattaatgcgttatggccattatttttggccaacaaatcattttaatctccccccatccgttcatccgttttcaaatctctcacttttattttggtagatatataaagaggccgaaaagacatttttgatgcataatagagaaaaaatg

SEQ ID NO: 113431 - DNA, 576 bp, Heterodera glycines
  Promoter: Source sequence=SeqID_20586; Location=1..576; Strand=+; Gene=SeqID_51139
taaaatgaagaaaaagaaaatttacgatttttaaaagaagatttactggttttttcgttatttaaaattttcaaaatttttacaaaaatattactatttttttttataattttacttttcataaaaagattattgactttctttttgggtttctcttagtgcagagaggggccattttagtgacgagcttttacgagctttttcataaatgtggacatatcacatgaaaaagcgcgaggcaaagagaataatcatcattgtgaattaaacataggaaataatttcatttgtaaaaaaagaaaaaaccatttgctatgctttaataaaataaataatttttattttatgtaaaatatttttaaatacataaaaattattacttatgcggtaatatttttaattaaattatttgtttttttaaaatgaacagggcccggttaaagaaaataattagctctgttattttttttttataaattctgatgtttttttaatttatgtcatggcatattttagcttttcaaatttagaaaaatcagtcaaaaattttgacaaaatctggcatccagaaaaatg

SEQ ID NO: 113432 - DNA, 55 bp, Heterodera glycines
  Promoter: Source sequence=SeqID_27181; Location=154..208; Strand=+; Gene=SeqID_57872
agtatgttctttgtgtttttttatttctttttttctgtttaggcctttgaaaatg

SEQ ID NO: 113433 - DNA, 161 bp, Heterodera glycines
  Promoter: Source sequence=SeqID_6207; Location=705..865; Strand=+; Gene=SeqID_60713
agtgggggcaaattactcatcatattttaatactcaaacccggtgtttttatccccgaaattaatttatttaaacgccattttcgctctcgaggaaaggatattattttctacagccaaatttctgtttgtgaattccgccgcctctttgtccaggagatg

SEQ ID NO: 113434 - DNA, 82 bp, Heterodera glycines
  Promoter: Source sequence=SeqID_15671; Location=1544..1625; Strand=-; Gene=SeqID_79977
atttggcttttcactgccgtcgacatctgtcacaccaatcggcgatttggtgcctttttcgacaacaccaactgcgccaatg

SEQ ID NO: 113435 - DNA, 194 bp, Heterodera glycines
  Promoter: Source sequence=SeqID_3808; Location=838..1031; Strand=-; Gene=SeqID_45641
tgtgaattcaattcatacaatgtgaataaaataaaataaaatttaaatatgaatttttttcaacacgattttattatcatataatgatctttattttttaattttgcaattttaatcacaaaattacttccaccaaagaaggttttgtctgttccaaaagccaaaaaatcaaaaaagcattcgttgacaaaatg

SEQ ID NO: 113436 - DNA, 91 bp, Heterodera glycines; identical to SEQ ID NO: 98538
  Promoter: Source sequence=SeqID_39263; Location=1000..1090; Strand=+; Gene=SeqID_67871

SEQ ID NO: 113437 - DNA, 402 bp, Heterodera glycines
  Promoter: Source sequence=SeqID_28972; Location=1..402; Strand=+; Gene=SeqID_59545
atgctttgcttttttgctccttaatttatgctttctttttgttagttattaatttattgctgtgagctttcttatttggtttgtctacggaagggccgaaacacttagtttttttaatttgtaatacggaagggatcgtactgactaggcccacccttccagttaatttttttggcaattgtcgtccgcaattgtacggtccgcaattgtcgtaacacctataaaattcgaatgtcatcattaaccactttttaatcaacaaaggacgaattcgcgtcatttcgacgtaagatattttgtttaaataaaaaatataaaaaacaatcaaaatattttaattacaatttatttatttttcatttttttagcaattttccaaatctgagcacattggaagaaatg

SEQ ID NO: 113438 - DNA, 934 bp, Heterodera glycines
  Promoter: Source sequence=SeqID_7765; Location=1323..2256; Strand=-; Gene=SeqID_65874
attttatgtgaaaattacggatcattaaagtcgaatttatgttataattttccaaaatctgtaaatgtggaaaaatagaggcgaagaaaaaaggggtgcactattttctaggcaattgtcttaaataaccaaattataaagaaaagtctgattcttaattgttaacaaataaatatacggtagccctttaaataaaaattgaaaaaattgttttataaaaaaatcttgcaggaactcgtctcgaaaaataatccaaagtaccagttgtgggtctaaattacggaaaaatcgcaaaaatccgtaacccgtaagccgtaattacggggtccaaaaaggccgtaatttccgcacgctcagccctggcctatgggctcattttcaattttttttcactttataacgaatttactctatttatcaatgactggtttttatttcttttaacatatatatttttttactctataatttatatataaaattgtatttttcataattaatttgtttaagatccaattcaaatttatgtattttcactttggatttgaacccggacccccaaaaatacaaatgaaccaacttaccaacaaattttgctctatctctttcgcttctctgcagtcgggaaaggccctcaagcacttaaacctatactttttgaggctctgtaacttttgaagcaggcaaaatttaccgctaaaattaaaagttcacgatagaaaatgactatgttctatccaatgtttatcgtttatatgtattttccagactgatagcttgggatgttcctttattagttaaaaaaattcagaattaaaaaagagcgtaaaaactatgcaaaaatgtaaccatatagcgtaaatttatttagaaaatttcattttgacagatcaccttaaaaaaacaccccaattggcgcaaagcaaagcgcatg

SEQ ID NO: 113439 - DNA, 243 bp, Heterodera glycines
  misc_feature (30)..(30): n is a, c, g, or t
  Promoter: Source sequence=SeqID_32323; Location=724..966; Strand=-; Gene=SeqID_62636
gctgaaaaaatcgtcaggcattgaaaaggngaagaagtaaaaaaagattagcagacgatggaccaaagcagacgattgacgccttatttttctctgttttattctccctttgataaacaatgattagctaatttcgttagcaatttcccttcgtttctccctgttctcttattgtctgtttgttttttattttgtttttctatgttttgttcattacaagtgttgtactttcttcgctcgatg

SEQ ID NO: 113440 - DNA, 200 bp, Heterodera glycines
  Promoter: Source sequence=SeqID_28148; Location=743..942; Strand=-; Gene=SeqID_58795
tttaaaaacaataatgcaatttgaaaactgaaaatataacgataaagaaagcatataaatttgaagtttgtttattttctatgaaaaagcaaaaaaggaaattttttttttctatcattagaaattgaacacatgaccatgatcacaacaacagtcttaatttttaaaattacatttttagagtaatttttttatctatg

SEQ ID NO: 113441 - DNA, 276 bp, Heterodera glycines
  Promoter: Source sequence=SeqID_6471; Location=220..495; Strand=+; Gene=SeqID_61711
ttggttggtgccgaaatcaaacaaaatttgccacttcaatttcaggttttgtctcaatttgaaaatggcaattatttcgcagagatgaaaatactgttccagtcgggttctcgcttttgttcgggctttgccatcaaaagctcggcacactttcgcaattatccgtcgaatttattcaaccaaataattgaggtcgctttatgtgttaatacgtcattaattagcacagcatttaatatttagcatgctctgaccactcgccaagttcaaaaaatg

SEQ ID NO: 113442 - DNA, 110 bp, Heterodera glycines; identical to SEQ ID NO: 98226
  Promoter: Source sequence=SeqID_5871; Location=444..553; Strand=-; Gene=SeqID_59502

SEQ ID NO: 113443 - DNA, 1003 bp, Heterodera glycines
  Promoter: Source sequence=SeqID_3640; Location=519..1521; Strand=+; Gene=SeqID_51230
atagggatgggaattttacgtaagaaaaatcgcaaaatatgtaaataaaatatgtgtaaaaaatactaaaatatgtatgaaatatgtacaaaaactcccaaaaatgtactaaaatatgtaaataaattttttaaaaaagttattttttcgaaaaaaaaatcttcgtataggcttagaatcaccttttaatattttaaaattaatttttgatatctcatttttgaaaaaacaacgatttttagagatacattaaaaaaaaattgtttttaaatttttcacaagaaattttataaattttcaaaaattcttcctactttttagagcatggagaatccaggaaaaaatatgcctttgcataaaattcccacccctagtcattacaattaaaaaagaaagctaaataaacacaaccgcttgacaatgcatttggccatgagatgaccaaagtcaaaaagctcgatctttaaaaaaaattaacaaatatgtgaatattataaatttttgtaccaagttcacaatttgtgccatttggaagtgccaaatttatcacaaaatttttgattaaaaagtccagcaactccctcacactagtgaaaaccttaaaaatcattatcacaattgaaaaccacgagaatatgttaagaccagggctgccagattaaaattttcaaaagcctcatttggcatgcaaaaaaacctcattttgggtcaaaaagcctcatttttacgaaatttaagcattttgtgaaaagctgagcacgaaaaatcgaagttgattttttgcggcgctttttccaaagaacttttggggaataggggggccggcggcgtcgataggcgccgtcgggggaaaattaagaatttttaccatatttttaacatattttcattgattggaattcaaaatttttatgggacgggatcccgcatatataaatcccgcaatttccaaaatgtgggattgcggattgggatcccgcaaaatcccacaatttccaaaatg

SEQ ID NO: 113444 - DNA, 1003 bp, Heterodera glycines
  Promoter: Source sequence=SeqID_22929; Location=580..1582; Strand=-; Gene=SeqID_53629
taattaattgatcattagtggtcggatgtcatcactatgaaaattcattaattaacatattgttagagaatgtatagcaccgccgccacgcaattagtgagtgcctgattagctaattgatcattagtgattgaatgccacttcattgttaattagtaatattatgccatttaattgatcattagtaattaaatgccactgaatggatcattaatgatggatgttaccgtcatgcaattagtgcgtggcgagcttattaattattagtggacggatgccactgctacacaattaattgattgacaaatcattagaaattgtataagatcgctgtcacgtatgagtggcacactactcccccccctctcagtgtgccatttacacaaaaattagtgccattatccgatcattttcttccccaaacagttccgcctcctatttggtgatcgcgccaaaaattgtgcggcccgggctgccctatgccgtgtcagtgaacattctgcgcagtgcggagcccgaccacattgtccgggtggagatcagggacagcaaaaatgagacgatggccgcgcgggtggtcagcaattttcggaccggtgagaattttttttttttaaatttcgaattttcaaataaattttcaaccaaaaacctaacccaataggtgataaagccttcaatttgaaaaattcgaaattttagaattttcataacggttttagaaatcggaatttaaaaacaaaaattcaactatgaatcatagaaaattaataagaaatttttttttaaaattttgaccaatttttcaaattttatgataaattgctaagttctttcaaagattttccaaaaattgctgaaaaactaaaaaaaaaatttcttgcaattttcttatagtgtataaaaaatttctaggtttttttcaatttctaaaatgaaaagcagggtgggggaaattttgttaaaatttaaaaattccaatcctttcatatgcgcaggaatg

SEQ ID NO: 113445 - DNA, 555 bp, Heterodera glycines
  Promoter: Source sequence=SeqID_31737; Location=1..555; Strand=+; Gene=SeqID_62044
aaagtttattagttcatttcctctctcaataaaatcttaaaaataaaacaatatattttaaatgtttaaaaatatctttttggctttgtccttcgcaattatttttatttaaacatataaacaatatagtacaaaagaagtataaaattactaaaaaaattaacaaaatccaatgagacaattcagggaaaaccctatagagtttgtctttttcaaataaaaaaagacaaaaattaaaattactttttacgaaaatctgaaaaaaaaacaattttttcaaattgtagtttatatataataaattttatttttgaagcatatatttaaccgatacatttaattgattaacgtcatcattaaatttatagaatcgccttcattaataaaaaaatgaatttatattattatatttattatttctttaactgtttttgtttcttttaatgaattatattcaaattataacttttagaatgtttcaaaaacgtttggattattttttgattttttacacatttattttactgctgataatttcagtgcaagaagaaaatg

SEQ ID NO: 113446 - DNA, 389 bp, Heterodera glycines
  Promoter: Source sequence=SeqID_21965; Location=1..389; Strand=+; Gene=SeqID_52595
ttgttcttcctcatcaactttgacctccgcatatatttgttatttcttcactgcataaaataaattggctgttggtcggacacaacagttcactggcgcagtcagcagtgcaaaacaaagcgacgaggcacaatcggagttaaataaaatacgcaaagtaaagcgttcaactgccgatttcaaaaacgcaaagtaaagcgtacttcttctgccgacttcatccaacgaaaagctcaaaaagctaatttaaaaacgtgaaagtaaacacgaattcgttttgtcagctcagtaaagtaattctgtctacaaagctgaagtttcacaaaagggtaaagtaattcccacgtcaaatcatcagcgtcaaaattcgtcaacattcacaaaggatg

SEQ ID NO: 113447 - DNA, 958 bp, Heterodera glycines
  Promoter: Source sequence=SeqID_29692; Location=116..1073; Strand=-; Gene=SeqID_60165
attttgaatttttttcaactatccttccacctaacatatttttattcagttattttaatttcttttataatgctatttgatagagaattgtttgctgatcattttaaaaaatgtttaatgactctatcattatctttgaattttttatgatttttgaaaaattttgatatttttaccgatttttcgaaactttgatcacttttttctgatcagttttggggtcaggaccaaaaaagttgaaaattggctatagcaaatcgactatgctctacacgataaaagtggttttaacgtgatttcggaatgttcccttgtcagcatgttttaggctataacttttttctttgtcatccaaatgcgacaatccttgtatcattcgaaagctcttcacattctatatagcctcacaaaaaaaaactaagattttctagcatataaaaaagttattaagaaaaaaaaaatttaattttacttttgcaatcttcatgttataaatacaacttttttctttttcaaccaaatataacaatcttggtatcattcgaaagcttaatgtgtttagaagctttttctaagctattgcttggcaattagacaaatttcaaaaaatttataacatgcaattttaaaaaatcaatattttgaagtttttcttcataaattttttcaaatcttaaaatttttttgctttttctaaggctaatagagtatgtgaagagcttgataccaacaatgttgcatttagttgacaaagaaaaacgttagatcaaaaactgggctggggccgaaccgtgcggggccgaactgagccggtccgtgtgaacacattaaaattgctcaaatgttcgtgtcgaaaattgtcacttttacgcttttgcattgatgatttttcagattcgccgactcatgttgaatttgaacgaattggacggtggtgacctaacattggacctggatg

SEQ ID NO: 113448 - DNA, 177 bp, Heterodera glycines
  Promoter: Source sequence=SeqID_10780; Location=2636..2812; Strand=-; Gene=SeqID_74036
ggtgatttgttttttaaaatttggcatattttccattattttgtcttgtgtaataactcaaggcgttaagacataagcagtgacgactcgtccgatttgctaagttccgactcgactttatcagcggatttgtcatccgacgaactgtctaatccgtccactgttcgatctgtgatg

SEQ ID NO: 113449 - DNA, 411 bp, Heterodera glycines
  Promoter: Source sequence=SeqID_15636; Location=1..411; Strand=+; Gene=SeqID_47305
ccatttattaaaaattgctttatgccaaagccatttattaattgaaaccaaataaaaattaaacccaaaaacatttcccattttcaaaaccattttttaacaccaaaaacaataaaaacaaaacataacgccacacaaattcaaacagtggcagaaacatacatacagacactcaactttattatataggatattttaaatatattaacattttgttttacgccaagctttttttttaacctttttaccgtcaatgaaggaaactcaacattttttaaattacctactcggtttttttcgtttcttccatgatcaattttgtcaattgatgatgtatgaaaattcctttagatagtaaagttttcgttattgactctgaacattattgtttgtcatcgaaaaagacaaatg

SEQ ID NO: 113450 - DNA, 353 bp, Heterodera glycines
  Promoter: Source sequence=SeqID_8350; Location=3633..3985; Strand=-; Gene=SeqID_67769
ataactaatcattaaaagcaaattttaaaaattctataaaatttttcttatattgaaaaggcaaaatttttcataaaaattcgttaaatgaaaactaaaaaaataatataaatgattcgtaaagtaaaaccttaaaataaatatgtttttcccatttcctttgtgaaatattttggcttttcaattcacctttttttgtaatcatttaaaaggagcaaaagaattcttttatactattttcctataaatatcagcttcttttttacaaaaattctatatcataattcttatgaaaataatttttatttttttttgtttattaattttttgtagaaaaaatcttacaaaaaatg

SEQ ID NO: 113451 - DNA, 1003 bp, Heterodera glycines
  misc_feature (438)..(438): n is a, c, g, or t
  misc_feature (450)..(450): n is a, c, g, or t
  misc_feature (481)..(481): n is a, c, g, or t
  misc_feature (515)..(515): n is a, c, g, or t
  Promoter: Source sequence=SeqID_17395; Location=343..1345; Strand=+; Gene=SeqID_81873
ccaaattctaagtcggtggtgccgttattcacatcactcggcgccctcgcctgcgccttttgctgacagtactcaagcccaagggagccacctctccctttgccggccactgccagcttcactcgttcggcgcctctgcctgtgccgacgatcgcagcactcaagcccaagggagtcacccctccctctgccggccgctgcctttccttagggagtccaatttctcccgcgcaaatctttgtttgcctccccgacccctccgcctcactccccttgggaaagggacccggacggcatcgcgaatcggaacggcaatttgaggagtgaggcggtgccagtggaacgggagaaactcccgaccgaacagaggaaaggagttttcgccacactttgtatgtaatggaattttgaatggacattttcccattatagatacangttgatgagggntccgcttgtaatcgaatggatttgtgctgangtcgccaacaaaaataaaattataaaacattatntctatgctttatcctattctatcatttttgttttatcatcacaaatacgtacaattattaattatgcaataaataattaattatgtattcattcaccttttacgccaaattgtccgatgaaaaagtggtggaaatttgtcgacgaattaatttgtgatgattttgtcaaaatgtaaaaaagtaaataaattaataaattacttttgtcatttatcggtgtccacaatctctgctatggtcgtttgtccgctttttcttctgttggtggcttttcccccatttttttacacgtcgacacaaaaaattcagtgattggtccaacggattcaccccacatcaacaaattccatcccaccactttcattcatttcattttatttaatcatttgggaaataatatttattcataaaataaatcaaataattttttaattttcattaattaaatagtattaatattcattaattaattaatcaattagacaatg

SEQ ID NO: 113452 - DNA, 262 bp, Heterodera glycines
  Promoter: Source sequence=SeqID_4443; Location=1347..1608; Strand=+; Gene=SeqID_54472
actgtgaaatgaattataaccaaaaaaccgtaccgtggcccgttgaccctcaccgagaaatactgtgcccgcctcctcccctccccagtaaaccgacctcgtagaacagtgggtacattctgttgcataggtggaaacggaacttcgggaacgcattcaaacaaccgaacaacgcattgaaggagtgaaggaacggctccaaaacatcgagtcggacgaacaggagttgggccgaaagattgaacggcgtcggcgcgaaatg

SEQ ID NO: 113453 - DNA, 718 bp, Heterodera glycines
  Promoter: Source sequence=SeqID_2143; Location=1..718; Strand=+; Gene= SeqID_78046
aacgtttttgctgagacttcttggtggttcgccaagagtttgccaaatgaaaagttcgaactttggaggcgaacagtgagcacataaatgatcctgtaacgagaaatacccgaattaaatggataatatttttaaattttactcaattctcaatcatttggctcaaattactaaaaaggcactgccagatccgaatttcttatatttttgccaaaatttggaacaaaatgcctaaatttggcgaaaatggctaaaatttccctttttgaaaatatgaaatttaatccaaaattgtaaattaatttattaaatattttaagattttttttcgaataaggacaattttgaaaataaattattaaaaaaataataataaattaattggaaaattgttccatttcttaggggtgtatttcatttttgttaaagaattttccgaaaattctgaaacaggcattaaaaatggcgaaataggcacaaaaataggcattataattccccgtagacagcccaaatagctaaaaacgcgcttttcgtgctcaattgtgcgtattaaatttaggaatttatcaaaaaaatgacgctctacaataattggccaaaaacgaaataattggccaaaaatgagccttctttttaccttttttgttaatcaaatttcatgtggcaattagagcggagagctcatttatcagcgatcagccaagggatatgaatg

SEQ ID NO: 113454 - DNA, 240 bp, Heterodera glycines
  Promoter: Source sequence=SeqID_1840; Location=667..906; Strand=+; Gene=SeqID_76285
tatttcgcgattttatatccatataattacactccctactcatgacattattgtcattcatttagccaactgtttgtttcctcattttccaatttgatttttaattggttttttcattttttcggttatttccatttgcataaaaaaactgtgctgtctgtgccaatggagtatgcgtattctatgtatgttagcggaccgccattagtggaccgctgttaacggaccaatggcaaaatg

SEQ ID NO: 113455 - DNA, 1003 bp, Heterodera glycines
  Promoter: Source sequence=SeqID_10530; Location=2726..3728; Strand=-; Gene=SeqID_73760
ggacgcgcttgttcattctattcctgatgtcaatttttcatattaattttcaccagtttttgtctaaaaatatatcggaacacttatttatcgttttggaaattttttaaatttaattgaaattttttcaaaatttccaaaaatccgcaatcctgcgcaggatccggcaatagacgccgctgctgtgaatggagggagatgaatcgcgcaattgatatgggtgattaatagggatgcgatttttaggcacaaaaaatcgcgaaataggcacctaaaaaagcattaaaaatcgcaaaataggcattaaataggcacaaaaatcatcaaataggcactaaaataggcaaaaaagtttttttattaacgctttttaggtagcaaaactctaaaaattaatcaaaaaacctattttgcttatatttcaattgttttaaagttgttttcgataaaaataattttttaacccaaaaatttttattatgaaaaaataattgaatttcgaggatcaatttttgtgaaattttttttcaattcttaggggtgtattttctaaaaaattttcaagtcgattcttaggggtgtatttttcattgttgttatggatttttccgaaaattctgaaaaaagcgccaaaaatggcgaaataggcacaaaaataggcaaatagtcattaagcacaaaaagtccaaaataggcattataaaagtcatcgtagacaccctaaacaaagcggaaaacgcgtttttcgtgcttatctatgcgtattaagtgcgcaaaaattttaggcatttgcctaaaaacgaagccctattaataactaatgctatacattttatgcctttgcgtttcggcgccaaaaaaattataaaaatacaaatacttggttaaaatcagcaaatcaaaaaacaaaatattttctaggaatttccaggctctagaaaataactaatttacgcgttacatattttcaaatgtatttagttaatcagtttcatcgaatatg

SEQ ID NO: 113456 - DNA, 97 bp, Heterodera glycines
  Promoter: Source sequence=SeqID_8837; Location=1..97; Strand=+; Gene =SeqID_69369
ttctgacaatggcacgcaattttcgagctcagaattcgccaaatttgttgcggccaacggtatcactcattttttctccgccccaaataatccaatg

SEQ ID NO: 113457 - DNA, 155 bp, Heterodera glycines
  Promoter: Source sequence=SeqID_29287; Location=1..155; Strand=+; Gene=SeqID_59809
tgtgggggagacggcggagacggttcagaaacaacagcagcagcagaagaaaaaagatggaaattctgcgaacaaattgaacaatgtctatttccagaaacaacagcagcagcagaagaaaaaagatggaaattctgcgaacaaattgaacaatg

SEQ ID NO: 113458 - DNA, 290 bp, Heterodera glycines
  Promoter: Source sequence=SeqID_14716; Location=3787..4076; Strand=+; Gene=SeqID_78846
gctgaaagaaccattcagcaatcacaacgagaaattcacggaaatacggtatatcatgcgaaaaaaaatgattggggcgggataatatttacaaaaggtcgagacaattagcaaacacacttatctgtcgataaatcttgaactttttaaaaaagcaacagttaattaaaaaattagtaaaaaatattattgtttattttaaattaatgatttaaatataaatatagtaattaatttattatttatatattaatctcaatttaattaaatatttttctcaaaatcaaatg

SEQ ID NO: 113459 - DNA, 169 bp, Heterodera glycines
  Promoter: Source sequence=SeqID_10057; Location=1348..1516; Strand=+; Gene=SeqID_73123
tgttatttaacatcgaagagaataggtcttttggcatctttttcaatatattttgttctttgaagaagagtgtttgaccagctttacaccgaagcattgatggtccgttcggaagtcgatgagcgaatgtttttggtgcttttcctacagaattttcagttgctttatg

SEQ ID NO: 113460 - DNA, 132 bp, Heterodera glycines
  Promoter: Source sequence=SeqID_38924; Location=1240..1371; Strand=-; Gene=SeqID_67618
gaaaaattaaaattaaggaaaagtcccctttttttaaagaatagccccttttatatggggggaaatcagggtggactttgataaatggggaaagtggccggaaaataaaaaatgaaaataattttaataatg

SEQ ID NO: 113461 - DNA, 1003 bp, Heterodera glycines
  Promoter: Source sequence=SeqID_4574; Location=1198..2200; Strand=+; Gene=SeqID_54940
tcggaactacattttatgcattgggagcagaattccattttcaaaatttgggcgtcggaattaggctcccggacaatccgtcagtaaatttatataaaaaaatgatcccgcttgggggaaaatatacaaggcttttttagactcccgtaattatgaggttacggatttccgtaaccaataaacactccgtaattatgagccacgaagttgcgtaattaaaatccaattacgtccaatcccaatcggaattcgtcaagacttttggggatcacaacacaaacgcattacaaaatgcttgctcacccatgttgcgcaaatgatcacggagaagcccaatgcagtcaaaggtgaacaagcagcagtcacaacggaatgccatcgccacaaaatttttgaatgttttttgagtgatcactgatcagaagacaatgacttaattggcaattaattaatgactcatttttgatcataaatcaattcgcaagaaaatatgccggggagagaaggcattctgagaacaaagaacagacagtttaaatattatttattaaaataaaatacataaaataattagtttaaattaatacaccgaaactcatttaaacaattcggaaattggcagtgccgtcgaattggctagcaaattttgtaggttaccgaaaaagggatctttgatactgtgagctttcattatagagacatcacgttacagtaccccattttgattacaaacgatacagtatcaaatagaacaaatttcttttgagccaacttaggcttaaagtttaaaacttgagcgccaacaatcggtaaaaataaaatttaaaaaaccaacaaattcaacaacagaaaaaacaacattgacaaagcataaaaataggaaaaagggtcatttttggcaagtgtttggtgagatcaccgggcgcagatgtttttcttctcctccgcctccttctccaccagggacaaattgcctaatttcagataagcgacgggacaaatg

SEQ ID NO: 113462 - DNA, 837 bp, Heterodera glycines
  Promoter: Source sequence=SeqID_951; Location=599..1435; Strand=-; Gene=SeqID_64822
ttggtctattaattttaaaatggtggcttctgctcccgtcatgcccttgttttacgcagtccttctgtcattgtttgccattatatccacgtggattataatgataatgattgataaaaattgaagcccaaccaggcaaacgtgtgaatgaatgaatacaatttttgaatgcttataataataatgcattttttctttttcttatgctatttcttaaataaaaatgctctttttcttttccccattatatttcgcttatttaaaatactctttttctttttgtgctatcctttctttttcttcattctttatgattgtttccatgtgatgtttgcactttcatatattagaattagggattctttttttaggcaaatgcctaaaatgcgcacttgatacgctcatataagcacaaaaacgtgttttccgcttggtttggggtgggtgtcacgatgactttttataatgcctaactttgcctattttggactttttgtgcttgatgcctaaatgcctatttttgtgcctatttcgccatttttggcgcctttttcaagattttcggaaaaattcttaacaaaaattcaaaaaaaaacgaaaaatacaccccctaagaatcgacccaaaaaattttcagaaaaatacacccttaagaattgaaaaaatttttttccaaaaattgattacgaaaatataatttttttttcttgataaaaatttttggtttaaaattttttcttatccaaaaacctttaaaataattaataacttcatttataattggaatataacatcagcggcttcgacgtgcggctgatttttgaccagcagagcatg

SEQ ID NO: 113463 - DNA, 76 bp, Heterodera glycines
  Promoter: Source sequence=SeqID_41718; Location=1344..1419; Strand=-; Gene=SeqID_69785
tcttacggcccctcccccccccccttccctctcacattccttctcagatttcaattctttcctttgatgtcagatg

SEQ ID NO: 113464 - DNA, 335 bp, Heterodera glycines
  misc_feature (41)..(41): n is a, c, g, or t
  Promoter: Source sequence=SeqID_35952; Location=1..335; Strand=+; Gene=SeqID_65406
aatggatagtaattaacaagacaaaaggatcaaaagcgaantttacaattcggaccgatgatgactatcacaaatttgaggaatttccgttgccggaccatgcgctgcccaacaaaatccgctttagagaccttcggattgagtaaatttatacttttgttcattcatgcacaaaaggtgtatcaggactcgggaccgaagaattctcatacaaaggcccaacaaattttttccatcgcgactttttttgtgactttccacattgcttttgtgcggggcgctctttcaaaaaaaattttttttttttttgaagaatgggatgggagtagagaatg

SEQ ID NO: 113465 - DNA, 182 bp, Heterodera glycines
  Promoter: Source sequence=SeqID_15038; Location=1..182; Strand=+; Gene=SeqID_47260
acactccctaccacttcaagcttcactccagccaaaactttattgatttgtccaaatgctacttacaaagtgaattccgaattcgcaaagaaaatgagcatggtcagctggttgacctcacagcagacgaagttgctccgatccagatgatcggtcaaactttcatccgaaacatcaaaatg

SEQ ID NO: 113466 - DNA, 588 bp, Heterodera glycines
  Promoter: Source sequence=SeqID_3402; Location=4186..4773; Strand=-; Gene=SeqID_84537
ttaataaatagtgattattatgtatttcacgtggacactttgtgtttcatgataattaagaggtattatagtgatcattgaaaaacttatgggcgtaggaatgggaacgaaaatagtcgttcgacggagcgtaaagatcgttggggcggtggggggggggggggtcgaggacgaaaatagataagcatcatttttaatgatcttttattttttgggagtattcgtatttaagcggcaattattaattagtcaaaccattcactcattctgatgaccggcgctattgcagttttcacgaccataaataaaaggacaacaacacaacttttttctaaacgatttttattacctttttatgatggattttgtgttctttaaaagcatttcgctctccccatttgttttacttttcctgttaaattcccctcccgcctctttctttcttttgatttgtgtacttttgttaacagaccgaccattcattcattcatttttttccttttgtttgctttccccctctttcacctcatttaaatcttttttcagtttcattagattcagtatttgagttgtcttaattttaaaatg

SEQ ID NO: 113467 - DNA, 238 bp, Heterodera glycines
  Promoter: Source sequence=SeqID_39096; Location=1..238; Strand=+; Gene=SeqID_67742
ctgatttggcaatatatttggttttattttcagcataaaaaataataaaaattcgcataaattcaccgatttctaaatgtatgccgacaaccctcggggggtcagcaccaactctgcctgcgggcaaaatacagaatttgattggagcaaccccgcctgcgggcaaaatacagatttaaaggtgaaaagtgaggatcaaaatgtagtgatcaatcgacctgtgtggcgcataaacatg

SEQ ID NO: 113468 - DNA, 1003 bp, Heterodera glycines
  Promoter: Source sequence=SeqID_9510; Location=268..1270; Strand=-; Gene=SeqID_71689
catatcgtccgtctatgtatggaaatatgtcgatcacacatttatccgctgagaataaattaacttattaacatcgaggcttttttggggatttcacaacaatccctgggcccgggattcgttccccaaaatgtcaatttttttgaaaaatttcccgatttttctgtgtattttaggttgtcctatcagcatgaaggaatgatttgatacaattgctgtaaattactaattactttttttgatcagcatcaaaagttagcttaaatgtatcgaaatggaaaattattataaataatgaccttgagtgtattttaaaaaaagtctgcaagagcaaaatttataataaattaattaaaattgaaaatcaattgttttattgaaaatttattgaaaagaaattattttaatgagaattttgaataacaatttttttggcaaaattactgctgagaactggttccaatttccactttttttattattgtattttcatatgccaatcatcatcactcaattcatcttccatcaaatcaccaccgaaacttttgttgtaattctctaatttggagtttggcgtcgtcgctaattcattccacacaaaaattaaccttgatatttgtcctaattttttccctattttcatttgtttttctaatacggaacaattttaaataacaaatatcattaaataattagaatttgcgagaaaaacaaataaatgttaattacccttttttatgattaagcatccaattttgaaatctttaatttaacgcgtctaacaatttattatttaaagaatagtttaatattaaattattttcttctcttttttgatggccatttgatgttgcgccaattttcgcttttgcttttggccacaacattcggctgtttggcccagagggatggcgccaactccgccaactcaagtcggcatcgcatgcttcctgccgacagggcgggcatgttccaatttccgcagtgggaggttcgcgtgatg

SEQ ID NO: 113469 - DNA, 1003 bp, Heterodera glycines
  Promoter: Source sequence=SeqID_7112; Location=900..1902; Strand=+; Gene=SeqID_46368
atggaatttgctaattcgaagagcaaagccaaaacgaaactccgacggcttaacattggactgacgtgacaattggaggcgccaaaagaatgaaaggctctccttaataagacatgtgttgggcttgcttttcctgttctcacgattaatgataatctcgtcagtcggctttttttataaattaatctcgaccgatccaccgcttaaccgattggcgaaaagctgtccgaaatcgcccttctgacaccccgccacacttattacccaaaaaaggactctttcttctccaggggggggggcgggggagagagtttgttggtggatttgggtcggaagcattcaggaagggcaagggtcggttttggactggatctgctgaaggattgacggggaatgagcgtgaccgcctcaggggcgatgttgggaaaataattgcatattttgtggaaagagagagagaaacgacgaaaggggggagggaagagatttatttgtgatgggatggatcaaaaaagaatggaaagcgaagaaaacgaaagtttggggaaacgcacggcgaacgaagcgaaccgaacccatccaatcaccgaccatcgaatcaaagtaattgttcgaataacgaaaaaaaaaaactaaaaaattctaattgggaagggggggaggacattgggacaatgaaattggaaaggagaaaaaaccattttcaaaactttttttgttgctttcgttgtagtcatattggagcattttgcaatttattaggaccattctcggcactgactaaaattctaccatccatgtacggtatttgatattttctgcttttttaaattttcttcatttggctttatgtctcctttcttgggtttttcatttgttttgcgtttcaattttgttccagttgctttcactactacagaattgtctaactatggtctttcatttttaattccaatttctttcctttagttgaatattagcattgtcattaattcttaaaatg

SEQ ID NO: 113470 - DNA, 1003 bp, Heterodera glycines
  misc_feature (892)..(892): n is a, c, g, or t
  Promoter: Source sequence=SeqID_484; Location=1280..2282; Strand=-; Gene=SeqID_54027
tcgtcatccattcacaatgattgtatctgggagtacatgcagtgggaagtcagagtgggtaatgagtcttctacgcaatttagagaaaatgatctctacccccattgagcgcgttatttatggctacggagagttgaacactaatgttttgaatttgcaacgcactggaaaaattggcaaattgccagtaactgtgcacagcggggtcccatctgcggaacaggtacgcgattgcgccaaaaaagaaaaactcttgctaatattggatgatttggtagtggggatgagtcaacagtatttggactcgcttttcacacgcggctcacacaattggggcgtgagcgtaattttggtgacccaacacctgttcaacaaagagttgcgcgtcgctcgcacaaattcacattatttggtattaatgcgaaacccagcgggtgctcttcagatccgtacaatagccacccacctcttcccgtcaatgaccgcccactttatggaagcctaccgggacgcatgcgctaaaaattttggctaccttttggttgacatgcaccccgagagttcggaagagattcgccttagaacaaatatatatgaacaaaaacaaatcgtttatatgccaaaatgaaagggtcgcaattgattgcaagaaatgaatcctttttggagacactgtctaattccaaaaaggcgaaaattgttattcgagacgcatccgatgaacaactattatgcctggtagaaatttgtctcaacattctaaaagggccgagttccattgcgtccacgtcatttaaagaagctgaaagctcacgcacagatgcttcgtcgtctcgcccgcacacgttgttctcgctctgccaaaaacgtttttgctacagcacggagacgngcctccccagccattgtagggctcattgcatcgattgcccttccgcttattgcgaacgtcattgaaaattatacatagtgcttgataaagtttaaaaaaaaaagtaaaatg

SEQ ID NO: 113471 - DNA, 59 bp, Heterodera glycines; identical to SEQ ID NO: 107294
  Promoter: Source sequence=SeqID_12484; Location=2565..2623; Strand=-; Gene=SeqID_76115

SEQ ID NO: 113472 - DNA, 80 bp, Heterodera glycines
  Promoter: Source sequence=SeqID_18717; Location=533..612; Strand=-; Gene=SeqID_83387
aaattacaattttataaaatatttcttgtgttatacgattatgtttttttccattgtcagatgaccagaacagaataatg

SEQ ID NO: 113473 - DNA, 180 bp, Heterodera glycines
  Promoter: Source sequence=SeqID_5338; Location=3504..3683; Strand=-; Gene=SeqID_46022
atgccttaatgtgacgagtgatgtctttctcaggaggaacgccagcgcaagtcgctgcgcgtcaccgttctcgaccgcgaccgcatcggctctgactttctcggggagacgcgcgtcgcactgcgcaagctgccgctgggccagacaaagaggttcaacctgtacctggaacatgcgatg

SEQ ID NO: 113474 - DNA, 287 bp, Heterodera glycines
  Promoter: Source sequence=SeqID_23394; Location=235..521; Strand=+; Gene=SeqID_54097
tgccaataataaaacaatggtggtcgaattttgtaaaaaaaaaaattataaaaagtggaaaatttaaaaaaattataagcaaattacatgggttgaaaaattcaaattaagttgattctcttccttttaatatccctgcaaaatttgatgagctttagttcagttaaaaatgagttttaggtgatgaaatttcagtctcggctttttttttaccgaaaaaaactgtctgaaccccacttttgtacggtcggtctctaaatgctttgttcgctgtcactaccgcaatg

SEQ ID NO: 113475 - DNA, 125 bp, Heterodera glycines
  Promoter: Source sequence=SeqID_4744; Location=5160..5284; Strand=-; Gene=SeqID_55590
ttggctgttgaaacgatgcccaattagtgaaaaaacggtggcgattcaatgggaaaacgacgaaaattgggacgacaaattgaacaaaatcaaatttaatttgtgtggtggcaaaagttcatatg

SEQ ID NO: 113476 - DNA, 833 bp, Heterodera glycines
  Promoter: Source sequence=SeqID_5972; Location=689..1521; Strand=-; Gene=SeqID_59875
attttacaaatttttgcgagaaaaatttggcatagtattgcctttttcaatatttttggtaacaaatttttgaagaatgaaattttctggaattttttatgctaatttgtgttgcgtttagcaaatttatgaccgaatttttctcgaaaaatctgtaaaattggcactttttaagaaccgacggcctaacacaatttttttaataattacagacaacgtggtaataaactgttcttgcacattgaagaaaacgaaaaccaattgaataaattcagcaaattgctcaaaaatggaagacaatttgccaaaagaatagtttacgtggcaaattttgaaattaaaaaacaattctttatcaatttaattgaggttttttaaacatttacatataaagaaactcgaaaattattaaaataattatattttaaaaaatttaagcaattaaaactctcttttaataattatcccaataaaaaaagattgaatttatattttagtattcttccatttttcccgtttaatgacaatttgtttttgtttttcatttcatttcattttggccctaaatttttacgcaatttcgaaaatttggactttcgactttttgttcgaatttgggtcaggggtttggaattaagtacgacaatcttatatgattttacttatattttttttataatacttaatgctacagaactttattttaaaatatttgtatcactgacgcattttttactgacgcattttccactgacgcatttcccatgtcacggggcggtcgacacccctttaaaaaaggttaattctgactccatgcacacctttttaagatg

SEQ ID NO: 113477 - DNA, 151 bp, Heterodera glycines
  Promoter: Source sequence=SeqID_1175; Location=1923..2073; Strand=-; Gene=SeqID_69396
tattttcaaatcatccaatcaatttattatatcccaaaattatcaaatatttacgagtgtctgaatggaagtgaccaaaactttgaaagcatggtcctattttaccagtgcttattatttatttattcccgggttgtcccaccagaaaatg

SEQ ID NO: 113478 - DNA, 888 bp, Heterodera glycines
  Promoter: Source sequence=SeqID_4672; Location=4162..5049; Strand=-; Gene=SeqID_55318
ttttgaaatttcacggtcacttgccgacccctcctttgtgagaccccctttttgatgactaactcacagaccactaagacaaaaaatccaacttaattgtacttggagcccaaaattgaatcgccgtgaataaaaactataagccaaaacagccattcaaagtgcatttttttcaaatccaaaaacaagcacaaaataagcacgtaatgctgaaataagcacaaatctcagaaataagcattttagctttctaagattcgacccctcaaaataagcacaaatcttagaaataagcacacttggccactctgttctttgtgcaagatagaatgccattaaaaaaattaagaaattatcaaatgcttaaaagccagccagagccgaaactgtcggttatcggacgaatatttggggtaattagttcagtttgccccccccccttttcgaaattttttttgtgttttcaaaagtcataaaaacactttatggggttttcgggtcgctgatcacgaatccggcgcccatttagaccacttcctaatcccggacccgaattcgaacaaaaagtcgaaaattcaaattttcgattttcacatttttggttcaaactttgtttaaatacacggaaacgaactgaaattcaacattgcttcaataaaagatcatttgagccacttcgaaaaccccataaaaagtgtttttatgacttgaaaacataaaaaacaattcgaaaaaagggggggggggacaaactgaactattaccatattttttcttgctgtttgatttgaaagcgtttatccgtcttagtgctcattttctcataatagaattttcctactcttttttttcagctgcccgtggttttgtttcaaccctttaaaaatg

SEQ ID NO: 113479 - DNA, 326 bp, Heterodera glycines
  Promoter: Source sequence=SeqID_20013; Location=1..326; Strand=+; Gene=SeqID_84788
cttctattaatggcattgacgtcaatggcaaaagatgaggcaattttgtatttcaaacaaagaaatgaacttcgcaattgatgaatgaaataaaaagggcattcattcgcatgtccatatttgggcatgacaatgaaaatgccaacagaaagtatcatcaggtaaatgccacgggtgagggggcgagaggagggggaaggtgccgcttggagcgtgccgttttaaagcggagaatcagccaccaatccatgcgcatcactcacaatttttttcatatctcctccattatcgctggaataaagaaaactaaaaaaaattcaaaaatg

SEQ ID NO: 113480 - DNA, 587 bp, Heterodera glycines
  Promoter: Source sequence=SeqID_42831; Location=1..587; Strand=+; Gene=SeqID_70638
atttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatg

SEQ ID NO: 113481 - DNA, 136 bp, Heterodera glycines
  Promoter: Source sequence=SeqID_2539; Location=1004..1139; Strand=-; Gene=SeqID_80277
aaacgcgttctgttctatgcgtccagcaatttggacgacgaattcctgttcaggtaccacgcacaaatattcatgccaagtgccaagttttccaaatggttaattcacacatttcatgtctgaactgcagcagatg

SEQ ID NO: 113482 - DNA, 1003 bp, Heterodera glycines
  Promoter: Source sequence=SeqID_16815; Location=170..1172; Strand=+; Gene=SeqID_81230
ctgattaacaaatgaataaaaaaaattattacaatagtaggaaaaaaaagaaaaaaaatcgtcaacaaaaaaaagaacaaagaaatcctttgcgttttaattatttttacggattattgaaaagaataataaaaattttggtgtaaaacttatgtaacaccctaagtattataaaattttttaaaattttcgtccaattttaaagacgtataacaccttaaaaaagcccacgagcaaaaaatcagaaagtgaccaaaaaaccttaattaaaatgcgctttatttaactaataattttaaaagtaaactaacagcacaaacatttatcagataacaaaaactccctcaaaaaatcacagtgaagcaaatttgttttctcatctgatcagtgttgcaattcaaattcacaattttttagcaattatttcgtatttttggattttcatctttaatttcaaaatattatttcatttttattactttgagctcattcaatattcgttgctaaaagaataaatatttcaacgaataaattcgattaaattttttttacagattttaccgaacaatgaaaattcgtcaaattttgacgataaaaatttttttaataaatttagccttaacatcttatatttctttaattaaatcttaaataaaaaataaatttacatttcgatattgttgcaaatttctttttccaagttctcaaagttcgacttccaatttacatttttctgcaatttttgggatatttaactcataaaaatgtaatttgtttgggaaatattaaataataaatcgacattataataatggtctacaaatctaattaataaattaaaataattatatattaattaattaaaatcatttattccgtactgaaatgacccgccccttccgatcacccatcactcatacttttttagcttcggctcaccacgcaaaacaatgaagcctatgaatgtataacatcgtatttttgatttattttctgtaatatg

SEQ ID NO: 113483 - DNA, 402 bp, Heterodera glycines
  Promoter: Source sequence=SeqID_8329; Location=1..402; Strand=+; Gene= SeqID_67708
catacagtacccccccccccacggtaatcaaagaagcgaacaagccatttctcgcttaggctaatctgggttttcaggcgcccttcttcaatttttgtttctccgcagagatttcaaaaacagaattctttttttctcagggtttttccttgttttcgaccacagttctggtggtttttaattcacaaatttatacacatatgtagtttaaattcacttcgttttccattttaataaataattaattcattaaaagaaagaaagaaaaaccaaatggggggaggagagcatggaaacaaatgggtggggtgacaattaaaaaggctgcttaattatgattaagttttttttttgattaatttcaaggtctgaaaaattttatttaagttcaaaatttcaatg

SEQ ID NO: 113484 - DNA, 767 bp, Heterodera glycines
  Promoter: Source sequence=SeqID_17728; Location=1..767; Strand=+; Gene=SeqID_82264
caggtggttgatggtgggaggacaggggagggcaatggtcacgggggaaggacggggtcaacaaattacccaattcccacggggcgcgggggggggcacggggaccaacccctccccaagatgtacaaattcccaaagaaatgctataaaaccctaaaataagcctcattttcccgactatcgtacggcacctaatcgccaaaccaaaagcatgggacgacccctgagggtgtggaaggggcgtgggataacaaatcaggaagtcccaacggaaaggggtgcatggtgtgaaccagggatggcacggaattccgatttccgatatttttgggctaggattccgattttgaaatttttggggcctcgaaatggcatccctggtgtaaacgcaatcgctcaagcagaatcttaattaatgtgtcctccccatgctaaagtcttgagagtctcgacgattgaaaaaatatatatatattaaaaattaataaaacgtaagggagaattttacaattccatttaaatttacacctaatttttgggcaaaaatggaaattaatcgatttttatgcaactattgaaaatctatatttccataaacttacatatttccacgaataatagacaaaaatttcattagcggaagtggataatattccccattcaaattcatgataaaaatatattttaaaagaaattaaattagttttcaaaactcagcacttatttttgttatcttctaattggttcttctaattggttaattaatg

SEQ ID NO: 113485 - DNA, 487 bp, Heterodera glycines
  Promoter: Source sequence=SeqID_23548; Location=565..1051; Strand=-; Gene=SeqID_54236
gctaaaaatttttttttgtggatacttttgtcggattctgaatttgttcaagaattcaaaaaaaattgtgatggtcaatttttgtaatgagtcagaataatttttgccataattactcatgctttaatttaaatggattttaagcaattttatttgttgtcactttcacttgccgttttgcttctttatctccgacagaatctctctttttaaaaaagaaagcctctttttgacttttaaaaatatataaaatttcaataatacatatattcacaattttattattcaatgatcagtagaataaaatattaatcattaaaataattatttattttcaattaggatgacttttttttattttacaggaaatcagtagaaaggcgatatttttacatcaataaaaatgcaaaataataatcaaaaattacatttatacaagaaaaaatttttttattaaatttatttaaaaaaatttgttaagaagatg

SEQ ID NO: 113486 - DNA, 668 bp, Heterodera glycines
  Promoter: Source sequence=SeqID_3951; Location=4089..4756; Strand=-; Gene=SeqID_52565
tcatttcttcagctgtttaacgtagggttagacttgcattagtttccgcttggattgagactcgaatacccggcttatatggaacgaaaatatcgagaaagtccaattttatttaagggcataaaaatgatataaaataatatattttgacattgatccataaagaagtgtaatgagtccaggaaaattaaccttttaattgagtgtataattcgcttaaaattttaaatctaatttgattaaaatttttgctttgagattagaggtattttttatatatatttaaatttttttaaatgctaaatattctgcagaatctttccggtgtccaaatttctgttgccccttaaacaccaagaaatttgacatttattctaggaaatgaggtgtttttcttgaaaaacaaaacgcatataaactattttattctttctctatttattaattctcagaaaactcatcaacagttgacgtcagcgaactaattaatttggaaaaagaattggcaaattttgagcaaaatattctccaattttataaattgggtaattacataaattgaccacttattctaattacggttttgtctaaaaaaaatccttcgaaaaatgaataaatggtcgaaagaataatggaattttatgccaaaacccccaggcacggtaatg

SEQ ID NO: 113487 - DNA, 560 bp, Heterodera glycines
  Promoter: Source sequence=SeqID_14489; Location=941..1500; Strand=-; Gene=SeqID_78533
aatttttgtctctcataattctgacagatcgcaacttcttttacaaattcttttttgattgtcaatccaatctctgcattgactaattactcgcgcctgattaagtaatttgcatttttaatgacgggtaattaactaatgggccgagaaggtgttttgacgcgctaacaaaaagcaaacgattcgccgaaaacttgaataaatcgtgcgcgacgggaccacacaaaaatgtttcatattatttttacaggttttgacgtattgttccccgccaataacctacttcgcatataaaaaatagatacttttggatttttatatttaataattgaaatgtaataatttttatttaaaagcaaattattacataaatgaaacaatttttattgttatttttattcaacactcttttacaaatttgttttaacaatgcattgccattaacaaatataaacaacaaatcatcattaaaaactggtgaatttaaatatatttttaaattctatctattatttttttatcatttagacacttcgccaaaatttcgcgttttgattatg

SEQ ID NO: 113488 - DNA, 134 bp, Heterodera glycines
  Promoter: Source sequence=SeqID_8174; Location=429..562; Strand=+; Gene=SeqID_67210
ggttcgtcgttctttgcctgctgccctttgtcctcttaattgattcccatccctgctaaaggcaagaatcgcgtgccaccgtggcaatgttagcgccggccgtgcacataatgcaccaagtgtggcgggggatg

SEQ ID NO: 113489 - DNA, 96 bp, Heterodera glycines
  Promoter: Source sequence=SeqID_8731; Location=412..507; Strand=-; Gene=SeqID_69008
agtaaatttggattatttttttctaaatattttgtttaaaaaagaatgctctaaaatttttttctgcctaaaatttttattttcttagacaatatg

SEQ ID NO: 113490 - DNA, 1003 bp, Heterodera glycines
  Promoter: Source sequence=SeqID_11461; Location=84..1086; Strand=+; Gene=SeqID_74860
tcggccataaatgccggcgactgttcggcggatgcacggcgcgaacatgaacatgtcacctattacaagaacccaaagagtccgctgttcatctccaaatgcttggccatcattacaccggtttgggcgggcaaaagaaaaagagatttgacaaacaaaaatgccaagagatttgctgaacaatatgatgataatttgattggcaacgatgataaatctcgactaaaattcccgagaattatagttttttgtaggagtgggggtaaaagatttacataattcgtccaaagtactccttgatcattatccaaaatttaatgactaatcctgagaaatttttgttttttggctacaaaaaagagaattggaattattcttaattgctctaagtctggtcataaacaagaatatttggctaggcgcctgaatgtagggctctgcgagagtctcgactctcgtatttattgggcttccttgtctcttaaaatttttcgggttttttgacttaaatttttttgtaaattttaatttaaatattttctcatcccgttggttgatcagattcctgtcatttattcatccgagaatttgttgcacaatttgtgggcactgatcagcgagaaatttccgctcagagaatactcagtggaggacctgcttcattggatgttacacgaagtaataatcatcataaatgatgattaagaaatttaaaaaaaaattgcgaaattttttaaatctaataattgactaaaaaaatttcaaaaatttttggctctcaaattttactggccccattttatctaaatttggaccttcgtataaaaaatgtatttttacatttatacccaacggcacaaaaaaatcaataaatctgctaaaattgtgccattcccatccactcttcctttttcagctttatttgccggcacccgcctgttctgcacagctatgcttctccaacttccatttgttgctccgtgtgccgtccgtggacgaaatg

SEQ ID NO: 113491 - DNA, 141 bp, Heterodera glycines
  Promoter: Source sequence=SeqID_13568; Location=2298..2438; Strand=-; Gene=SeqID_77470
aagaattaaaaaatttagcctattaaaatatttagaaatttttattatattgtatattttttgaaaaatttccgatttccgacgtttttggggtcggaattccgatttccgacttccgaaaatttttggggcctcggaatg

SEQ ID NO: 113492 - DNA, 282 bp, Heterodera glycines
  Promoter: Source sequence=SeqID_28564; Location=1..282; Strand=+; Gene=SeqID_59165
acaaataatacccctgggagaagggagtgggaaacatgatttcgaaattttaaattttttgtactctaagctactcaaaacggttcagaattcaataaaaataacattcacggtgcgaaaaatggggtatgaaaagtttattgggggaaaaaagactacaaaataatacccctgggagaagggagtgggaaacatgatttcgaaattttaaattttttgtactctaagctactcaaaacggttcagaattcaataaaaataacattcacggtgcgaaaaatg

SEQ ID NO: 113493 - DNA, 421 bp, Heterodera glycines
  Promoter: Source sequence=SeqID_34262; Location=1..421; Strand=+; Gene=SeqID_64096
atttcacccaaaattgaccataaatcgtgccagatgtaaaatttcgggtctatttcacttcaggcgtcaacaaatgacctcttcaataataaaatttcaaaaaaaattaaaaaaatttaaagaattttttgaaaatttttttggtaaagtgcattaaaacctagtaagtaattctccataaaaagaaaaaaatttctttcttagatatttgtggaaaattttttaagattttgaaatttctgtttggaaataaaaaaaatttgcgattttgagcaaatttttaaagaaaatcaaggatttttagggtccggcggtgccgataggcgccgccgagaaattttttgaaaatttcgatgcgaaattgtataaaaatgaagaatttttggctatatcataaaccggtaaaaaccggtccaaaatg

SEQ ID NO: 113494 - DNA, 166 bp, Heterodera glycines
  Promoter: Source sequence=SeqID_29849; Location=1..166; Strand=+; Gene=SeqID_60311
gtgttaaatctataaaaggggatgttaaagcgtgctgatggattaaaaatagaaaatagtttcagatctgttcggccataaacaattttacgtcattttggcgcggtacttttttgccaattttgtttttcaatcgtttttctcctaatttcagtcgtggaaaatg

SEQ ID NO: 113495 - DNA, 816 bp, Heterodera glycines
  Promoter: Source sequence=SeqID_14656; Location=741..1556; Strand=-; Gene=SeqID_78761
aaaacccggaaaacccttactccgtataagtccgtatgcaggaaaaatacggacccgtatacggatcagggttttttgaaaagttttttaatcaataaaaaccatatttttttttactaaaatactaatatagattcgttctaaattttattacgaacattaaacaagagtttttggagtccggcggtgccgataggcgccggcgggaaattttttttaatttgattgcaaattgttaacagatttatcgaacaaatttgcgctttttaaccgattatataattttgctaacgatttttcacaaaaattaggtatctataattttgaaaaatttacaaatccatcgtaaaaaagttaagaaatttaaaacgaaattcatttcaaatgaaatttacgaattggaaattaaatagaatttcataaaaaattgaacgaaatgctattcaaaatcgtaaaaattttgagtttttatcacaaaaaacatttttttccaatttcgtaaaatttttcaataattttttgtccttgatgttcttattttgaaaatttttcggtcatacccctgtcctagagccacatccgcttttccacctactaggtcttaattccctcagttagaggatacaattttaaagttcttaattaaaattgaatatattttaaaattttcggttttttcgtttcgtttcgtacgaaaatggttattttttcgttttcgtgtttcgttttcgtccgtcaaaattttttcgtttcgtgtttcgttttcggttttcaaaatttcttttttcgtttcgtgtttcgttttcgtgtcgaatg

SEQ ID NO: 113496 - DNA, 212 bp, Heterodera glycines
  Promoter: Source sequence=SeqID_43970; Location=993..1204; Strand=-; Gene=SeqID_71530
ggtaatcaaacaattcaaagaaatattagaaaatttttatattaaaatttcaagaaaaaaatttgaaaaatttcagcgattttttgaaaaatttttcaaaacacttacatattaatgcatcgtaaaatttttaaaaaattgctcgaaagtttttttgatttttttttgaatttcctattaattaagaaaattatgagaattcacaagttatg

SEQ ID NO: 113497 - DNA, 104 bp, Heterodera glycines
  Promoter: Source sequence=SeqID_12088; Location=782..885; Strand=-; Gene=SeqID_75641
atgccaacataattgccaaggttgaaccggaaacccggatttatgcctatccctttgacagcaactccacctgggaacaaattggatttggagagcgagtcatg

SEQ ID NO: 113498 - DNA, 164 bp, Heterodera glycines
  Promoter: Source sequence=SeqID_15308; Location=766..929; Strand=-; Gene=SeqID_79542
ggaggccggggggggggagccatgggatgaattgttgttggggatggcacgggggttggacgtattaagaaatttgctgattgggtaacagtttcagtcccttatcggtccccttcgttttttgggtatgtccatgacgaaagtgttgtgtgcttttaggcatg

SEQ ID NO: 113499 - DNA, 408 bp, Heterodera glycines
  Promoter: Source sequence=SeqID_21309; Location=1..408; Strand=+; Gene=SeqID_51908
ttaaagagtcgatgcggggggatggaaagtcaaatgtcccccccaggacaaaaactgtggtcggagtgcttttcccattcctccacaacagtttctttattcattggaaatttaaaatggaatataaaacccaacaacactcattcaaattttttccattttttaaatttgtcgcagtttgataagtggagaaaattatgcacgaaagcacataaattatggtcaaattttggggcgaacattttggtggggaatgaacgtgatggaattccgtccaaaagtttagcctcccaagaatttttgcacgctaatgaatatttgggggggggggagagatattccttgtttttagagaatttcagagttcaaagtttccctcaatttgaaaactgtcgatttcagcaaatg

SEQ ID NO: 113500 - DNA, 439 bp, Heterodera glycines
  Promoter: Source sequence=SeqID_25564; Location=388..826; Strand=-; Gene=SeqID_56304
ccgatttctctcattttggcgtattatttatttatctctgttattagagaaaaacggattctatgtttagtttttttgtcctatgttaaatccgcttgaactttgcaaatcgatagagaaaaaaattacgaacaaaatctaaaggtttttaagagcaaaaaaagggtcagctaaaaagttattcaaaaaacaaattttcaaacgctcatatctttttttaatgtatttaattgcttagcatttgcttaggaaaagcttctcaacgtgagctttcgaatgatatcaaaatagtccagtttggttggcaaaaaacctcaaaaatgttccttgaatttcgtaattttttaagttttttctttctctgtaaatttaaagcatttgaggcattatattgatataatttgtagctaaaatatttactttttgacttttcaaaatg

SEQ ID NO: 113501 - DNA, 382 bp, Heterodera glycines
  Promoter: Source sequence=SeqID_18450; Location=1657..2038; Strand=-; Gene=SeqID_83047
attggctggctgattttttcgaaattcagacaattatacgatgaaaatcgattttagttgtagtaccaggctcaagattatgctaagcaattggaagaagtagaaaatgtccttgaaaagtggttttgaataactttagtcgaagagtaaaaaataaattaaatttgagcgttaaaaatacgtcatgttttttcccgtgtccagacatttgcgccccggaaatttgcgtctcggacatttgcgcctgtgtaaaatcgggttcaaacattttttcatcttacaaattagaggttttaacagcattacctaaatttaagaaaatttgtttttttgtttattaggaacaatataatagaattaaaaaatatagtacagtaaaatg

SEQ ID NO: 113502 - DNA, 779 bp, Heterodera glycines
  misc_feature (40)..(40): n is a, c, g, or t
  misc_feature (51)..(51): n is a, c, g, or t
  Promoter: Source sequence=SeqID_33438; Location=155..933; Strand=-; Gene=SeqID_63508
gtacagtcatggtcagatatttatgcagtaaaatattttncacataacttnatcagtcttagccaatctgaatgattggcaccaaaaaatagctggagtctcagttgacctatttcggcattttttggaaaaattcacgttcagacggttttcatggggtttaaaaattatgccattttgcctatcaaattaaaaaattttctcctaaactgagcccattttgacgcgattttttgcatcttctagagaatttagtgtagaatcatatgtttttccatatcccaaaaattttcctttaggcacatgaagcgaaaccggttttggtaattgaattttccaaaaaatgccgaaataggtaaactaagattttttttcgatcaagttatttttcatacaaatcatttggattacttggctaattaatgataaaattatgtgacaaatatttcactgtataaatgtatggccatgactgtattatattaaaaattgggccaaaaagctctaaaccaagttttcaataggttgtatttttcctgtccccactcacttaaaaaagggtaaatttaaaataacggtgttaggccattttgcgaaaagttcaaaatggaacaaaatcgaggaaataatcagttgaggatttttgggtcgagtttttgaaatttttgaggggaaagcgttggtttcaaaatgcactatcataaaattaaatttttttaaaatttatataaaattataattttacctattttagtttattttacccattttagtttatg

SEQ ID NO: 113503 - DNA, 104 bp, Heterodera glycines
  Promoter: Source sequence=SeqID_551; Location=1426..1529; Strand=+; Gene=SeqID_56036
atctctgccaatatacctcaacaaatgttgaccgacttattgccaaaacaaaagccgtttttgtcaaatcgccttacagagtgaagacatttcgagacaaaatg

SEQ ID NO: 113504 - DNA, 214 bp, Heterodera glycines
  Promoter: Source sequence=SeqID_24725; Location=866..1079; Strand=-; Gene=SeqID_55472
tttttatcatttaacatcgcgctcgggaatggttgatgcgtcgaaatagatgtgctgtttggatgcgttcatttgttattgaccccgaaaataatgcacttttgcttgtccttgacaacgaaatcagcaatgatgaagaataaatcacatattttttttctttctttatttgctcaaataacagcggtgatgttgggggcaccgtggtggaatg

SEQ ID NO: 113505 - DNA, 80 bp, Heterodera glycines
  Promoter: Source sequence=SeqID_24; Location=3700..3779; Strand=-; Gene=SeqID_80479
ggtattttttttatgaaaaaagtttataaataaaactatattagtaaaaaaataaaataaattttcaggaaggacaaatg

SEQ ID NO: 113506 - DNA, 559 bp, Heterodera glycines
  Promoter: Source sequence=SeqID_30021; Location=624..1182; Strand=-; Gene=SeqID_60471
agggaataaaaaaattattaaaaaaaacaaaattcttatttcaacgtttgctttaggactattacatggttttgcactcagagggtttttgaataaaaatacttttgttttattgaaatgaaaaaaatttcaatttttttctttacccgacaatgcccgggcccggttttttgaccaaataccacagggcctggtattttttaaggtgatcagtagggctgggaaatttaggtaagaaaaatcgcgaaataggtaggtataccccgcccgacatttgcgcctcggacattttcggtccgacattttgcggccactggccaaatagaaacttcataaaattaattatccaatttaagcgaattttatgtcacttttgaaaagccgatttcgattaaaattattttttttttttgcgttatgaaatggtgaagaaaaggtatgaacattattaggaaatctatgaactctacagtatcacctgggggtcttgaataagtataatttttgaaaacgattacttggtaaaataaagttttcggcgtaaatttgaagagaaatg

SEQ ID NO: 113507 - DNA, 174 bp, Heterodera glycines
  Promoter: Source sequence=SeqID_15584; Location=2108..2281; Strand=-; Gene=SeqID_79873
tctctgctgcgaaatatttagtagcaaattcaattgaaattatttcggcttaattaattaatagtttaatgtaaatatttaattttaaaaatattggaaataattgggtttttgtgttaaggaataaataataattttttaaatataaaatcaaaaaaagcggttgcatttatg

SEQ ID NO: 113508 - DNA, 226 bp, Heterodera glycines
  Promoter: Source sequence=SeqID_42280; Location=725..950; Strand=-; Gene=SeqID_70207
tgtaaaagaagaagaaaatggtgaaaaaactcttttaaaatatgatgaaatagggcagtatcttgaagcacgatatttgagtcctgttgaagcttgctaccgtttatttaaatatgaattacaaggtaaatcacatacaatagaaagactggaagttcatttagaaaacgaacaaactgtttattttgatcaaaacttaaacgatgataatttagaagaggcaatg

SEQ ID NO: 113509 - DNA, 106 bp, Heterodera glycines
  Promoter: Source sequence=SeqID_21512; Location=745..850; Strand=-; Gene=SeqID_52122
attaactgctctaatgagtggtcgcaatttcactagatggagttgggcccggggctctcaaaacactacaaacaaaagccttgtttttatcggcagcttaaaaatg

SEQ ID NO: 113510 - DNA, 161 bp, Heterodera glycines
  Promoter: Source sequence=SeqID_19763; Location=1570..1730; Strand=-; Gene=SeqID_84502
tcagatggggattgcgagaaaactttgaggacttaccgctgcaattgcgcaccaaaagtgcgggggatgagcaagagaccgtgaccgagaagtacacgcgagaggctgaacacgaagacgcgcaacgaacagtgtgggtgggacgcgagggcgagaggatg

SEQ ID NO: 113511 - DNA, 95 bp, Heterodera glycines
  Promoter: Source sequence=SeqID_33610; Location=1069..1163; Strand=-; Gene=SeqID_63623
gggggggaggtcgcatgatagaaacttgtcaggttggctaatttataataatccttcgataagtttttcttctccctcagggtgtgagcaaaatg

SEQ ID NO: 113512 - DNA, 877 bp, Heterodera glycines
  misc_feature (9)..(9): n is a, c, g, or t
  Promoter: Source sequence=SeqID_27844; Location=1054..1930; Strand=-; Gene=SeqID_58520
tgtccgccncaattggtgccaaaaaagtcctcgtttttcctcatgtcttcctctaatctcttttctattgatattttctcattttatgccattttcactttccttttacaaaaaatattatttattttcattttgccaaatgctttcttttattattttcactgaattaattgttctgccggtggcatttttggtcggcaaaggtaagtgaatttgtaaaattaaattgaaaaagagaaaaattaaatttaaaaataattaaaacaaacaaatcgtatgtcgtcggattggcataacttaaaaccttttatataattttttttttgtatttgttaaataaatttcttttaattttcgtttaattattttaaatggcgaataaatttcgaaatttaaaattaaacaatagtttaattaaaagttaatttatttttgttaaatcccttaatgttttccaaaaatgttgcatttgcggaaatatttgttcattattttggccaaacttttcaaagaataaaaaatcattgacacaatttgttttcgctcttcgcctccattgtttcaattcgtcgaccatttcctcttgccaaatttgccctttatttcgttcccaaaatgccgtcccccggggggacattcactcactatgccgtgccattgtccctctcactcccccccccccctctcctaatccgattgtgccatgactttcatgccaatttttcattttgtgccttcgtttgactgacatttgtggccaaacaattacaaaaaatgaaacgccaaaaaggcacttttccactgaaaatgccactcgacttttgagttgtccaacaacatttccttgtgcttcttggcaaatagttaaattgaaatg

SEQ ID NO: 113513 - DNA, 112 bp, Heterodera glycines
  misc_feature (60)..(60): n is a, c, g, or t
  Promoter: Source sequence=SeqID_38373; Location=1019..1130; Strand=-; Gene=SeqID_67204
atcaaaaagatgcgcgactcaggggcgccattggaccaactcttcgaaaagacgaacttnggaattggggtgaagaccagcagaaagttttgaaaaagcaaaagagatcatg

SEQ ID NO: 113514 - DNA, 724 bp, Heterodera glycines
  Promoter: Source sequence=SeqID_1336; Location=2023..2746; Strand=-; Gene=SeqID_72848
gacaaaatttctcataacgccaaatagcgtaattggcgtaaatttttgcgcgcttgtttgaaaattaataattttttcaaaaattcattgacgatcaaatgatcggatacaatcactttcaatcgcttatttaaagcttgtttaggctgtcagtgatttgaaaaacttaatttgaacccgattttggacaaaggcacaaaaaaatgtgaagcgattaggggaaaagtcagagacgaaggcgtaaaagaaaggcgacttcgtaagacacgaagaaattaacgcaaactcaaacaaaaaaaattgaaaattcagatttttacgatttttttaaatttaggttaagaagtaggaattttttttaacttatatttccagaattcttttaaattttcttccttttttttgctttatttatataataacgctattcgagacggaaaattacccgagaattggggcccttagatacttagattttgagatccattaatccgtgactcaagtaaagactctcgaacaacggcacaattgatttaggcattccgtttggcggcatcccgcttccgcttcgtcgttgtgtttttgggattcggatgaaattgtatttccaacattttccataagcaacacttttactggagaacatatgagtctcagactcaatggcaatcaaacattcattttgtttcggcactgtccccctaattttgtttcaacagaaatg

SEQ ID NO: 113515 - DNA, 161 bp, Heterodera glycines
  Promoter: Source sequence=SeqID_41724; Location=358..518; Strand=+; Gene=SeqID_69793
tttcgggtcatttaaatgctttggtttaattaatttattttatttttgctttcaacagaaacgatttccccgaccttcgcgacattgtcaaaaattcgccgtttgttttcgttagtgtggacgaactgctcgattttccgcgacctctcttcccaaatatg

SEQ ID NO: 113516 - DNA, 1003 bp, Heterodera glycines
  Promoter: Source sequence=SeqID_18633; Location=674..1676; Strand=-; Gene=SeqID_83287
gtctaaatgtattattaagtttttaactataagaataaataactaattataagcttgcgccgcaagtttttaatagattcattaattgttattatcgatttacctcgaatgcaaaatttgaaattcatttttattaaattcaagcgacaaaaatccttttcttggccgattttccattaaattttaataaaaatgtttcatttttatccttgaacagcgaaaattatttaattcatacaaattaaaaaattcttttgatggttcatttgtatattttttataatattttattgatttaataaaatgcatttagagtcgtttttatatatccgcaatttatttaaataaaaaaattattttatataatcgattattttcaagtaagatttgcaatattttttatattttgtatttgaattattactatgtctaatttaagcttatgcctgcgggttatcacatcaaagcggcgtttgtactatttcataaatatttgtgaattatttaaatactagggtgtcccaaaagttttttctgattttttataacaatatcggtacccctgtaaataactaaatgttgaatataaaaaaaatagcgcaaagaaaaactcgcttgaccgatttttgaaccggtctaaaaaccggttcaaattcaattttatgaaaaatgctgaaacatgacaagcgagtttttccttgcgctattttttgatactcaacatttagttatttacaggggtgccgatattgctataaaaaatcggaaaaaccacatacataaatatctaaaaaaataactaaattgacattttttagacggtttcaaaaaattttcttgaaaatgaccggcaaaagagcattttgtaaaatttgctacaaaattatgaaatgaacgtaataaatttaatgcatttcaaaaattgggaatcgtacaaatgaaaatgatttatttttttgaatgttttgggggagtaaatgacaagaagataaaacatgaaatg

SEQ ID NO: 113517 - DNA, 441 bp, Heterodera glycines
  Promoter: Source sequence=SeqID_29703; Location=1288..1728; Strand=-; Gene=SeqID_60176
ttttcccaggcaatttaggatatatatatttgcgctttttgatgaattctttttatttaagtttaaatttttcgaaaattcactaatccccggaatgcggcgcggaacctcacaaatgggaaatgcgtgatttgctgggttaatcctgctatatcccgtacagctaacaattccaatcccgcaacgtgacccgatgggcaaatttacaatcccacaatgccgtgtggggtcccgcaaattggaaatgcgggatttgctggattaatcccgcgggatcccgtgcagaaaaaaaataaaataaaaattttgatttccaatcccgaagcgggatcgagcggcaaatttgaaaattcaggcgatctctccatttttaaccacaattttagcaaacattgaacgtccaaggttcgattgagaacgaaaaatgccatcaaaaatatg

SEQ ID NO: 113518 - DNA, 64 bp, Heterodera glycines
  Promoter: Source sequence=SeqID_31433; Location=920..983; Strand=-; Gene=SeqID_61778
cttaagtgtcttctattagcctgcaaaattgcaaaaaatttcgtaaaatttgaacaatcttatg

SEQ ID NO: 113519 - DNA, 99 bp, Heterodera glycines
  misc_feature (38)..(38): n is a, c, g, or t
  Promoter: Source sequence=SeqID_9311; Location=1..99; Strand=+; Gene =SeqID_70959
gaactgcttcagagccgagaaaattgggttgtgtttcncaagttgcatcagcaacttcaaaacctacccatctaactagccattcatccataccggatg

SEQ ID NO: 113520 - DNA, 155 bp, Heterodera glycines
  Promoter: Source sequence=SeqID_14118; Location=2639..2793; Strand=-; Gene=SeqID_78104
gctataattttagataatttaattaaatattatataatctattaataaaatcaaatttatttatttatttaaaatattaaaaaaaatatattgatactttaattttaaataataatatttttactcattattcatatcattattctgacagaatg

SEQ ID NO: 113521 - DNA, 753 bp, Heterodera glycines
  Promoter: Source sequence=SeqID_23984; Location=1..753; Strand=+; Gene=SeqID_54687
cgaaatagttaactaaaatagtgaataaaaatgccaaaatagtgacaaaaagtccgaaatagtgacgaatattttcagccaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaatttttttttcatttcataggagtatattttgaaaaattttagctcgattcttaggggtgtattttttgaaaaaatttttaggtcgattcttaggggtgtattttttgaaaaaatttttaggtcgattcttaggggtgcattttttggttttattgcatttttgttaaagaattttccaaaaaatgtcgaaatagtgaaaaaatagtgacaaaactccaaaatagtgaattttcactattttagtgacaaaatcccaaaatagtgatttctagtgaccgataatgacatcagaatcgaaaatttttaacgcagaaatgcgttttttgagctcctttcttcaaaacaattaggcaaaaaaagtttttcactaaaagttgcggccctaattattataaaaataattaattttcttaaggcgtcgctggagaaaataatatgatttttggtccaaaaattttttttcggacattttttgtgccaaattttcaaaaagtcaaaacaaattattaaaatgttcagcagaatg

SEQ ID NO: 113522 - DNA, 226 bp, Heterodera glycines
  Promoter: Source sequence=SeqID_28016; Location=1..226; Strand=+; Gene=SeqID_58676
aggggggttggtaaaaattcagtgggggggttatattacaggaaatacggtacctatctcattaattttgttttcgaggattttggggtcctgatcagtgatcacgtaacatctattttgattaatttctaaaacctaacccgaaatatacaaaagtaaaattcaatttctcggtttttatttttttgttaaaatatttcattacaggattctcttctgtgcaatg

SEQ ID NO: 113523 - DNA, 173 bp, Heterodera glycines
  Promoter: Source sequence=SeqID_7381; Location=211..383; Strand=+; Gene=SeqID_64662
cgccaccgccaccagccacgtttgcgcctccggcacggcccaccgacgagccagaggggccggcgccagaaggcgcgcctgctgcatgcgcttcgtagccggcctggcgcgccgttcggtttccgtgcgcgacgaatggtgcatttttcagcacctcaacctcgcgaaagatg

SEQ ID NO: 113524 - DNA, 230 bp, Heterodera glycines
  misc_feature (10)..(10): n is a, c, g, or t
  Promoter: Source sequence=SeqID_15169; Location=2314..2543; Strand=-; Gene=SeqID_79366
ctctttatanttcttcttaaaataaaataaaaaataaccccccccccgcccggaaaaataacatttttaacgatgggatttttcttcgacttttggttgggaactcaaagaaggagtcaaggcttttcagagtttatttatttccaaattaaataaaagagacaaaaaaaggacacaaacaattttttgagaagacaacatcataaaattaatacaattaaattcgaatg

SEQ ID NO: 113525 - DNA, 751 bp, Heterodera glycines
  Promoter: Source sequence=SeqID_11047; Location=546..1296; Strand=+; Gene=SeqID_74379
tttcttcactatatttttgatattcgcattttaaaatggtaaaataatgccttttcattgtcagattggcaattttggatgactacgacttttgcagtccaattgaacgtttaccagtcgactttctgtgccaatgtgtgaatctttacctgatggactcccgggttggttttttaaccgaatacccaactttaaaaaaaaatttaatcttgaataaagatctaacttttgggggatttgctatcgtttctctctttttctgaatttgggtctcccgaaaatgacaactttgacttagagtgctgtttttagggtacaatctgaatgctttctccaatatttaaggacattttccccgattcatcgccggtcaacgccgtctcttcctctccaatttcgtctgcccatgccctgtggcaatggttgcattcgccgcggggggacgggcgacctaagattttgctgtgccaggaaatttggtcattcgctgacaaaattcgggaactaaaaacggtaattatcttaataaaatatgaatgtctccgctaataaaaaagattgccggctaaattgcaaattaaggcattttgcgacgcctctgcccccgttagtttcatcattcgtttgtctttgagcagttttgctggtatgtggcattttaaaaatttctagtatttaagacccccaaacatttgttgttttctgtgcaggtgaacagtttgaattgcgcaatgatcggaccggggaaatg

SEQ ID NO: 113526 - DNA, 245 bp, Heterodera glycines
  Promoter: Source sequence=SeqID_828; Location=3808..4052; Strand=-; Gene=SeqID_62235
ttcgtaacacccattccgattttccactccccgtgctccctgagattgtcagcgtaaacgggtgtctgagttgtaagtgtttttcatcaaatttttgaaaattgtctgccatttttttttttttttgcaaaacggtttatcttatattatccatgtttaaaaaatattatatatacacaataaagctttacagaaataataataataataataataataataatctcttaactattaaacaaatg

SEQ ID NO: 113527 - DNA, 350 bp, Heterodera glycines
  Promoter: Source sequence=SeqID_8864; Location=2294..2643; Strand=-; Gene=SeqID_46654
atcagatccaaaaacgggaaacgtttattgttttgttagaatattgttgcttttagtaattgttgcatgcgaaaaacatttatttcctccattcattgaaaaagcgtaaattgaaaagtgctttttctattttgattttttatgtcctctgacaatgagcattattatcctacaaattgtctgtcatttttgctaatctgttgctggttctcagagttctctttccgatgacttcgtggcgattgtgtttaggaaagatcagacgaaaagagatggtcagattgtacaaagtgaagtcagtcgctttttaggattttcactaatttgttaaaagtttctttagaattatg

SEQ ID NO: 113528 - DNA, 1003 bp, Heterodera glycines
  Promoter: Source sequence=SeqID_6599; Location=182..1184; Strand=+; Gene=SeqID_62151
tttttgtcatttcctactttttctcttccgctcctctcacacactctctctccctttctgtcctcccctacctctttttgtcttccctattctctctctcttctcctctcactctctctctctctctttctttttctcttccctcaccaatcagactttctttccttatcctttccaccctctctttttctcttcatcagctcctctcacacacactccctttctccctccctccctccctcaccccgcccattctctactgtcccaatgtctttcacagtttttccacgatttttacaccaacacaccaacccacaccacagggttaattatgtaattaaccccagttaattacacatataattaactccttttatcgtgcattcctccgccgttctttcgtcctttccctttccctttttttctctctttttcactgtctcttccgctgtccctttcccttccccaatcattcaattgcctgccattcttctcacattcattcattgttttttgactgatgaaggtcatcttttcgtcacacagtagaagtgggaaagtaaagaaaaatgaaaaattcaaatggaaaaaaaatatatttaaaaagagggaaaatgggggggggccaattaaaacgataaaagactaattaggactaattaggccacagcaaaatgaatgcatggcaaacaaatacaatattatacacatatgaagggtatattacattcacaaaaaaaatgcaattgagattaaagtgatcatcggcttcgagtcaactttccatcaattgctaattttatgaatttttggaaaaattgaaattttttgtaaaattgggtcagggaggccttggagggggtaccaataaggaaaatcgaaacttttctgcatacaacactatttttccattaaagaattgttttcatttgtttctcacttgcaaaaatgaaaatttggcaaaatttcagaaaatttgccacccctcctttgtcggcacatg

SEQ ID NO: 113529 - DNA, 563 bp, Heterodera glycines
  Promoter: Source sequence=SeqID_32890; Location=241..803; Strand=-; Gene=SeqID_46317
tggttcgaatattcggcgcaaaaatccggcaattaattggcacaaagagatgagcgaatgaagataattgacgacccgaagaaaccaaaaacaaatcaaatggagaatacattaagttttcacctaaattttattttgtatataaattaattatttctgttaatcctttctttactcgctgtacataagtgtcagcttattgttagcccaaacacgtacagattaaagttaggtaattaaaaagatttgaattatttttcgtggcattatgtttttggataattggcatttagatcaacctaaccaacaagaactaaagatcgattcatcaatcaaataacttttgatttcgtttaatgtggtcatttacatacatacatccaagcccgtagttagtggtgaatgaaagggcgggtgggttaggattgggtccattttgaaaatttctatcaatttattaaaaaattcaattgcaaatatttatttagatttaagcattttctaatttaattaacggtttgccaacctctgcacattcttcgttacaacttccgagattaatg

SEQ ID NO: 113530 - DNA, 70 bp, Heterodera glycines
  Promoter: Source sequence=SeqID_3062; Location=2373..2442; Strand=-; Gene=SeqID_83029
aacgcgcaaaactttggcttcgcttacgatttcggatcattgatgcattatccatctggaggcgatcatg

SEQ ID NO: 113531 - DNA, 1003 bp, Heterodera glycines
  Promoter: Source sequence=SeqID_3844; Location=3939..4941; Strand=+; Gene=SeqID_52107
aattaagtgaaaatttcgacgaaattggtaattataaatgtccaccatattaattttgtataggcgtactttagagaagacaaggcttccccgagaggatgattatggatcaattaagcagacaattgatactatataatcaaaattattacagtagtattttgatcaggtgtacttttttcgaagtctttttatgttttaaaatatttttaatgatgtaataagaaaatatccttatatttgacctatttttcggccaaataatttgcataatatgaaaaaatatcgaaaaatgatttacatagagaggatccggtccaaaaaagaaaagcgaaatgtgctattcaaattaattgaacaattaactaattaaatagttggaagggtcattggcacaccgtaaaaagttatttttaaaagggattttgtcattttctttatattttccctcttaaaattaaattttttcaaaatttccaaaatcccgcaatcccgcgctgtatcccgcagattttaaatgcgggattaatcccgcgggatcccgtcccgcaaaaaatttgaattccaatcccgcagcgggatccgcaatttgaaatttcccgtctctatgcagcaacacgggctttatttatttatttatcatgacaatatcgaaaaatcagtcatttaaatgttacgaaatacatcaatcgactacaatttgcatagctcagactcgaaaacacgtgaatatttatcgaaaatatttctataattttatttaaatgagaaaatgtaaattaatcaatcaaatcatttcttacaaattacaaactaaaaaaaaataaatcaaatatataccgatttatatatctatagtataacatgtgaagattcattgaaaatattttctaatattattatttagaattaatcaataaatgatttcattacaaactacaggcttaatgtctaaaactaaaaccaaaaaattaccaatttttaaagcttaatcttccttatg

SEQ ID NO: 113532 - DNA, 238 bp, Heterodera glycines
  Promoter: Source sequence=SeqID_17629; Location=1..238; Strand=+; Gene=SeqID_82156
tttgcctttgtttcggtaaactaatttaatttaattaccaaatttatttatttctaacaaatttaatttaatttaattaagaattataatagtttgaaaatttaaatttttctttataaatttaattaataagcatatgtttttacaattttatttggtttaaattatttttttgcagttttattacaattttaattttattttgcaattttttttattttatttttatttaaagatg

SEQ ID NO: 113533 - DNA, 538 bp, Heterodera glycines
  Promoter: Source sequence=SeqID_260; Location=4440..4977; Strand=+; Gene=SeqID_80143
aatcctaagcttaagcctaggtccaagcaagcctaagcctatgactcgcctaaagcttaggtaagcctaggcctagcctaagcgattgtacgagttgccttttgtaaattctcgtaaagctgagttgtccatcagccgaattatccaatctgctgagttatcctgacacgatatatttttcataattggcgtttttttagcaaatataaatccgttcaaatataaatccgttccttggatataacaataaaaaaagatgttgaattgctttggtttattttttccaattttttttattatttcattattatttttaattattcatttgaatttttgtatatataatcgaatcttgttttccaattttagaatatttattttctttaaaaattgcttgttttctgaatgtcgagttaataatttatttatttatcctatagaaacattgttgcgacttttgtgtttccatctaatcattttatttttcgtcatagtttattttatgtgtaattattagagaccgagatttccaaaaatg

SEQ ID NO: 113534 - DNA, 637 bp, Heterodera glycines
  misc_feature (543)..(543): n is a, c, g, or t
  Promoter: Source sequence=SeqID_24162; Location=975..1611; Strand=-; Gene=SeqID_54868
ccccttctgttctatcacataaattaataaaatgccgccccccccgtcctttttattcctgatttttctttttcttacactttaatctaatctctaattttggcacaatttacccaaaatgttttattgtctcttctaaagaaacaaaggaatacattgagatgaatccataagaaaacttttcgcataatttaaattatcatttttattttaattctctctttttgttaagtgtctttttttgaattctttgggcaaaacgttttagcaacaagaagatttggaaagctattcacagatcatatttgaaatttatgtcgaaatgcccgggagattttaaatagtccctactgacctttcaattcaacaaatatacaccccttggcattggataatttaggcttttatgaaaatatttttatttataaattgatttatgtacaatttaaatcaatgcattacatttttattatcttatacattggataaaatcaaagcaatcaatcacaatttttataaaataaaaaattttgtatttaatgnaagcatagatttaaaaaataatttaatgaaactgtcctttgttcttgtaattgtgctgacagtgataattggcaaaatatcggaaaatgaaatg

SEQ ID NO: 113535 - DNA, 623 bp, Heterodera glycines
  Promoter: Source sequence=SeqID_16665; Location=1..623; Strand=+; Gene=SeqID_81071
tttcaaacatccatcaaatgtaaaaaataaaatcacttgctttttaaagaaaaaaaaataattagaaaatttttaaaaaccaaaatcccaaagatatattattggaaaataaaaaaaaaagttgttggtttaattttaccgttattctgagcctggtcattgatgcggtaatttaggtaattaatttagaaaatattcgattgaaaagaatgagagagaaattccatttttgcattatttattcataaagggcgatttgatgaatcatttggcggatgatttgcatgtcattcacaatgcagcaggacagcgacaggaatcattttctgctgtccttttaattacatttgatatttgagaatgaaaatattggggaggggtcgggggaaagaccgagggaggaggggggggggggagtgagcagtgttatgccagtaataagggaggaaaatgagacgaggaaaaggagggggtggggttaaatggaacgaaagacagagagagaaagagggaaattcggaataaatttgggggggggggaaagtatgggaaggtaaaagatgctgacaatattggggcatgggcaaacgaatcaaaagcaaaagtgatcggtgggagaaatg

SEQ ID NO: 113536 - DNA, 408 bp, Heterodera glycines
  Promoter: Source sequence=SeqID_1477; Location=1385..1792; Strand=-; Gene=SeqID_73796
tccccggcgggggaggggagaacccccccccccattaatccgatcacaaaaattttacgttttcgaccaaatattaaataaacaaataagtatcagctgaattaaaaaataaataaaattcaaaatatgtacaaaacaatgggcggcactgggggggggggaagcctaatccattggggggaaacaacaaaaatatttgtgcacaaaaatggggccaaaatgtgttgtatttaagcgaatgaacgcgcagcagcaaaagcagtagcaaatggtctgttttattagcttagatttaaaattttaagcttaaagaacttaatatttttgtggattctttttacggaaatttctttaattttacaaaattttttttttattaaaaaaatatccaattaagtgaaaaaaatg

SEQ ID NO: 113537 - DNA, 58 bp, Heterodera glycines
  Promoter: Source sequence=SeqID_20143; Location=648..705; Strand=-; Gene=SeqID_84929
tttagtcgattggttttcaataattttaattttttgtaagaaaatccttaaacaaatg

SEQ ID NO: 113538 - DNA, 75 bp, Heterodera glycines
  Promoter: Source sequence=SeqID_10914; Location=4308..4382; Strand=+; Gene=SeqID_74196
tgtaagcttttattttttattaaaaattattttattaatttaataaaacaaagtttatagactcataatacgatg

SEQ ID NO: 113539 - DNA, 600 bp, Heterodera glycines
  Promoter: Source sequence=SeqID_32572; Location=433..1032; Strand=-; Gene=SeqID_62882
tttttattataaagagtcaatatccaataattgtattcttttaaaacagtaaaaaaagagtaaatttttcgtttactcgctcacgttcatttttttttagaaaatatgtatgtatattgctttaaaattgagtttttgacaaactgaaaaagaaagaaaaaagataattttttggtttgttgagtttttgaattatatctgattttgttattgcgatttttattcattataaaaaattgaaggcaacttagttgtttgtattgactgacaaaaggatgtgaaaagcttttttttgttttgtattgtaatagatttgtgacattgtaagagaatatgtagttgtaatgaaattattttcttcaaattgtatttcataattgaggcaagtttaataatgaggtttcaaattacgctgaacaggtcggtttgattatttatttgtcacatcatttccattattcatcagttaattttaaattgataaactttaacttttttgtcactatttgtttaatgcaatattttacctttgcttttataaattgatattagtaattaactattatacagattaaaggcgcctttattgtttgagcgatg

SEQ ID NO: 113540 - DNA, 1003 bp, Heterodera glycines
  Promoter: Source sequence=SeqID_8556; Location=836..1838; Strand=-; Gene=SeqID_68516
tttaatgtccttgaaaaagaattcgagaaaaacaattattttatataatgtttttaatcatctacattcttttgaatggattttgggacaacaaaggttgatttgatgaaaaataaattttcgtcttttatttgaattcgggtccaggattcgaaattggtcaaaatagatgtcagatttgtgatcagcgacctgaaaaccccctagaaatgttttaaaaaatatttttttttatggtttgtaaagtgcatacataagtaccctgaaatctttcaaaaaaattttcctgctgatcggcaaccgccggaaccaatgttcccaaaaagttttttgaaaaaagcataccgcaaaaaagtgcacatgcggtgaaatgaggaaactgatgaacagaaacaaaataataatgaaaaaatactgcaatcatttttcattgcatattataatttttttgtatccttgaatttaatgaaactttcacgttacgtccttgtaaattattatacccgtccttggaaagtccttaaccctaagttgaggcaaggttaatgaatttaaatttccccatggcgcccaatcggcggcgcccaatcgtaccggcgcccaaacggcggcgcccaatcggcgtcgcccaatcggcgtcgcccaatcggcggcgcccaactgacccggtccgtgacacacccgaaaaaacatatgacatctaagaaaaggaccgaaaatttttcaaaaaaacccctaattttctgagtagatttttcataacggaattaagttttcgaaatttttttcttaaatttaacgcatttcgaagaaattttgggaattttacctccaattaaaaaaaaatttatatgcataatttttgaactctaatctcataaaaattaaatcccatataaaaataaaattgctttttcgcttatttgcgaattaattaattacataattaattttttcccttttgtacattcttttattttatttatttcatttcaaaaaaatg

SEQ ID NO: 113541 - DNA, 1003 bp, Heterodera glycines
  Promoter: Source sequence=SeqID_15966; Location=854..1856; Strand=+; Gene=SeqID_80321
accgcagtttttatgttcgtgacctgtcaatcaaattctttgggcgagaaaatttaaagcgcggcggagatgcaaaaataattgcgtcacacaaaccgcagtttttatacacgggaactgtcaatcatataaatgaagggaaggctgaagcgacttcatttcaattccatttcgcttaaggtggggggtcgggggctattcttgcccctcggggcgcttgcccccaaatattcaaatttttccatcgatcatctggatctgtcaccgcggcacggcagcacggcatggcagtgggaggagtcagcagcggcaccatccccaagttctcttctcatcatttgccactttcgcccactttttcaatttgtcagcagcggagacgcatcccaaattcgcttttcactagttgccattttcatccactttcatcatgccctttattgcccccggcactttcgcgtttctttcaaaagagtatggggaattttcggctgggcattttgacccaaacagagcatacgacccaaattcacttgcagaactttcgtaatgacatttattttgcttccattatctttcattttttctttgtagtcaatggcgaaaagagtttctggacggccgatatggatccaaacaaccaacccctccttccaccccgcgtgccccatcgcccagattcccaatcccggtcattgttggtaattttaatttgttttttggattttgcaaatattccgtttacaggaaatcgtccacaggatgaaaattgtttggttttccacaaatatcttgtctgattttttccattttagggcggcagatgttccccgatgacgaggggtaagaatcggaagatgatgaaattctcttgccacctgcgccgatccccccgcaacttggccaccctccgccaaatgtgccggtaatttcggtctcgcttttcgttgctttttctcaaatttccgagtgcttttttcaggcagttcgtgttcaaccaatg

SEQ ID NO: 113542 - DNA, 129 bp, Heterodera glycines
  Promoter: Source sequence=SeqID_2888; Location=1..129; Strand=+; Gene= SeqID_82192
agtcaagagcatcagctcggccatgtgcttgtccgtcttctctattccccccatcgtttgtctgtctctgttctgtgcgtctgcggttttcacggcgcctcaggcaattaatgagtttcacaacaaatg

SEQ ID NO: 113543 - DNA, 304 bp, Heterodera glycines
  Promoter: Source sequence=SeqID_17880; Location=1..304; Strand=+; Gene=SeqID_82426
aaaacaaagagatttgtggtcctggagcgttgctaggaaaattttgtgactttttaaaataaatatttttcaaaaaaatattccccatttttttaaatttttccaccctcttcctttaccaaatagttatcgggcctgctcgtaaaatatacagtacacagacagtaagaagttttttttttcgatttttgtttttgcgccttttgtcgcccttcatcgcctgataaaccaaacagtttgcttcgtttggccccgaatattgtactcaacacaacgctttcggcgccatttgcagcaacaaatg

SEQ ID NO: 113544 - DNA, 1003 bp, Heterodera glycines
  Promoter: Source sequence=SeqID_25149; Location=93..1095; Strand=+; Gene=SeqID_55874
atgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttttcagaaactgatcagaagcgcaccaaactttgcagggatactgaaaggaagagaaataacctattttaaatattatctagtcagttcatttaaataatttttatccaaaaaatttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttacttttgttttcggggcagtccccccgaaccgatgcgcccagatttatggggagaccgaatccttcgggaatagcttccctatagcctgtactttaattctgcgtggatttttgctccccataattgtttgagtaccccaaacggacacttgaaaaaatcgatttttttgttttcggggcagtccccccgaaccgatgcgcccagattatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 113545 - DNA, 364 bp, Heterodera glycines
  Promoter: Source sequence=SeqID_10005; Location=1..364; Strand=+; Gene=SeqID_73055
ttttccggaaatttttcagaccttaaaggccaaaaagacaatttagctgatgggggccgttctaatagagtttgtatgcctaaatatggacataatgtcaaaatatggacggataactatggtcaaagaataaaaaggatttccatataattgggagccctaggtacatatataaccatcgggccgggtttatatgccgaattttaaattaaaacatttaatataaaattaatatattttaaatttcaacaaaaaatgtcgctttccaaaacaatttttgtggctgaattttgttgttgttttttttcatatacaaactgtctactactgaactccttcaatttttttttcaacagacattatg

SEQ ID NO: 113546 - DNA, 609 bp, Heterodera glycines
  Promoter: Source sequence=SeqID_35716; Location=380..988; Strand=-; Gene=SeqID_65200
gaaaaaaaaattttccaaaaaaagttaaaaccggtcaaattttggcgtaaattgcatattttttatgcaattaatgttgaggcattattttggatcaaaataaatagtgttaaatgaattagaagcttttatccacgaaaaatgtaatccttggaaaaaaatttcaactttttgttcgatttcgggtccggggttcggaattgagtaaatccgagttcagattcgtgatttttgagccaaaaataaaaaaaataaaaaagttaaattagggaccgcgattctttagcattgcgatcagacgaaagttaaaagggattttgaattttgatcaaaggaagaaaacccaatcagtgggagaaaaacgaatcgcaatgggaaaaagaaaatgggaaattccatcaaaaaatcaaataaagcattgtttaggaaacaaattagggaaaggaaaaatttaattgaatgttttaagaatgtgttttgccgttatttttaaaattaaatttttttcaatgaatttgattttactttgctttttaggattaagccatccagcggcactttacaacagtttcaaaacaaaatttattcgtctattaatatacaaaaatg

SEQ ID NO: 113547 - DNA, 220 bp, Heterodera glycines
  Promoter: Source sequence=SeqID_41414; Location=1..220; Strand=+; Gene=SeqID_69537
agcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatg

SEQ ID NO: 113548 - DNA, 1003 bp, Heterodera glycines
  Promoter: Source sequence=SeqID_1569; Location=1951..2953; Strand=+; Gene=SeqID_74498
ctttccaaattccattcccaccatttttctttctttttaaaatcagttcgcttcattcaaaagtttaaaatcccacggtctctccggttttttcgagaaaatcccgagcaaatgccacttttttttggtgttttaaagagctttttttgctgcccattttgttctccctctgtggggaaattcgtcaacgacgcaaatttaagagagaaaaaggacgaccaatttttattggacgggaaaaacgaaacgaaaaggaaacgaaactgtgcggcggcggcggcggcggcgccctccgccgtttgcctctcgaaaatgatactgaatgactgctgctgataataataatgataataatacgaatgaatgaatgtgtgcattttgtgttgtgttgaggcaaatcaatttattattatggttaaaaaaaggaaaagagagagaaaaaagagaaaagagaaggaaaaaatcatttcgaccaaaaataaatgggaattattggacaataataaataaaaaaagaacaacattttatttgtttaatttgtatacaataaaatgacaaaatatacatcattattttatacaaaatgtgcattgactgagaaaaaaaggggggggggggacggaattgccgggggccgggggggggcagtgtttattctgtcccctttattctgtcccgctccctccctccgccgttggctccgctccattcgctcgtcccattccccccccccccccccactcttcagctgattgtgctgcgaatgcttatgattatgatttgatgttgttagtgattaccgttgatttgagtttgtctatgtcaactaaaaaaaagaaagaaattattaaaaaacccattttacgatttgatgacgcattttgatacataaaactattacttaaatcattataattatcctgaagcctccccattttctgcccttttttattgattgttgggattgcctaagcgatcatcgacggatcgtttccaaagatg

SEQ ID NO: 113549 - DNA, 52 bp, Heterodera glycines
  misc_feature (13)..(13): n is a, c, g, or t
  Promoter: Source sequence=SeqID_17084; Location=3361..3412; Strand=-; Gene=SeqID_81513
ggaattcaatganatgcaattaataattggcgattgcaaattagatctaatg

SEQ ID NO: 113550 - DNA, 553 bp, Heterodera glycines
  Promoter: Source sequence=SeqID_21000; Location=1..553; Strand=+; Gene=SeqID_51575
atattttgacagtttttagtccatattttggtccatatttggctatttttgagctttttagtccatatttcgggcttttttagttaaattatttaatttacaacaaaatcaacagatcccttttttgtatgcaaattcgacaaaaaatgccttagcaaattaatttaatttttaaattcgcgaaattgtttaaaaagtttacaaaattttttgtccaaaattttgtcttttattgcccttatttgctcatttagatcctcaaaaattatacagtttctcaaaaggttaaatagatttacttgtaaaagattagtagctaagcacaaaagcagtaaaactgaaaactcatttattaatagaacaataaaacaatggaacaatcttgactctgaaattacggcatcatcttccatacgtagttttaaaaacaaagttcttaatgggttaaagcccgtaaataccataaaatatttacattgcatgagaaaaatatttttgattatttataactgtgtttcgttcgatgcttgtgatctgactttattttttcatg

SEQ ID NO: 113551 - DNA, 308 bp, Heterodera glycines
  Promoter: Source sequence=SeqID_8819; Location=1..308; Strand=+; Gene= SeqID_69321
ttggcccttctccttccgatcattttgctggccacaactttgaacccgctttaccagcacatccatccctacctcaaatagtcagtctcgaaattttaatagtgaataagtattttaaattaaaaaagcaaaaatttaaatcgaaaatttgctgctgccttttgttgtcagctattgtatccacgccaactaacgttaattgtttcaaaatatgtttttaaatttaaatttgttcattcagtccgctgctgcacaccggtaactcgtcgcccagtcacgacgcgttcgccaccgacatttacgcgatg

SEQ ID NO: 113552 - DNA, 258 bp, Heterodera glycines
  Promoter: Source sequence=SeqID_3186; Location=3874..4131; Strand=-; Gene=SeqID_83587
actgctaaaatggattggtttgaattgagtgaaaaagactaaatggcacatttaacactaattgcattgcaaggaagtgttcccgggtcaagaacccaaatttctataaacttaaaacgattaaagtaaattgttaataagcaagcatttggaattttggtactttaccgtgcaattgttcgttccattcattgcccaacaatatttcaagccctcattgggaaagagttctggagtaatattttgcaggtaacaatg

SEQ ID NO: 113553 - DNA, 808 bp, Heterodera glycines
  Promoter: Source sequence=SeqID_11915; Location=524..1331; Strand=+; Gene=SeqID_75427
actgcaaattgaccaaattgtcgaaaaattcactcgtcgaaaaaaagaaaagaaaggaaaagcagcgagaagaagcgacaaatacacgcaaagaagaagcaatggaagttaatgtgaggcaattccatttttggagaagggtggcggtgatcaaagaatgggagaaggggggcacaaatggagggggggttataatagggagtttcttaaatcccccaaggggtaggaaaacaaaaagtgttgtaacgcatatacctaaattcataacttggctcatttcaaccaaattaatattttaatttaatttaacattaaaatgttatattttgccatgtcaatgcatgtataattatagtcattttaaaattttaaagttattaaaatgtaattgatccaaacttattttatatattcgatattccaaagaattgtttaacttaataattaaaaaaaattaattgattttcaaaaaatatggccaaaaaattctgattaatgcttatttgaattatgtatatatatttttatattttttgtaaagaaatttaaataattatatattaatttgcaataaaatgttgaataatttcttaaatactaaaaactggtcgcaatcgcttttctgtgcttttattatgcaataaaggcatcatcttgccaaatgtcaatgggcgagaagccgacgacggtgaataaggcggggggggggacccatttttggacaaaattacgctgtgagcataaaactagtagcgaagcagttgaatgccatcgatttgacataaattagcaaattaaacagcaaatg

SEQ ID NO: 113554 - DNA, 996 bp, Heterodera glycines
  Promoter: Source sequence=SeqID_7381; Location=1237..2232; Strand=-; Gene=SeqID_64663
tgcagatcattatcagcataagcataattatcatactccatttagagttagtacaggtgttgatgttgttgttgttgttgctgctgtttttgtcctacggcggcggtggcggatggacgaatgggaggagttaaagggggcgtggagcgagaaaagctgagggatgaagcagcaaaaaaatggacgaaagaatccggatgaagtagtgaagcctaaaagcaatcataatcaatcagtagtcagccagcaggtcccccgcttctcccccgtccccgccccgttcggttgggcctctgattggagttgccctccccctatccctccatcggcttctcccccctataaatagggagggatccgtccattctgagactcagcaagcatcagcagcaaaagaacacatagcacacttattccaatcccatagtggggctaataagggccaattaagaggaagaagcaaaaagggtgcctccgccaaataccctcggggcaaaaaacacagcgcgcacttttcccaattccaacaagtgcacatttatgtggagcaacaatgtgtacatataatcctgataatcttttttattttttaatagggctaataaaatcattttttgaatttcctaaaaaaacaataaattttgtttattaatcttatcaataaatttaattttctcaataatttctttaatctttctcaaaatcttataatcattatttgggacatttttgttatttctttttcatttaccgttacaatatttgcccttgaaatactgtatcatcgattactgtaattttcaattaaagcagccgtccgtccactggttgggaataaaaaaaaatcctccttttttaatgggtcattaccatattgaagcttccatcatgggacattattaatgagcgtaaaaggcgattaattatccttaattatcccttcaaaggcgggctaatccattgattattataaaacaaccggtgccacacattatg

SEQ ID NO: 113555 - DNA, 415 bp, Heterodera glycines
  Promoter: Source sequence=SeqID_8236; Location=1576..1990; Strand=-; Gene=SeqID_67401
aaaatttcaaaaaaatgaaaaaaatggacctcctcactctcaaaataatttttcagataccacacattttgaaagccaaaaagttggttggaaatgatgagcttcaactgtttgcgtcgccatggtagcgaaaaaaacgaaaaaaaaaattttcaaaaaaaatttacaataaaaaaactctccaccctccccccattttcaaattatatattttttaaatgcactgctaattccgaacccttcgacaaataaggacaaaaaatgcttgaaatttgcaatttttgaaaacctaaccctccccttcgccctaaaatttaagaatttttgaaaaattaaacccttcagcccttccctcccctccctccccaaattggacaggtcggcgccggcatggatgaaaaacacgggcagaatg

SEQ ID NO: 113556 - DNA, 72 bp, Heterodera glycines
  Promoter: Source sequence=SeqID_3261; Location=5518..5589; Strand=-; Gene=SeqID_83951
ggtaaatagatattacctgtgaataatatttgccttaaatagctcaaatataaattttaaactttaggcatg

SEQ ID NO: 113557 - DNA, 1003 bp, Heterodera glycines
  Promoter: Source sequence=SeqID_5145; Location=708..1710; Strand=+; Gene=SeqID_57072
tttttaaatcgtaactagaacattttaaaattagatgaaggagttagctcgcttaattgttgaacttagtatattcgtattaataactgaacatataaaacttcaattcgtttaagaaaatgacagttattctgtttaaaacattaataagccttaagcatagccttatgaaaattctcaaaaacaaattaaaaatttctcataaaattttggcattaaaaaatttctaactactttttttttcaatatcattgtagaactgattgcaattcaagtaagcagtttgatgagtgtgcgttctgatcagaaaacatagcaaaaacttttcaaatccgatcccgtcaaaatttttataataataaaaaaattttctgccaaaaatcacaaaatttctctcaaaattcaattcagtgctgaatgagtggtgaagatggggcttaagcctccttactaatcagtgtgagaactctgatcacagcaaaaaaaaagaaaacatactttttgcccccccccctccccttaaagcgttggttggttggagtgcttcatcatcgcaactccactttaaaaaattgtctccaataagtctcccccaagcccccggccctgggcttcatccctcccattcatttggcccccaatgtttgtccaaaatattttcttgacgacgacgacgacgaacgctgcggcgatggcgggaggacggaatattcagaggattttttggggggaggggggccaatggttgggccttaagtaaaggctaatgtttcaggcctagccaaatccgcttgatcgattaaggccgaattaaggagggcaaaccaaaaacaaagtacaaacaaaacaatttgccaagtctcgcactcagtgctaacatgttttggaattttgattaattaaaaatttgtcaagcgaggcttgtaatttgccgagactcgagactctaattaagttcatgatttaaattttgggcctcgagaaccgtgcttttaatggcatg

SEQ ID NO: 113558 - DNA, 697 bp, Heterodera glycines
  Promoter: Source sequence=SeqID_12920; Location=2549..3245; Strand=+; Gene=SeqID_76669
attcatttgttttgattgtttttgtctatcatttatcattatttaaacaatttatttattgttctttatttgtttatgtgcgtacacttggtcggagtccttactccccagtgtttcattcatgcattaaatttctgttttatttattttatttgttttggacataacacttggttggagtccttactccccagtgtttcattcattcattcatttctatattttgttctctcatttatttattttgttttgttcacaacacttggtcggagtctttactccccagtgttgcattcattcatttatgtttatgtttgacaaattgcatttttttgttgtatgcacatacacttggtcggagtctttactccccagtgttgtgtgttttaataaaattttttaaaaagttagttctcatgtttttaacactacaaatataaattgttggtaggtgggtaggtcttgcacatatgagccacctcatcgtggtgtgcaagtctagtagccaacaacaaaaatatattgttggtgaagctaacggctcattaggcacaaataaaccacaattttacaaaatctgtttcaatataattttaaattgtttttcgttttctgcatctccccaaaatgttttgctttttttatgaacaataaattttgttaataatttttatataaaaattaagctctaaatatg

SEQ ID NO: 113559 - DNA, 212 bp, Heterodera glycines
  Promoter: Source sequence=SeqID_37721; Location=412..623; Strand=-; Gene=SeqID_66718
tctcgcctaccgacatttcgcctactaaccaaaaaacattcatttcgcctactaagccaaaaacattcatttcgcctactaagccaaaaacattcatttcgcctttttttatgttttgctacctaaaaagcgttaataaaatttttggttctagtcggttttacgcgtcccatggcattttacgcgtcccatgacattttacgcgtcccatg

SEQ ID NO: 113560 - DNA, 193 bp, Heterodera glycines
  Promoter: Source sequence=SeqID_40622; Location=1..193; Strand=+; Gene=SeqID_68896
tcatttatctcattatttacttctttttcccaactttgtctctttttctgtcatttgtcgtcgtccactgattttgttgccagtaatttcattcattaattcatttttattgtttattttttcagtgttatttaatatattttgaaaatgaaaaaaatcttaattttagtggctttttcttataaaaaaaatg

SEQ ID NO: 113561 - DNA, 82 bp, Heterodera glycines
  Promoter: Source sequence=SeqID_12243; Location=2903..2984; Strand=-; Gene=SeqID_75815
tttttaaattttataaataaaaaattatgcttttaaagttaaaaattttcattaatatttttctgttacgagaaaaaaaatg

SEQ ID NO: 113562 - DNA, 1003 bp, Heterodera glycines
  Promoter: Source sequence=SeqID_10411; Location=1311..2313; Strand=-; Gene=SeqID_46866
gtttggaatgaataaatcagcctgtttgcccctctcaaaagcccacccccaagtcccatcatttcgttgccggaggacatttgttccttcctcaaggacacatgcgcagagcgaagaatgcaaaacaaaatccgtagatggtgggaggatggggcgggtgctagatcgtttcctaaaaaccgcatgtggtaggaaaacaagaaaatataagacatataaattcgtatcttggcccaatttcaaccaaattaatatttatgggtgaaaaaggactgtggaaaacgaaacttggaatttgtgtgggcaatgcgcatgtgtgttgtgtggaagaacgggtgattaaacggggagaagaaccctttgtgctgcaagtgatgggaaacgaatgaatggtgttaaggaggggggagggcggttggagtggaaggaagtgacgaaacactggaggagaaaaagcactgtcaccgaacttgtttggtgacgactgactaactgtgtgtggtttgcggttgctcttccgcctccatttttctatttcgggggcgaccgcgcccctttttcgagagcatttttgaaaattcacaaatatttcttttttgcttatttaaaaaaaattctttcgttattttttttttctttctaaaatgctttgagtttggtactgtttcagcggtacaaaaggcattgacccgtttcaacacatgtttcgaaaatatatttaaaaagaagggtccaatatttcctctgagtttaaatttgaaaataaaatcgacttgatttttcattaaaaaaattttaaatatgccattttttccacagggttcgtcttcttttggggccttgtgttcctcgtcaccaccacgttggtgttcattttcaagcatgaaattgaccactccgtcgtctcgcaaccgcacgagtaaaaaaaaattttttttttgcctaatttccccatttttgacacggtttaaggaaggccgaaaatggtcaccacaatccgatg

SEQ ID NO: 113563 - DNA, 1003 bp, Heterodera glycines
  Promoter: Source sequence=SeqID_16336; Location=867..1869; Strand=+; Gene=SeqID_80724
ttctaagatttttttcttgaaaaatttctaagttagcaattttttttttttaattttctcgggggggaaacgattcgggggggaaacggcgggggggaaacggcgggggggaaacgaggtgccctcaaaaagtttgcctgccaatttttgaatatttttttcgtcgggacaccaattcttgatgattgccaatttggcattatgcaattttcgagtctgggacctagaacgatatttatatttacctaggagactattcaatattttgtccgtgttttagtcccggtcccgacctaccctattctatatgtaaatgaatacatagtggtgttaaaaattattggttttatctgattattagggatgcaacttttagtgatttaactattttttctgctcgattcttttgaagaaaggagctcaaaaaacgcatttctgcgttaaaatttttcgattcccgcccccggcgggggtgacgggggcggggtccgaaccctaatttcaacattttttggaaaattccttaacaaaaatgcaataaaaacaaaaaatacacccctaagaatcgaccaaaaaatttttttaaaatagaccactatgaattgaaaaattttttcaaaaattcttaccccaaatttgttttcttgacaaaatttttgatttaaaaaatgtcaatatttgctaagagaattttataaaggaaatgtagcacatttgcaactgcaatcagtgaataaaaattattttttgctcaatttttggctgaaaattatgtaactatttgccactatttcggaatttttctcactatttgtcactattttagttaactatttcgagatttttcatcactaaaagttacagccctactgatcatcccctcattttttaatccatttgaaataatatttatatttttttttcgtttaaccaaattaaaattttttcacagtccaaatttaattgtttttttccattctttcagctgtcaaaggcgaagatg

SEQ ID NO: 113564 - DNA, 882 bp, Heterodera glycines
  Promoter: Source sequence=SeqID_15058; Location=1..882; Strand=+; Gene=SeqID_79230
tttcattgcggagagtgaaaatattatctattatttattttttcaaaaggaggctttttgaacttaaattaggcaattaaaaattttcacttgacatccatgatttgagcattaaaacaaatatttttttttctaatgagcaaattaatttttgctttttttatattattttgcctaatttttgaataggttccgaaaacctggcattcattcctttttggtggttttgccaattttactgtttttcatttaaatgtcttattatgtattggccctttacaatgggcacttttaaattttatcccaatgtttcttcgtcgtttcgatgttttataattttgcattttttgccaaaaaaattcttaatgaatttttccactattttctttttcttttttctgctaaacttcaattcggttcaaccatgtggttggctgaaaaatgggcccccacggtgattcaaaggccaatttggacagactcggcaagttacaatggcctggtcagtaaatgaataattttgaattttatttaatctaaattatggtgacatgacaattcgtaccaaagcgtacttgcgccaatggtgtttcattaattttttaaaatttttatgcattattttgtatgagttgatgttgaccccatcttcgtggcatggcgcatgtgaaattgttatttggggacctctatatttaataattcattttaactcaaattgacaaagttttaaattaacttaattaatctcaatcattgaaaagcaagaatgattacattacaactgtcttagattaagatttgcttgtttttccttttgtacgggtgttaggaggttgctctgccaatggtcccatttcataccattagaacgcaacgatg

SEQ ID NO: 113565 - DNA, 390 bp, Heterodera glycines
  Promoter: Source sequence=SeqID_2385; Location=1664..2053; Strand=+; Gene=SeqID_79466
aatttttaaatgtttgacccaattaatcacattatttggtgtcggattatttatcattcattagtcattcattcagtcacccatcaatcagcaccatcaacatcatgctttcatttaaatttattaaaattctttttacaattccatccaaaatcaattaaaatttggttttttctgacgggtgcacttcgtttcccctcctctgaattttttttttaaatttccagtaaaagtattaattgattaaaattttgaaaaaatgctaggaaatgtttaattttgttttcttcaaattttctttaaaaaagtgtttgtttctccattagcttgcaaatttaaaaaaatttcgttattgttttttccttcccaccgcagggattgcccacaatg

SEQ ID NO: 113566 - DNA, 761 bp, Heterodera glycines
  Promoter: Source sequence=SeqID_27293; Location=1..761; Strand=+; Gene=SeqID_57975
tttttttaaggagttctctgtcttaatgtacaattttttgatcaagaaaatctcatccggcataattttatatttacgtttattatctcgagatcatctgaaaaatatgtgataattgaaaatgttttttctttgtcaattgctttttatgttgtttattatcgtttattttaatgtaacaaatcaatacaactgtaatttgtattgtcctgggaattatgcagaagggtaaagttaatcataatataaaataaaattagaaacattttttaattgtcacattagtaaaataattaattttttgctcatttctcatgaggggagggggggggggaaagggtggaggagggagagctggtcccgattttatatttttaaactttgtgaaaccatttggttggcatccacgaataaatgaaacggtacggatcaaaatcgccaatttaggcgtaaattttgtcctggacaagaatgtttgttacgagcagccacataccggtggacaaacaaaccccttttggcccttaaattgaagtaaattgagggggtggaaaatttttaaatttcgtatgaaaagacaatctcgattgggtaatgtcggaatttttgaaaaatgcatcggagtagctagccataatcaatagtctctatttagctggaaaattataaaaaattaaaaaattcggaatcttgttaaacatcaaaaccaaatgtatcaaatttatgaataatcgcacatttttctgaagcacttcaacatg

SEQ ID NO: 113567 - DNA, 103 bp, Heterodera glycines
  Promoter: Source sequence=SeqID_35139; Location=820..922; Strand=-; Gene=SeqID_64771
attcaggaatctatatttgaatgttcacgctaaaaatccctattttgagtgtttgcccctaaaataatttttttccccttattttggcatttctcttaaaatg

SEQ ID NO: 113568 - DNA, 537 bp, Heterodera glycines
  Promoter: Source sequence=SeqID_26465; Location=258..794; Strand=-; Gene=SeqID_57197
gaaaagttttgaggagtttttaacaaaaatttaatttaattttgttttgattttttttctattttttaatttatcttaacattggggaaaaatattttaatttctaaaaaaaattttcttggaaaatcccagtttattcccgatcgtaatataaatcgaaaatttaaaaatggaatatttttcaaaaaatagtaatagagaaaatgattatttaacattaataattttgtttactgaaattaacttcataaaacattataatttagtcgtaaaactgaaaactttttctaaagcaaaaataattttcttgtaaaattaaatgaaaaacgtttcggcactttcgtgcagtgtttagttggaaaggcacaattggattactgagaatttgcacatggcaattattaaaattaatttaacgcgaatgaaagtgaaaagcgcacaatggcatttctttctttccaagtaaaaaggcaaagcgaaagcatttggcacggaaagaacaggtgaaaaaaaaagtaaatgaaaagtgtaaaaatg

SEQ ID NO: 113569 - DNA, 1003 bp, Heterodera glycines
  Promoter: Source sequence=SeqID_8021; Location=1415..2417; Strand=-; Gene=SeqID_66725
gaaaacattaaaatttttcaaaaaatttcattacatttgatatatgtacaaaaaaaaaaagttaaagaattttacttaagaacattataattattagaattaaaagaaaaaattaaaatttgaaatttgaaaaagattaacaacaaatcatccaaattcaattgtgatttgctttaaaaaaggccaataaattaatattttattaaagaaaaattagtttgtaattaattaaaataattgccaaatttcaaaaaaaaagaatgagcagaaagaggcgaaagaaaaatatgataaagcctaccaccaatatcattatgatgatggatgcaacgacaacaaaaaggcaaagattgaatgggaacgaaaaaagaaagaatttaagaaaataaaacgcaaaattaaaacgtaagaatttaaaaataagaaaaaacacataaatttaattttttaaaaaacctaattattttctttttaaaattttttgagctgtcataattatgcataattagtgccaatatttttaggttttagcttattttttccagtgttaaatagcctaaagcgccacgaaaaacaagtttttttttgtgggttgttaagctacttttcgagttattcatttttagctaaacgggggttttttagagcctaaagcctagctattttggctttttagagcctaaaaatattagccctaattataatatttttttaattttgaattttttaattaaatttgacccaaataaacaaactttactaactataattcttttctataagctaaaacgagaaattttatttgttttggatggataattaattatattatattaattattttatttctcaacagtttgctgtttttggcgtttttgaaattaaaaaaatattttaatcaaaaattattatagatttccgatcaattttgaattcatatgcctattactgcttaattgaaataaattaatccaaaacccatttaaaaaaaaaattttcaatg

SEQ ID NO: 113570 - DNA, 99 bp, Heterodera glycines
  Promoter: Source sequence=SeqID_12505; Location=1..99; Strand=+; Gene= SeqID_76143
ttcctaatttcactcatttttcttggtaaattgactctatattttctaaactttccccggcggtgcctaaagactccgccggatcccaattttcccatg

SEQ ID NO: 113571 - DNA, 206 bp, Heterodera glycines
  Promoter: Source sequence=SeqID_10379; Location=1247..1452; Strand=+; Gene=SeqID_73569
tttgttgtccttggcagatggagttcagtaatgtctttgcaattccaaaaatcgagcgaaatgacggagtgcgacgctgacgaccaatccaagcgttttcaaggtattcaagaaaatcctggtgccgttgagtgtcgcaaaccggtgaatgaacctttctgccaggtcattaaaacgtgccacaacgtcatcaatttcacaaaatg

SEQ ID NO: 113572 - DNA, 460 bp, Heterodera glycines
  misc_feature (9)..(9): n is a, c, g, or t
  Promoter: Source sequence=SeqID_43981; Location=1091..1550; Strand=-; Gene=SeqID_71537
ataaaaatnttgaaaaaaatcctattagttttggaattcttctaatttcgtaaaaaaaataaaccaaaaatttcaaaataattttattatctagaaaaattaaattaacgcaatttgccgacccttcttcgtttctcattttgatattaattaattttttcattttaccaattaatgtcactcatcgccacttttcgataagaaattgatcgttttccgcggtccgcttttaatttgagcaactttaattgatataatgacttgtgatctggtcagtcagtaagcactggattgtgtgaatgatcacaaaaaagtcatcagtccgttcttatttttaaattgtttccttttttaatttttttttttttaaaacacaaataatttatttatttaaatttatttttaattctcgatgattaaaaataaaactttcaattataatcaatcaacctcaacaatg

SEQ ID NO: 113573 - DNA, 295 bp, Heterodera glycines
  Promoter: Source sequence=SeqID_15325; Location=1..295; Strand=+; Gene=SeqID_79562
tttaaatggttattttttgggaaaaaaccttcgtaaagtgttaaataggcgtaaaatggcataaaaatgacctaatatatttataatcaccttttaacatttaaaaaattatttttggaggggtacatttaaaaaaagtttttttttttaattttttcactagaaatttctaaaaattttcaaaaattctcaaaatatgtataaaaaaataaaaaatttgccaaaatccttccgtttcttaaccctatatttaatttctaaatttcaaaggtcacagcaacaagcacaggaaatg

SEQ ID NO: 113574 - DNA, 891 bp, Heterodera glycines
  Promoter: Source sequence=SeqID_22176; Location=1079..1969; Strand=+; Gene=SeqID_52839
tttgatatggttatatgtaactagaggagcaaacaaatttagagacttagtttttgaaaaaatggaattcttaagaaaaatgcaccaaatttgtggaactcgacaagtatcattaaagcaaaatgcgttttatggaaatcgcaataggtgcctaaatatgtagacaccaaaatgtcaatccctaaacgctatttcggaagccaatttccaatattttttcagccgtcggaatgccgattttcgaaatttttgcaaaaaaaaaagccgaaaatttacaaaatgttcccttgtaagttttgatcaattgtatattggctattaaaatttttgaaaagaaatttttttcgaagcaatgttaaaaaacaaaatgacgcacaagacatggacggtaaaaaacgaaaaaaattgccaaaaaataattggcgtaaaacaaaacgccaacacacgcaaaaacaaagtatatgcacttacactggtaaatgccttttttgtattttttattttgatcagccataacacgcttcattcccaacaaaagtgaacaaatttgatatctaaaaaaagattttgaaaaggagaatctttttctaagtgaatgctaagcaatttgacatctcagaaaaaagttgtgatactttcaaatttttatcacgttataactcaagtcctaaactgctgttttcaccaaaaatgctaaaactattaatttctctattaattctaaatgtcctaagcgattttgtacccttataaccaaaattattagaattttcgaatttatgtttttccatgtgttagagacatgaaaatagtacgccaaaaagagagaaaaagtaatgcattttcatgttttatatatatcttttgaaaaagtgtataaaacataaaatg

SEQ ID NO: 113575 - DNA, 592 bp, Heterodera glycines
  Promoter: Source sequence=SeqID_2779; Location=2988..3579; Strand=-; Gene=SeqID_81545
cgttttattaaatgtgcataatttttggttttttaaaggccgaaattgtggtttttttgaatcaaatcttccaaaaattcaatataaatattaaaaacattttactgttaataagaatggtttattgcttttttgcgaaaaaatataaaaatttaaaaaaaaaccgaaaccgaaacgatataccgaaaatttttcttcggtttttttaggtttcggttttttttcggttttttaaccgaaaccgacctaccgaaaattttttgagtttttcggtttttataccgaaaccgaccgaccgaccctcttgtccggtctctagttaaaattagaattttaattaatggtgaaacagtttttatttatattattattattataaaattattaatttcgatcattcagtagagagaaaaattcactttacaatttaatggatatagtgatcctgtcaatattttaccattaatgtaaatttataaggaagagaaaaattcatttttgagaaatatttttattattatttatttctttttttcatatcgaataaaatataaattttaatttttaagaaaaagaaaaattgtcaacaatg

SEQ ID NO: 113576 - DNA, 106 bp, Heterodera glycines
  Promoter: Source sequence=SeqID_35311; Location=1..106; Strand=+; Gene=SeqID_64888
gcggtgccaatgccaacaatgggataaatgcagaaatggtaagcaattgtaattaaattttcaaaatttaattatttttctcattttgttttaaggcgatgcgatg

SEQ ID NO: 113577 - DNA, 936 bp, Heterodera glycines
  Promoter: Source sequence=SeqID_11522; Location=799..1734; Strand=-; Gene=SeqID_74947
cctggaaatttttttttgagattttggctaattttttaagaaaaatttaggtttttggggggccagcggtgccaataggcgccgccggaggaaaattttaatgaattttgttaaaaaaaatggccaactgatttgtcaaaaaagtcggtcgattgtttcggttttttaattatttcggtcgaacggtttcggttaaaaaatcgaaaaaaaccgaaaccgaaaaactcaaaaatttctcggtcggttttttcggttaaaaaccgaaaccgaaaatcgaaaaataccgaaaaaatcgaccggtccgatctctaattaagacctcctatttattacttactgaaaaatataattacaaaatttagttaattttttaattttttcacgcttaattttgcgcatgaacattttttttgcacatttcattttttccaaaatttaaaacatataaatatggacaaaagtctcaaatacagaaaaatattgaaaaggtatcttagaagcatcaaatcaagctaaagacactttttttcagaagcaaatagattaaattttctttttagaatttcaagtactctatttattctatttatctttctaatttcaaaaaatttcattgaggttcaaaaaagttctggacaaaaaattccgacttaaggttttgtggaattttaccatatctttttatatacttaagtaaaaaatttaataaaattatattctgatagaaaacacctagagctattgaatgatacgaagaattattaatttggttgaaaatggaccaagttatgaatttatatgtcttacatttttttgttttcctaccacatggcggtttttaggaaacgacccagcacgtcttagaagcatcaaatgctaaagacacttttacgtgaaaatgtcaaaccaatctaaaaatactatttacataaaatg

SEQ ID NO: 113578 - DNA, 471 bp, Heterodera glycines
  Promoter: Source sequence=SeqID_27436; Location=284..754; Strand=+; Gene=SeqID_58132
tttccttcaacttcacttcgccaacatttgctcgcgtacatacatacacatattgattttcattcacatttttcttctcgacaatattcctttgtttttccgtaattttaaattaaaaaaaacatttttaatcatttatttttaaaatttataaattaaatttatatgcattcattaattaatagggattccttttttaggcacaaaaaacgcaaataggcaaataaaaatttttattttgtctatatttcattgcaaatgaaagtaatttaaatatttcaacttttttttgaataaggccaatttttaaataaaaaattttatcaagaaaaaatttctaaatttagaggatcaatttcttggaaaacttttttacttcttaggcgtttattgtaaatcttaaaattattttatgatatatacgcgacgcattttacaataatagatttcaattaaattaacctgaaaatg

SEQ ID NO: 113579 - DNA, 1003 bp, Heterodera glycines
  Promoter: Source sequence=SeqID_14206; Location=437..1439; Strand=+; Gene=SeqID_78219
caaagctttaagaaatcggcaaatttaattcaaaaattgtccagtgccttttacacagctggggacacccactctcattttcatgttcgttgtgttacctttttctaatcattctaaattcaaatatcttttttttaaattttgtacctaaatttcttaataaatttatttaaaaaacctatggattttccttggtggtgcttgtcgaatttcctaagaattttaccactaattaaaggccagaagatgacctcttcaaagcacactgacaatctacattgtctaatatttacattattattaaagcattctaaaaataaataaattttccaaaattattgcttcctttcgacggattgtaaaatgattccattccggtcaattaagcggttagtgaattttcccggggatttcgttaattcggaatatgtcgctgtgtttctctctgaatttgtccttttgttggtgcttgttaattctgtccattccttcacagaatctttatttactatatttatcagttaattattggaattgtaattccttttttccttggcctaacaaaagtaaggagcatttggcctgggagaaagacactattaactattagcacttatgttatcgcctctatcaattaattatcctaaatcattttgtaacgtttgcattgttaaaacaaatgtattttattacttatcattgtattcctcgtttattaacacaaatagcaaagcattcgattgataaaaattgggccatcagataaataaaatttaaattgatttaaataaaattcattgaaaagttaattggaaagaaaaattacctaaaaatgtttttaaaacggtaataacttctcgacgtttctctattggctcataatttgtacaacattttctattattccactcccaaataagcaattcgttattatgtccaatattcgttcaatttcgacgccaaatgcgcccgcggcgattgggccttacaggttggccaaatg

SEQ ID NO: 113580 - DNA, 133 bp, Heterodera glycines
  Promoter: Source sequence=SeqID_37102; Location=544..676; Strand=+; Gene=SeqID_66263
ttttcgagcgtccatccaaaacctgcaaacatttcgcattaatgtgacaaaatgtgaaaatgtgcaaaaaatcggcaacgatatttctaaaattgtttttcccaattttatttttcgtcaaatttacaaaatg

SEQ ID NO: 113581 - DNA, 97 bp, Heterodera glycines
  Promoter: Source sequence=SeqID_44948; Location=290..386; Strand=+; Gene=SeqID_72354
agtaatttctcataaatattttttctttcattttaattttaattttataaaatttaatattattttactaaatgtttatagttttataattattatg

SEQ ID NO: 113582 - DNA, 114 bp, Heterodera glycines
  Promoter: Source sequence=SeqID_17742; Location=1150..1263; Strand=-; Gene=SeqID_82280
ttatttaattattttaatttaatttaattattttaaattgatttaattattttaaatttaattcacctatttttcattgtgaataatattttgattatttcagttcgaaaaatg

SEQ ID NO: 113583 - DNA, 1003 bp, Heterodera glycines
  Promoter: Source sequence=SeqID_11843; Location=173..1175; Strand=+; Gene=SeqID_75345
aatgccaacaaaaaaatatgattttttattttttaaataaaaattccaaaaaaaaaacaatttaagttaatttcgacattttatgggtggcaatagagcattttactaacaaatcaataatataattcatatttttttcagaaatgatgaattaaaaatattctatatttccttgaaatcaaaaatttttatgtttttggcatttttatataattttttaaattttctggcatcagcaggagttaattaaatatttatatattaattaatttaacaatacttttggagttttattggtaccaaatgactaaaacttaatataaattgagtatttttacttagtttttaaaaattctttgtgaaaggtttccaattttctattttttctctaagtaaaaaatttatgtgtttttcacttttttataattttttaaattttctgtcggtaaggtaaaactcttcaattcaattattaaaattgaatattatttcataaaattaatttaaaattataaatataatttttattccaatttagcttttaattgacaaagtacagcaaaatgagcgaatttcattgacaattttggcatcagtacaaagtcgcgcggacccaacagtttggctggacgggcccatctcaacacaggcgcattttgtgcttttggcagccggtttaatattttatttaaaaaaaactaattaaataatttctttttaaaatttattattaatgataattttaattttttaaattttatttataatatttaatttaatttttataatttttttttgaatttttttggatagtttcacgataaaattcaaattttaaaaaattaattaggattcattaattttatttatttaaatcaattattttatatttaaaatagtttcaatttaaataattttttttttttgaaatttaattgaatatttttgataataaattaaatcattaatttattttatttatttatttttaaggttggaaatg

SEQ ID NO: 113584 - DNA, 128 bp, Heterodera glycines
  Promoter: Source sequence=SeqID_23561; Location=1..128; Strand=+; Gene=SeqID_54247
ttagcattgccaaatagcagaataaaacacacattttcactaactgccgcagcaacttggaggatgaaacggtcaagccaagttatcgagcgaggcctcagagaattgccctcgagaaagcccaaatg

SEQ ID NO: 113585 - DNA, 320 bp, Heterodera glycines
  Promoter: Source sequence=SeqID_27608; Location=925..1244; Strand=-; Gene=SeqID_58288
attaaaaatgaattgaaaaatgtgaacgaatcatttgaccgtttggtagtcgcactgatgaacatgttgacgagcgcacgaggcaaatggtggacatcaaacattaagaatggggaaaaacggattaagggcccagggaaaaaaccatggaatgaccattttttaacggcctttcccagattaattcgaaaaagtggctcccattaaagcaaaatttatgaacaaaaagagtaaaattaacaaagctagagaccaatgatcactgccaatttttttctgtctgcgacagtcacccaattcgctccatcggttccataatg

SEQ ID NO: 113586 - DNA, 183 bp, Heterodera glycines
  Promoter: Source sequence=SeqID_7907; Location=417..599; Strand=-; Gene=SeqID_66336
tttcggcgtcattcagcgccttttatagaaaaaatgaaatggtttttccgcaccggaaattctgcgtttttcactaattgagaaacattggattataaatagataaatttatgtacatatatacacattctttcattaataaattcgatttcaaactgatatttggcctataattcagtgatg

SEQ ID NO: 113587 - DNA, 59 bp, Heterodera glycines
  Promoter: Source sequence=SeqID_10502; Location=1401..1459; Strand=-; Gene=SeqID_73726
ccttgggaaaagaaatgtttttttttaaattaaaacaactatttttaaattaaataatg

SEQ ID NO: 113588 - DNA, 166 bp, Heterodera glycines
  Promoter: Source sequence=SeqID_13166; Location=1215..1380; Strand=+; Gene=SeqID_76987
gtttttggtttgtgaattcgacgaaacgaaacattccgattttgtgcctccgtttcgatatagcaattttaatatgctcttaaatagaacagagcatttgtatatcgaagcggggcattttcactttatatcaaaagaaaaatgaaaatgcatgccatccccaatg

SEQ ID NO: 113589 - DNA, 134 bp, Heterodera glycines
  Promoter: Source sequence=SeqID_428; Location=2640..2773; Strand=+; Gene=SeqID_52360
ttttgggggtgagggtttagtagaatagaggaagaaattttttatctacatatttatatatatatgtgtgtgtgtgtgtgtgtgtgtgtgtgtgcaaatacagagggacacaaaaaaccgaagaagggaaaatg

SEQ ID NO: 113590 - DNA, 706 bp, Heterodera glycines
  Promoter: Source sequence=SeqID_1636; Location=1622..2327; Strand=+; Gene=SeqID_74992
gaaatgaatgaattaattgatggttaattgatgcgattatatgaccgaaatgatatgttggcactgtgccatttcaatattatattgtataatttgcttgtatgtacctatttgtcctttgcttgttttccgtaaaattcgttcatttccattttattttatgtgcatgtgtaaaatcattgtgatatgtaatcattgttaaaaaatgatttgtgataaaatggatttgatttctgaattttacaaaaccaggcgggatattcatacaaagcatcttttttctagcattatctcttccaaataaaaatctgaacaatttaaatttaatgaaaaatttgttggcgttctattttttcaaatttttaattgagcctggttttaatgacaaaaataaaattcattttcgcgttatggccattatttttggcaaacagaccattttaatctcctccatccctttcaaatcggtcaattttgttttttttttaccaaaaaaatggccaagtaattgatccatttgagccccttaaataatattgtgccgcggttgtgtgaatttgcgcgcttttattgttgattttcattttaaattttgttgcttaaaacgagaaagtcgaaaattgaaaatttttattttattttttgcttttttatgtgtatataaagacgtcaaacagaatttttcattcataataccgcaaaaatg

SEQ ID NO: 113591 - DNA, 320 bp, Heterodera glycines
  Promoter: Source sequence=SeqID_19066; Location=776..1095; Strand=-; Gene=SeqID_83811
gagaaggtttttcattccctctgacggggagaggctgctttaagattttcggaaaattaactccctcaatttgttaattatttccatatttttgtaattttatgtccatatttagcgattttatatccatattttttcgatccctacttataggaagtcgtaatcttatttgtttatgtacaatgaacaatttttagaatatatttaaaagtttttttgaaaaaaaatttttctcaaacgcccgaataataaaaataattttttttttaaatttaaaaggagacggattaatcagggtgatgaaataacgataaattatg

SEQ ID NO: 113592 - DNA, 55 bp, Heterodera glycines
  misc_feature (50)..(50): n is a, c, g, or t
  Promoter: Source sequence=SeqID_9181; Location=2078..2132; Strand=-; Gene=SeqID_70507
aaatggcctcagtagtggtgccattgacgacaaccacactggtggtgacncaatg

SEQ ID NO: 113593 - DNA, 490 bp, Heterodera glycines
  Promoter: Source sequence=SeqID_6631; Location=1..490; Strand=+; Gene= SeqID_62272
aaattggtaaaaaaccaatttaaaatcacataatataaaaatggacaaaaatattttgatttaaattgattactttttcaatatcgcacgcataaacaacattaaagttaagaaaagcagctcttgaaatattagggttcattattcataatttgaaatgtaataattgggttttcgaattaaaaaacgaaagaaaaaatgagacaggactattgaaatataatcacatcattaacacacttatagagttttgttaatattattgtgatagaaaacatagaatttaatttaacgaattcaaataaaaaaattttacactaaattattgacaaaatagaaaatctgagtttaattaattttgcaaattaagatccctggttcctgggccttttacacgctgttttttgcgctaattgccgtgctcatccttctctcagtgctcatcataatcaatttaatcataaaaattcaatcattttacggcacaatg

SEQ ID NO: 113594 - DNA, 199 bp, Heterodera glycines
  Promoter: Source sequence=SeqID_12108; Location=1..199; Strand=+; Gene=SeqID_75669
gtcgacaaaagcgaattacgcaagtcaaagcatggcatggcggccatgtttcaaatttcctcaacatcttcacggagcgcgaccgacgggcatcaacaaaatacagcccttacgtccagcgatacatagacaaggttttagcactgaaccgaagtctgagccaatcaacaaatccgccgacatcgacaacttcgccatg

SEQ ID NO: 113595 - DNA, 465 bp, Heterodera glycines
  Promoter: Source sequence=SeqID_18463; Location=1..465; Strand=+; Gene=SeqID_83063
taacatttcataactttttttaccaaatatgatttcgaaattttataaaaactttgaacaatttttcttaataaatttcattaaaagtcaaaatttttcctcggcgacgcctacaaaaacctaattttttacatggcttgatataattttaagctaaaataaaagactaaaaaattttttcgaattttttaatcaaaattcttaaaattttgaaaaaagtccggtcaaaattttggacctggctcggggcgcccggtaaaacgggcttttttttgaccgggcggccctggcccggtaaattttcgaagcccgtccctgtactttcaaaattccgggctctagtgattattagtgggcaaattctatattattttttttctcagtttttttcgcaatttcatgtctttaaaagttaaatttattttggatagtaattattaattaattaaggaaaacagcacgatg

SEQ ID NO: 113596 - DNA, 96 bp, Heterodera glycines
  Promoter: Source sequence=SeqID_9930; Location=1805..1900; Strand=+; Gene=SeqID_72965
attaattaattagctaattaaccagcagccacccacacgccctcccataatttggcaccattacccgacaaaattgccaaaagaattgaagcgatg

SEQ ID NO: 113597 - DNA, 646 bp, Heterodera glycines
  Promoter: Source sequence=SeqID_11213; Location=1360..2005; Strand=-; Gene=SeqID_74572
atttatcaacaataagaaatgattgacacagaaattaacgaatgttattttgacaaaattttcaacaaattttatgataaaatcaccgtgaatgctgttgaatattcgacttttttctttcatttgattattcattaaattaaatcattttaaattattaacggaattatatataatttcatataaaaattaaatcacttcaataaaataataagaaatatataattaaatttaaactagggtcggtcacgtcatttaactgaattgaaaagctgagggcccaaaatctcagctcgctgagaattatcgaagatttaaaaaaaagagtaatttacacactctcaaaaaaaaattattttcaccaaattttttcattaccaggggtggcacgataaaaatttattaacaaatgagcaaaaattaaaaaaaattttcaggcaacgactccctagaactctttaatttcttaaaaattgtcatcaaattgcaaaatctctaattcaaaaaataccaaaattaatttttaaaattaatattttaataaataaaaaacattaattaaacacaatataaatagattaaaatttattctttaaatttaatttaaaatttggtaattataattttaaaattatcagccaacatg

SEQ ID NO: 113598 - DNA, 108 bp, Heterodera glycines
  Promoter: Source sequence=SeqID_17489; Location=1..108; Strand=+; Gene=SeqID_81994
ttttcgactcgcccctttttgcggtcggccgcgactcggcccttcgccggtggtgcctccgcgtggtcgaggcaaaatacagcggaacggcggaggaaacgctgaatg

SEQ ID NO: 113599 - DNA, 963 bp, Heterodera glycines
  misc_feature (42)..(42): n is a, c, g, or t
  Promoter: Source sequence=SeqID_4330; Location=1..963; Strand=+; Gene= SeqID_54076
acaccatttgaaacatatcaaagggaactaaaaaaagaaatnttgtaaaaattgaaaaatatgtacatagatttgtacaaaaaaggaggaattatatatgaaaaattatataaaattgaactaattgtgccaaaatatgtggaaattgtttttttcttttttttaaatttttataagaaattctaaaagttctaaaaaccataatttatcggggaaattttaattaaaagttcggttgcacaattgtaaatcaaacacatttcatgcttttcaggcgttaaaatattttaattgtttatcctcctaatcattgccagggcttttactttttgaaaaatcgattgttcgggggtggggcgtattatttgaaattaagtagtttcttagagttgcattttattttattgcatttttcaaaataattttttattcccaaagtgaaattgcaagttctcgagcaaatcacaacttaattaaaaaatattaggagaagtttcaaataaaaaaataaaaaataatctttaaatcattaaaaattgtgaaaacaaattggtttcaagcattttttgattttgagaacgacataaaaattttagaattttattgtaaaaaaatttttaatgtttgtatttgattttgattttttttcgtatttcgtattttatttttcgattttcaacaaccctgttttatagccattagttttgcctgagcgcatcagtatgtcacagaaattatttgaataattctgtcgaattggttttgtgtatttatgaatagataaaatttcgtttttctttttttgttttagttacattttttagtattttattttacgaagtgtgtgttataaaggagggcgatcattgggacggaataaaatcggttaaaaaatttttctgcgtccgtaatttttgcgtgagctgtgaggttacgtatcagacaaaagaacggcacagaatg

SEQ ID NO: 113600 - DNA, 90 bp, Heterodera glycines
  Promoter: Source sequence=SeqID_4550; Location=1..90; Strand=+; Gene =SeqID_45842
tgaattggatggcgacttgcaaattgcatgcatgtttaacttttagacaagttttagcgaaaaatttcgacatttttttttgtccagatg

SEQ ID NO: 113601 - DNA, 1003 bp, Heterodera glycines
  Promoter: Source sequence=SeqID_4082; Location=3443..4445; Strand=-; Gene=SeqID_53106
tctgaaacgcacgaaaaacatgtttttagcttggtttgaagcttctgggatgactttccatatccattttttccatatttttccatattttcccatttttgtccatattttgggatttttccaaaaaacctcaattagaacggcccccatcagctaaattggccttttggaccccaaaaaccggaaaattttccaaaaaataattttttagcaaaattttcacgaaaaatattgaataaatttaaatttgccgacaatcgaatgagtttttcagttcaaaatttgtaaatgtatcttatatgcaattcaaccaataaatttgaagaaattttgagaaattatacactaaatttggaaaaatttatgtccatattttgcaattttatgtccatattttgagatttttgctattttatgtccatattttgcgatttgttgtccatattttatggaatatttcgtgattttatatccatataattacacgccctacttatgagcaacttttagtgacgataaatctcgaaaagttgtcaaccaccagggatgacattccgagactcaaaaattttatataaatcggaattcctaggccaaatttttcagaaattggaataccggcctccaaaaatcggaataaatacaaaaacgaattggctaaaacgaatcgtctttgtcctactcaagcttattgttagtgtgtaatcatggacggtaacaccgtcggaccccacccactcccgccatagaccctaaaagttttttgaaaaagcgcgacgtaaaaaaaagtacgccaaaatgagagatgttttttctctgcactctctatttatttacacatgtctcgttttttgagtcggtgtgtataatgattcgattaaaattaccattactttacaaggaattctgctgacttatttcacatattaaatttgtgtttcgatttttctaagctaatttaaatccgacgaaaactatcttaataatttgccacaacaaaatg

SEQ ID NO: 113602 - DNA, 1003 bp, Heterodera glycines
  Promoter: Source sequence=SeqID_12440; Location=623..1625; Strand=-; Gene=SeqID_76054
taataatttaaatttataaaaattaataaattaatatttctttgaattttaaaataattaatcttgctttaattggatttcttgagcttttcttcgtcatatcatcgaatgaatgaatgatgaatctaattttggaattttattgcactataataattattatttttacttattaacaaaaaaatatctgagataaattaattaatttggacaatgtcttcgaccaaatcagtgttgacatttgtcatctgatggagacgaaaaagcaattaaaacggggaattaaaggaaatttcaaattaatttgtttgccgattgagtaaaactggagagcaaaaattttgcaattttatgggttattttaccggcactggcgggtccctaaaaacatttccactaattccgacggcaaaaaagtcggagcccgcgctggaatcgagaaaatcgaggtcgatgaacacctggccaagcgaacgcttgaaaaataaaatggcattttggatttgaattaattgccaaaaccatgtccaataaatccaaaaatgatgatgcaaaatctgttggacattccgcagaaagtgcatttcttcgggcactgctcgtgccgttgtagccaaagtgttccttggagtttttgccggattttccccacccgccggacaacaaagtcggcacttccttttgttgtgccgcagtaactgttttgtttttgtcaacaattccggcggattcttaaaatacagatgaaagcattaagtttttggcttcataaatccataaaatgtgtattttttcggcaaaattatctaaccgttatcttgtcagctgaaagaggatttaaatggtatcattaaaaaactaatttgtgagtttagtcttaattgtttaaatcatgacgaatatttggaaaacaattgagacattgaaggatatcaattttaaataattaaaaatttattttacataattctttttcatttttttttgttattttgaagagatg

SEQ ID NO: 113603 - DNA, 234 bp, Heterodera glycines
  Promoter: Source sequence=SeqID_21523; Location=1..234; Strand=+; Gene=SeqID_52134
gcaatccggtgggattttcagtttttggcattccatccaacgggctggggatcggatttttttttcaaaaattggaagaatttgcctttttaaaattcaaaaagttgttacatttgtgggagcagctcgtcaccaatccatgcacagttttcctggcaaatggaaaaattcttgaaattctttcaatagtattgaggaactatagtataatatttttaatcatttttagggatg

SEQ ID NO: 113604 - DNA, 192 bp, Heterodera glycines
  misc_feature (103)..(103): n is a, c, g, or t
  Promoter: Source sequence=SeqID_14916; Location=1..192; Strand=+; Gene=SeqID_79080
gcggcttttatgttgattcgaaaatcgatagaaccccgaatttgggaaaggcaacacaaagaaagtaggaggaaatagtgtaaacgagagaaaaaggcaaatntaacaaagcaaaatgacatcgtttgaatgtaaaatgcgcgggctgtaagcatagtaaaatatcggcataattcccctaaatgggccatg

SEQ ID NO: 113605 - DNA, 161 bp, Heterodera glycines
  Promoter: Source sequence=SeqID_7866; Location=1..161; Strand=+; Gene= SeqID_66223
acttcgactttctatctgcggcgttgttagagcccgaagaccgggaataaacgcagcagacggcattgcaaattgctcaaagattgagaaattgcacaaaatttttgctcaaagactgagaaagtgccgaaactctcgagttagcccgtcgaccatccatg

SEQ ID NO: 113606 - DNA, 617 bp, Heterodera glycines
  Promoter: Source sequence=SeqID_21133; Location=1172..1788; Strand=-; Gene=SeqID_51720
ttaaatagccattcttagccgcgagtaaaattatgctaatgaaaggcaaaacaaatggaagagaaagggcaaagaaggacgaatgaagaatgaatgacaatggattgaaaacaaaaagagaagaaaggagaagcggttcaatgggagcagaagaagcggaagctaatgggccaaagctaaaggcaatggccactggccaaaagcaaagggaaagggcaaacaaaacaaggaaaagcgtggaaggacaatttactacttttccgtttcttttctgttttattaaagcgaagaattttaaattttaaataaataaaatgccataaattatttacgcgctattactgtacttttggcttgggtttacatttacgcaatcgtagtgtttggtctgggaatgagcaatcgttgaagaaaaagaacaaacgttcacgcgtcgcttttcacgtccctttcacttttatttgtgttttgacttgtttaattaatacttgaccttgataaaacattaattaatcaaaatgttgttcgtcacttcgcataatctattcaattttgacgtttttacacttaattgtcatatggctttttatgcatttttctctttagataaaaatatg

SEQ ID NO: 113607 - DNA, 78 bp, Heterodera glycines
  Promoter: Source sequence=SeqID_5293; Location=824..901; Strand=-; Gene=SeqID_57585
tcgggaagcgattttgggccgattggactctcaggggaacagagtccccggtctcattgacaaattaaagacgccatg

SEQ ID NO: 113608 - DNA, 482 bp, Heterodera glycines
  Promoter: Source sequence=SeqID_18646; Location=1548..2029; Strand=-; Gene=SeqID_83300
caagcgttgtgcgcgtggctgcacacgccgcggttggacggacggccgaagttgctcaaatgcgtgacggaggagagcaaattcgcagagagtgtgcaccaactcaaagaggtgggctcacaaaattggcaatacctttcaaattgatttattgttcgatttcgtaattttgatcattttatctttcataaagttttttattgtttaaattatttggcttaatgcatcgttttgaatttcttaattgttccgttcacttcctttcagcttttcctccgctcctcctcccccgttaatttcgtcgtccgtttgtccgctttttccgcctgttcgccctcccctgtcgcttcatcatctgttgccgattttacgccttttgttcttgaaaatggcaaaactttggagcgtttcactgcgcggctttgtcggcactcattttggctgttggaaagggcgccgattgagcgcaatgagcagaaatg

SEQ ID NO: 113609 - DNA, 437 bp, Heterodera glycines
  Promoter: Source sequence=SeqID_45120; Location=635..1071; Strand=-; Gene=SeqID_72485
gcaacctttcagcgattcatgaaccatctcttcgatgggtacataaatgatttcatctttgtctatattgacgacgtattaatcgcctccgattcatacgaaactcatctgcagcactttgcactggtttttgagcgaattcgtgaggcagagcttaaattgaagctttcaaaaagccatttctgtgccaacgaattgccatttctcgggcatattctaactcgagaaggaataaaaatggacgtcgaaaaagtgcagccaattacaatgcaacaccactttttaaactcctgcaggaaaatgtcaaattttccattggtgaagtggaaaaagaggcaataaaaagcctaaaagaaaaagtcctgaaagacgtaattttgtacttccccaactttgaaaaagcgtaaaatgacccatcgcgttgctttatcatgatg

SEQ ID NO: 113610 - DNA, 644 bp, Heterodera glycines
  Promoter: Source sequence=SeqID_14134; Location=1450..2093; Strand=+; Gene=SeqID_78128
acaaaatcaatcaatttttcttggccaaatttcttttgaaaaaaggtaaatgaaaacaatatttatggcacaaaaaaaatttgaaaaaaaaagaaataaatcgttgatttaaatttgggtaatttaaaataaataaagctgaacctcaaaaaaaaagtaattggaatgattgaatcgaaaataataaattgctttttaaataactaatagaaaactttttaatagttttttgtttttgaatttttaaattttctaaaattttaagagagtagaaatttcaaacatgattttagcaagaactcaaaatgttaaatgtgtaaaacaataattatgtaaattaaaatattatttaaaaatatctaatttttataaaggtcaacaatttttatcctaagaaaaaatgtataaaaaataattatgcaaaaaaatttatttgaaattaccaatttagaaaaatttcaacaatttttatcacaagaaaaaacactgaaagtgaatagggttaatgaatttatggcaacagaaacaaagaaaaaaaagtgccagcattgagtgccaaattgtttctgtggctgaggggcaaagacgcatttttggacccccaaaaatttcactgccctccgccggggggggggaggaaaatg

SEQ ID NO: 113611 - DNA, 443 bp, Heterodera glycines
  Promoter: Source sequence=SeqID_1934; Location=1193..1635; Strand=-; Gene=SeqID_76869
ggtgggcaaaggggggcggaagtttggagacggtcacacccccaagggggatgaaatttatttgaaaaggacaaaaactcccgaaaaattgcgaaaaaaaacaactttttcctcgtcactcttccccaacccccgttaatcctacctgagactgttcctggagcgagtcaattttgaaatggaaggacaaataaatgatgggccagaggggagggggaatttttgaaaatgagggaattcttatttttggtagaaatgatcgaaaagccatttctcgttctcggcaatttctggttttgggataactttgccgtgttttccttcaatttccctcctcctccctattaaaggtgattccgatgttgccccgaattctttgtgaagaactctgctcgctgaaccctggcgttgatcggctgaccttttccgtcgtgtggcacatg

SEQ ID NO: 113612 - DNA, 95 bp, Heterodera glycines
  Promoter: Source sequence=SeqID_8261; Location=584..678; Strand=-; Gene=SeqID_67481
attggtaaaaaaacaatttttaattaaaataataaaataaatttaaaataattaaattttataccctaaagtgtccctttttagggcaaaaaatg

SEQ ID NO: 113613 - DNA, 727 bp, Heterodera glycines
  Promoter: Source sequence=SeqID_1186; Location=462..1188; Strand=-; Gene=SeqID_69479
tcggtgatcattttttggaaacaaaaaaaaaatttttaatttgcatttttaaggcattttgccgcttttccgtggcgccattttggatcggcttaaaccgtgattgaagtgaacgagttttaaggaaggaagagcattatttaagtgggatgtcgaaagaatgggagaagaagaagtgaaataatggaaattcgaatccccgtcgatcagttaaaccattttcccccaattccgatcagtctattattcaaattaaattaattattcaatccaatttgtcgccctatatccaatcatttagcaaaatttttttgaaagaattctgagagggggggggggggggttctaattcaggggaggaggtcaaaccctaattttcaaaaacccaataaaatggcgatttttgtaaatattttcgccaaaaaaacggaacccgtataaactcattggacgtgtaaaatgccgtgccaaaatgaccctgatctggtttttaaggaaaaccattcatattacacaccagcagggatggcatggaatttcgaacgcccaaatctttaatcaaattacttagcatttacttggaaaaaaatttcgttctcaattaaaaaaaaattctgaaaataataaaaatattgggcggtcctaattttgacgctaaataaataaaaatataaaatttatatttttaaataaatagaaaaataaaattttaaagcaattaaatatg

SEQ ID NO: 113614 - DNA, 828 bp, Heterodera glycines
  Promoter: Source sequence=SeqID_11067; Location=1621..2448; Strand=+; Gene=SeqID_74400
tggcgccaatttttagtgttttgttgaattgcctccaaaattgtaaaagttggacaagtttgttcctgcaactaacaggctgaaaatagaaattcaaatttattttttaattaaatttttttttataataatggtaacaaattagagttcggcctggtctccaacatggaatccaggtccaggcttttttcaaaatgccgagctcttttgaaaacccgaaaatttaaggactgatttggagattgaactacaaaagacaaaaaaaaattatattggcgatctattttataattcaaatataaaacaaagactaaatttgcattttctttgacgagtcactgccttttcgcttgttttgcatggattaaaaagctctttgaaaagaatattttaaatgatcaaattgcgattttggcaaattttttgggatttttaatgaagtttgaaaattttgattttttttcaagatccaaggacgtccttggcatccaagtaagaatcccagcccgtgtttaaactgaagagttaattgaataagggaagaacattaaaaaaacaataaaattggtttataacagatatacaatagaacacatgcaaatatagggaatattaaaaattttattaaaataaaattattaaaacaatttttgcatcatttaaccgaacattagtattattattattattatttatttttccatcttatggccatggcgaagatttccttctcatcattgtcagctgtgtcctcctcatccattttttgtcgtttttcctgcgcaaaagcgccgtcttttttgctgccgatggcatggcacaacaatg

SEQ ID NO: 113615 - DNA, 538 bp, Heterodera glycines
  Promoter: Source sequence=SeqID_5539; Location=1452..1989; Strand=+; Gene=SeqID_58389
tttgtgctcatttggctgtataattatgataattacgcttttttattactctttcccaccaagacccatttgaacagttttcttgaaaaattgttttaaccaacaaaatttgagaggctttttatttaatgtgtaagctattgatattttgaataaacaaaaaatgctttaaaaataatttttataatgtgcagctaattttgagcaggaatgaactgattaattatcctgtttacgagtttttttgatatacaaccctcccacgttccctaattttgatgtttaacctttacaatttgtctcaattattattcattttagaaacttttctctgtgctatttacttttttaatgacaacttcatcatcatctgcttatccaatgcttttcttcacccaaaaatggagcggtgacggtgagttatgggcacataaaacagaaattatttgtagccggggtggttcaaagttccgattattaatttgactccttttttcgagtttagacagtctttgggtgttctaatggctccgcgatg

SEQ ID NO: 113616 - DNA, 191 bp, Heterodera glycines
  Promoter: Source sequence=SeqID_20617; Location=233..423; Strand=+; Gene=SeqID_51173
ttgtttaaaaagaaaggagggcgtttgatttgcttgttttgttaatttctaaaaaaaattctaaggcataaaatattcatattatttttcaggtttctattggttttggataaacttattaatccgaaaaccggccttacaaaaaccttaaattcttaccattttctagttatttaactcaataacaaatg

SEQ ID NO: 113617 - DNA, 152 bp, Heterodera glycines
  Promoter: Source sequence=SeqID_31616; Location=1025..1176; Strand=-; Gene=SeqID_61936
gggggggtagaccttaaaacaaattcaaatttttaaattatttagtctgttgctttctaatcacttttcgcttcccccttcagcttaattactccggtgggcgtccgctcggcgaatgggccgaattgcgcgatgcgttgagaagacaaatg

SEQ ID NO: 113618 - DNA, 320 bp, Heterodera glycines
  Promoter: Source sequence=SeqID_29860; Location=441..760; Strand=-; Gene=SeqID_60324
tcactcttttttggcacaggtggaaattgggggccgacctgaagagatcggagatgaacaggtgaaagagagggggaggggttaaaacatttggcaaaaacatggcaaactctccattattcagatcattgagttttctctcgagaattccttctatggatgtttggcccggatggagctgaacggactcaatttgttggcctctgcgcccaaattgttgccgtcatgtcaggtgtgatgatgaatgggggtggcatggtttttccaatttggccatttttcgttttgttttatacccctccctaccccctccatagatg

SEQ ID NO: 113619 - DNA, 77 bp, Heterodera glycines
  Promoter: Source sequence=SeqID_38527; Location=302..378; Strand=+; Gene=SeqID_67314
ttgctgacgccgcccaattcatttgactctcatttggattcgatcatttcattgtcttcattccactcataatcatg

SEQ ID NO: 113620 - DNA, 66 bp, Heterodera glycines
  Promoter: Source sequence=SeqID_17644; Location=854..919; Strand=+; Gene=SeqID_47464
ggtaccatttccaaaataaataaatatttatttttcgtcatttaggatcggacacggctatcaatg

SEQ ID NO: 113621 - DNA, 950 bp, Heterodera glycines
  misc_feature (53)..(53): n is a, c, g, or t
  misc_feature (62)..(62): n is a, c, g, or t
  misc_feature (69)..(69): n is a, c, g, or t
  misc_feature (93)..(93): n is a, c, g, or t
  misc_feature (110)..(110): n is a, c, g, or t
  misc_feature (117)..(117): n is a, c, g, or t
  misc_feature (119)..(119): n is a, c, g, or t
  misc_feature (121)..(125): n is a, c, g, or t
  misc_feature (136)..(136): n is a, c, g, or t
  misc_feature (138)..(138): n is a, c, g, or t
  misc_feature (149)..(149): n is a, c, g, or t
  misc_feature (160)..(161): n is a, c, g, or t
  misc_feature (163)..(163): n is a, c, g, or t
  misc_feature (184)..(184): n is a, c, g, or t
  misc_feature (195)..(195): n is a, c, g, or t
  misc_feature (197)..(197): n is a, c, g, or t
  misc_feature (215)..(215): n is a, c, g, or t
  Promoter: Source sequence=SeqID_35555; Location=1..950; Strand=+; Gene=SeqID_65096
ctacgatgacttttataatgcctaactttgcctatttcctttaagggttgtgnctaatgtgnctatttnaagattttcgacttaatatttaanaaaaatggaataaaaangaaaaananannnnntaagaaatgananaaaaaattttnagaaaatatannantaagaattgaagatttttttngaaaattgatnanaaagttaatatttttttntttataaaaataataaattaaaaaaaacttcttatttgttgcttttgaataaaatttgaccatttacacactaaaattgaaatttttggcacttttttcacatttctagcaaacctattttggggattttttagaacctaaaaatataagccctaataataacagatattttgtcaagtctcgtcatttaattttctttagcgttttaatttattcttaagcattccttcaggttaattaaggcgctgccgagtaaattttaaattaatattaatttcaaaatggaaaaagtcagctaaaattaaccaaaaaaagcaaacaagataagctaagaagattttcttttcttcaggtccaccatgcaaggaaaaatattccgaactgtctccgcttaatcattttgaaacctgtttttattgtgtatagatggtcgatctattattgtacagttttaatgcatattttgtaaaatttgcaaaatttaaaaatggcaatttgcgtggggcctaattgaaattaagctcacctaataacgcgccaaatcgccttgcagaatggctccatgaatgtatttttcttctctaaataaaaaagcattgaagattctgtataaaaataaaaagatgaaaatttttttttcaggatgaaacagaatgccaaaataatcagaaatgaaaatatacataaacctaaagaaaaactgaaaaatccgttaaaattatacagcaaattatg

SEQ ID NO: 113622 - DNA, 99 bp, Heterodera glycines; identical to SEQ ID NO: 101586
  Promoter: Source sequence=SeqID_1506; Location=710..808; Strand=+; Gene=SeqID_74051

SEQ ID NO: 113623 - DNA, 380 bp, Heterodera glycines
  misc_feature (17)..(17): n is a, c, g, or t
  Promoter: Source sequence=SeqID_12879; Location=1..380; Strand=+; Gene=SeqID_76612
taactgaatttttatanttttttaacaaatatttaataattggcttcgttaaaatcacttgttaagcaatattaaaaatttctttatataatttaggaatctatttacgtgcaaattcctcgccacaattttatgcggcgccctgcaatgtcctattcttattcagaaaaatttggctgttcatcagtaaaaacacttagataacatttttttaagtataaattaagaaccagattcctccggtccctgagcagatggcggcagtcagtgagcacaatgtaaaaaaatgtatttttaaaaagcaattaaattgctaattgccaattttttatggaagattaaataataataaacaattttttcagctcattggacaaatg

SEQ ID NO: 113624 - DNA, 151 bp, Heterodera glycines
  Promoter: Source sequence=SeqID_21798; Location=368..518; Strand=-; Gene=SeqID_52418
ttcgtccaagtttttgtcttctgctgaacagttcgcccgtgataattacgcagattcggccgaacatttcgactctttgcttctggggacggaaggggacggtggcggaggaacgaacggagtgccggaaggggcggaagaagcgcaaatg

SEQ ID NO: 113625 - DNA, 669 bp, Heterodera glycines
  Promoter: Source sequence=SeqID_11672; Location=1..669; Strand=+; Gene=SeqID_75139
gcggaaattgtgaattaattctcagaaaaatggctatctctttttagggcaattttttatcttgtaaccccgatgctaatccgttccgcagagcctcttcaaaattttttccattgccgcaagagttgcggaaattgtgaattaattctcagaaaaatggctatctctttttaggacaattttctatctcgtaaccccgatgctaatccgttccacagagactcttcaaaatttttccattaccgcaagagctgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccttgatgataataaggtccgcagaatctaataataatagatacaatgagacttgaacttttgtaaagaaaattataaatgaaaataatcaacaattaattaattaggtaataaaatcttttttggaaatagcttaaacgctgcgatttatatatctattttggcttctttagtctttgtgctttcgaatgacaccaaaaagacaggttttgttcaaacatg

SEQ ID NO: 113626 - DNA, 331 bp, Heterodera glycines
  Promoter: Source sequence=SeqID_7047; Location=3312..3642; Strand=-; Gene=SeqID_46352
aatgggtcaaaatagatgccagaatcggttttcccaaccccaaaaaacccttaaaacaaatttattttcaaaaaaatttttttgaaaacctgcacacagataaccgtaaagtaccgggtaattgttattattatgtacatacatattcttttttagattatttacaatgatgcaattggattataaatttgacttaaaggattttaaatcaaataattgttacaacccttcgaacttaaattttgttgagcttgagtccgagttatttcgtttgacatgccatttcgacaggcgaattcgaacttttgctataagcgcgttggagcaaatg

SEQ ID NO: 113627 - DNA, 764 bp, Heterodera glycines
  Promoter: Source sequence=SeqID_15399; Location=995..1758; Strand=-; Gene=SeqID_79660
gtaatccgtaattgcgtgcagccctgcaatagacgtcactgggaaattttaaatgtttcaaattggtgctgggcgttcgccaaactgccaattttacagttttttcataaaaaactcttcctggactgttcaaaaacgcaataaaataaataagcttggtatcacacggtaatttttgtatattttattaaaatgaaaattttcagataattttattgttcaaaaagagtggtaatttttttcaacacctttggtcacaactttttaaatttttcggaaatttcttttattataaaataggatggcaaaaaatgtacgaattttctgaaaataaatttattagtgagcaaaatgaataatcaaagacaaacgaatggattaaatggaaatagttccaagtcatttgttaaattgatgtctctgatccatcaacaaatgcatcacaaaaagtgcttttcacaaaaaaaaattacttatttatccaattgcaaaaaaaataataatgaataaaatattatttactttttgaattatttatgtttatttatttattagctatatttaattaccccgtgaatgcgtgataaaatgattgcttgtagcaaatcacattaattcacgcttattattagaacaataaaaaattttattttttggaaaaagtaggtccaaaataaggccggattcgtgctcagcatccgaaaataaccccagaaaaattttcccgattaagtttatttaagagttactaaaactccaaaatg

SEQ ID NO: 113628 - DNA, 329 bp, Heterodera glycines
  Promoter: Source sequence=SeqID_10310; Location=4101..4429; Strand=-; Gene=SeqID_73491
tcagaatgtccttggttctgacgactctcgttttaaacaaatactaaggctgataaaacattgaagcgttggcgtaattttcggcaaattctctgtcagcttcgcatatttttgtaatatctgtgaaaaggtttttaaaattttttaaattattttacatcacttaggttttgttttctcttttttctttttacaaaaatcgtcagtttttcacaaaatttttaatttgtaccagggatgggggcgcgccgcgatgtgcgatccgcgattcgcggcgtttttttttgcgcgatccgcggtcgcggccgcggttttttttttgcgcgatg

SEQ ID NO: 113629 - DNA, 121 bp, Heterodera glycines
  Promoter: Source sequence=SeqID_6125; Location=2514..2634; Strand=-; Gene=SeqID_60445
ttttacaattttcccaactttcccagacagcggaaaaacgaagcgaagcacaatttttaaattttattattaatattatgttgcttttctttttatatattttttcatttgtattgaaatg

SEQ ID NO: 113630 - DNA, 161 bp, Heterodera glycines
  Promoter: Source sequence=SeqID_36672; Location=636..796; Strand=-; Gene=SeqID_65931
tcactttggcgtttattagaattttattttttataaaacaattaataaacaataaatttaataaaatactcattttatcttttaataataatgaaataaaaatttggcaatttaaatgcattaaaaatatttctagagagtataagaaatactaaaaaatg

SEQ ID NO: 113631 - DNA, 349 bp, Heterodera glycines
  Promoter: Source sequence=SeqID_31759; Location=1..349; Strand=+; Gene=SeqID_62064
tataacaaattgaggaactggcgagcgctgtttttggtagttcagccggtagagcaaaggtccgcaaagctaaatccgaacccttacatagtttttcccaaaagcttttccaatcaacattaaaatgattaatgggcaaaaggaagagacttttgtccggcaaagaaatgccacggagttgggagggcttgccattaagacctttgactatcaccaatccttgttagtccattccactttccaccccaaatctttcacggctacaaaagcattaaaattttctaaaaatggtcaaaaccttacgcctcgggagtgaatcgaacccacgccttctccatccagtgaaatg

SEQ ID NO: 113632 - DNA, 393 bp, Heterodera glycines
  Promoter: Source sequence=SeqID_25160; Location=1..393; Strand=+; Gene=SeqID_55889
tatttatcattgggcttgtcaatcaaaagggaaacaacaaagatgctgtttttaacgaataaagggcataggttattttgaagaagtgtcaaagaacatgcagcaataagcctgcaaaatttaataagtggaaaattcatggagtatagaattattttcagaaaagtgtccacatacttttggaaaaaatatatttgcaatttatcaacaattttggagaagtgagttagaaatgataaacttcacgattcaaaccaattttcgttgctctaattaaccgcgataaaaacattcgaatcaattaaatagcttctgagataataaggtttatcataaaatgtcatttaaaaataaaccctcaattattggtgtgaacgatactttccaaacatg

SEQ ID NO: 113633 - DNA, 485 bp, Heterodera glycines
  Promoter: Source sequence=SeqID_17543; Location=209..693; Strand=+; Gene=SeqID_82045
tttttttgaattggtaagcacagaaaatttaaaagaaatgaactgaaaaaacaaaatttatcaaacaaatggaatgaaagggaagaaggatatgactggaaagggatttggtcggctttatatactcggatacacttgaggaacgggggatggaataatggacatcagaagaaatagtaattaaaaattcttggcgctttgcttccctttcatcgattatttttctttttgacaaattaataaataaattgcgccttttttatcttcctaaataattgttgcaagttaaaacaggcattttcctctcattttttaaatttggggggtgtaaatgaaaagtatcttatggtgtttttgtgttccttttgctctctcatttttccaatttgtctccttttttaagtttaacaacagatttttgctcttttgagacacaccaatcaaccgggaaagggaaaagtgtgctaattgcagcaacaaaaatg

SEQ ID NO: 113634 - DNA, 140 bp, Heterodera glycines
  Promoter: Source sequence=SeqID_10031; Location=1..140; Strand=+; Gene=SeqID_73083
caaagctcggtcaacctccagaacagattattcgtgtcaaggtgtgttgtattaggcattccgcagctcactttagcagaacaaataaatcttcaatgtcatttccctctgatcatacctccccgaagagattccctatg

SEQ ID NO: 113635 - DNA, 340 bp, Heterodera glycines
  Promoter: Source sequence=SeqID_30896; Location=907..1246; Strand=+; Gene=SeqID_61272
atcagtggccgatcattctaatcactcttttcattaaaaaatgccttatgctgttaattgtcgttattccctctgcttcattttaattattattacgaaaaacttttatttttacaaaacataagccatgcccattgtaaggacatcttttttgaaacatttaaaataaaaagccaccaggcttccatagtacatttacatatgtgcaaaaatatttcaaaaattctcttgaaaaaatatttcacaaaatttatttgctgatagaaattgttctgataccaaaataaaaccgatacccatccttttcagattggtcaaattcttatcaaaattaaagatg

SEQ ID NO: 113636 - DNA, 422 bp, Heterodera glycines
  Promoter: Source sequence=SeqID_29714; Location=264..685; Strand=-; Gene=SeqID_60185
tgtagcttttccggatccaggcccagaattttttgaaatccctttttcttattatgatttcatgtgcatttagataaccgcgctgaaagtgtccgccactgtgctcgtgttcgtcatgcctttcctggtccgaaaatgctattcaatcatcgccaaacagttcaatttcaaacgtaatacgcagtccaacaaaaaccgcatttactgaatttgagccccctctcccccctaaaataaaactctcattttgaggggagaagggttgaaaaataaaagcccccggggggctctgatccaacaaatgtcaaaattacatatttttattaaaaaaattcacattttttttgttgttgtcagtgttccaaaatggctccaaaaaagtgtgggcccttctcttcgcctatttcttcgcttctctgatg

SEQ ID NO: 113637 - DNA, 263 bp, Heterodera glycines
  Promoter: Source sequence=SeqID_8846; Location=1..263; Strand=+; Gene= SeqID_69415
gggaaagggcgcaacttttcgtggcaaaattggtggaggaggtgaagcagttcgccagaatccggaagggatatggcaacgtgcagaaggagcgagaaaagaagacggcggaacaaacgacagcgtttgaattggtggcaaaattgctaagcgcggagcgcggcgtggtagtgctgtctgcagtggagcgtgccgaggttgcgaagcagttcagggcgcttggcttgcaggaaatcgtgttgaaagttgtgcttgatcgcatg

SEQ ID NO: 113638 - DNA, 796 bp, Heterodera glycines
  Promoter: Source sequence=SeqID_17427; Location=1..796; Strand=+; Gene=SeqID_81914
aaaatttaacctattaaaatatttagaaaattttattatattttatgttttttgaaaaatttccgagttccgacgtttttggggtcggaattccgatttccgaaaatttttggggcctcggaatgccatcccattatctgtggtcgattttttgaaaacttttttgagataaacttgttttagggatttttagggtcggaaaagccgattctgacatacattccgaccaaattcgaatcccgaacccggattcgagcaaaactcgaaaaatcgttttacaacaaaattcacatttattgcacaaaaaggttttttaggggaattttagggtcggaaaaacggttctttcatctattttgtcccaatacgaactccgaactcagactcgaacaaaattcaaaaataggaaattcatttttcaacaaaagtacagccggaatttgaacaaaaattttaaatctgaaatttgtatttcccacttttgcttcgaattcgggtccgggattcgaaattggtcgaaatggatgccagattcgtgctcagcgactctgaaaacccctaaaaacatcgtttttgggacttacagatttttttaaattttttttctaaaaaggggggctaccatcggcactattaccgtcactaaaagtcgcggccctaataattacacgccctattcattatcattgatcttccatttattttctaaatactgtaaggcgaaaatttatcgcatccatttaatctctttctcaatctgtgatctgaaaatttaagaaaaatttgtcaaaaaatg

SEQ ID NO: 113639 - DNA, 354 bp, Heterodera glycines
  Promoter: Source sequence=SeqID_8275; Location=1000..1353; Strand=-; Gene=SeqID_67538
tatataccgtatatactctttttatatgccatggtatattatttttcaacctcctcagaagggggtagataattggaggccggcagattaatggagactgggagattatttttcagctgatttatttagtggaaaatttttgaaatttttttgaacatgtcgccaaaaatgtcatcgcgtcaaaaaaaaattatttctattgcatttctgttaaacaacttctgagaattgaccccaaaatggcaaaaatgtgtcattttcttttactgttgaattgagtttaattttttttttggaaaatgtgccaaaaaaattatttaaaaaattctatttatcccccctggcagataaatg

SEQ ID NO: 113640 - DNA, 686 bp, Heterodera glycines
  Promoter: Source sequence=SeqID_26153; Location=949..1634; Strand=-; Gene=SeqID_56903
ttttgtaaaatatacagcaaataaaaacaaaattaaaataaaagtgaagatatgccttgttgaaaaaattctccggtgtttttataattaaaataggtttgataaggaactaacaatagtaaacccgctgaacatttctaattttagcgtgactcatcggtcgtaaaagacgcaataaattgaaaaatttaaaaaatgttaaaaatttatttgtggcaaaatgttttatttcgtgcagtcttctcagtcccaaacaattcctttggcagatttgagttgcgcggcgggagacaccacactaacacaaacattgattaattaatgggaggatatcccccagcgaaccaccaattgcttagaaaaggggccgaatttgaatggtttttagaaaacttaaaatttacgacttttcacctccgtactcaaaagccaattattaaataaaaaatttgccttaaatcattttgcctttttcactttcgattgccttttcctttttctaatcgattttcgtccaaaggcaaattaaagttgatatataaaatcggtcgcttaagtgcataagtcattcatctgtgtataatttgcactgtttttcaaaaattgaaatttttctcactttaaatacttagtttttctttctcgtacttagctaagatttcattttaatttagccaattgctatg

SEQ ID NO: 113641 - DNA, 258 bp, Heterodera glycines
  Promoter: Source sequence=SeqID_11934; Location=1..258; Strand=+; Gene=SeqID_75453
cttgttatgggggcgtaaaatgaaaacttcacaataggagtcggccaaaaaaagtgagtgacggttaaaattgtcaaatcattttttcatctcttttttatgacgtgtaaattgtaataaaactgatttaaatccccaattcgattcctattatcacatgcatatatatatatatatatatatatatgacatatccaacttttttttctaacttaaatttgtaacagatacatataaagtaattaaaaaccaaaaatg

SEQ ID NO: 113642 - DNA, 228 bp, Heterodera glycines
  Promoter: Source sequence=SeqID_31863; Location=1246..1473; Strand=-; Gene=SeqID_62175
cataacaatgagaagaagcccaacaaaaagcaataagaaatgcgagaaattgcattttaggatttcaaaaaattgtatctaaaataaagtaaaagttaggatttattttatttttattaatttttgtacgaatatttaaataaaaatgtttggctgaataaattggcagtaaaaataatggtttattataatggtgaaatcgcagatgtgtgaactgatgagaaaatg

SEQ ID NO: 113643 - DNA, 269 bp, Heterodera glycines
  Promoter: Source sequence=SeqID_3199; Location=5475..5743; Strand=+; Gene=SeqID_83646
tatagtaagcggaacatatgtaatatcccgaaacattgatcaaaatgatgataaacaacgaccgaaagatgcgtcggttgaacttttccgcgttcgaattgtttgaagctggaaaaaacaaaatgaaaactttcgaaattttgacattgatgaatcataaatttacaattttttgtttgaaaaatcggtaatctccaaaaataagaaattttatgatgagttgatatagagttcgactgggtcccggaaaattgggcatcagacaaatg

SEQ ID NO: 113644 - DNA, 1003 bp, Heterodera glycines
  Promoter: Source sequence=SeqID_6880; Location=1244..2246; Strand=-; Gene=SeqID_63196
ttattttttcgttttcgtgtttcgttttcgtccgtcaaaattttttcgtttcgtgtttcgttttcgtatcgaatgcactttttcgtttcgttttcgtatacgaaaaagtttttttgtgattttcgcacagccctgatctcgacccatattttgggatttttcgcctcaaaaaatcatgcataagatttattctgatcataaattacacttaattctttagattggattatcttaaataaaaatttttaaatataaattattttttcaagattacggattacgcaaaattatggccttttggacctccgtaatgatggattacggatagccgtaactaaaaaagccgtaattacggattacggaattccgtcattgaaaatcagttgcgtccagccctgctgtgggttctttgagaggacacctttcattccgtcaatttccctcctccgccccttttcccctcctctttccgaaaatgattatcgataattattaaagtttctctgctgctgctgacactttcgcctccgatggtccttccacttcttcaccattttagcttttgtagattctttttgtataattccataaatgttttattatttatttggaaaatttgctatgaaatcgattttcccattttaatgcattagcgtgatagcttctgactaatttgtaagtgcgagagaatattgcgggagatcaatcagcgggaagaattcgctgatcaggtgccattcaatcatttgccaatctttgtttgttcctttcaatttttctctttgttaatatgcatgtgtggcttagtgtttaaaccttctaccttcctttatttttcgcttgggttcaatccccaatgggatcgaatgtttttcatattttatttaccattattttaattgaaacctaatttaaaaaatattccatgtttttttttcatttttaaacagcctaaacaccaataaattatttttattttttagtccggcaaatggaaaagatg

SEQ ID NO: 113645 - DNA, 174 bp, Heterodera glycines
  Promoter: Source sequence=SeqID_747; Location=4745..4918; Strand=+; Gene=SeqID_60388
ttcgcagaaaagaaaccgtttgtaaaattttcaaaaagaaatttttaatttttaaaattgacgttttgttttaaatttttgcaattaaatttaaatgcttaatttctttttaattttttggaaaaaaagaacagtttatacgtaaattgcttatttgttttattgcctcagatg

SEQ ID NO: 113646 - DNA, 828 bp, Heterodera glycines
  Promoter: Source sequence=SeqID_11067; Location=1619..2446; Strand=-; Gene=SeqID_74401
ttgttgtgccatgccatcggcagcaaaaaagacggcgcttttgcgcaggaaaaacgacaaaaaatggatgaggaggacacagctgacaatgatgagaaggaaatcttcgccatggccataagatggaaaaataaataataataataataatactaatgttcggttaaatgatgcaaaaattgttttaataattttattttaataaaatttttaatattccctatatttgcatgtgttctattgtatatctgttataaaccaattttattgtttttttaatgttcttcccttattcaattaactcttcagtttaaacacgggctgggattcttacttggatgccaaggacgtccttggatcttgaaaaaaaatcaaaattttcaaacttcattaaaaatcccaaaaaatttgccaaaatcgcaatttgatcatttaaaatattcttttcaaagagctttttaatccatgcaaaacaagcgaaaaggcagtgactcgtcaaagaaaatgcaaatttagtctttgttttatatttgaattataaaatagatcgccaatataatttttttttgtcttttgtagttcaatctccaaatcagtccttaaattttcgggttttcaaaagagctcggcattttgaaaaaagcctggacctggattccatgttggagaccaggccgaactctaatttgttaccattattataaaaaaaaatttaattaaaaaataaatttgaatttctattttcagcctgttagttgcaggaacaaacttgtccaacttttacaattttggaggcaattcaacaaaacactaaaaattggcgccatg

SEQ ID NO: 113647 - DNA, 550 bp, Heterodera glycines
  Promoter: Source sequence=SeqID_3801; Location=2418..2967; Strand=+; Gene=SeqID_51930
ggaacttggcaaaatgctattccgtcacctgtgaaattaatggacagattattgaccgacaaaaacataaaataaaataaaaagccaattcatacaaaaaataatttaatataaatattttttttaacttataattagggaaatatttttaggtgctaaaactgccaaaatagttaggttttaagttctaaccccccccccccaaaaaaaatggtgctaaaaatgggaaaataggtgccaaaaagtttcaaatttaggggtgtaaactacaaaatgtattcaaaaaattttaaaattatgtatttttgaaaaattttgggtcaattgttaggggtgtttcgtttttattaccttttttgttaataaatttggacaaaaagctttcgtgcattttataccatagggagcacaggaaaaaaaataagtaaaaacctaaaaatattagccctacttataattctttaagataattcacaatttgcctcaacccaaatgggtacacaaaaaatgggaagaatttggcaacaaaacgaccatcgaattaattatg

SEQ ID NO: 113648 - DNA, 301 bp, Heterodera glycines
  Promoter: Source sequence=SeqID_5177; Location=1290..1590; Strand=-; Gene=SeqID_57169
ccccgatcgaacgtccaaagaatcgtttgtgaagaaagagagtgtcgactctttggctgcgaaacgacccgcgttggttctgaagatcaaaaaggagggcggtgcctcctcggcagcgtccacaaagcactcttcctcctcctcttccccatcttcaacttcgtcgtccactgccgcccctccggcattggctgtgccaacaccgcagcagcagctcaatgaacccgtcgcgcgtttgtcaagcagcgcggcaccaccttcgaaatacaaacagcagcggcaacagacgaagagaccaatg

SEQ ID NO: 113649 - DNA, 904 bp, Heterodera glycines
  Promoter: Source sequence=SeqID_14450; Location=2681..3584; Strand=-; Gene=SeqID_78493
taaggaatttgggatccggcgctgccgttaggcaccattgggcgaaaaattaggaaattttggatcaattcgttaaattccggggaaatcttaaaattgttaaaaaatataaaaattatttcatcagcttatttagttctgctattttcaagaattcaaccatacatggaaaggggggggggtcaaccgaaatttttgcgaaggggtctggaagggggggtcgagggggggggggggagagcagcaaccgcaaggcaaaaaaaagaaagaagagaaaaattgaaaatttagggattagaaagagacagtgagcgaatgggagagaatgtgagagaaagagagaggggcttttgaaagagggcaaattcggcattttcttaatttgtttaatctttcattcaaaaatgtttcgtctaatcaaattgttatggttgtgccccccccccaatcccgacattttctcgtcccgaactttttttggcagtctcgacccaaactttttcttcacgcgccgcaacaacgatttcgcgaagagaaaaatccatgaaactttctttctttattgagccggtgttatgacgctactcaaaatgaccagataaaaaaaaatgtttgctataactttgctcaaaagcaaacagatttattataattattcatgccattcgatagtattgagaaattttttgaaattttgcaggataaaagaggaacatttagggctagctattgaatcataaaaagaattaaaatttggttgcttttgcgtaagcataaatcaatttttcgtcaaaaattttcaatttgatggtttttgagtaacgaaaaattggcaagtgattgaaatagtgatttattgtaaattaaattcactaattgtcacaaatgctttcagacccaaatg

SEQ ID NO: 113650 - DNA, 999 bp, Heterodera glycines
  Promoter: Source sequence=SeqID_31039; Location=336..1334; Strand=-; Gene=SeqID_61405
ttgggtcgtcggccaaaatgttctaccctgtgtttcagtttcaacatccatatcaatttttgaattcccctcccacaaacttggaggatgatttttgggaatttacagctgttaagcatacggaaatagaaaaattatacagaagattggatgaaatttttagaaggagaagtcggaagggagccgtcgagaggataactgtaaacgaacggaacagactaattttactgtcgtaaggggtggaagaccacccaaatgcaagatttattatgctaagaaaaccaaccgaatcatccattgccgtttttcagttgattgtgatggaaatacaggtcaaaaacgaaacgaataaatctaaacaagaaaataactaaaagccgaaataaatattatcaataagaaatttaaacgaagacaaacaaagcgaaatgaagagaagaacgactgatgagagaatgggctctgcttaagacagaagaatgcccgggtcaaaagggaatcgataaatggactatgtgacgtgcacggtgtcctctcaaaggacccacagacagaggacccacaaaataataattaattcaaatatattaaaagatttaaaataagctgtgagagaaatgccagttactaaatttattcaaattggactgagaaaaatgctatatgaccaaaaatcactaatcttaatgagaaaaatgttacatgaccaaatgctatatgaccaaaaatcattattcctattaatgagaaaattctatatgaccaaaaaccactaatctgaactgattagaattaaattttgccaatggatttgcccgaataacctgaataggtgctataaaagctgaactaaatttacaaaattcattaaatataatggctacgttttttccttcacaaatgggcggctacaaactcgttttcgaaggccatatgtaccaaaaaaaagaagcacgaagggaattcatttattggcgctgtgaccaaaacaaaacaatg

SEQ ID NO: 113651 - DNA, 720 bp, Heterodera glycines
  Promoter: Source sequence=SeqID_1737; Location=1..720; Strand=+; Gene= SeqID_75603
acgaaattgaaatgtataattaaatttaaataatttttattgacacttagactacctattttcggttcgtttcagcgtggtattttctactgacttattttcggagcactccttccagtcctgaagaaatgaaaaaagaaaaaaatcgggcaaattctttaaatttaataaaccggtacttccaaaattccgattttgtcgtgactcccggccccgttcttaggacaaaacaccgggaccgggattccctaaaaacgggagtggaccccgttccggtccaatttccaagttccggttctggtacttccaaaccaatttgccgtgtctcccggtcccgttttttggccaccgggacctacattttcaatccctgcagtgtttttaacctttttcttcgttttcgcaattcccgttcccagaagtttttttaccgggctccaatttatggcacatcattttatattttgtttttcttaactatagtttattttgctatcaccaccaccttattttcttatctgtggttattttctttttttttcgtgcacacaaaccacacacaaaattgacattttaagtactccaaaagccagaaccattaattgaaaagggaaaatatattgtaattaattaatgggatgggtgtgttgttaattccgttgtcccttttattttcccttaatggatttgcatttataatcaatttttagctttctaatg

SEQ ID NO: 113652 - DNA, 141 bp, Heterodera glycines
  Promoter: Source sequence=SeqID_6823; Location=1689..1829; Strand=-; Gene=SeqID_62999
caatatgttattgtcccggaaaaggaggagactttttcattcctatttttggattctatgaagccaaaaaatgttatttaaactattgataaattacataatttggcgtcaaaaattatttaagaaaaaaaattaaaaatg

SEQ ID NO: 113653 - DNA, 146 bp, Heterodera glycines
  Promoter: Source sequence=SeqID_11414; Location=3733..3878; Strand=-; Gene=SeqID_74809
ggttttaattaaattttccccatgaaaaaagcactaattcctttaggcgattaaatcttcatttctcaattcaatagtcaatgatttgctcggccaacgaccctctcaattcgacgttttagtatctggcaaacaaaaacgaaatg

SEQ ID NO: 113654 - DNA, 219 bp, Heterodera glycines
  misc_feature (36)..(36): n is a, c, g, or t
  misc_feature (102)..(102): n is a, c, g, or t
  misc_feature (110)..(110): n is a, c, g, or t
  Promoter: Source sequence=SeqID_13677; Location=1060..1278; Strand=-; Gene=SeqID_77593
cgctgcccatcaaaatgtccctgcgtcataatgtcncagcgtcataatgtcccagcgtcgaaatgtcccagcgtcataatgtccctgcgtcataatgtcccncaagccanaaatgagtcaaaatgtccccctctaaaaattagtgaaaaaactgaaaattatataattatatgccttcatacgatctgctttttaaatttatgctttagcatcaatatg

SEQ ID NO: 113655 - DNA, 449 bp, Heterodera glycines
  Promoter: Source sequence=SeqID_36840; Location=223..671; Strand=-; Gene=SeqID_66065
ttgcggtgtttgttcggcagtgaaaggtgcacacactcgtgatcaaaaaccacattaattatcaaatcccagttttagtgatgctctcagctgctacccctatttggactttcgaaaatcgtcttccgattttttcgtctgttttaaatgccgacggaattaccatgatctgatggactatcttaggcatgccgagatgtaccataaagcaacttatgaaaatttttaaattatttattttcaaatgtatttagaatttatggcattttgtttaccgtataataaaatcgattgtgttgagtgtggcgcatttgcggttggtaacctccgttccgcccacttacctatttgttaatgcgttgttttgcttcctaatgccattttcggtgtataattaattgtatcttttaagttcctattttggtacatttactgatcaaaaggcaatg

SEQ ID NO: 113656 - DNA, 120 bp, Heterodera glycines
  Promoter: Source sequence=SeqID_1794; Location=1491..1610; Strand=-; Gene=SeqID_76000
caaatcaattggtcagttggacaatgtgacacgaaagcaacaaagcagcacgactacggtggtaagtcaaacacaaaaaaaggaggtgagtagaaataatttgacattattaagataatg

SEQ ID NO: 113657 - DNA, 98 bp, Heterodera glycines
  Promoter: Source sequence=SeqID_7314; Location=2280..2377; Strand=-; Gene=SeqID_64433
ggtaattaagcagcgtttattatttttcgattaaaataatggcacaattttttaatttttgttttctcacagatctcttccaccaggccatccaaatg

SEQ ID NO: 113658 - DNA, 622 bp, Heterodera glycines
  Promoter: Source sequence=SeqID_4392; Location=3325..3946; Strand=-; Gene=SeqID_54282
aacaacgcaaatgtcaacctttacaaatgataaaaaatatataataattaattgttattttatgattgaatttttcttataaaattgcgaaaagcgaagaaaaattaaaaatggtttttatttttacgtattttctttttgttttcattgctgagttttttgcttatggccactgtactgccgtttatcaaatgcaaatgcacaaaacgcaaaagaaaaataaaaaattattctcatcagctgctgaacaacgaaatgaaaagatattccattttcaaaataatgtaaaatcattcaaaaagatattaataaaatttgtatcagattagacgtatttctgagtaattttttatttatttgaaaaattaaagtcgaattaattcattaaaactaaaagtgatttggtaaatatttatttgtattgatttcacattatatttttattttggcggtgatctcgtttaactgtttatgcgcttcttgaggacatttttaattaatgtttttgtcctcaatgtaagcggattttcccttttgtggactttttccttattgacaataaacaaattaattttataaaaacttctaataaaattccattaattttagttcctatataatg

SEQ ID NO: 113659 - DNA, 1003 bp, Heterodera glycines
  Promoter: Source sequence=SeqID_1032; Location=1445..2447; Strand=-; Gene=SeqID_66499
tttttaaaccttttgtatatattaacatatttaaaaaaaaattaatttattcagcttttttaaaatttattaatagataattgctgaaagaaaaatataaaatttaatttgttcttttatgtaaattttaaattactctaaaagaattaaataaagttgtttttctttgcttttttgtttttaaattaaaaaaacgcagaaaaaaaagaaaatttattattaatttttttgtcgaattgtaaatcattgaaataaaagtaatgaatttctactagagcctattggtttaatcacataatatttaagcctccaaaaccaactttaaggaatttgttgaattattaaaaaaataacttacaaatgaattcattgaggatggagtttttcctttcaaaacacagaattgttaccaattaataattatttattaatttgaattggcctggaccaggacaggaccgcacttttcaaaatcccgacccaaatggccgggaccggtaccgaaacttttgaaatgggaaagggacaaaatcccgggtccgaaactcccttttgccgggaaaagtgaaagattaactgattggttaaaatgccaaaaaggtgaaagatgtgaaaggtgaaaacgaaaccgcgccttattagggtcatatttttacatttttttagtatttattttaaaattttcaaaatcttaattagtagggctgggatttttatgttttaacatattttttttgcggcttagttatggcgagagaagcccaaaaatagcattttctccgaacaatgtttgatttagagcgagttataaaaacataaaaacacatattttggcgttttggcacataaaaacatatggcacatatttcggggttttggcacatattttggcatttttgagaaaaatcgtaaaaaaaatacaagaaaatctgaaaatgcaccctaaaaattgactactttacgtttattaagcatttagaaaatttctttatatattcaaatg

SEQ ID NO: 113660 - DNA, 810 bp, Heterodera glycines
  Promoter: Source sequence=SeqID_30276; Location=323..1132; Strand=+; Gene=SeqID_60696
tccttgggccgcgcctttttttgtgacaggcatctccaatttgagcatcacaaagtttgggctaaattaaaccattcggtaaaattaatttaaaaaataattgtaataaaatttagaaaataatataaatttgtttgctttttaatgtcatgcgccaaaatatggagatatgcacaaataataaaaatttgtaaataaaaatatttttttatttttatttttcccatcaaatgttttcccgaccatttcattttatgcttttagcaccgtgacatgtcacataatgataaaaaattttttttgttattgatgacacaaacaaaattagcatcagctgacacgagaaagaaattatgatttttctttttgtataaattaaaaaaaatttcccacaatattcatactggcatagctattatttttctcgtatacacttaatagaaaactcattctcggtgaaatggcaactcgtataaaatttctttgaaaaaacaattaaaaattaacttttttttataattttcaataaaaaattaaaaaagtaataaaatccgaaaaaggaacataactgatatttgattatttttaaaatattttttatccaaattaacaagtttttcacacatacaaaattttattttaaattaaataatatagaaattaattttattccgacaactttttttcaacactaattactcccctcgatttaaatttttttgatccgcataaaaatgctgatgattacgctggcatttgtgaaacaaattgtgaagttgagcctgtttttcaacggcatttcctgggatg

SEQ ID NO: 113661 - DNA, 224 bp, Heterodera glycines
  Promoter: Source sequence=SeqID_715; Location=1900..2123; Strand=-; Gene=SeqID_59669
tctaaatgactgacagggaagtgaatgataaggggcgtggcataggagggcatactgtggatggatttcgaaatcctcccgtctggaggtccctgcgtgctctcacttgagtgggcgtggcctattcccacgtgacacccccctctccgctacgtcacatacagtacccccacacttttcccttctcattttcatcttaacacacaaaaatattcctcgaaatg

SEQ ID NO: 113662 - DNA, 849 bp, Heterodera glycines
  misc_feature (59)..(59): n is a, c, g, or t
  Promoter: Source sequence=SeqID_15076; Location=294..1142; Strand=-; Gene=SeqID_79246
cccgatgggtgggtctttgttcttgaacaaaaataatgaaataataatttttgtttttntaatataattcattttcataattttttatttgaagtttattttatttatttttaaatttataatttttgtctttaaattaattttttgtttataaatacaaattctttttttaatattattattttaaatattttttcttgaatttttgtctaattctaagattaaaaaaggctttaatttcattttttttaaaaataggcaaaaatatttcttcaaatttctgatttttatggattaaatttattataagaaatgggcagctttaaaaactgtgattattattgtaccctgatatgtttgttctctgtttgtttatgttgttttatttcactaattttattctgaagaaagttatgagaaaaaatatgtgtcaagaaacttttgggacacaatgtatttaattatttatttacttaagtaatcaattcttaccaactcgatttcatctcaacaagtttttcatttgaacatttgaaatcgtcaattatgtgcccgaatgttcgccgccgtcaaagccttggcctaattgtttacaaaataatttataatataaattattcattatgaatttaatattttgaccgtttcaccgatttcaaaaaagtttgctttccatgcctcgctgcttatctgtccgtgccaatgatggtcattccgcgtgccattcacgacgttcttgaaattttgtataattttctattgtttttctctcttttttcatttatggtcgaatttttttgattttcaaaattcatatttttcacaaaaattttttattacaggaacatg

SEQ ID NO: 113663 - DNA, 305 bp, Heterodera glycines
  Promoter: Source sequence=SeqID_11261; Location=1..305; Strand=+; Gene=SeqID_74630
tttgctttgatccaaaaattaaataattattgaaaacattaattactttaattttaataaacgcaatgaaaaaataagaaatacaaataaaatatattcatttttcttaacattttttaaaataaaagatatatgtaattaatataagaattaataattgagtaatttcaaattttattcaattgagggataaaatttaattcaaattttaataaataaaaattcattttaattggactaattttaatttaattatttgaataaacaaaagaattaattttaattggctaattcagagtgatatg

SEQ ID NO: 113664 - DNA, 1003 bp, Heterodera glycines
  Promoter: Source sequence=SeqID_2242; Location=669..1671; Strand=+; Gene=SeqID_78665
taattttatggtggttttttattttatttgcttttttctttttgttgcgtgtttcaaatttaagaaccttggaacagaatttatggatttttgtgaatttaataaaaaaaattgtaataaataatttaaaaaatttcttctttttttggtatattctaaacatgaatttcctgactattttaacaaattgaatcaccatattcacaattataaaaatatttttatctaatctataataattaatataattataaaatttataaaatattaatacactttcttcgaaatagaaggatattaatgttaatttatcaaatgcctgatatgaaacttccttttacaagtaatattgttttaagtatttgaatttaactaataattatcagtagtaacacacccgggacctctgtggattgacactaattagaagtgacaggtggcggggggaggggtgtcaattagtcactaattgggggggggggggtactaattggtcagcagtcaagagggcactaattggtcagccgtagggtgtggggtggggtgtcaattaattaattaattggggggacccaaacctattgaacggtttcaaattgtcttgtactttttttgacataaaatttgattgatttaaaaagtgacagccgagggggagggggaatttgattggtcagcgaagtgacagatgagggatgaaattcaaatttctgatggggagggggatcggaaaattatgattgatcaacaatgtgacatttgcgggggcattcaaatttgcggggagcggggtgggatggtagagagggatatttctcatcttttctctgtccacccctgtccaaacagagcaatgcatatcgatttgacgggggaacgccgtcactttctcaccgctttactcattgccattaaatgaccaaacgaccttttccataattctcccctatttttaggtgtgttatttttccatatttttctcaacatttgttcaacaccaatg

SEQ ID NO: 113665 - DNA, 386 bp, Heterodera glycines
  Promoter: Source sequence=SeqID_35150; Location=1..386; Strand=+; Gene=SeqID_64774
actccgtacaaaaagtcctgtcttaacaagactccggtcctgtggcattttccgaaacattaaccggactatatcagttgcccatctccgtctagaaaacaatacagttttatttttaagatttgaaacttaacctaaatcagcacagagcatacatttagcatttgtttattagctgtattattttaattaacgttttttcttctttccatcacttttcctcctccattattttgttcatccttttttttccattacattggcaaaaaacttcccgtcggtgaatcatttcttccattccaattggccacttttggccaatccttcgtttttcattttcattgattcattttacatccgcataaattgttgcataatattaaatg

SEQ ID NO: 113666 - DNA, 210 bp, Heterodera glycines
  Promoter: Source sequence=SeqID_39118; Location=1..210; Strand=+; Gene=SeqID_67759
atactctctctcttctttcgctgtctgcgctctcactgaaactaatgcagagacgctaaaatttgtttttattttagtgtttctatgtaaaaaacttttgcatggcaaaaatgtttaaatttaacttttacactttaattatttaattttttcttgcagagcaaatgaaaattattgtacgaaaaaaaatggcagcaagatcttcgcatg

SEQ ID NO: 113667 - DNA, 104 bp, Heterodera glycines
  Promoter: Source sequence=SeqID_7494; Location=1056..1159; Strand=+; Gene=SeqID_64997
aatgattcattaagaatttcctttgattagggctgctaaatgcttttcctcccttttcccacagttttcgcctgcatttcgtccgttgtattcgtgccgaaatg

SEQ ID NO: 113668 - DNA, 1003 bp, Heterodera glycines
  Promoter: Source sequence=SeqID_9555; Location=78..1080; Strand=+; Gene=SeqID_71878
agcgcaaatttatagttttcttaaatcaagtattaaaaagctcgaaaataaaaacaaataaaaaggacagataatatagaatcaattgcaaataatcaaaagatctaactaactaagtaaccaactaataattattttttcaaatttaattattttaagataacgaaataaaacaaaaataaaattcagaaagatagatttttaaaatataagaaaataacctcaacgaaaattttcaattaataaattaaagagttttttcgagcgttaaaaatattaaaataaatgattttttatattgcaagtttaaaagtacataataaatatcataaaaaggttggttgttaaaaatataaataaatcattaataaatattcaaaaagtcttaaaaaaactatttatgtttttccctctttcactccggtttatttgaataaatattttgacgttagaatacaaaattttttaattattaaaaataacgataaatttatcaatttaaagaataaaaaatataattttatttaattgattcttggtagttgtgtgtggacgcgcagaagccgatgcgtttttggatgaagaagggcatcaatattttccttgatcaatttggaggggagcatgcagattgaaattattgcaatataaataaaaataaaaaaagttcattaaattttaataaaaaagaaaaataataaaatttatacaaatgaaaaatgaaattataatataaaaagtttaaaataatatttggttgttcgaatggctgaaaaattatataggcaaaaacgggacattgttcaagtcagattcaccgtgcactctacctcaattgaatatcatttaaataataatttaaagattactattactgtaggcaacaaaaaataataatggcacttacaaaatcccttacctaagaaaacaaaaatttattttaaaattttcaaacattatataaatataagtataaaatatttaaggttggacaatttgaatg

SEQ ID NO: 113669 - DNA, 66 bp, Heterodera glycines
  Promoter: Source sequence=SeqID_564; Location=225..290; Strand=-; Gene=SeqID_56332
tatccttttcggagtaatcggcgcaaaaagttcccacgtcgagacaaccaacagggggccgatatg

SEQ ID NO: 113670 - DNA, 149 bp, Heterodera glycines
  Promoter: Source sequence=SeqID_4234; Location=964..1112; Strand=+; Gene=SeqID_53707
ttttttggctttgaattgaccgattgacgcaaattgatcaaatcggaacctcagcgaatggacgaagaattcatcttcaacaaaaccacgtctgatcgacaaacggattggtacggagagttgtgatcgttcactttttgtgcgaaatg

SEQ ID NO: 113671 - DNA, 407 bp, Heterodera glycines
  Promoter: Source sequence=SeqID_10719; Location=1..407; Strand=+; Gene=SeqID_73967
ttaaattcacccgctcaaacctcaaaatcattttataaaatgtcatcattatcattatctcccgaaaaaattatgtctcaagctccgtcccctaataaggcaaaagttgaccaacgagctctctggaaaatcttcaagggcaagtacatgctggcaatttatctctgcgacgatgactagcgaaaactgtacgagaataaagagaaagtcagacgactagaggacgacgacgacaatgtgacccttagtttccaaatgtgtgaggattgcgtgcgcgtgaattgcaatccaattgacataatggcaccaccgaagaaacgaaagatcgagaaagcttaagctcgactcattcgccccatcccatctcgtccaattttcgcccaagaacaactcctgccatcaacatg

SEQ ID NO: 113672 - DNA, 178 bp, Heterodera glycines
  Promoter: Source sequence=SeqID_41603; Location=716..893; Strand=-; Gene=SeqID_69687
atatttaatgcatttgaacttcacatatttgtttttagactacaatcggacaaaaacaatgacaaattatcgtgcttttatggtggaggggtgggggtgataaaaagcacaaccttttttaaactttaataaaggatttcaaatttttttttgtcaggttatgtttttttaaaggatg

SEQ ID NO: 113673 - DNA, 266 bp, Heterodera glycines
  misc_feature (51)..(51): n is a, c, g, or t
  misc_feature (75)..(76): n is a, c, g, or t
  misc_feature (83)..(83): n is a, c, g, or t
  misc_feature (129)..(129): n is a, c, g, or t
  misc_feature (168)..(168): n is a, c, g, or t
  Promoter: Source sequence=SeqID_21197; Location=1..266; Strand=+; Gene=SeqID_51787
aaaactcaggatttcattttaaaacaaaatcatcaaaaagagagatattanttcattcaatttaaaagaacaagnnatagtgntgtagtaatagtgcagatggtagatataaaatttttttttgaaatntaaagtcatttcattaaataggtatgcattgtaaaacgnactcatttttggtcttaaattttgtgttgaaatgcgaaaatcaaggtcgaagctcgcatttcattcaaatcaacaaatcaaagatttccaagtgaatg

SEQ ID NO: 113674 - DNA, 370 bp, Heterodera glycines
  Promoter: Source sequence=SeqID_11484; Location=2670..3039; Strand=+; Gene=SeqID_74898
tttggctgaaatcggggactgaaaattaattacaagaaattgcacaaaacgaaaaaaattaacaaaaatacttagggtttttagtttttcaattttagattattttggagcaaaaaattaaaaaaatgacgattacaaaaaatttagtagatgaagaaaataaaaacaaagaaatgtaaatttgatacggagcggagcaatttatatagaaaaaaacgaatgacaaatgaaacggaattttggaaaggcacacggttcacacatcggaaggatatttaaatgggcatttttgcgctttgttgttcattcgtcgcaatcactgcaccacacataaataatattttgtccttcttcctcctcccataaaatg

SEQ ID NO: 113675 - DNA, 834 bp, Heterodera glycines
  misc_feature (64)..(64): n is a, c, g, or t
  misc_feature (91)..(91): n is a, c, g, or t
  Promoter: Source sequence=SeqID_11541; Location=425..1258; Strand=-; Gene=SeqID_74978
agacaaattaaacttgcgaatcaagggaaaaggtgagaaaagacgaaagcaatttaaagcattntatacagaccgtattaattaacttttntaatcaaacggagactaacaacacaaagggaaatttaacccaacggaaaaattgagctaatagaattagtgaggtaagtagaaatgaaacgattcatttttcttccgtttaagatactgtaattccctccaataaattattctttaaaatttttggcgccatgtttattttaaaaatggtgtttgttagctgacaaatgagttttcaattctatccatttccagtgcccgatttatacaatgcgtactctatacctaatgtggaccttttttgttttgttttttttttgtgattatcaggtcctgattcctgatacgaatttaacatatattttgactagttcttcagccctaacccgaacttcaataatcacagaaacaattttattactagacgtattcaaaaacatttgcaaaccaaaaggcccttggtttttaataaaattcaaaatgtccaattaggtaggtataaccagcgctgaaaattctatttttccaatttttcaggcacgtgttttaatcgataaaacaagcaaaaattagtcacaaacattgcgacttcactagtcattttatcagatttgaccataaatgtgaattttgaaaaatttaattctcgaactttttattcgaattcggactttgtgtcgaactcaaatttttttatgtatcaacaattccataattaaatattttttccccaggcggtattttttatttttcgattttacattttgtgacatg

SEQ ID NO: 113676 - DNA, 56 bp, Heterodera glycines
  Promoter: Source sequence=SeqID_3028; Location=5934..5989; Strand=-; Gene=SeqID_82840
ggtatacgtttttaaacttctatttgaacaaaaaaaaaatgtttaggggaaaaatg

SEQ ID NO: 113677 - DNA, 1003 bp, Heterodera glycines
  Promoter: Source sequence=SeqID_40633; Location=84..1086; Strand=+; Gene=SeqID_68901
attattatatatatttgtgtgttcatcaaaacaaatccaagtctttcattcattttttgttttgtgtgcggacttctttcttttctcttttctgatgagcccttctcctcttcacacaccgaaacactccttttattattttgtaaaaaacaaaacaaattacttacattcgtccaaaaagtcactttttaaattttattccattggccaaattttatttcattttttcgcccatttttttgtattatttttatttgtcttacacaaaacactcccaataattattaaacacagtgccgaccgaaatttggtgtattttacctaacattttttacttactgcgctctttcagcatttttttctttttactttccctgtcccctttcattcattcgcttgtcattattatttttttttatatatatttgttttttatgactattaaatacttcaatgtcagaagaaagtgcgtgcatttttatattaaaggaagcagttaattaattacctgattataccttaattgatttacatctgctgcagcaaaagagagacaaagagcccttcaatttattagcgcgtaagtgtatcgaatatcgccatacccacaattaattttcattttaaatttgaaaaaaatacgcccacaaaacgccaaaacttttttgtgtaagaaaagaaaaaagaggaagagcagagctaacgccaactaacttcgaaaatgttttaagccttcgaactttttaacggccaatgctaacccattataaataagcttttgctttgctcaaattttcctaattttgatttttttttaatgatttctcactcacctggtgaacctcaagacaatgtctaagaatcccctactttttaaattcaatttacatttttatgtctaatggatgcccaataataaattttaaatgttttttcagcctgaaattttatctatcatttgccatttgctgtaaaaaattgaatttttacaaaaaaagcgatg

SEQ ID NO: 113678 - DNA, 869 bp, Heterodera glycines
  Promoter: Source sequence=SeqID_12274; Location=1411..2279; Strand=-; Gene=SeqID_75865
gaataaataaaaaataaatttttttggcatttcaaaaaagcgattttgtatcaagggaatttagagcattctaaagccattaaaaataagcatttgatggaaattttcctgctattcgtcttatgtgttatttatttcttttttaaatgaaaaataaaaaacttatttcaattttttttaaagttacatagaaaatttaatgttatctatcctaaaaattttaactttattgactttatttagacaaaaacaattattctgattgagtaatttaaatcatttgttacatatttttatttaattagtttgttaaaatctttgatgtcactgttatgctcaaatctaatttgcaaaattagtttaacaaatgcccactaattaggttgcgttctttgtgaacctgttggttatcagccacggaaaaattaaaggcaccttcagctaatttataaacgtaataaagcttccgctttcaaagacgtaaatcattttcatgaaaataaatggtccactaacaatgaaaactatgcttttcattaaatttttttcatattagataatttgatgaatattttatataaaaaagtaatatttctttcaaataaatttatattttactacgatcaaaattattaacgtgaaaaatgcgtttataatttcgcttacaataatatataaaatcacattatcctatgaaaaaaattagcgtgaaaaatgcatttttaaattttgcttctccgaaacaacgataataatgaaaagggtcaatcaaatgaaagtgacattctaaagcaaataataaaagaaatttcataaaaacaaatttaaaaaaattaattttctttttagaataaactccctttaaaatg

SEQ ID NO: 113679 - DNA, 103 bp, Heterodera glycines
  Promoter: Source sequence=SeqID_16849; Location=1545..1647; Strand=-; Gene=SeqID_81272
tttttttatgatttttagcgcatttcgtttttttggcattttgtaataattttaattgtttcttaattaggtagtgaatattgattttgattgattaaacatg

SEQ ID NO: 113680 - DNA, 313 bp, Heterodera glycines
  Promoter: Source sequence=SeqID_30591; Location=1..313; Strand=+; Gene=SeqID_46226
ggaaaatgttaagattttgcccgttatagaatccgttgtaacaggacagtctcgtacaatattttctcaggatatcctggtctggatcttgcatattttatcccggatattctcgtcctgtcctggcgggttgttttttttaattcgattcaaatcatcgcctcgattatcaataagtccatttttttagtgggtaaaatttgtttgtttcttataggaaatgtgacataaaaatattaatttttacaaaaattttcccctgtttcagtgtaaggacaaatgcattgagcagtaccaaaaggcggccgacatg

SEQ ID NO: 113681 - DNA, 1003 bp, Heterodera glycines
  misc_feature (41)..(42): n is a, c, g, or t
  misc_feature (46)..(48): n is a, c, g, or t
  misc_feature (52)..(52): n is a, c, g, or t
  misc_feature (55)..(56): n is a, c, g, or t
  misc_feature (64)..(64): n is a, c, g, or t
  misc_feature (77)..(78): n is a, c, g, or t
  misc_feature (91)..(91): n is a, c, g, or t
  misc_feature (100)..(101): n is a, c, g, or t
  misc_feature (108)..(108): n is a, c, g, or t
  misc_feature (110)..(110): n is a, c, g, or t
  misc_feature (136)..(136): n is a, c, g, or t
  misc_feature (144)..(144): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (191)..(192): n is a, c, g, or t
  misc_feature (203)..(204): n is a, c, g, or t
  misc_feature (209)..(210): n is a, c, g, or t
  misc_feature (213)..(213): n is a, c, g, or t
  misc_feature (226)..(226): n is a, c, g, or t
  misc_feature (230)..(230): n is a, c, g, or t
  misc_feature (238)..(238): n is a, c, g, or t
  misc_feature (245)..(249): n is a, c, g, or t
  misc_feature (252)..(258): n is a, c, g, or t
  misc_feature (260)..(260): n is a, c, g, or t
  misc_feature (262)..(263): n is a, c, g, or t
  misc_feature (265)..(266): n is a, c, g, or t
  misc_feature (268)..(268): n is a, c, g, or t
  misc_feature (270)..(272): n is a, c, g, or t
  misc_feature (279)..(280): n is a, c, g, or t
  misc_feature (285)..(285): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (296)..(297): n is a, c, g, or t
  misc_feature (300)..(300): n is a, c, g, or t
  misc_feature (308)..(308): n is a, c, g, or t
  misc_feature (319)..(319): n is a, c, g, or t
  misc_feature (323)..(324): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (336)..(339): n is a, c, g, or t
  misc_feature (349)..(350): n is a, c, g, or t
  misc_feature (355)..(355): n is a, c, g, or t
  misc_feature (363)..(363): n is a, c, g, or t
  misc_feature (378)..(378): n is a, c, g, or t
  misc_feature (381)..(381): n is a, c, g, or t
  misc_feature (395)..(396): n is a, c, g, or t
  misc_feature (405)..(405): n is a, c, g, or t
  misc_feature (407)..(407): n is a, c, g, or t
  misc_feature (412)..(412): n is a, c, g, or t
  misc_feature (425)..(427): n is a, c, g, or t
  misc_feature (429)..(429): n is a, c, g, or t
  misc_feature (432)..(434): n is a, c, g, or t
  misc_feature (438)..(438): n is a, c, g, or t
  misc_feature (441)..(441): n is a, c, g, or t
  misc_feature (452)..(454): n is a, c, g, or t
  misc_feature (457)..(457): n is a, c, g, or t
  misc_feature (460)..(460): n is a, c, g, or t
  misc_feature (462)..(466): n is a, c, g, or t
  misc_feature (468)..(468): n is a, c, g, or t
  misc_feature (470)..(473): n is a, c, g, or t
  misc_feature (476)..(476): n is a, c, g, or t
  misc_feature (478)..(479): n is a, c, g, or t
  misc_feature (488)..(488): n is a, c, g, or t
  misc_feature (491)..(491): n is a, c, g, or t
  misc_feature (496)..(497): n is a, c, g, or t
  misc_feature (501)..(501): n is a, c, g, or t
  misc_feature (503)..(503): n is a, c, g, or t
  misc_feature (514)..(514): n is a, c, g, or t
  misc_feature (517)..(518): n is a, c, g, or t
  misc_feature (520)..(520): n is a, c, g, or t
  misc_feature (522)..(522): n is a, c, g, or t
  misc_feature (538)..(538): n is a, c, g, or t
  misc_feature (554)..(554): n is a, c, g, or t
  misc_feature (556)..(556): n is a, c, g, or t
  misc_feature (561)..(561): n is a, c, g, or t
  misc_feature (563)..(563): n is a, c, g, or t
  misc_feature (569)..(569): n is a, c, g, or t
  misc_feature (587)..(587): n is a, c, g, or t
  misc_feature (598)..(599): n is a, c, g, or t
  misc_feature (602)..(602): n is a, c, g, or t
  misc_feature (611)..(612): n is a, c, g, or t
  misc_feature (626)..(626): n is a, c, g, or t
  misc_feature (630)..(630): n is a, c, g, or t
  misc_feature (641)..(643): n is a, c, g, or t
  misc_feature (647)..(647): n is a, c, g, or t
  misc_feature (653)..(653): n is a, c, g, or t
  misc_feature (660)..(660): n is a, c, g, or t
  misc_feature (671)..(671): n is a, c, g, or t
  misc_feature (675)..(676): n is a, c, g, or t
  misc_feature (680)..(682): n is a, c, g, or t
  Promoter: Source sequence=SeqID_8994; Location=1441..2443; Strand=-; Gene=SeqID_69937
tttgtatttggccaatcatttatttatcttttgagggagcnnagcnnnggcncgnncgccgccncagcctttcgagnnggacgggcgaagncccaccgcnncggagcngnacacggacgacagacaggagcacagngaagccgncccggcncngngccggacgcacgaggaaagcgccaacgccaaaggcnncggggaccaannggcanncgnggacaacccaagngagncaaaccgnacaacannnnnccnnnnnnncnannannanannncagcacnncgacncgcncngnggnnggnggaaaaangggccgagggngacnncgnganggncannnncacgcccggnncggancgagaganggccggggaacagcncgnccaacgacgccacnnccccgaccngngcaanacggggagcggannnanggnnncggnaanaggaggagaannnggncangnnnnngnannnncgnannaagcgaacncgngaaanngcancnacggaaggggncanncngncgcagcaccaacaacnccagcaaaagggacangngcgcncnaacaancagacgaaaactggcggnccaaaaaaggnnccngcgaagcanngccaggggcatagnccgncgccaaaaggnnnccgngcaaangacaaancactgctcaancggnncatnnncgcgcgctttgcctgtgccgatccgtcagtgatccctccgttcttcgcctcttctcagtttggcattgatcgcgctggtggacccattgttttgccggaccaagtctgctgtttccatctgcgccacccttttcaaccagtgctttcacttaggttgggttgcttatcgcccgtctccacggcgtcgtcagcaccgccgtcgacgtgtccatcccttttgagccgaagggaggaaaagcgcaccaccagcggtttttgcatgaggccgatttgagtcaactgaacgaagcgttggaaagactgcgccaattcgtcgaaatg

SEQ ID NO: 113682 - DNA, 348 bp, Heterodera glycines
  Promoter: Source sequence=SeqID_9824; Location=1316..1663; Strand=-; Gene=SeqID_72833
ttttaattttttgtttttgtctttcattgtttaatttaaaggtttaatattgcttatttttttaaattcaaagtctgtttgtcgtaaaattttatggttatgtattggttagaaaaagtatttatttttgttgtatacacattatttcatatatctactttaatttgtgttttattttagaattgttaaacaattagagaattgtttttctgccgatacggctcattttttctaccagtttggtcaaaaatctggtgactaaacaatttatcgttgtttttctgccgctacggctcattttttctaccggttcggttttttcaaatctggtgccagcctgttgccatg

SEQ ID NO: 113683 - DNA, 483 bp, Heterodera glycines
  Promoter: Source sequence=SeqID_33317; Location=1..483; Strand=+; Gene=SeqID_63415
ctcgaataaaaatcggaattttgaatttttcaaattatgattttttgttcaaatttagattaggaaatcggaattgatcaaaataattgaaggattcgtgatcggggaccccaaaaaccccagagaataaatttttatgactatcacaaaaaaaactttgcaaaacaaaagggtccccccttttgaaaaaattttcaaaaagggccacttttaatatagcgcctataactgttaactatgtagggattttttgtcactaaaattcacagccctagtcattaggagccacattgtaagacggatgtcgtatcatttcccttcaagctcttggaattccatttgatcaattgtacgatgggtatggccaaaagtacatcaagcaaccaggtttacaaacattggccataacttttttgaaactcaacgaaattttttgaaattttgcagattattagaaaacacttgtgttagggctatcgaatg

SEQ ID NO: 113684 - DNA, 211 bp, Heterodera glycines
  Promoter: Source sequence=SeqID_4018; Location=2737..2947; Strand=-; Gene=SeqID_52834
tagtgattagcaccaaaaatgttttggattattatggtattttagctaccatttgcttttgtctccttttttggtcgcccatttgtccgtccatccgacagataattccctttgtcagcgttccgcgtcaaattccctcccattcggcttcccgccggtgcttttaaagtgcgcttcgcccctccgcccattcattccgccgtgccaaatg

SEQ ID NO: 113685 - DNA, 334 bp, Heterodera glycines
  Promoter: Source sequence=SeqID_14523; Location=1..334; Strand=+; Gene=SeqID_78574
cttaattggtccctccgcccgatcaatcatttttttctgtaaatgcaataaactcagttcaaattccgcatcctattccaattttttatatctctttcgtacatatttttattaataaaaaaaataaattttttatcattttaaaatatttagtatttcatttttcatttaatatggttttcattgtattttccaattaaatttcgtcattttgataattaattacaaattattttataagaaaatttctctcttctcaaaaagtgcaaaacaattaaatgcatattttttgttccacataatttagatgaccttctgctaaaaaaataaaatg

SEQ ID NO: 113686 - DNA, 251 bp, Heterodera glycines
  Promoter: Source sequence=SeqID_27304; Location=348..598; Strand=-; Gene=SeqID_57984
ttgtttaggtatgagtacgcggacgaatcgaacatttcacagccgtcgtcgatgtacgcggacccgcccctcttcaaggaggaaatgtcggacgaatcgcacttttttctccactcaaacaacagcaatcagtcactgccatttccagcctctacgtttgtgcaggtggtcaacgaaagattgtccttttttgatggcaaaacaatgcgaaattattaccactgcccccccccccccccccgcaattaatg

SEQ ID NO: 113687 - DNA, 185 bp, Heterodera glycines
  Promoter: Source sequence=SeqID_25410; Location=334..518; Strand=-; Gene=SeqID_56154
ttttgagcattattttaccattttggagaaaatgcccatagttttgaatgcttttggcatttttcttccaattttttgaaaaaaaagaatttgacctgctaaaaaattgcttaatctttaagctattaaatgaccaaaattgttttaaaacatgcgcaatttaatttttttagcatttaaaaatg

SEQ ID NO: 113688 - DNA, 744 bp, Heterodera glycines
  Promoter: Source sequence=SeqID_5130; Location=1874..2617; Strand=-; Gene=SeqID_57020
gttgtttttcatcaaatttaaaacatttaaaattattacctaaaattcgacattatatttttaggatatcattaccaatagtttgtttttttttttttcaaattgataatgtcgacgagtagagaaaaacttcgaatagcaatttttatatcttccgagggattaatggcaactcgtacaaaaattatttttacaaaataaagcctaagcctatgtacgagtagactttgtatggtttccattatgtacaaattgtcatgactctcatttccagagcgataattcaatctttcggagtaattttctatacatagattttcgagaatttctaaaacagaataaagcattcattgaactcgatattttttatcgtacaatttattttcccttttcatacaatttatttttcgttttatttttgttattttataataattgaatcattcatcttccaaacacagaaaaatttattgccaggaaaataattatgcataaatttactgatttgggtgtcaatcagcttttttttgctcacatcagtgatgaaaccgcattacattctcattaaccacaagagatatgcatcgaaaacagaattgtacatcccttcccaaccattcatttcatttcattttggacaaccaatttatttggttaataataaataaaaataaataaaaacgatttaaaaataaaataaattttcatatgtttttagataatccaagaaccaaccttaacatg

SEQ ID NO: 113689 - DNA, 480 bp, Heterodera glycines
  Promoter: Source sequence=SeqID_1675; Location=1247..1726; Strand=+; Gene=SeqID_46984
taaaagtttctaaaaattaaaatttgttttaatgaggggtaagggtttgatgttagacgttcgaccttcgattcagttttgttgctagtaaatatttaaaattaataaattggcgttttgcaatctttttttattagaagtaaattgaaaattttgaaaaatataaaattttttgaaaactttctattgtataggttgtggagtaaaattgaaaattttgaaaaatataaaaaaaaatttttgaaatagttgtcttgtacatttcgggtcataaaaaaaccccgagttcttttaaaacaggaatttgtccgggaacctgtcgggttcaactcggaattctgattctgctacagaccttggggttttttttcttcaagattacgtcctcatctatgtaaatgacaagggtttaattaataaatattctataacaaaaatatctgtttttaataaaaaggatttgtcttgatagagaatatg

SEQ ID NO: 113690 - DNA, 112 bp, Heterodera glycines
  Promoter: Source sequence=SeqID_37256; Location=859..970; Strand=-; Gene=SeqID_66364
taatcatatcaacaatatatccaattccatccaaccccaactaaacacactacgagaaacaaatcctcaaattttagaagagcctgatataaaaatttggtttgacaaaatg

SEQ ID NO: 113691 - DNA, 440 bp, Heterodera glycines
  Promoter: Source sequence=SeqID_42954; Location=1..440; Strand=+; Gene=SeqID_70744
gggaacacttagcgaatttaatgacggaaagtaacggagggaaggtaaaactgatgaagcaaattataaacaaagtgactaatgaacagacagaaccgtcagaagaaaaaaagacggaggtgaaaaattggttaattaattgagaaagacaattaattggcaaattagttaatttattgagaaagaaaactaatggtcaatttgttaattaattgagaaagacaattaattgaccaattagttaattaattgaaaaaggcaattaattggcaaattagttaattaattgagaaatataattaattggtcatttagtgtattaattgagaaaggcaattatttggcaatagccaattaattaatttaatttgtggactaattaaatatattttgcataaacgtaaaaatgaattttgaatttgctgccaaaggaagtgatg

SEQ ID NO: 113692 - DNA, 462 bp, Heterodera glycines
  Promoter: Source sequence=SeqID_6783; Location=593..1054; Strand=+; Gene=SeqID_62890
ggggggggggggggaatgtataagtaggatggcaaaacttgataaacctcgattttaaaaaattatagcggacccgcccccccccctaaaaaaccgaatataaggcaaatccgccgtctgactctgtccccattttttattttaatgttcaaaaaacattttttcattttaaggtcacaatcccatcacaaagtaagttcaatttgagaattagaccggagatcatatacagaaaaataaattgaaaattaaaatttttgaattaaaatattcctgttttttgtgttcccatttttacagtagccacaaattgagcacgaatgagaaaatgacaaaaccgatgacaatgattcaattttcatccatgcacaagagggacatgaaatgaattcatcgtaaataataaatattaaaattaaattataatattttatgaattaaaataaaattatagccaaaatg

SEQ ID NO: 113693 - DNA, 81 bp, Heterodera glycines
  Promoter: Source sequence=SeqID_12125; Location=1..81; Strand=+; Gene= SeqID_75694
cgcttggcgcctgagagagcgatcggaaaagtgttcaattcatgtatggcaccgagaatagtcttctcaacagctgccatg

SEQ ID NO: 113694 - DNA, 275 bp, Heterodera glycines
  Promoter: Source sequence=SeqID_21336; Location=1005..1279; Strand=-; Gene=SeqID_51936
ttccccactcattttgttctttttttcctctccaattttgccccatccattttttcataaaaatttgttttcataatattacaataaatttccaatttatcatttatgcatgttaattgtcgccgtttaatgaataattcatttttggtagaaagaatgattcacaacacacaaataacattaacagattttgaccaaaaatgacaactaccgagtttttttgagccattaaaaactagaatttgataatacatacatacatattctttaaaatg

SEQ ID NO: 113695 - DNA, 955 bp, Heterodera glycines
  Promoter: Source sequence=SeqID_10878; Location=842..1796; Strand=+; Gene=SeqID_74158
ttttaaatttctgtccgggctagtcgaagactaaagggactttaaaaagagaagaggtgagaaaatctgtccgggctagtcgaaaactaaagggacattgaagacgaagagaaaagaggtgagaacatttgtccgggctagcgaaaagctaaagagattttacaaaaaaaaagaagaacaaaatttgcccgggctagtctaaatgctaaaggggctgactgcatcgaaaattgacaaatttgacaattatttgtaggagagagagagaataaggaaagagagtgaaggaagccaaaaataaccaaaaaaaaagtcctggtaacaaacgaataaggactaatttataaaaatatttgaacgaatgtgaagcaaaaaaaaaagagagagagagagaagaagtgagacaaaaaaaaatatagaacaattttttgaggagagcaaaaaggcccgggctgataaccaatcaaaggggcactattttagctaattaaaaagagggaccaataaaaaatgaaaattaggccctatcaagttacagtttttacaagttccaaagttcattttatctctttgttttctcccgtttttcacgccataagaatattcacgtaatcacgtgccgccgcatttttcattgggcgagatcattcactttaaacatttttgcggcgcctgagaattgttaattgttcttgttaggcgaagtttaaacggagatggagcagataagcccattcctggaaggcgttcgcatccatttgattacccgctatcattcattaattttttttttctctctcaattaatgcataatgggattaccaaataattttttttagcaaaataaaacaaaatcttattacgaactgaacgacttcgaatgtctacatcagggggctcgtcaaatgagttcccatttggtacatcccaagccttcgggcaggaaacaaagatg

SEQ ID NO: 113696 - DNA, 334 bp, Heterodera glycines
  Promoter: Source sequence=SeqID_7611; Location=1685..2018; Strand=+; Gene=SeqID_65405
cctaggcaaaattttgttcaaatttcgttttcttgaatgtcaaattttcatttttgttttgtctcattaaaactaattgcaacaatctcattatcgagattactactaatttgcccaaattaggggtgtcagctaggaccccaaaaattcgaaaacccggattaggaagtatgaaatgcagaactgggattcatattcccgaaaaaagtcgaaaactgcaacggtaaggcggcgggggggggggtcgaacgtcacccgccgagattaggcacactactaattggcccaagaatcatttggccaaaaaaagaattgagactgttcctcaaaaatg

SEQ ID NO: 113697 - DNA, 658 bp, Heterodera glycines
  Promoter: Source sequence=SeqID_5468; Location=1..658; Strand=+; Gene= SeqID_58168
gtctatgaaataataaatttaaaaaaatagtgataaatctttgacaattcctaaatgatttcttgttgacatgatcaggaaaatttgagttaagattttttttaatatttaaaattggtattcctaaatttaaaaaattccttaattatgggtttggaagcaggaaatctttttaatttttagcatagaatttaggtcgacatttaatttaacgctaattattattaattctaactctaattatcattaatacctaattaaaataaagtaatttcaaaaaaataaaaatggcaaattcagaaagtcaaaaggtattaaatctgtaataatacaaagcattagcatctatttagcctagcggccaaagaggtaattctttagtttttaattaaccctccgcggtcatttttctaaaataacaaaaaattattaataaaataatcatacgaggcaataaaggggacacaaacagcaggaaaagcgttaatatcgcaatgtaatgacacaatattataagtaaatttttttatataaaattttggccaataaattaaaaaagttatctctaattaaatttattaaaactctttgattagagtttcatgtaaacgaacaaacaaattgtggtgttaatgatttagcacgtcattagaaaatg

SEQ ID NO: 113698 - DNA, 1003 bp, Heterodera glycines
  misc_feature (424)..(424): n is a, c, g, or t
  Promoter: Source sequence=SeqID_13263; Location=633..1635; Strand=-; Gene=SeqID_47117
agaaataccaaaaaatatttaaaaaatgaatatttattaaaaagctatgtcaatattgtctagggtgagagggttgataggcccgcattctggaaaaaaacaattaaaatgacacaaaatcagtaattatcaaagttattttacaaaaaaaggcataaaacatcataaaagaaaaaaattaggtgcatatttttaataatatttggcgcatataaccaaccaatcgtcgaaacctgtaattgccaatcttcaaaaaaaataaaacatattattcaaaaagaaattttatttaaatcgtcactgcttaaacataatatatgtaatcaatttgatatagtatcatatgatagaaaaaagaaaaatgtactattgtataaaaagataaataaagtaaatatttattttaaaaatattaaaaattatntagttgggatggaagggtttcgacagaaaggctggacattaatcaattgaaaaaaatcaaaaagaatttaacataatagcacagtgtcaatcaaattggcacccagcagattttgaacggttgatgccgttatttttcaaagtgaagcgaaaaaatttaccaaatattgaatttattagcatattttaatgttttaatcttatttaaatctttactgcaatcaataaatttgtaacaatcaccaaattataaaataaaaataaaatacatttattataaattctcagagtctcattaattgtaaataactagtaatatttgaaaaataaaagaaatgctatttaccccaacgatatcagtagtgacccctgtacttttgttacaatttttggcgctaaattcaaatttgaattttcgcgtcgatactcggtgggtggagggacgcttgctggggaggaggaacaatgccgtagggtttaagtgttgctttggcacattaaaatttatttaaatatatattatttaaatgtgttatttttattgtatttaattgtttttaatttagatattccaaaaatg

SEQ ID NO: 113699 - DNA, 180 bp, Heterodera glycines
  Promoter: Source sequence=SeqID_2105; Location=136..315; Strand=+; Gene=SeqID_77879
ttttcggtacaaaatttattaatctttttcattgattacatccatttgattataattattcatttaagtgattatgactgtgaatttgctcactaatgctgcgtaatgaagtcgaaactgaatttagatgaaaaagaaagaaaagaatttttgttttgatcaacaaaaacaatacttatg

SEQ ID NO: 113700 - DNA, 256 bp, Heterodera glycines
  Promoter: Source sequence=SeqID_13864; Location=1..256; Strand=+; Gene=SeqID_47165
attatgtttttatacgatttttctttttgcgtgataaaaaaattcagaaattattaattttattttggcattttgccctaattaaaaaaaatcaagaaatgaaaaatttatgtttcccttccacttttcgctaaatgtaaaatctatgactctatggttattaaagccgttttttgttgttatacatatttccttttaacttaaatctctattttgaaggtaaattttttgtcgcacacaaacttgagtaaaaatg

SEQ ID NO: 113701 - DNA, 267 bp, Heterodera glycines
  Promoter: Source sequence=SeqID_13814; Location=1960..2226; Strand=-; Gene=SeqID_77751
actgagagatttctttgaattttattttttcgtaaaaaatctatcattttgtacaatttgttactgtgcttattagagaccggacgggaccggggccccgccgggatttttccgggacccccggtcccgggttttttgggcaaaccaccgggaccgggagtcccgggggtcccgtacgggtccattttccaagtcccgctcccggtcccggcaatttcaaaattccggtctctactgcttatattacgtagttctctctaacgtatg

SEQ ID NO: 113702 - DNA, 1003 bp, Heterodera glycines
  Promoter: Source sequence=SeqID_11874; Location=3123..4125; Strand=-; Gene=SeqID_75383
gtccgtggaaaatacatcagtgaaaaatactcagtgaaaatacataagtgaaaaacgcagtgaaaatgcatcagtgaaaatacatcagttaagaatacgtcagtgacaatacgtcaatagaaaatagtgaaaaatacgcagtgaaaatacatcagttaaaaacacacagtgaaaatacgtccgtggaaaatacatcagtgaaaaagacgcaatgaaaatacgtccgtggaaaatacatcagcgtaaaatacacagtgaaaatacatcagttaaaaacacacagtgaaaatacatcagtttaaaaaaaagtcagtgataataaataatacgtcaatgatttttgaaacttttaattttttaagcagactgttaggagaaagcactgtcagcacatttcttcaacaacatcttcaaatgaaatgagtcattctcatttaatgggataaaaaacgacaggcggaggagcaaagaaacaaataaaataattaaaaaattgaaaaaaataactgacgacaaatcgatgtgatggatgaatcaccgattcatcagcgaaaagacttttctcttttctcgctcactcaaaaattgtcatcattttgcaaaaaattcaatcaaaaaatttgtcacaaccatcttacaatcaatcgcataaaaggtgagcatatttaatttttgtatatctattcaattaacaaaaactgcaacaaaatactaataaaatatttcaattttgtttctgtaaaatcaaaattacccaattgttaggctttaaatcggagtaaatgtatgacattttaattgaaaaattaaaaccgattttaaacatcgttttaaataataaatgtttataattattaagaaattttaaaaatactaagccaaaattaataattatttatgactttctctaaaatttaataatattttataaattttctgcatacctaagatattaacaatttaatggatttttatgtgtcttccgctctccaatcaacaaatg

SEQ ID NO: 113703 - DNA, 324 bp, Heterodera glycines
  Promoter: Source sequence=SeqID_324; Location=12279..12602; Strand=-; Gene=SeqID_82304
cgtcgacgtggtgatggctgagcttgacaagttggtcagagcgagggagacgatggaggtgctgacaaaaaaactttgctgctcagcgatcctgtggagatcatcgtcacctgtttgacccctccagtagggtcagccccacgtttacatccataccaaaattggggatacgatgaatcgcaaagaattcgcatacgcaacaacgatagctactgtttatttcatgcgcttgttgcaggccgtgcctatcatgaccgcgatattttctgccttactcataacccaatagatgagcagcagcctcaatttatggcaaacataatg

SEQ ID NO: 113704 - DNA, 211 bp, Heterodera glycines
  Promoter: Source sequence=SeqID_2763; Location=1196..1406; Strand=-; Gene=SeqID_81463
cccccccccccccaatcgtattccatccatcaaaaatattccgacgtaccacccggaagagtgaacttttgccgcatccgttcggtccgcagacgagcacattggtgccggatggcacctcaaagtccaacgagcggatgagcacgtcgccgttgggcgtcaccagcggaacttgttggaaacggatcaaattgtcttggacaaggacatg

SEQ ID NO: 113705 - DNA, 1003 bp, Heterodera glycines
  Promoter: Source sequence=SeqID_9361; Location=1159..2161; Strand=+; Gene=SeqID_71112
gtgacgagagagtagctgcggatggtatctgcagataaaaaaatcgtcagctacagatagttagcgctagcattatgaaatgaatacggattttatctgcagctaccctatccgcatatccttagctgcagataactatccttagcattatgaataccagcaagagaaaattttatgcaaaatttcaaacatttctgaatgtgttaagcgaagaaaaaaaacctgcatacaaaaagtaaatcaaaagcatttttataattaatcagaagttttagctgacgtaataattttaaaaaatttaggaaaaaagtaaaaactaaatatgtatcaataatgattaaaaaacattattaattatggaacgaaagggacagaaaatgattatgacgacgaatggtgatgggtgtgatgatcagcagcagtgcataagtcatttttattatatgtttttgtttgtttgtttgtgtgtgacgtcattaagaatttaaaaaaatggttgtacaatttcaaatcggtttctaccagggcccagggctaaaaatgcagcagaaaaaaagttaaaaactaaaaatccgggccctattcataataaatggaaaaatgaccaattggtacaaaatctgttaaaataaattatagctaatttttttgaaagaaaattaattaaaagtaaaagaaatttaaacattatgaatttcgtaaagtttttcacctttgaaatcactccttctgtgaaaaaatttttttatattggagatcgaaccccattttaggggaggggcacaaatccgacactaaagaataaaaaaataattaacaattcattaaaaaaatttatttgcgtgagaaaatacgtttaattgcataagcggaaggttttgtatataaaattcaaagatgagaatttcaaattttgaagagcacacatttcgccgaaaaataaaaatcgatgacattttttgaggggggggggggagaagaataagttgcattttgacaaatg

SEQ ID NO: 113706 - DNA, 606 bp, Heterodera glycines
  Promoter: Source sequence=SeqID_5864; Location=1..606; Strand=+; Gene= SeqID_59478
gtttttgacattttcgaattctcaatctttttaaaattaattttcgtgtttttacccaatttcggcaaattcgtccctcagaattccttttttaagtgtcaaaaacgtaccaaaaaaattcgcagaccgcttaaaggaagaggattagctaacaaataagctcgaaattttcgtctcacaaattcgttcgcaaatatttcattaatacaactctttccaattttttttttttcgggcaaattttgaattttatcccttagaaattctttttaaaaatgatcattcgatcagaaaagaagcgcaccaagcctaaaggaatactaaaaaaaaaagagagagagaatgattagcttattcatcaaatttttatcctctcagacaatggcgtcgttcagcggtggccgcctttttcctttctgcaacaaattggtcaacaattttcgcgcacttttgcagggcgccaaatggcgaacggttggattggcgcccttttttgcctatttatggcattttgccagccaatattttttttttatattcgaatcatttatttcaaaaagggaggtgtcaaatgtgggtccgttgttgatcatttttatcgcaatg

SEQ ID NO: 113707 - DNA, 147 bp, Heterodera glycines
  Promoter: Source sequence=SeqID_34361; Location=396..542; Strand=+; Gene=SeqID_64178
tttcaccaaattttctgtttcaattttaatttggacagaaatgcacctccgctgttctcgcttatgcgttcccttctcacatttatgcagcaattccccgtcctttgcccttgggccgacttttccccgcaatttgtccataaaatg

SEQ ID NO: 113708 - DNA, 1003 bp, Heterodera glycines
  misc_feature (641)..(641): n is a, c, g, or t
  Promoter: Source sequence=SeqID_22612; Location=1354..2356; Strand=-; Gene=SeqID_53283
ttcgctagatcaattctatattaattatatacgtggtgagccgaaggtacatattcaatagttatcttatgtaaatatcaaaaaatagcatttcatttttcacgtttttcgctaataattcttacctccaaaaactaaaaacgataaatttaattaatataaaataatttttgttttaatttttaaaataatttattattttgcttttaatttgatcacttccactttatcgtacttcgcctattttgcaccttttcgtacttttcgcccaatcttgcacttttcgtacttagtcattgcacctttaatttaattcgacataatttttataaaaattcttaatttatttgttagctcatcatttaggctatggctaatcattattgttttttgaccttatatcaaataatttcattaattcgttttttaaatctcttttaaaattaattaatttttcctaattattttattagtttattaattcattaattactcattttgagataggggagagttacgtcgagaatatttgctcacctaacttgtttttttcaattattttttcctattttttggggtgaacaattttgttttttagtccattcgttatacatttgcactgctgcgcacaatttacactnttccaatttttcctaattgcaaaatgacttcctccgcaaaacttgattgaaattaattggtcgttaattagtagcgttatgatgctttgattaactaatgagtgattagcgttattgagtttacaagctaattgcagaaaagaaatgcatttaaagaaatgaacaattcaaatgaattcactcatttatttaaactcaaaataacctttatatataaaaaatatttcttaattgaaattatactcaatttaaataaaatgataattttcaatttcaaaatctatcactcatcagatgatagggaacattttgaattgagcaattaaaataaattgtccataatttaagaaaattgaaaaatg

SEQ ID NO: 113709 - DNA, 1003 bp, Heterodera glycines
  Promoter: Source sequence=SeqID_2592; Location=1366..2368; Strand=-; Gene=SeqID_80604
gcggcggacgggggattggtgaagggcctcctccctcttaattccgccgatcattgatcggcgataggaataaaaattccgacactttttagtcaaagtcgtttgttttatgcaattttagatgcataaaaagatctttaaacataaacccccgagtagaacaaaatatcataaaaaaacaaaagttgagtttgtaattgtcacaaaactcgagatcgagctcaaaaggaaaacggcgagaaatccaagtcactcggccttcattaatgaaatcatatccatttcagacttttggtaaaaccacagcaggactattgcatcaaacaaatcatgaattaataatgatggtgaaaaagaaagtgtttttcccattgaatagaccaattagaaatgtttgtccattttatggggaccaagagtgggtatgcttatggcctaatcaacgaagagacgcaagagtacaagaatacagaagagagggcaaatatggtttgaaatttgatccttcaatctgggaatatttgagcgatcatgctgtgattactttcaaaaaatgcagaggagtacaagtaagaaaaataaatgaaaaattaaaaatttttcaatatgaaatttctagaaactgcaattttgaaattgggcgggtcgagacgggctgatcccttcaaaagcaatcggttccgagtctctccgatgctgttcaaatcggattctcaaatttcccggctcggaaccagtttccatttggataaaaatttaaattcccatgtattttcaccaacagtgaaattgataaaaaagtctcttgccaataaaattgatgtctccgaataatggtttaaagactcaataactgttggtataaaaaaggctagcttttagtatttcttaataaaaattgaaattatattcaaaatcataaaaaggtaaatgaatagacaaatttttaaggtttattttggttctgcaacagtacagctgttgcgtgaagttgctggaaatg

SEQ ID NO: 113710 - DNA, 345 bp, Heterodera glycines
  Promoter: Source sequence=SeqID_1675; Location=5733..6077; Strand=+; Gene=SeqID_75253
tgtactctgatgctgcttatttatatttattatgcataaactttaagcatctttagtcgcattttgaaatggttttgtcggccatcttttcctttgattttgtgaagctgtttaatattaaaatttccactgatttgcctttgctatgggtcgaatgccttcgctttacccttcttggttacttaattatttgcctgacactgtatgtacattaaaaaacgcacatttttttgcataattcgttagattttacatcgaatccgacgcgaagagaatgtccaacggacggaattggcgctcccaacggaggagacgacgcttcccgaagatgccgacggtccgatg

SEQ ID NO: 113711 - DNA, 195 bp, Heterodera glycines
  misc_feature (56)..(56): n is a, c, g, or t
  misc_feature (61)..(61): n is a, c, g, or t
  Promoter: Source sequence=SeqID_3192; Location=1..195; Strand=+; Gene= SeqID_83603
agtacgggctgtttttctcagaggacggagatgtggtggtatttagtgacttttgnacatnttatttgaatttttatatttgtttggcataatgttttttcgaatttggccaatttgttttcgtttttctttagtgcagtcgggacacttttgttgttgtttttgttggtggtaattcggtttttcatgaatatg

SEQ ID NO: 113712 - DNA, 699 bp, Heterodera glycines
  Promoter: Source sequence=SeqID_20631; Location=1..699; Strand=+; Gene=SeqID_51183
atagggagtccaattatatgcacatgcatatttttttcctggactgtgggaggcctgaaacgcacgaaaaacatgtttttagcgtgttttgaagcttctaggatgactttccatatgcatgttttgcatatttgtgcatatttcgcgatttatgtgcatatttgcatattttggcatttttccaaaaaacctctaatagaacggccccccaacagacaaattggcctttttgacctcaaaaaccggaaaattttccaaaaaaataattttttagcaaaattttcacgaaaaatattgaataaataaattttctcaaaaaatggttaatttatgtcaaaaataagcaaaaaaagcaaaatttcgctttttgggttggtttttcgcaaaaaatgagtaaatttttgctttatcatgtttttttcttctaaaatgatttttaataccacatttagccattttttgaagattttacttaatatttaacaaatttgaagaaatttagagacattacacccttaatttggaaaatttatatgcatatttttcactttttatgtgcatattttgccatttttggtgcatattttatgcgcatattttgcgattttatgtgcatatttttggatgccctaataatcattattcccttttcaaaggtcaattccgacaatgtgcatttccttctctctgttgggcatg

SEQ ID NO: 113713 - DNA, 465 bp, Heterodera glycines
  Promoter: Source sequence=SeqID_26724; Location=1..465; Strand=+; Gene=SeqID_57499
cgattttgacatcaattctattccacgtgaccagcggcactacaccattgaaagcaattctgttcatttctctttcaattattttttatgtaacaaaaattattaaatcaaaacatgagatgaaattttttaaaatgcaaatattttaatcaaatttatctttgttaaaccttttttatatctttgaacttatgattctaacagagacttaaattttggaaatacggaacgggaaatccgcgaaatcccgcggcgaccccgtctccgtccgggctctatcgaataaatttttttttattctccaaattggcacagattctctatacgctgtgcatcactgcgttatgggggcacgaaaatgagaacgcctgctacacattgttgtttttcattggcattactgatctgtcggtgttgtgggtgatcgggctgttccacggagtattggcgctggagggagccatg

SEQ ID NO: 113714 - DNA, 736 bp, Heterodera glycines
  Promoter: Source sequence=SeqID_19961; Location=1076..1811; Strand=-; Gene=SeqID_84724
tgtgctaaaattgataaaagtggattcaggccttgttttcctaggtctaatactttttttttcaagtcttaaaacatgtttttagggggtgtggcaaactgaacaacaatatgatggaggaagaaaaagaggaacgtgaaaaaagaagagaaaaagacggagagaaagaggaaggcgaagaggaagagaaaaagatttttgtccaattcggatcccgaaccaggattcaaacaaaaagtcgaaagcctttttacactttttaaggcaaaatttaactttttgtgatgaaaattccaaaaaataagtcaatcttcgagacggaactgaaatttcttataccattagactcaaatgacggaactgaaaaataaataaataaaatttgaatatttttttccattaaaattagtagggatgtcaaagtttctgatcagtgatcaagaatttgacaacttttcaacaattcagtaccccggatcccaattcgaacaaaaagtttaaacttcaaattctcgaatatcgcatttttagttcaaaaccggcttaaatacacgaaaacaaactgaattcatcacatcgactctgttctgtaccaaattagcatttgatttaatctaattgatattcttatgtagtctaaattgtcttcaaattccttacatttaattaaaactgttctttaagcggtacggaataatcaagcagctaatatttggcttcttcgaattgcgcaatg

SEQ ID NO: 113715 - DNA, 168 bp, Heterodera glycines
  misc_feature (35)..(35): n is a, c, g, or t
  misc_feature (43)..(43): n is a, c, g, or t
  Promoter: Source sequence=SeqID_34284; Location=805..972; Strand=-; Gene=SeqID_64112
agtgcagtttagcgcccctctttttgtaatatttntaggactntagagcaaaatgattgttgaaaaatatccctaaaaagacaaatttcattcttaccttaaaaagtgatctgcataaaaaattactcctattggtttaggattgaccttaaaaatgtgtgccaaatg

SEQ ID NO: 113716 - DNA, 141 bp, Heterodera glycines
  Promoter: Source sequence=SeqID_32422; Location=1..141; Strand=+; Gene=SeqID_62732
tcattcatttgggagtcgttcgcacggaaggccaaccttttgggaaacattgacgttccgattgtcagacaatttccgtgccggcttttcgaggtggcaaattgcttggctggtgagtgggtgccaaaaatttacacaatg

SEQ ID NO: 113717 - DNA, 694 bp, Heterodera glycines
  Promoter: Source sequence=SeqID_11360; Location=1..694; Strand=+; Gene=SeqID_74752
tataaaaacccggggattgtcaattgattggactcataaaagtgcactagagccaagattcatatgttcaattttttaaattttttggtattacttttctgaaaccaaatgaaacttgctttcgaatgagctcaataaagggtttaatttggatgacttaatagagcctaaaaataggcccgatccggtctctaacataggtaaattaaattaaaaacaaaaatattgtaaaaaaaacggtcgaactttgtagatgtttaagatgatgtcttgccggtgtatccggtgccaacttcgactgctcatcagggcccccccaaacaagcattgtcacaaaaaaatgctcaaggtttaattttatgacttaatcgccattcaataggtttggtatttcaaaaaaaaattttttttttttgcactgaattttatttgaatttaattgattccatgatttaaaatgtttcattaaggacggccaattccctaccaaacaaacaaaatgattcagcgccctcccgtgcccaatcaaatgcaatatttaaaaaaaacaagtgctgttccaactgcaacttcttgcgcttcatcatcccaaatatttgtgcgtttgttggcacttttgcagattaacccccccccccctgaaaaatttaaaaaaaaatgggccattttgtagggatttggaattggtgaaatg

SEQ ID NO: 113718 - DNA, 667 bp, Heterodera glycines
  Promoter: Source sequence=SeqID_3140; Location=1..667; Strand=+; Gene= SeqID_83381
aattttatttttttcggaatttccccgattttcagtgcaattaaacggccccctctattaaagcggccatttgggctctaatgactcaaaattgttcaaaaatatcagatttttgggtatatttctttctgtcataagcattgatttttccaatttttacatttatttaaaaagtgcattgcgccaattcacatgttaagaaattaaatttttggcattaaacaaagggccaaattcacgtgaaaatgaacaaaattgtcattctcgtgtttaacagtgggccaaattcgcgctgtaaattttaaacattgccgtttttgcgtgaaagtgaaggcatgtcatcaatttcacatgtatacatttattaatattgttggcattttttttccactctctgtgtttggcacactattctcgcaacaattgtggataattgccctcaattttgccaaatctggccaaaattatagcgcgctaattgactttgcttatctaccggcctgtaaagcacgccttatatttctatatttctatttctctcactgtcattatgtataaatattttatcatgtgcatattaattttttttttgcagcgaatatctgcataaaagaagcagtgattaccaatttttaacaaattcatttattattttttttaataaatg

SEQ ID NO: 113719 - DNA, 209 bp, Heterodera glycines
  misc_feature (44)..(44): n is a, c, g, or t
  Promoter: Source sequence=SeqID_23678; Location=1737..1945; Strand=-; Gene=SeqID_54378
ttaaatgagaataggttagttgattaggactcaaaaaacctttntggtgcattacacataaaacgttttttagaaatgagcggggaaaagaaattaatccaacaaaaatgatttcaacgaaattcaggataaaaagttgatgacgaaataggcaatttaatgacttgttttatgcatgtatgtaatgcaattctaacacatacataatg

SEQ ID NO: 113720 - DNA, 53 bp, Heterodera glycines
  Promoter: Source sequence=SeqID_15721; Location=1601..1653; Strand=-; Gene=SeqID_80044
tgttggcatcatcataagacaatttcaaattaatgattcttcagggtttcatg

SEQ ID NO: 113721 - DNA, 1003 bp, Heterodera glycines
  Promoter: Source sequence=SeqID_9953; Location=839..1841; Strand=+; Gene=SeqID_72996
cgatgtccttgagcatcgtttgtcaatcggcggacctatctcggggtgtttaacgatggcaaataaattgattgattgatagactcaataaacaagcgggaaaagatttttccgaccggaaagggaaaacgcaatggacacagtcgagtcatatcataattgtgtggtcagtcggcaactaataaatgagggcatcatttatgcacgcgggaaaaatgagtggttcaccagcaaagaaaagggagaaaggtcaattaaagtcaaggcgaaagaagcacaaacacttaatcattcaacaaatttgcattcaataaaaccaaaccaaaaattaatacgtttgacgattaatcgtttaagatatcacttatttttaatttcattaaaatttcattgttttaatacattttgaaaattacttacaaaaaaaaaacaaaatttcattgtgttaaacaaacgaataaaacgcaacagaataagcatagcaaatgctaaaattcccttcatcatttcgttcccgtggaaacgttgaaacgatcgataacaacagaagcgccccggggatatgaagaggaaaagcccaaaacattttgcggacaaaaagattgatgaaaaaaggacaaatggagaagagagtaaagaaaaagataaaaagctaacaaatcgataaaaaagaatcgtttcaaaattttatttttttgatttgcctatcaattgatattgggcaacggacaatgggacagcaaacaaacgaacacgaggaaggggcgggggagtttctgccttatctttggcttagcttttttttcctttacaaaacacgagactgggaattcctgtgtactatggattataccattttatttctttaaaaaaaaattataataagggaattaaaaaccaaaagcataataggcaattctcgtttttataccacgacaatacttttggtttactatttgtttgactttggcatttgatagtaccaattttttagttaattatg

SEQ ID NO: 113722 - DNA, 124 bp, Heterodera glycines
  Promoter: Source sequence=SeqID_24997; Location=1..124; Strand=+; Gene=SeqID_45904
gaatttcgactttttgattcaagtcttagaaaagcgctaaatttttgaaaattatcagtttttaaattaaattttttttcattattccccctcaaaaaaaaaatccgaaaattcagtggtcatg

SEQ ID NO: 113723 - DNA, 374 bp, Heterodera glycines
  Promoter: Source sequence=SeqID_12898; Location=941..1314; Strand=-; Gene=SeqID_76632
atttttcatcgagagactttaaaagcaagtgaaatatgtaaaaactaaacaattgtaaacaatttcagttttctaatgaaaaatcgtcagcatcaaccattatttcgactataaaaacattgcgtgattttttgcaagaaaaaactttctcaaatcgcattttgggcgtgctagggtcatagtggagtctttaaatgaacgagttcgtgaattttgcagcaacccactgttgcgagtcgcaatgctacttgatcctcgatttgcttacacagaactgttttctcagcaaaattggagggttgtcgaacagcaattaatcgaatttgcaaaagagagttggttgaattattagaatatttggtaattaaaatatg

SEQ ID NO: 113724 - DNA, 218 bp, Heterodera glycines
  Promoter: Source sequence=SeqID_20169; Location=102..319; Strand=-; Gene=SeqID_84954
tctaaaaaggacaaactttaaaaaaagctccgaaatttttaggaataaaacacactaaaacctgtaaaattcaaagccaagaaaactcggccaaaaaaataccaaaaaatggactggcaaaaaactgagtcaaaaaatgtatcctaattttgcttgaaaatgttattttgcgaaaaacaatcgcgcacagtccgcccagaacctggcgaacaccgatg

SEQ ID NO: 113725 - DNA, 231 bp, Heterodera glycines
  Promoter: Source sequence=SeqID_18702; Location=1667..1897; Strand=-; Gene=SeqID_83377
ttccgtcaacttcatctcatgctatgtcgtctgtacaaagtgcataacgaaaatttatggcgaaattctctacaagcgccatgtggcatttgtgggcggcagcgcaccgtcacattctcccaccgtgcctatgaacacacccaaaccgatgcccaattcatcactccgtgtccaatggcggcctttgctcaatggctgctcaacgaattcgatccgcgctatcccacaatg

SEQ ID NO: 113726 - DNA, 69 bp, Heterodera glycines
  Promoter: Source sequence=SeqID_8611; Location=1..69; Strand=+; Gene =SeqID_46623
agataaagttttgaatgatttaaactgagttccaattgtcggctgtgagtacgtttcagggctcagatg

SEQ ID NO: 113727 - DNA, 564 bp, Heterodera glycines
  Promoter: Source sequence=SeqID_2967; Location=85..648; Strand=+; Gene=SeqID_82544
accgttttaaagggtcaggggctccctttttcactcaatttttcgagttttaaaccggttcaaaaaccggtttttttgcatttccgcaactggagacctacttttttgtgcagagctcgtcgagacgaatcgattggtatatcatttgttccgttttttacggggggttgactatactacacccaaacctttcttagtacaaacaaattaagtgatcttcgatcattcggtaaccctaatttttttctcatttcattgcataatttcaaaaattatctatctataaaaaatgggaagttttttgttgaaatttttcatttgatggtttttaataaggattaagcatcatctaataaattaaaaaactctgatcagcctataaggttttatttgtagaatttttcaagatttttttttcttcccaaaattgtgtttttggcgattgatcatttttgtgattatttttgcacctcaaaaaattaagctggtcgatttgggtacactttctcgatgaaacacagtagtaactgttggaccatatgttagtaaagaaatctcataatg

SEQ ID NO: 113728 - DNA, 319 bp, Heterodera glycines
  Promoter: Source sequence=SeqID_31770; Location=1..319; Strand=+; Gene=SeqID_62071
tttattggaaagtaaaattattattttttttatttaagacaaactaatgacccatttcttttgtttgcttaggctaattttttgataaatttttgcagtttttaagcgacaaattaattttaggctaatatttctgcagctatctaaataaaactgacgcattaatgctgtatttaatcagaattttttgtctcattattatcaaaatggcgtcatttattttgtttattattttgattattacgaaaggtatgaaattggtttaaattaatttaataaaaaataaaataaaaaatttaatttagctaataactcaatg

SEQ ID NO: 113729 - DNA, 465 bp, Heterodera glycines
  Promoter: Source sequence=SeqID_25954; Location=2031..2495; Strand=-; Gene=SeqID_56707
aactgatgctttaccggcacttaaatagcaaaaaaacatagcacgtctgcttttttgaaaaaataatgtagtatttacttcgcaacgtcattcttctgttatctcacatccaaaattggaaccataagcaaaaggaaattgggtatacctactcgaaaacctgaatttcgtttttctctttttattttccctaattacagaattttctcttctcttttcgttgtatttataaattcccgaaactttaatcttttgcaagaatggagaaattatggcctaaaaaattaggaatcattgacgcctaaactgtgcaagagccaaaagtttaccttttctttatttaaaatcgtttcacactgtcccaaatcttaacagtgcataaaattctctattttcggcaaaacgaaagaattggaaacccaaaaaggcgaaaagcgacactagcatttttaaacaataaaaatg

SEQ ID NO: 113730 - DNA, 272 bp, Heterodera glycines
  Promoter: Source sequence=SeqID_36533; Location=683..954; Strand=-; Gene=SeqID_65820
aatgattgatcatggacaaaaagcataagccaacgaccaaaaatagggccaaaaactttgagtgggaagcgtgtggcaatccgtcagttgtgttcgtcaatttgtcagtgctttgaacacaaaaaattcatttgccagcgaatgattctttggtcaaatttcacttgtgaaatatttatactcactgataattgccaaaagcttcaaaagaaaagcattttaaacacttaaattaaataaatatattttttagaaaaactaaagaaataatg

SEQ ID NO: 113731 - DNA, 290 bp, Heterodera glycines
  Promoter: Source sequence=SeqID_44093; Location=506..795; Strand=-; Gene=SeqID_71630
aaggaagcggagagagaaaaatgcaatagaaagagctcaaatacaaatagaatatttttttaattttttcacatgccttattttactaactaataaagagattaactaactttctagaaaaaattaattgaaaagcaaaaaagattatttacatggctggaggacctcgtaaatttcggtccccaccacttactattttataacctaatcagtgcttggaaatttcgatgctttatataaaatgttttaggtattttgtttgagttgcgtcgcagtgtgtgcttgtgatg

SEQ ID NO: 113732 - DNA, 515 bp, Heterodera glycines
  Promoter: Source sequence=SeqID_7890; Location=1752..2266; Strand=-; Gene=SeqID_66301
tttttgcgtagaaaaagttggcttgtttctgtttcctgtctaattgtaagacagaaggctcaaactatcagataaaacccatttactttgacgaattttttgtttgtattccgggtcaaggcgacgtttacggtcaatgtaaactgcatagccaacgaccaaagccgtcccaagagataaatatttcagccaattcgaagaaacatttaacgaataaaaggtagacattgtatgaataataacctaaattccaattcgcatgcatttgaaagaaaacaaacccattgaaagaaaaggcatataatctgtaccaaaatatagatcccactcaatcctttgtcttttcccacttcccatgttacggttgagtttgaaaaaaaagattttttaggctttttattgtacattaaattttaaatacaaagcgccaaaatttttaattttaaagttgcctaaaggctttactgacaaatgagttaaagacttctaattgagatgttcatgttgataacatg

SEQ ID NO: 113733 - DNA, 129 bp, Heterodera glycines
  Promoter: Source sequence=SeqID_14582; Location=1147..1275; Strand=-; Gene=SeqID_78654
aactagtaccattaattctgggtcaaagacagacaaaagtcattgattgaacgcgtaaattattgtaacagagacagattctctaattgttttcttgcttcatttttctttttcagaaacaataaaatg

SEQ ID NO: 113734 - DNA, 363 bp, Heterodera glycines
  misc_feature (27)..(27): n is a, c, g, or t
  Promoter: Source sequence=SeqID_4725; Location=1..363; Strand=+; Gene= SeqID_55534
gcttggctcgtcctttcttctcccctnatgtactcccttttcttctcctcctccgctcctaaatcaatatatttttgttgcacataaattatagcccatgtctcagcaaatgcatttaccaatttcattcaattatttgtatttttatttttaattttaaaattattaaaattaattaaaatgacatttatttctcattttgataatttcccaaaaatattatttaaaaatgataaattattttcagacaaattgctcgcctcgcctctcccacacattttttggagtgtgaggagccgaggccgcaatttccaaacttttttccaatcaccgcccccgccccgtaaatcgtcgtcccaaatg

SEQ ID NO: 113735 - DNA, 395 bp, Heterodera glycines
  Promoter: Source sequence=SeqID_39677; Location=1..395; Strand=+; Gene=SeqID_46602
gatgcgtaatcagaaaaaatggtcagattttatgaccaaggacctcgaaatctatgggaacatagttgtcgcgaatttttcagacaaaaaacttgcaaacagcgaaattgggtcctacttggtcttaaaataaacgcgttttttgagttttttaactttttcatgtcttttaaaggctgtaacttttgcgagaaaactaataatttggtctctgaagacacgtataactcccgatttaattttgggtacaagttttttgggtttctatattagctgaactctatattatgtataacatgctggaagtggtaacatggtgaccacattcatcattgccaattttgttgccaaatttcaaaaaaaaaaattaaaaaaaaaatttttttagtcaaatg

SEQ ID NO: 113736 - DNA, 135 bp, Heterodera glycines
  Promoter: Source sequence=SeqID_10740; Location=1..135; Strand=+; Gene=SeqID_73985
aggtttctaaaattaaaaatgacaaattttagtataatttttacatatgttcttaacaagaaaattcaatcattttataaaataaatccccaaaaaaatcattaaaagatattcctaaaaatattttagaaaatg

SEQ ID NO: 113737 - DNA, 1003 bp, Heterodera glycines
  Promoter: Source sequence=SeqID_8876; Location=368..1370; Strand=+; Gene=SeqID_69493
ttttcagcacctaagaaaacctataaaagtatttttatgcgactttgagtctgggacctatgatggatattttccatgatttaggccactgtttccgccggatcaaacgtcaaactcagcggaactgaattataattgatgggaattgatttgatgctgatttgtgaattatttgatgaaatgacagatcattttgaatcactactgatggtttgagaattgattttgatgctctttttcgtcgattttttttttaaagttaaatatttcattctaaatttgattaattaaaaaatatcctttttttaatccaattgaatggtaattcatttacttttatccaccatagatcaaatattcctcatttagccgccagcttaatttcaaaaaattaatttgggggattttctcaagaatattattttaaaaatggaatttaaaaaaaatataaatattaagtctaaaataagcactttggaaattttctcttttatttggctttcttaaaataagaaatttggctttattttgtattttttcttgttaaaatggcctaaattaagcgcaatttggattttttaacaaaataaatgctattttattttttttgtttctcacccaatggaatatattgaaacgaaaaaacaacaaaaatcagtgagcaaaaacgagcatcaaaaatgatcagcatatcacttctattcatccccataattcaaagtgtgattgatcatttctcaaatgcaattaattcacttctgctgaatttactcgcccttttcgctgattaagtgcaatttgaattagatatacactttacaatggcgtggtacataacaaggatggcacggaattccaatttccgaaaatttttggggcctcggaatgctatccctggtatataatggaaagttagcttagcttttccatccccacattcttttcaagtcttaaaaaccgtatgcccggcgttttcggggttgttcatcaagaataggacatg

SEQ ID NO: 113738 - DNA, 305 bp, Heterodera glycines
  Promoter: Source sequence=SeqID_19231; Location=1..305; Strand=+; Gene=SeqID_83969
tatgtgagcatggcaataaacatttatatgtttatgtgaattcctctgaataatattttaaaattaaaatttaaaaaaatttcactgagtttaaaaaaagttaggacaaaaaaaatgttgactcaaaattttctttagctcaattttcaggacaaatatccttggaaaattttataaaatgcatgaggccgacctcaaaaatatttttaaattcataaacatttccatttttcatttcagaaaattttgatcttttgcattcattgtccgaaaattcgcccacagtttacgaagtgataaaaatg

SEQ ID NO: 113739 - DNA, 51 bp, Heterodera glycines
  Promoter: Source sequence=SeqID_12195; Location=1670..1720; Strand=-; Gene=SeqID_47017
ttttaaaattttgagcaaatatagttcaaatagatttaacaactaaaaatg

SEQ ID NO: 113740 - DNA, 805 bp, Heterodera glycines
  Promoter: Source sequence=SeqID_42403; Location=147..951; Strand=-; Gene=SeqID_70302
aaattccaaggaaattttgttcagtttaaaaaaaagttcgagcaaaaaaagttggaaaatctggttttttgaattcttctgaccataactttttttgaaccttaacgaaatttttcaaaattttgcaggctaatagaggatacatagggctatcgaatgacaccaacaatgttggatttggtcgataaataaaaaagttatagccaaaaacttgtgctcgtacgacatcggcccgtacgaaaacgaccctgcccccaaaaataacgcaaaaatatcaaaaaaatttgccaaaataaaaaaaactcccgtgatcagtaaaaattttttggacataatatatatttacacaaacaatctcatcctcaaaataaaacagcagttgtttctgttcaacatgctaagctttatgaaaacaaaattttttatttttttttgctgaattttctttttgaaatctgttcattatttcgttacattttttttttgttaaacataaacaaaaaaaatttgttattttaggtccacaactgttgttgctgaactgaacgacaacaattagggtatgttgatcgtggccaaattttgttgattgtttatggccacaaaagagcttcgagcaaattctttgatggaaaatgttgtttactcaaatgaactctcgtaaaatttggcctatataaaagtggccaatgaataataaaatagtcaattttatataaataataaaagaatttttattttaaatatttttatttttattttaaataaaatatttaaatttaagaaaaaacaattcttttaaatg

SEQ ID NO: 113741 - DNA, 59 bp, Heterodera glycines
  Promoter: Source sequence=SeqID_6226; Location=4913..4971; Strand=+; Gene=SeqID_60792
gtaagaaattcatccaataatttgagttgattttcccgtttagcctcaaagaaacaatg

SEQ ID NO: 113742 - DNA, 491 bp, Heterodera glycines
  Promoter: Source sequence=SeqID_402; Location=1351..1841; Strand=+; Gene=SeqID_51491
tgtaagcaagttttatttccaaatcaattagatgcggttctgattgctttgggattttagggggaatttgcaattgattatactggccaacgatttttattatatgactcacgtgttcatcaacccgatgaggtcgttttttttatatttgccacagaactgggactacaacgtctctcacactatcatcattggtcatcagatggaacatttaagttagactaataatgtacataaaaagttaaaaattttggggtcgtaccttcttccttcctgcaactttataccattaatatattgattgaacattcatcaatggcatgtgcctatattcttatggcaaacaaagctatgcaaacatatgagcgggcgttaactgtcctgctgacgcacattactcatagtccaagcagtattatgattgactttgaaagaagtttaatgaattattaaatgacatttattatgtttaatatcaggtgccaaaaatg

SEQ ID NO: 113743 - DNA, 108 bp, Heterodera glycines
  Promoter: Source sequence=SeqID_5213; Location=2227..2334; Strand=-; Gene=SeqID_57288
ggtggccaagttggccgagtacccggccattagctacgcaggttgccactgtttttttgtggatttgttagcctcacagtcagaaacatctaagatattgccgagatg

SEQ ID NO: 113744 - DNA, 247 bp, Heterodera glycines
  Promoter: Source sequence=SeqID_29320; Location=1491..1737; Strand=-; Gene=SeqID_59824
cccccccccccttcttcgctactcccttgactgactgaccgtcccccgaggtgctgcccatgtcgcctcggtgctgtccttcgccctgcccttgtcctggctcctcctcgtcctcatcatcttggccaaacttggtctggaagtcgaacaccaactggttgtaggtggccagccaagtgcgctcctccgccgaaagcgcctctttgattgcctcgggcacttgtccgccggaggtccagcggagatg

SEQ ID NO: 113745 - DNA, 1003 bp, Heterodera glycines
  Promoter: Source sequence=SeqID_3916; Location=4056..5058; Strand=-; Gene=SeqID_52434
atttatcaaaataggacttcgatgcagctgaaaaaaaatacgcaatcccccttgtcaagaaaagtagatattaaaggctttttatatattagtgattgcaatttatttgaaaaaaaattaaatataaaaaatttagaaaataataaaaataggctgaaatgaaacaatttgaaatttcacaatgactgattattttatacaaatcaaataaaaaatattgcattttcttctccaaattattaaatattttatattaattatattagtttaatatcacccaaaaactgtaaattaatagtaaaccgtaatggtaaaaacaccgaagttttatcaaaataaaatgatctttgaaagattagactttttttttaaatatatagatatatggctttttatcatagaaaaatgaagttattaaaaaaattagttaatcactttcaaaaaaataaggaacatttatgcaggatagttgcattaataagaaaaagaaattaaagaatctatagaagtaaaggaatattaattacgtcaattgtgtattaaatgctgcaaaaattcttcctatgtttataaaaaaacactgaaattataatttacacgttaaaataaaaattaaataaaatatttgtcgaaaatctcttaaataggtgtctccaacaatgtttatcaatagcatactaataataaaaacttttttcttcaatgaactacgtaaagctagaagccaacaagaaaattaaaaaacaaaaaagcaaagaaaaaattatttaataataatgcagaaatattgaaaaattcactcggccgaaatccgaaatcgaaaaaagaacggtcataaatgtaatttaaaaaaattataacgaaatacgagtaatacaaataaaataatatttttttctaaaaagtaattgatccttaagtacagtaacatgctttgaaaatgccattaacaagaaaacatttcacaaggctaatttttaatacgtgaataactagtaaaatg

SEQ ID NO: 113746 - DNA, 460 bp, Heterodera glycines
  Promoter: Source sequence=SeqID_31050; Location=393..852; Strand=+; Gene=SeqID_61422
acagctcttgactcacgctagtttggaatttcttcgaggtatttcccaccattatcaaatgaacccttgaaaattgttgttttttgttaccatttatttattgttttttggtatttaataaaagttttattttatttttttcgttttaccaagtatttgaatttaaaaaattttttctctcactttggcgtactatctcttcattttaattatgtaaaaaacaacatttacttctctccatataactttttttctatgcataaaagttgcaccagattttgcatcgaatgttctataaggttttaataattttcaatcttgtttttttgtaatatttatttaagatttgtttgacttttttaattgtttaatggctaaaagaaatttgccacacaagctcaattgcaaaagagcaaggcaaaaaagggagaacaagcgagaggagcgacgaaccaaaatg

SEQ ID NO: 113747 - DNA, 1003 bp, Heterodera glycines
  Promoter: Source sequence=SeqID_1770; Location=1239..2241; Strand=+; Gene=SeqID_75859
caccctcaaaaacgcctaaaaactggttttgagcacaaaattaaaaaaaaaattaaaaattagggacaaccattcttcaggattgccgcctgggtaaaaagaggacactacattaagttaaataaatggtttcattttggatttatattataggtccgtctcattttgtcttctttcttcactattaatagggctcggatttttaggtgctaaaaatccctaaataggtactaaaataggtgctaaaaaagtgcaaaataggtgctaaaaaccccaaaaaaggccaaaataggtgcgaaaataggtgttaaaaattgaaaaaatctagtatttttatgtacaaaaattcaaaaagtgactaattttttatcaatttcggcagcactattgcaactggtcaagaaaataaataaataaattttggagacgaatttttgagaaaattttcatttcttaggggaatattttctgaaattttggtcaatttttaggggtatattttttaaattttttgggatcgattcttaggggtgcatttttcgtttttattgcatttttactgtgaaatttctgggaaaatcccaaaataggtactaaaaattcataaaaatgccaaaataggttgtaaactattttaggtgccaaaacgccaaaataggtgtttttaggtgctaaaaagtcgctctaaatcgaaaattgtacggacaaaatgctttttttgggcttctctcatcataactaagccgggaaaaaaataggtaaaaacctaaaaatccgagtcctaaacgcaaaatgatcgaaggtcaaaaaaaagatgaatataaatggaaattggcgatgggttcaaaagcgaaggaatttctcttcccttttccaaatttacaattaaaaaactttaacatttgattttcaattattattaatattatttgttatataatttataataaatcaaatttaaaaaagcaaaacaaaattaagatttatttgattatccaaaatg

SEQ ID NO: 113748 - DNA, 97 bp, Heterodera glycines
  Promoter: Source sequence=SeqID_40644; Location=1..97; Strand=+; Gene= SeqID_68912
atttttattaccattttcaagtgcaattccattggtgagtcaattaatagcgtaattatatttaataatccaatttaattaggtgtacgatgaaatg

SEQ ID NO: 113749 - DNA, 150 bp, Heterodera glycines
  Promoter: Source sequence=SeqID_35018; Location=853..1002; Strand=-; Gene=SeqID_64678
gatattatttaaattataatgcaaccaattaaaatagtaattttaaatacctttttaaaaaaagctgattaataaattaagtgatgctaattgttgcgttactattttaaaaaatcgaatttctgctgaccaaatttcagatatgacatg

SEQ ID NO: 113750 - DNA, 442 bp, Heterodera glycines
  Promoter: Source sequence=SeqID_27143; Location=1..442; Strand=+; Gene=SeqID_57848
aattcaatgtttttgtttgcgttgtctttttcctttattcattttcacacccaatgagagaaaaggaagattttcatgaagaaattcagaagcaaagtatgtaattcttggttaaaaatgaacaaattccctttaatgaatgttgccaacagaaaaaaatgaaaatataaaaattttctcacgaaacaagtcgccaagtcactcgtgccgagaagtacaaaatcatttttcgacaaattgtttatttacgaatgaaattagtcacccttacagggattccccccccccttctctctctttggatcaattcattattaactatatgtacactatatgtacatttattgagtgttattgtttttttatttgagtttttaaatgtttacacataattttttgatgatattttaaaattttattttaggttataatttcgaagatg

SEQ ID NO: 113751 - DNA, 696 bp, Heterodera glycines
  Promoter: Source sequence=SeqID_19669; Location=359..1054; Strand=-; Gene=SeqID_84401
aatcgaaatgcgatgttcttcgatctctgttgttgtcccataaggcataagcctaagtacttaattctcgagttgttcacttatcgtacatttgctcgatgtatttttattttgttgctaatttcactctgagtatgtaaataaatgctagcgtgcttttattttaaaaatattaatgttgatcaaaaaaaagaaaaatttgttggaaattttttgctggcgataggcgcactggtacttccgggttatgctgccccctccccctcaaaaaattccaaaatttgtaatttgggggttccaaggtcggtgatcactaatttgatattaattttaacatctgatgatttttaatcatatggactcaatattatgatatggataactatatacgcacatgaatggcgccacacaggaggcaaaaagtgaaagatattgcgcaaatatcacgagcctttggtgcggaataactcctaatttatgaggtgacctgaggatgcaactcttgtgatattctcccagccggaccgaccgttattcaacaaaattcgcatgtaatatactttgcaatgagttaattattctaattataattattattaggttaggaatctgatacgaaacgagattcagtcagcagagctgatgaataaatggatttgatcgcttctatgtcgttattcacaaaccatcaaaatg

SEQ ID NO: 113752 - DNA, 245 bp, Heterodera glycines
  Promoter: Source sequence=SeqID_6156; Location=1041..1285; Strand=-; Gene=SeqID_60533
tttgttaattgtttttgttattcggtttcaattcgtttggcttttccctttcagttgaatcgtcttaagccaaagggtgtgcgaaatgtgctgtttttgatggaaaagggtaaacgcaaccgatacagaagtcgcgactttttggtgtgtccactcacataatattttactgatttatcactttaaaaaaagttcagttttcgcaattttacaatgccgaaattaacgattccgacacttcgatg

SEQ ID NO: 113753 - DNA, 756 bp, Heterodera glycines
  Promoter: Source sequence=SeqID_13202; Location=872..1627; Strand=+; Gene=SeqID_77029
aagagtgggcgaatggcaccatactttataattttttgttttgttttgtttaaagtgttgtgaacaattgagcccatgacaactatggcgtgataaactcataaacttgttgaattgttcacacgaaatattttcagacattttctcgttatatgttgaaccggattttagaattttggtcgagttcgtgttagggaataaaaattggtcaaaatagttgtctgattcgtgatcagggagggacccccaaaatcatcggagtcgggaaacagttttcacaaattcaacaaaagaatccctcccccctatggcttttgataaaattcaaaaactatcactttagtaaaagcgccgtaatttttcatttaataacaaattaaccaataaccattgtaaaaatatcgattcaataatgtataggcaaatctgtggttaaacattgataaaatcatatttattttttaaattatttaattttcttatttatttagcaaaaaaaaaactaaaatagaaacattcaaccagtcaaaatttttaaaattaaatttcgccttcaatttttgaaataatccagtcaattttttaaaaagattttgctgacaatgacaaccgcgaatttttcagattggattgatcttcagctttttcattgaaaattcattgccctttattttattaataatttttggctttttatcacaaattaaatgatttgatttagcaaatttaaacattaaaaattcttttttactgatg

SEQ ID NO: 113754 - DNA, 447 bp, Heterodera glycines
  misc_feature (105)..(106): n is a, c, g, or t
  Promoter: Source sequence=SeqID_39924; Location=607..1053; Strand=-; Gene=SeqID_46610
ggttcaccagcctcgatgctgggaaagtttcttttctcagaaaggcccaggaggcctttacttttacgggtaagcgcccgccacacgggcaaaactcaaaatatnntttcaaatagaatagtaaaaagctggaataatcttccagtggtagcggtgcaaataataaagcaaaggattcaggggtttactaaaagcaatgagttctgagtaggattttccatgttgccatatttacactatatttttatcacctgtgaatttttaacatttgattgaattatttttattcatttttagtacggtattcattttgtatttttattttgatcaaatttatttgttgttttcttttttggcaccatataagagcactcatgtgcctttggtttgctcgataaattaaattaaatctatgcttatgaaaaattggaacgcttcaacgacatg

SEQ ID NO: 113755 - DNA, 680 bp, Heterodera glycines
  Promoter: Source sequence=SeqID_5545; Location=223..902; Strand=+; Gene=SeqID_58402
tatttcaacttggagaaacaaattccgacaaagtcaattaaaaatggaatgagtttttcaaacttgttctgattttcacatttgtcctgagaaaatgaataaaatgacgatttttttttgttattataattaatgtaaaatatttctgttttggatgaaaaatttgttaataaatgtcctgattttttatgtttgtactgacttttttataatcgatccaagcaataaattctcatttcttcatttaataaataattcataaagataaaatttccttttttttttgaattgtaaattattactaatatttattgtcaattgaaaatgaaattctgtattttattatttttatttttgattgccctaattattccaatttttttctaaaatctctttacattgtgaatttattatatttttattgaaaatatgtttattattttcgaatgagctccagtagaaagtaataaaattttatttaatcattaatttaccaattggcaattattttgtcattaagataaaattattattattatttctttgcaattaaacaggatttccttattttattaagtaaaataatgatttattcagttttttaatcagaaaaaaatcatttaaatgcctcaaaaaatgaattgccatttaattgaagaaaaattaaattcttgaaaatg

SEQ ID NO: 113756 - DNA, 778 bp, Heterodera glycines
  Promoter: Source sequence=SeqID_530; Location=1188..1965; Strand=+; Gene=SeqID_55519
attaatgatgctaaaaagacaacaaacaattattctgtttttaactccgatgtaataggattttcgagatttctgtcccagggatgtacttttttttgaatttagtttaaattcaaaaagaggaatttatgatttttagaatttcttcaaatcattgaagacaggcacaaaaatgccgaaaggcaataatttaatgctttgcccggttcagttggccaattaactcagtttcaaaatgatcagaatgctattttgggacgaatttcccaattggagacgcagcaacagcaaatgcgtgaagcatttatttttatattcgaaaattttaaatgaatctttctgagaaattttaaatgttccttaaaaattcctcgattatttaatgattgtcttttttaaatttgacagttggcacagcaaacaacgaaagagcccaccaaagtaggcaatgccaaacaacagaaaaaagcgcaggtattaaattttgaaaatttatttgaataaatgtttttatcataatattatggcatttatgtgtaccaatataatttattttgaaaaattttatcatataattacaaatattcaacaaacaatttctaatttaataaaagcagacaaatatacgtattagagttagttcaaacatttttttacacaaaagatagtattgttaatttaaaaattttaaaaatattttcgaaaatttctcattccactttttctcgtgttcatatgtttttaggcatcacattttctcttaccactgccgataatg

SEQ ID NO: 113757 - DNA, 848 bp, Heterodera glycines
  Promoter: Source sequence=SeqID_23432; Location=1..848; Strand=+; Gene=SeqID_45783
tcgcccctttccaaattttaggcaattttgggggccggcaaaaatttaaccctaattctgaccccaaaatgtcgaaaatcggaatttctactccaattttttgcgggaattgaaagtcggaattctgcgataatttcgtccccaaaaatgacggaagaaatcgtaatttgttcatctgtacttcaacatacaaacaatgcttgttactactataggcccagcgaatggagcggcttttgattaaatgacaattaatttatgttccgtttccatgacgatattaatagggcttcagtttaaaataccctaaaaggcgcaaaaatgggcacaaaatggacaaataggcagcacacacaaaagtctcaattgtatgaattttatttttttttcttgccttttttttgagaaaaattattcataaccttactcaaataaaaaaagggggtaattttttaacgagatggccgcaagcgaaggtgtaccgacattggcgcctcgacaattacgcaacccgtaaaaatagacatttgcgcctccacaattgcgccacccactaaaaatagacatttgcgccgcccagtataatagacattttcgccacccagtaaaatagacatttgcgccgcccagtataatagacatttgagccgcccagtaaaaatagacatttgcgccgcccagtataatagacatttgcgccacccagtaaaatagacatttgcgcctcgacaattgcgccgcccagtaaaaatcactgatcacaaataaacgaagatttgctaattaattttaagtgatcgaatttttaatttagaaaaattaaataaaaaattattatttaaaaaatg

SEQ ID NO: 113758 - DNA, 82 bp, Heterodera glycines
  Promoter: Source sequence=SeqID_16594; Location=261..342; Strand=+; Gene=SeqID_81006
gtatcaattttgaaatcacattaaaatttatttccaataaattttacatttcaaaaatcgccttttcattaggcttcgaatg

SEQ ID NO: 113759 - DNA, 339 bp, Heterodera glycines
  Promoter: Source sequence=SeqID_41614; Location=384..722; Strand=+; Gene=SeqID_69697
ggttacacagaatagttcaagacaggtactgttcaattaatgatatacaatacaacgaatgaattgttaagatcgtcaaaagggcacgacatgaagtaatgcaccacctgtggttcctaaaagtgttgaccaactgattgtaccgccggcataccgaacatataagcctattgacggtgatgaatagcagttcctattgggtgactctggtgtgtattacgaggccggaaacgaaaatccgcagaggtagttttttgaataaaattccactttcactacattttttcaagaattctgctgtttgggcgtgcatcttttgggcgatgggctgatcgcatg

SEQ ID NO: 113760 - DNA, 143 bp, Heterodera glycines
  Promoter: Source sequence=SeqID_4838; Location=1707..1849; Strand=-; Gene=SeqID_55902
caaacgcaaatacataaatgctaatttacagaatttttaaagttctcaaaacatttaccattttattaatttgtttttcccattttattgtcggcttcacgcttttgcgcttaggtaaataaatttttttaaatagccaaatg

SEQ ID NO: 113761 - DNA, 970 bp, Heterodera glycines
  Promoter: Source sequence=SeqID_9; Location=191..1160; Strand=+; Gene= SeqID_61205
agtagtgtaacttactttttttacaatgcattatttttttcttataagaatttggtataattttaattgttattggaattttttttgttaaagacaaatttttaaacatttaactgtttaaaaataataaattattgtttataataaaacttaattcctgttattaaaaaaaagtttggtctctcgccgccacacgcccgcctccgcagcgcttgtggtgaagcaaaggggaaaatttttcaccatatagtcaacaattatcccattcctttcaactcaccctgtggccaagtggttaagctcctcgcttccactctcaacggttcgagtccgctaccatgtttttgatttttcacaatttttcggaattttcatcataaagtcaacaattatcccatacctttcaactgcccctgtggccaagtggttaagctcctcgcttccactctcaacggttcgagaccgcgaccatgtttttgattttccacaatttatcggaaaaagtcgcgcagctctcgctcatttaaattaattaatttaaatttaaattaatttaaattaattaaattctcgcgcacaagtccatccaataggtttcggttgaagggatcaaagatcatccaataggtatggggcgggggggggggggtccgaaaatatggattgaaaaaaatcgataatcaaagtactcgtacattgtagtggaataatatgctttttaaacagacagaaatttttgtttttaagggtatttttgagaaactattaatccgatttttatctcacagattgacgcaaatttataatagaattaaatataaataatttttaggaataatatgctttttaaacagacagaaatttttatttttaagtttatttttgagaaactattaatccgatttttgtctcacagattgacgcaaatttataatagaattaaatataaataatttttaggaataatatg

SEQ ID NO: 113762 - DNA, 133 bp, Heterodera glycines
  Promoter: Source sequence=SeqID_6058; Location=1220..1352; Strand=+; Gene=SeqID_60173
aaagtgcgttcaggacaacaccccaaaaagactaaatatcgaagggattgttaggcctgtaaccagaaaaattttgctgaaggggggggggtcgaaaattttatctaaaatttattaacgaatttaagccatg

SEQ ID NO: 113763 - DNA, 643 bp, Heterodera glycines
  Promoter: Source sequence=SeqID_1299; Location=705..1347; Strand=+; Gene=SeqID_72000
tattttgagcccgccccctgaattaagaatattttgcggaatggatatttggcagctccaaacaacagcactagtgccgcgcacaaatttgcataatccttcgttgccggaaattccacaccctttagcagaactgtcaatcacccaccctcccatccatgggattaggattggtcacccccgcgtccccccgaccctgctcaaaaattcagccaaacaaattgttgaaatgcagtaaacaattaattcgtgttaccaatttgtcagcaatatccccataggttttggctttttccccacccaaataattaattaattaattgaccacccccccccaattagtcacccgaaaaccctcccataggttttgattttaattccccccatctgtcacttttccctttgaccagctgtcaatcaattagctaattagcccccctccactggtcagctgtcacttttaattagtgtcatgctgcagaggtggcgtatggtttactactgaagtatgaaaaaatcaaagaattttaattattagttacagttgttaaatcaatttttgggtaatttaattaagaaccaattaatcattaaaatgcgggaaaattattaacaaagttttgatcgagatgttttacatatg

SEQ ID NO: 113764 - DNA, 502 bp, Heterodera glycines
  Promoter: Source sequence=SeqID_36128; Location=564..1065; Strand=-; Gene=SeqID_65531
ttttccggggattcgaataaaattgatgccattcattgctcttgtggcctgtaatgcccaggctaaatactcactgaggtgcggaacttgcaaaaaaattagatgtaccgtacaatttcactcgagacggtagatgtaccgtacccatcccccccccaaattacccaccgtcttggcaatggaccgtacccacccccttccatggcccaccgtcttggcaacggtagatgtaccgtacccatctccccccccccctaaattgaccgttgccttgggaacggaccgtacgtctgaactgggaggaggaatatggatcgcttttggagagggataccgaatccctcttttactttcgcaaatgatttgaaccatacttttgtcttctaattgggcacaccgataacatttagagtgcacatatttcgccatatgtctaccgaagcatcttcctcatcgtcagcatcgtccgtacaacaagatcaacaacaaaaggttcaaaatg

SEQ ID NO: 113765 - DNA, 608 bp, Heterodera glycines
  Promoter: Source sequence=SeqID_6226; Location=3381..3988; Strand=+; Gene=SeqID_60793
tcagaaaataatggcttacaacccagtttaaatctttggttttaaaatttaactgaattaaatcaacctaggtaattttcgtttgttgactttggctgtctcacgaaaaaacagatgaaactcaaaaaaattcaaatacccgccatttggcaaaatgtttgttttattttcgaaacaccgaaattccttgaaagtgaaagagttttttgtgaattttaacgctgtttttgaaaaaatgagtaattttgacgcctttcagatcggttttcgaagtttctgtccatgtgggaacagaatgaactgcaacataacttctcaggttttattttgcttataataaatcaaagtgttgttacttcttgcattttttggatttttaaatcccgtaaaatgcaaaagtaacaaatgactcgtgttttatgtttgtaaatgccgtcgtccgaataaggacgggaacagggacacgcaaatgcaaacattgcgtaaagggtaaacccaaacggctgcgagttgcgtccgaaagcgtcccccaatgaggaaaagtgttcatttgattaacgaattccaaaaaatcaaccaaatctcagaagcactgaactccaacaatg

SEQ ID NO: 113766 - DNA, 387 bp, Heterodera glycines
  Promoter: Source sequence=SeqID_41826; Location=814..1200; Strand=-; Gene=SeqID_69876
ggtctggtcagggtcactctgatcaatgatcacccatgggtacgctaatataaaaaaatgaatgcaatacattgaacagcagagagacagagataaacaaaggacactaaaacaacaacaacaaaaataaaacacagacattttttttgggggggggggagatcaaacgaattcgcctcctattagcacgttggcaaaacatgcacaatcatcaacatttattattattattttaattagagttgttcggcactagcatttttagcaatggttggtttttgaaaaattgtgaatttaaattcatagtttataacttgattattgtgctcattttataaatcataaaattggtgaatgaaaatgattaataaatacgtttttcagatg

SEQ ID NO: 113767 - DNA, 393 bp, Heterodera glycines
  Promoter: Source sequence=SeqID_9464; Location=1..393; Strand=+; Gene= SeqID_71511
tgttttgcgttaaaaaatgatttgaaaaatgaaatatttggttttgttttttatttgttttattaattaatgcatttacatcaagcatttttaataaactagcggggatgcgccgaaggagctaactaaccccactagttatacttaaaacaatttacatacacggaaatctgacgtgtgctcttccccaaatttctatctcctaattgtataatagatttcttttgtgtcaatttattgaaatgttcgtcgtcaatagaggagggcaaattacttggaagtaatgcggataatataagcggatataggtttgattataacatctttcatttaagtcgcacagattgtaatcggcaattcgccggtcagcgccaatttagtgaacaccttatg

SEQ ID NO: 113768 - DNA, 340 bp, Heterodera glycines
  Promoter: Source sequence=SeqID_2658; Location=4237..4576; Strand=+; Gene=SeqID_80924
ttttttgacaaaaaaatgtttgttatatttttgaaaaattagggcaaattgtggttgtttatttaaatggaggacgccaaaaaagtgccaaaactttgatggattaaaaaaaatgaaatggggatgtagataaattggcgctatttacaaagaggtgcattttgaaacaaaaggggggacccttttgttttgcaaaattttttaagataaaaaaccatgataattttttatccggggttttaaaggtcgctaatcacgaatctgacatgtattttgactaatttctaatccctaacccgaactcgaataaaaatcggaattttgaatttttcaaattatg

SEQ ID NO: 113769 - DNA, 58 bp, Heterodera glycines
  misc_feature (25)..(25): n is a, c, g, or t
  Promoter: Source sequence=SeqID_43685; Location=1..58; Strand=+; Gene= SeqID_71304
aatggggggtcaagtgcgatgaacncaaccggcgatcattttgcaacaacagcaaatg

SEQ ID NO: 113770 - DNA, 69 bp, Heterodera glycines
  Promoter: Source sequence=SeqID_28216; Location=316..384; Strand=+; Gene=SeqID_58858
ttggttatattccctgaaaagcgatttatatttctaatacataaaattgaatttgtttagctaaaaatg

SEQ ID NO: 113771 - DNA, 1003 bp, Heterodera glycines
  Promoter: Source sequence=SeqID_4619; Location=312..1314; Strand=+; Gene=SeqID_55120
tattttcaaatgatgtgcttaatggggaaaataaaaaatcacagaaaatacaacacagaagagatgaagaaacggctctgctgctgctggtggcagaagagatttttatcatcccatccttaagaagaagggtgtggatgggagagaaaaagtggtggtggaaaaaggtgcgacaaattgttacgggaggggggggggggtgactcatcacggacagaagcaccgatcgacgtttggcatttagcggacagacaaatgatcatagttttgtatgtacattattccgccttcctccgctttcatccaaccgtcattttttaaattaaaacaatttacctcctgtttttatttaaaaaaaaaaattaattttttgagtttttacatttgtataatatgtatttgtagctaattttcgacacttattttttgttttgtatttttttaattgttaattttttcgttttattaaattatgaaaggggaacagaggaagagagacagttgtagaagaggaagagaaagtggaagacaaagagggacaggagtgacagaggaagaggagtggaagagaaaagggaaagagaaaggggaagagggacctgaggagaggaggaagagaaaagggaaaagaggaagagaaaggggaagagggacctgaggagaggaggaagagaaaagggaaaagaggaagagaaaggggaagaggggcatgagagaggaggaagagaaagagggatagttgagaaggggaagataaaagtagaagactaagagggataggagtgacagaggaagaagagtggaaggggaagagaaaagggaaaagaggaagagaaaggggaagagggacctgaggagaaaggagtgaccgtagggcactgattttacatgtgtatacctaatatgtatttttaaagctattttttatccttactgttttttttttgcctttcttattcatcttcaactactcatcacaatggctctcaatttgcaggaaatg

SEQ ID NO: 113772 - DNA, 63 bp, Heterodera glycines
  Promoter: Source sequence=SeqID_24436; Location=1592..1654; Strand=-; Gene=SeqID_55171
caatttaaaagataaaattgaaatggtttgggctaaaaaccgcgcgaaatttgcagaaatatg

SEQ ID NO: 113773 - DNA, 472 bp, Heterodera glycines
  Promoter: Source sequence=SeqID_8405; Location=1958..2429; Strand=-; Gene=SeqID_67952
cgataactgacatgtattattttttgattgtttcttaagtataaaatggaaatatatttgaaaatttttgcattattctgaacataaatttttcgataaaaactcttcatgatttttcttaaacacaatcaaattaaaatagtcttggtatcatttgttcaattaatatgaaaaatgaatagaattttcggaaatttctcgtgctaataaatgggataggaatttcaggcaacatgtttcaaacatcctccaaaaagcttttctttgaagccgaatccgacgtttatattcctctaatttaaaaaaaaagaaataatccgccaggaataattagaaaattgttattttttaaaattctaaagaaaatactgttttataaatttttgaatagaaaacacatacaactgtagcgatttatatattcatcatcagtagggttgtaaattatatggactaaaaaacgcgaaatatg

SEQ ID NO: 113774 - DNA, 313 bp, Heterodera glycines
  misc_feature (21)..(21): n is a, c, g, or t
  Promoter: Source sequence=SeqID_20690; Location=1..313; Strand=+; Gene=SeqID_51247
aaaaatttaatgacgcgaaanaatattttgaaagcaattctctaaaaattcatttaatttgagttaaggatgccattaaccatcctgaaaattacgtgctcaaatcgaacatggaatgtggcggcaacaactatttcgatgaaaaaattccgataaaattaacgggaattactccgactgaacgttcgttccacattttgatgcagaaattgcgaccgatgccaattaaggcatctttttgaattttgaatttttattttggaaagaaattgccttttttatgataaatttgttttaattttagaacgttatg

SEQ ID NO: 113775 - DNA, 370 bp, Heterodera glycines
  Promoter: Source sequence=SeqID_785; Location=6809..7178; Strand=+; Gene=SeqID_61215
ttttggaggctcaattagcacacttttccctttaaaatctgttgttatgtaacttaaaaagagacagttaaaatgagaaagcaaagtacaaatcaatcaatgatgcataaggctgggaatttaaggcactaaaaatcgccaaaaagtcacgaaaaaaagtcctgaaaaattaggtgaattaatttatagaataacactttgatcatatttaaaatatcttaattttaggccattgtcgccaccagcgaaagaaaaagaagaagcgggcaaaagcaacgaaaatgtcgtctaattattagggaatagaattacatggaaatccatatttttttcctggactgtgggaggcctgaaacgcacgaaaaacatg

SEQ ID NO: 113776 - DNA, 1003 bp, Heterodera glycines
  Promoter: Source sequence=SeqID_13318; Location=124..1126; Strand=-; Gene=SeqID_77182
ttcggcctaacccgacattacaatttacccaataacaatagtttttctttttttaattacatcgatttaaaattcattcactttccacccattaccaccaccattgatggactgtgctctaaagtgattcatccaccagttcaatctaacggatgggctgatatccttttcagcaatcagaagaattaatgtttcgctagttaaatttgctcattttgtgccgttcgcttcccccgaccatcgaatgagaaaatatattcaaatttgattaaaaagaattcattcgaaataacaaccattcggtcgggtcaaccgagcaattcttgtacaattttagcaacctcaaaagatttaattgtattttttcaattttctgttttcaatttgggatgaggtttatggcttcaacaaatattaaataattcgactctttttaattcattccatttgttaaaatgttaagaattcatttttcctctttaatttaaccgccattctttcaataattaatcaactccattctctctgccgttcaacatgggcaagttcattcttatgtaagttagttagtcagcaggagtttggcaacccattgctttgatttgtcatttgaataagcataaattgaatcggagtacgaaattagtgaacagaattaagaaaaatgtcaaaattttatttattataattattaaggttatatgtaaatgattctgcgtttcatagtaataattgcctctctgaattaacgaatccgataggccaaaggaaaaaactgaaaattttgaattttgcaacaaatatttcaatattcgcaattaattcattaccacacatccctccaggagcattctctttctgctgacagcagcagcattgtcgatgggggcagaaaaaaggaccaaagtaagtgaaaagcttagaaattcaaaaaaccacaacatcgacgacgacaccaacaacaaccaccacgacaaccccgccaccggcaactcggacaatg

SEQ ID NO: 113777 - DNA, 879 bp, Heterodera glycines
  Promoter: Source sequence=SeqID_16011; Location=1753..2631; Strand=+; Gene=SeqID_80365
cctgaaaggagagagaatgagaatgagggaaggggggggggcggtagaagcactggaggacgaggccctctgtctattcgcgactgccgatagatgtgtccgaacacggggattatctcgtacgaatattggtatacccaatctattgaatgcatttcagttcataaatccccgttctcgctaattttacgtggtcgagcagctcctcatccttgaggaacgtctcatcgcatgattggtatccaattagataccaatacctcacagcaccgcagacgagacatggcgccttgtcgtacagggccagtgatgtgacctcatactcagttgtgccatcgtcgtcctccgcgatgtcggcagcattttgatccgggtgtcaatgttggcactaataaacaaatttgtccattaaaaatgaggtagttgcgaatggcttctaactcattttgcactcaaaattatgaaaagatctatctcgggatgagtcaaattatcattttttgcctataatctataatttcacaattaatttagacttattagataaaaattaccccgaccgtcccctaatcacaatttcaacaaattttataacacattcattaaattcaaattttgccgccgccaaaacatgtcagtggggcgcttaaagtcacttattcttttgtgtccaatattccctgcactaatctttgttgatcgccccgagccaaacaaagaaagataacatctgttgtatggccattctgacaatgaagaggaagtgaaattgacaaaagaaacaaaaatttggagaactaaagtggatggggaggggggggggggttttagcgatcgggccatactccgctggtcatttctccgaatattcgcgccatg

SEQ ID NO: 113778 - DNA, 436 bp, Heterodera glycines
  Promoter: Source sequence=SeqID_7676; Location=1..436; Strand=+; Gene= SeqID_65603
taaatagaaatctttgcttaaaacataatctccgtgaaaatcccaggaaaaagaagcattttggtaacttttctgaggactaatcacctgggatagccaaattcaatcatttttcttttcttttaatcatactgtattttaagtatgtggaccggtctcgagaagtcgtttcagcttgaaaatgccaacagaatttggacaggctttcgtaatttttaaatttgttaaacaataagtcccgcgggactgtttattgcttatctctcttttatcagttctgaggaactcatcaatcattatctaataaatattataatcatactcttgaaactgatcacttatctcagtcctgtgtcagctcagatactatttttatggttaaaaaaaaagtgaacatatttttctaattaatcgtttcttttactaagcacaaatg

SEQ ID NO: 113779 - DNA, 67 bp, Heterodera glycines
  Promoter: Source sequence=SeqID_28425; Location=1..67; Strand=+; Gene= SeqID_59051
aaaaaagaaattgtcttctgtttagcgctaccgaagcgaccccgttttcgcagaaacggctcgaatg

SEQ ID NO: 113780 - DNA, 161 bp, Heterodera glycines
  Promoter: Source sequence=SeqID_3300; Location=1..161; Strand=+; Gene= SeqID_84126
acatccacaaaacactaattaaacgtaattaattttttctatttaaaactttaattatttaatttttaggcattcctccatttttgcacattacaaattcacatatttgcttggacatctgttaatttgtgtaatttacggtgcatttacactgaattatg

SEQ ID NO: 113781 - DNA, 185 bp, Heterodera glycines
  Promoter: Source sequence=SeqID_44652; Location=1382..1566; Strand=-; Gene=SeqID_72114
tggaattagcgtcggaaagccgctgcccgccggcgcaattccgggccgaattttgggcgaattttgtggccaaattccttccaatgaaaaaagtaaaaaaaaaaatacaaatttaaaacccaaaaaatcgatttgttttttagaaaataaaaaattctttttgctggccgaatcgtcgttcaatg

SEQ ID NO: 113782 - DNA, 268 bp, Heterodera glycines
  Promoter: Source sequence=SeqID_43831; Location=244..511; Strand=-; Gene=SeqID_71414
ttgtcgggagagaatgcaaaaggcaaagacggggtgcaaagagaacgtttcgatgggttgcgcttgagggggcgttgacaatgggcttttctttgagttcggtcggtgttttgcgttgggcggcggtgtccgtcccaaaattcgccaacatttatttatttatccctcgccgccccgtcaactttccctcattcactcacacctcattttttgtcccattcttctcactttcaccgttacccttttttcgagttgtataatttcaatg

SEQ ID NO: 113783 - DNA, 133 bp, Heterodera glycines
  Promoter: Source sequence=SeqID_18268; Location=1079..1211; Strand=-; Gene=SeqID_82861
aaatcaaggggttgcaaaaaggataagatccgtcatatttgctaaatggggacaaaaattaaaacccatgcaaaaatatgttcgttaaaaatcttggtaattggaaatttctggttattttttattgcccatg

SEQ ID NO: 113784 - DNA, 320 bp, Heterodera glycines
  Promoter: Source sequence=SeqID_16646; Location=725..1044; Strand=+; Gene=SeqID_81061
ttggtacggtaacccgcgttgattaaattacagtattcaaattggatgccattttttttgttgttgaaaattttggcaatttataacagggcattttttaggaaattcatcgattaaaaatcaaattttttgtacaaatttaaggcgaatcaaccgatcgcgaaaagaacaacaatctgtggacagaatggacggaatggacacagtaaaaaaatgcaataaaattataattaaaaacaaataaaaatcaaaattaaaatgtgtttgatttgtcattttttgccagttgttcccgcagttgtggtggaggaaaacagatg

SEQ ID NO: 113785 - DNA, 125 bp, Heterodera glycines
  Promoter: Source sequence=SeqID_20354; Location=1106..1230; Strand=-; Gene=SeqID_50875
tggcccaactgacgtagaccgagtgatggataagtaaatgataatacaatacattcattgaacatatagataagtggggatttgttaagattgaaattatgtaacagaatacgtaattttagatg

SEQ ID NO: 113786 - DNA, 69 bp, Heterodera glycines
  Promoter: Source sequence=SeqID_12986; Location=1610..1678; Strand=-; Gene=SeqID_76749
ttatttagttatctaattacatgtcaaaatttgactaaaggaaagccggtgacacgcattccgatcatg

SEQ ID NO: 113787 - DNA, 472 bp, Heterodera glycines
  Promoter: Source sequence=SeqID_19097; Location=432..903; Strand=-; Gene=SeqID_83840
gtgaaaaatattgtgatagcaggtgaaaaaaaggggcagaacaggtgaaaaatattgtgatagcgggagaaaaaagggcagaacaggtgaaaaatattgtcatagcaggtgaaaaaaagggcagaacaggtgaaaaatattgtcatagcaggtgaaaaaaaggggcagaacaggtgaaaaacattgtcatagcaggtgaaaaaagggcagaacaggtgaaaaatattgtcatagcaggtgaaaaaaaggggcagaacaggtgaaaaacattgtcatagcaggtgttaaacaggtgaaaaaatgtcataataaagtaaaaaagtgaaaaaataagaaaaatgaggaaaccgtgaaaattttgtgacatcatatggtcgaacaatgatggtttgcgaagaaaacatatgaaaggtgaagagtctgaaagttgattataaataccaataaacaatttcttacaaccaaaataatg

SEQ ID NO: 113788 - DNA, 160 bp, Heterodera glycines
  Promoter: Source sequence=SeqID_12025; Location=1501..1660; Strand=+; Gene=SeqID_75553
gcggcaaattaaaagcggaaattaaattcaaaaatacaacaaaaaaacaggtgaaaagggaccccgagacattgccgcaaattccggcaattccgctcagttacggcgacgcgtatgaaattctgtcgcgcgtggatgggccggaagtgccgaaagaatg

SEQ ID NO: 113789 - DNA, 1003 bp, Heterodera glycines
  Promoter: Source sequence=SeqID_1531; Location=1414..2416; Strand=+; Gene=SeqID_74284
ctgatcaccattggacctcttctaatcactgttgtagctcttctaatcactgttgtacctttgagaccgttttttaatattattaaaaggttttttatttatttccatattttatatttttttcaattcttcgctttttgcatatatttttacattttcacatgaatgtcagactatgctctcagtttattgacacatttctcgtgtttgtgatggtgtgcgttattgattaatctgtttcttttttctctatgaaaacttttgatgggcaaaaaaggtactcaaattttcaaaattttccggcctcctgttcccaataatttttttggaaataaagcgtgccgaaaatattttttgtaatttttgtcattgaaataaaaacttttttaccaacaaaacctacaaattattatattttttggtaaattaggattctggaccaagggggattgacaggctttttgagttgaaaatttttttcaccaaaaatcttccaaaaaatgtcagttgcacatgttccaatcactgctttacctcttttgttcactgttatacctcttttaaaaattttccgaattctcgcctttgcacctaaataagttaggaaaaacctaaaccgatcatttccattcttttttattaaaattctccatatttttctctttcttttgttattttttccaggtttcttccttttttctgaccaactttttgattttttaaataaatttcgaattttttttgtcacaatttgttttattttttggagtggaaaataaaaaaatattttattcttgatttcgaattagccaatacatacctaaaacatttgatgggttaatattgatttttttaaaatttacaatactttattcaaattcaggcccacattatatggcaaccaatttttcagttttttgtcatttttaatgaaatattttgaatttgttgctctttttaaggcattgttgacattcaattcgatgacaatcagcagcaaatg

SEQ ID NO: 113790 - DNA, 306 bp, Heterodera glycines
  Promoter: Source sequence=SeqID_42291; Location=1..306; Strand=+; Gene=SeqID_70213
atgacacttattgttagaaacttatgggaattttagccccatctaggaattttttgtccgtttttttacattcttttcacctttaaaatcctttgatgctttctttaaatattttttgcgtgagctttgttctcctccttcaccttgcatttgcctttgtccatggccatgcccacagtgacgagccaccgcatttaaaatacacacgcgaagtcaacgaagcggtggtaaatccaataaatgtataattcattatgtagcaaagtttgtctcttaacttattatttcagacaaaaagcgaagatg

SEQ ID NO: 113791 - DNA, 192 bp, Heterodera glycines
  Promoter: Source sequence=SeqID_6688; Location=1..192; Strand=+; Gene= SeqID_62497
cgacaggtggggctcgctcattttttcctctaattaccaaatttacggggtcgttttgaaagtcgaatctatagcctggcttgctaaggattgaaaattctcctttactccaatcatttttttgtttctgttttagcttcctaccgtacggcgggaccgaaaacgaaagtgccagacaaaaacgaatggatg

SEQ ID NO: 113792 - DNA, 200 bp, Heterodera glycines
  Promoter: Source sequence=SeqID_40411; Location=298..497; Strand=-; Gene=SeqID_68750
ccccggaaaattttaaaattttttcaaacctagaaattttcaccaaaaaaattcctaggatattagtaagaaaatttcttgaaaaattttttttgaaaaaacttattagttcatcatgatttcgaaaaaatcgctgaaaacgttttcaaaaataattcattgttttttctccccccccccccccccgtttttctcacatg

SEQ ID NO: 113793 - DNA, 171 bp, Heterodera glycines
  Promoter: Source sequence=SeqID_12144; Location=884..1054; Strand=-; Gene=SeqID_75717
gatagaaaatttaataattttggttttggaaattggtagataaaaacaatttaaaaaatggatttacattttttgtgggtttcattttcaattaatacatcttccaacaaattaaaaatcttctaaaaatgaaaatataagaaatattctttaggattacatgagcgaatg

SEQ ID NO: 113794 - DNA, 62 bp, Heterodera glycines
  Promoter: Source sequence=SeqID_21349; Location=1..62; Strand=+; Gene= SeqID_51952
ttgcctgtattaacagtgaggcgacataccccccccccctttttttgcagaccaacaaaatg

SEQ ID NO: 113795 - DNA, 1003 bp, Heterodera glycines
  Promoter: Source sequence=SeqID_9979; Location=3589..4591; Strand=+; Gene=SeqID_73022
cacccaattatttcatccttttcttaattatgccaattggatgtaaattaatgtaaaatatttcttattttttaagaaacatccatttatagaaaaaaaattaaaaaatttttttctttaaaaaaagaaaaaataacaaaaaaaatggaaaaaaataactaaaaaaaaattaaatttaaaaaaatttccaaatcgataaattctcattttttcatttataaatattatagcaaataatttcacaatttccgtcattaaattaaattaattaacagaattattgtcaattgaaaatgcaatttcccctgttctcattttaattatatttttaatcaaccaaattaatcaaatcggaacggaaaagaaaaaattggaacaaaaatcatttgatgaaatatttggggaaagttgggaagaaaaagaagaaaaacaacgaattgaagagaaaaaaatagaaaaaattgtggcaaattccataaaataaaagaaaaaataaaggaaaaaggaaaaaaatattcagcaaaaaaatggaataaaattgaacagaaaatagcgaaaaaattggggacaaatcgacacaaaatttatgaatggattaaagaattaggacttaataaacaaattcataaaagcaaaaaatccaaaactgataaagaaaaaattgaaatttcataaaatctctttaatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgaaattaaacaggatttccttattttattaagtaaaataatgatttattcagttttttaatcagaaaaaaatcatttaaatgcctcaaaaaatgaattgccatttaattgaagaaaaataaaataaaatcatttcgagacgacaaaaatg

SEQ ID NO: 113796 - DNA, 339 bp, Heterodera glycines
  Promoter: Source sequence=SeqID_15253; Location=2046..2384; Strand=-; Gene=SeqID_79467
agttggttggatccgtgcattcgagcgagagtacagaaagttcaactccggttttctgtggggcacgtccggtacccttgggtgttcaaaatgatgttgacaccgaattggacagattgataaagttgggtgttctcaaaaaagttgactacagcagatgggaaattaaacggcgcaaaaatattttcccaaattgattttaaggacgcttatttgcaaattagcgttgatgaacagtcgcgtcaactcttaggcgttaacactcacaagggactttatcaatgccaacgcctggcattcggaatcaaaagcgcaccaggcatttttcaatggacaatg

SEQ ID NO: 113797 - DNA, 202 bp, Heterodera glycines
  Promoter: Source sequence=SeqID_24758; Location=967..1168; Strand=+; Gene=SeqID_55494
ggttttttattttttatgatcgaaattcatatatatatatatatatagttaaaacttgctttaaccaaaaaaaaaaaaaaaatttcaatgcaaaaatataacattcacgcaattttctcgcttacggtttggacgcaaaagaaattcaaaaaaaaacgctgaaagcttttcaaaaaaaacatttttttacttataaaaaatg

SEQ ID NO: 113798 - DNA, 293 bp, Heterodera glycines
  Promoter: Source sequence=SeqID_8977; Location=1..293; Strand=+; Gene= SeqID_69894
tttcgggtcgctttttgagttcaattaattgactatcattgattaaaactctctctctctcgctctctctctcgctctctctctctctctctctctcttctctcgctcgttctttctctctctcgctcctcgctctctctcttattctgtctctctcattctgtctctctctctctctcttctatctttaaatcgtattcctatttaccacagaatttttgtacttttattttttatttatcccttttcttcttaaaaacaatcgcgataaaaagattaaaattttaaggatg

SEQ ID NO: 113799 - DNA, 391 bp, Heterodera glycines
  misc_feature (33)..(33): n is a, c, g, or t
  Promoter: Source sequence=SeqID_35262; Location=457..847; Strand=-; Gene=SeqID_64855
caaaaaccacttcgccacacatgcaaacctttntggaactgagaggccaaaattgaaacggtgtgttaattagtaggaaaaacactttcttttttgtgtttgcgaacaaaaatcgggacttttatttatatattttggacttttcgccattttttcctacatattttgcaatttttgataaccgttaaaaaaatttttatttacatattttcgtacatatttgggaatttttgtacatatttcgcgatttttcttacataaaaaaagaatccctgattattatctatcctataaaaatttaaataaactcaaaattaatctttagatattaatcatacctaacaagtaagagttgaaactttaaaagcttttttattgcacaaaaatcatg

SEQ ID NO: 113800 - DNA, 55 bp, Heterodera glycines
  Promoter: Source sequence=SeqID_719; Location=1328..1382; Strand=+; Gene=SeqID_59754
ggtagtgtattttaagattttctaaaattgataatttttataacaaacacagatg

SEQ ID NO: 113801 - DNA, 485 bp, Heterodera glycines
  Promoter: Source sequence=SeqID_13886; Location=1..485; Strand=+; Gene=SeqID_77830
gtctcggttcccggtttcggggttttagtctcggaaaccgagaaatttttacactgttcaagatgactatttcgggcagtgggggtcgccagcgaagggggaaaaggggaaaatttattgaattttgaacgtattttttaacaaaattcatgaaaatcccaaaaaagccaatgtttagggcctgtctttgttgtgatagcaataaaatttaagcataaatttaagatgcttttagatttgcatcacaattattgggatgccagcgcttgtcaaaaggacgtcaaaattagtggtgccaagcatttaattgccgaatgcgttggaggcatatacagtgaatatagtggtaaatttcgttataattatcttttaattattgtatttattctttaaaaggctgccattccgtcttcgcaaaacattcgatttcatggaataatgattacccttacattttttactttgaaatttcaatcataaaaatg

SEQ ID NO: 113802 - DNA, 812 bp, Heterodera glycines
  Promoter: Source sequence=SeqID_13831; Location=2688..3499; Strand=-; Gene=SeqID_77772
acaaaaattcgattttttcagccattttacacaaatttcttcaaaaccctcaataaatgctaaaaattaagaaaagtatgaaaaatccaaaattcggaaaataagtaatttattattgtaaaaaaaatcagaaatataaatatgtaaataaaagtacttaagaaggttaattaaaaatttataattttaaatgtttattttctggtttttgggcctactgcagtttacgcttcaagcaatgaccatcctcagtttcttaagtcctaacttcttacaaaaaattatttttgaatatactcgaaaaagctgattttcgagttttaacgtcgaattttttttcttaatattttgattcaatttaataaaattagttttcataagtttgttattgtataaattaagggaatataaaaatacttttcaccccaaaatataatattattaatgaaattttattaaaatttttattagagattaagtaagtcccaaactttttaatttatttaatgatacttattcatttataattaattcataagttctcaattttgtccttttatcctcaatattcaagatattaatcaaatatctttttgaatgaacgaattctccataactattttaaccaatattctcttttttatttttaaagagaccccttcatttttccgtggtgtgatatttacgcctcacagcaaaaatcgtacctttatgcatatattgtaagggctatttatttgttaattatcccatggcacatttatttttgtttaaaaaaatcataaactattttcagcaaggtccaaaaaatg

SEQ ID NO: 113803 - DNA, 498 bp, Heterodera glycines
  Promoter: Source sequence=SeqID_1929; Location=4499..4996; Strand=-; Gene=SeqID_76843
tacctgcaattagcgctacctagaagatgtatattaatgtctaattgaaaaaaataactgataaagtgcgggagaggaatgtaaaacgttatgaatttatacgaagtcaagttgtccatccagttgtaagtgtattaggctgcgagatcgcgaaaatgttaatgagcaacaaataaatgagcggatttgaagacggaatgaaaaatttctatgtgacttcatttctctctaccccttcgttaattttactacacactactcgattggtaaaccaatgtacatgtgctgaatgaataagtcgagttaaatacccggaagataaacactaccccttgacaatactcaaagtttgggtgattcctttagaaaattagatattctgttttgcccgtcaaagtgaatggtaggctctgattctctttatttatgaagtgcaccaaaaacaatcaaaaaggcaggatagacgtaaatacatatgcaaacacaaacaatgagatg

SEQ ID NO: 113804 - DNA, 1003 bp, Heterodera glycines
  Promoter: Source sequence=SeqID_11892; Location=548..1550; Strand=-; Gene=SeqID_75401
cttcgcccgttaaaaacaaacattttttgcttgtccgtcgtccaatttcccgagatgagaacaaatggataaaatgggagaatgaagcgattgagttggaatatggggccaattgaatatgtttcacattgcaattaatactgaagaaatcggagacaagtcagtaaaaaacacaattaaattgtaaatttccattttttggttttagtcttatcgatggcacttccgaccaaagtgattagcgcaaatgaattgttgagaagtgatggatcctttgaattgtctgctatttgtagtattcctttaaattatttttgtcattttaaatgtctaatttatagatttttcttgtatacaatatatatgtattgtggttaggtatttagtattcgattgataccaaaattgttcagtttagtggggaatgaagcgagttataggtgatcaaatgtgatcaaactaaacaacgaaaataagacactgaaattttcgtaaattttataaatattattttttatttaattatttctaaaaacacacgatttaacttatttgaagtggaattggaagctttgaccactgattaggaatttgatcaaagaaaaagactttgtattctttttaaatgcattggcattttgtttattacgccaattattttttgccgcttttttccttttttaccgtccatgaaaggaattggtttaattatgtcaaattcatgatcaaagaccgagtccaatcaattaaccataaagttctgaataaggtacataataatatcagaaaacaagataatgcttacatttaaataaagaaagtacaaccctttggatcttgaatggccgctacttttttgtagcgccgttttaactttgcttagttcatgttataaagcaaaattgtacaatgattcaaatcaatgtttttttactgtcttggttttctttaaataagttttttaagttttaattgttaatttttaccgaattcctgaaaaatg

SEQ ID NO: 113805 - DNA, 149 bp, Heterodera glycines
  Promoter: Source sequence=SeqID_10792; Location=841..989; Strand=-; Gene=SeqID_74056
aacaacgcactgcagggtttccttttttagtgtcgaaattattaactttgaatactatcaaatgaaaatactttatgttgtctcctgtttttcacaatagattttttcatttgtccctttagaccgcttggcatttcgaccgtaagatg

SEQ ID NO: 113806 - DNA, 244 bp, Heterodera glycines
  Promoter: Source sequence=SeqID_5356; Location=1..244; Strand=+; Gene= SeqID_57777
cccccccgcccccgacactatttcgggggatgggggactccgagcgtttaaaaatttaaaagctaattcatccacgaaggcgggaaatattgaaaattgttgagattttgaacaaattttcttaataaaattcattaaaaattatgaaaataaggttcaaaaaaattatggcctacttttttggtcccaaaccaagatcattagatttggttgacaaagaaaaaagttatagtcaaaaaacatg

SEQ ID NO: 113807 - DNA, 151 bp, Heterodera glycines
  Promoter: Source sequence=SeqID_9385; Location=1525..1675; Strand=-; Gene=SeqID_71211
tgtccttttgtttgcatttgaaggcccctaactttttttgtaaaactcgaatcaaaaagtgcccgctgaaagggcactccgcctaagggtcctctacaaggtggtattttttaaaattttttttgagcaaacccctggcctgcaaaaaatg

SEQ ID NO: 113808 - DNA, 1003 bp, Heterodera glycines
  Promoter: Source sequence=SeqID_2626; Location=1601..2603; Strand=-; Gene=SeqID_80787
atatgtacaaaaaagtccaaaatatgtaaataaaattttatttatttttaattaatttttggtatttttagaggtacattttcaaaaaaaaaatttttttcataagaaatttctataaatttttaaaaattgtcaaattatgtaataaaaaaatgaaaaattgccgaaattttgcatttttttgagaatttccaaaattaccataaaaaatacccaaattatttttaaaaaatgtacatatgtaagaaaaaagtccaaaatatgtaccaaatatgtaaaatatgtataaaacaccgaaatatgtaaataaaagtcccaactttttttccatcgttaagggtgtataaaaatgcaaaaaatatatatgtaaatatgggatatagataaaaaccaaacctttaaatagtatttttagcttggtttgatgcttctaggatgtctttttatttgcatattttaaccgcaagcaactgtctatgccgtagcgatgcgcctgttcccgaacgtctagccccggctgttcacctgcgcagccaccaacgggcgagccggctggtttttataagaaaattttttataaaataaaccaaacattatacaacataattgtaaacaaataattccaattaatgatggattgtgtgatcagtttcattaatttatccaatgaagatttttcagcctaaaagattttttaaggctcgtttttacatgcttataaaaaaatataaaattcaagattattacaacctaatgtaaacaaataaatccaattaatgatgatggcttatgtaatcagcttcattgatttatccagggaagatttgtcagcctaaaagaatttttcaattaaaaatgattctttcaatttttattatacaataatctttctaattttattattaaaaaaaaagaaatttaatttattttaaaaggaatggaagcaaaatttttgattattaaaattattatgctgctaattgccaagaattgtacacaaatg

SEQ ID NO: 113809 - DNA, 379 bp, Heterodera glycines
  Promoter: Source sequence=SeqID_24018; Location=1510..1888; Strand=-; Gene=SeqID_54721
aaggacgggtatgccagtttccaaggacacaagggaaattccattaaattcaagggcatttaaaaattttatcatgtgcaatgaaaaataattaaattttataccctaaaccaagcggaaaatgcgtttttcatgcttatctgagcgtataaagtgcaaagtgcgcaaaattttcggcatttgccgaaaaaacgaagccctagtaattaatcaagaaatgccttttgatttatgaattgctaatgaatagagaccggatttttaagtttttacctattttttttgcggttagtacttgatgagagaagcacgaaaaacacattttctctgaacaatttttgatttagagcgactttttagcacctaaaagcctaaaatg

SEQ ID NO: 113810 - DNA, 116 bp, Heterodera glycines
  Promoter: Source sequence=SeqID_12220; Location=1452..1567; Strand=+; Gene=SeqID_75795
aaaataaattaaataatgtaattaattaatcacttttttaattaggatggagctctgtttttgcgaaatttcccatcacaaacttttgtcgccccggcattttctacttcgaaatg

SEQ ID NO: 113811 - DNA, 1003 bp, Heterodera glycines
  Promoter: Source sequence=SeqID_5647; Location=6400..7402; Strand=+; Gene=SeqID_58765
tgtaaatttattattgtatattttacctttttgtttttccattgaagcataatttgtcggttagataaatattttaattattttacatagcaattttcaatgaaatttactatttttagcatttttttcatccgggaatcaaaatgatgttaaatagtcgtcattatgtcatcggaaatctttttaattttttcatttttataaacatttggcattatatgtcacaacaaataatgataatgatgcttaatattgaaaatgtttaaccaaccaaatcaattaaaatggaaaaaaattaatgttgctcattaaaaattactaaaatgatcatttcgttaaccataaaaatattattattcatttgatgcttaatattgaaaatgtttaaccaaccaaatcaattaaaatggaaaaaaattaatgttgctcattaaaaattactaaaatgatcatttcgttaaccataaaaatattattattcatttcaattacttttttaatcgtgcggaaaaaaaaattggaacaaaaatcatttgataaaaagaaatattcaaaaaaaagaatgggataaaattgaagaaaaaatagcaaaaaaatgagctcattcgaaaataataaaaataaaataaattcacaatgtaaagagattttagaaaaattaaagagattttatgaaattttattataccagaaaattggtgtaaaatggccaaaaatgaaattttagcgccgaaaaatgttgctgttcacgaaaataatagaaacttgaatatttgaatttcttatttattcaaaaataaaaataaccaaaagaagggcattgctgccgcttacacttgaggtggaaatacgagaggtcaaatgggtagaagtgacatgattgttgaaattttaaaatttttaatttgatattttaaagtatttccttccaaacaatatttttaattaatttggtcatctaaattgacataaaagcaacttaatgttgagtgggatggaaatg

SEQ ID NO: 113812 - DNA, 207 bp, Heterodera glycines
  Promoter: Source sequence=SeqID_42965; Location=1..207; Strand=+; Gene=SeqID_70749
ttttctgattttgtgcctttacacgaaagacctgcttttccgagtcgtacagcgactggtcgacccttttcaacacgctttccccccgtttaggagcagtacgggtggacggtccgtcacaacgacgacccaaacagcaaaggcagtggcggagggcatttcgctgctgccgtcgctggcgccgttggccccgccgatccgttgatg

SEQ ID NO: 113813 - DNA, 115 bp, Heterodera glycines
  Promoter: Source sequence=SeqID_20644; Location=2910..3024; Strand=-; Gene=SeqID_51197
tggaaacgatgcagcaccaggcgatggaccccaatcagtcggagaaaagtcaacatcagccaacttttatcgcgcaaagagttgcgtgcccaaattgcatcgacaacggcaaatg

SEQ ID NO: 113814 - DNA, 312 bp, Heterodera glycines
  Promoter: Source sequence=SeqID_26735; Location=1..312; Strand=+; Gene=SeqID_57507
acggactgacgatgattttgtattaggaaaatttgagaaattttggtcgaagtttttccgttttcaaaaattgccggcagaaaatccggcatatgccgagaaaataaaacccagattccggacagagctccggaaaaattggcgatcggaatttggcttaaatgcatttttagtgccatttttgcaaaaataaagcgtcgccggctttttagcagcccatttttgaacagaaattggctccaaaaatgaaaatttctataatttttgatcaaatcaaccgcattaaagagaaataaaattcagaaaattatg

SEQ ID NO: 113815 - DNA, 260 bp, Heterodera glycines
  Promoter: Source sequence=SeqID_3703; Location=2376..2635; Strand=-; Gene=SeqID_51531
acttatgtagtgcgaagatttatcctgagcctataaaatttgtgtgaattttttagaaaaaaataaaacgccaagtgcctgtgcggtacaacgccaaaggcgcgctaattcaaaaaatcaatacaaaaaacattaattactgtgggcacaacgccagaggcacgcgcaaattcaaaaaaaaaatgcaattttccgtcaataacaacaagcagttggcggcgccgccatcactgcttctcccgtcctctctgctgatgatg

SEQ ID NO: 113816 - DNA, 162 bp, Heterodera glycines
  misc_feature (69)..(69): n is a, c, g, or t
  misc_feature (76)..(76): n is a, c, g, or t
  Promoter: Source sequence=SeqID_40411; Location=1..162; Strand=+; Gene=SeqID_68751
cctccgtcctctcagcaggttcttctgatgagtgctctcctttcaaacggacgaattttatttgaaagngaacggncattgactttcgacgccttttagaatcagcctttggtcctccccgtctcttccgtccccactttccaattcgtccaacaacacatg

SEQ ID NO: 113817 - DNA, 557 bp, Heterodera glycines
  Promoter: Source sequence=SeqID_34; Location=1354..1910; Strand=-; Gene=SeqID_52145
tagtgaataggcttaatgaggctttgggtgagcatattaaacgtaaagatattgaaaatagacaagtatctgaagctgagaaaggaccacaaaaaagagagagactagccaatgaggatgttcaatttcaatatgacagcattgatcaaaaatttattgtctatctttctgctgctgtctcccacatagatttgtcaaaacacctcgcctatgtgcttggttttaagaacacaaggctatttcacgcggaagaggcgaattatatgccagatttgacgggaggcgtaaggcagctatacatttatgcaccaaatttaatagaaaacacaattatcgggaaccagatggctccactcttaagaatagttaacgtcgtcaatgacccagggtcgattagtgaagttatatatagcaccgagtactttcatcgtctacagtcgaaacgaatttcagaaattacaattgaaattcacacaccgtttggcgaattcgttaaatttcactggggaagttgtattctcacattacattttaagaaaagtatattttaaaaaatg

SEQ ID NO: 113818 - DNA, 160 bp, Heterodera glycines
  Promoter: Source sequence=SeqID_23690; Location=191..350; Strand=+; Gene=SeqID_45803
agttttaaaaaaattttgccgtaataagttcgaccgccgacctttccaaccctcggtcgaccggttaaaggcgaattcaggaccctaaattaatttatttggctcttttttcgcagtcaggctttttgattatttttgtgactttattcccgtcctaatg

SEQ ID NO: 113819 - DNA, 217 bp, Heterodera glycines
  Promoter: Source sequence=SeqID_5437; Location=3187..3403; Strand=+; Gene=SeqID_58035
tttcaatggataaattaactaaaaataattagattattctgttatcttcaataattggccattaaaaggatgtttgaatttgtttaataaaactaataaaattatgctctgtctatccaaagacatttttttaaaatagaggcaatttgaacaattaataaacaaaatataataattaaataaattatatttaagaagtgttgccgcttccgttatg

SEQ ID NO: 113820 - DNA, 61 bp, Heterodera glycines
  Promoter: Source sequence=SeqID_10157; Location=1459..1519; Strand=-; Gene=SeqID_73261
tatccttaatcaatcaatcgccaattatgccaaggtctgtcgcacgccgccgctggaaatg

SEQ ID NO: 113821 - DNA, 175 bp, Heterodera glycines
  Promoter: Source sequence=SeqID_16344; Location=330..504; Strand=+; Gene=SeqID_80730
aatgctgttgcgttgtttagccaattgtgacagtcaggccaccaatgcggaggaatgtttgcgattgtccaacggcgtgcgctgtgttttccacaacaaatcgtgcaccaaaactctgcccaattcgtccttcaggcagtcctttctctcaattgccaagggcgaaacggcgatg

SEQ ID NO: 113822 - DNA, 415 bp, Heterodera glycines
  Promoter: Source sequence=SeqID_13947; Location=3150..3564; Strand=-; Gene=SeqID_77909
gtatatgaccaatagcattgtgagccggtgtgtcaacgaatgagggaaaattaggtggtgggaggaaagtgcttggtataaaagacaacatttccacccatttcttcatataccttaattcatttaaccaattgagctgaattcaaaagtttatgttttcaaaaatatgtatgtaaattttgtaacaaagcaaaaccgacacaaagattaaataaatgcaaggctcccatatgaaattttttttagaccagaccttatgatcattttttaaatgttattgaaaagcgcgagcaaaaatcatcaaatttgccccctttaaaagaaggaaaaacgctgataaatatatacatgacagccctgattaactgacataaaaataaaatattacattattttaatcaatttccaaaaaatg

SEQ ID NO: 113823 - DNA, 438 bp, Heterodera glycines
  Promoter: Source sequence=SeqID_25008; Location=623..1060; Strand=+; Gene=SeqID_55744
aatcagatttttaacattttttgcggcacatttccaaaaaacttggtgaatgtgcgaggggagaggtccggtggtgccgattggcgccgcaagcggaaaatttttaagactatatgaattttgttagaaattagccaaatttcttagaaatttcccttttttagatgaaaataaggtactaccccaaaaccaaaacatttcttagaataacaacatagaaaaaccctgtattatttggaaaaaaaaataaaatcacaagaaaacgtcaaccgatgtcgaactaataacaaaaagtttgttaatgttgaagcactaaccactaaaccacaaatattttaaaaaacataagcaaatttaatttatttcataaaaatttgtaaaagatggttaaaaaaattcaaaattgtataaatttttgcctttaatttcacgaatatg

SEQ ID NO: 113824 - DNA, 146 bp, Heterodera glycines
  Promoter: Source sequence=SeqID_28775; Location=1079..1224; Strand=-; Gene=SeqID_59349
tgattagcgtgaactgattttcgcacttttgcgtttcctcacgttcgatctgtgaaggaactggaaatgattgaaggtcaaaggcttttctctttctttcccatcgttaaattgggtaaatctttttttcagaagaattgaaaatg

SEQ ID NO: 113825 - DNA, 251 bp, Heterodera glycines
  Promoter: Source sequence=SeqID_7441; Location=814..1064; Strand=+; Gene=SeqID_46421
atgaaaagccagtcgacaacaaaccaaagttgaacatcaatttcgaaagccaaaaatggaatgaaaggaaaaaggaattggacgcactgcaaaaattgttggtgcaatcgccgagacttactgattcgccaaattaccgggaggtcatcgaacgcttaacaaaggttataaattaaaaaaaaagtgaaatgaaaaaattggaatgaaaaatttataaaattaacattttgtaatttagattatggcaaatg

SEQ ID NO: 113826 - DNA, 152 bp, Heterodera glycines
  Promoter: Source sequence=SeqID_15635; Location=1940..2091; Strand=-; Gene=SeqID_79928
agcatgctcctatgatgatttgaaatcagttattgatatgaatggtaatgcaaaagtttgtgaaactttttcagccgcatgtctagaaagaggattgattagaaatgatgaagagtggaaaaaagccctagaagaagcagagttttgagatg

SEQ ID NO: 113827 - DNA, 284 bp, Heterodera glycines
  Promoter: Source sequence=SeqID_14601; Location=650..933; Strand=-; Gene=SeqID_78679
taaaatcggacggaagtaatgcggcttgagtggatgaatttggcagaacggaagacagttgtgtaggagatgaagtgggaataggatttaaatgtggaggaaatgaaggtgacgaatttggcggaatggaagaaaattgtgcaatggagggaccgggattgggatttaactgtggaggaattgaaggtgacgaatttggcggaatggaggccaattgtgtaatggagggaccggcattgggatttaactgtggatgaattgaaggtgacgaatttggcggaatg

SEQ ID NO: 113828 - DNA, 955 bp, Heterodera glycines
  Promoter: Source sequence=SeqID_12790; Location=3415..4369; Strand=+; Gene=SeqID_76505
actgtaatttcctacgattttcgcttttttcaattctttcattgggattttttatctacttgtggtaaaaaaaagagagaagaaaatcattgctaaactgttactgctaattattcacagttacccatttccattcgtaaaagcaaaaactgtcgaaggaaagggtaaaaaagcgattggacttttgcgatggctttgccccccccccctataatggacatggctaacccaacagctcattgatattcaaccgatgcttccattcactccctttccgttctcctccaattactcctctccccccattctctgctcactttcattccagaaaatttctgttttcttgtcaattttccaatcactttggtctaatctaatcaattcaaaaaaagtccaatcaatcctacaaagtattcgggcattctgaagtgtttttcatgttggttgatgagtcatcgatgagacaatcaatatgtcagacacctcagagggcaaaagacactgaacaaatgtcgagattgaaagccacggtccaacatacgtaattagctcgaaatgatatgtattgcaagccaattattcaccaaaacatcgccacttttgttgttatgcgttgccgctgaacaaacatttgctcatttccaaaagtcgacatttccaatccttcagctttaaatttcggtgcatctgaaagtggtaaaagccatggaaaagccaagccaatctttttctaagctgagtaaatttattaaaccgtgaaaagtgatgacgaatgggcacataaaaatggaatggttaaaagtttccgatgaatcatttgaatctctcaaatgttcaaactgatgttttttttgcatctaatctcgacattccttctcttttcgcttatttctttgcctcgggggatgtcttcgtcccgtataaacttctttttccggaaatcctttccaaaatg

SEQ ID NO: 113829 - DNA, 1003 bp, Heterodera glycines
  Promoter: Source sequence=SeqID_22896; Location=586..1588; Strand=+; Gene=SeqID_53607
ggaaaatgagttttccctcaaattatgctgagctcacgggggaccaatgaatgttccgtccagttttgatgtgagaatgacttcacataaacatgcaattaaaattttttaatccgggggttgggggacatttgatatgctaatgagcttattatgtaggggcgggcagctgtccctattttgaaggtcttctccaattttttaaatatctaattaaaccaatgcctagatttttgttccagaaaataaagaggtcaatcagcaggtccaagtatttctcacaatgtgtggactaatgaccgaattcaacaataatgactgacatataacggactctattgtttggattggtctctgacctgttccattcacccgctctcaattaatggtctcgcaattccattgtcaactaaatccgccgcatacactttcaacgaccaaccaataaagacttgtttaattagcaccttaattatttgctgtttgcttttctgtctttgcctaatgcccccccggggaaagataggggcggtgggtcggcttccttttacctcttccactccattgtttaattttgaaaggtttatgaagagaataggggtgtggtcagcagatgaccgactactgatcatgcatgattcttgctcggtctatttgtaatgattatgccattggcggacggctaaatcgctttaaagccataaaaggaaaggatgaatgggatggcctgttgctggtagctcagcagacggtaagaccactggtttgggtgagaagccgatcgctacaccagcagaggatttcgagggttcgattccctcctttaattagcaaacaagaattaaagaaataaataaaagccaaaactttgaggggcggggggggggggacagaagcacggaaatcagttggaccaaagaccaaacagaaaaaggaaacaaataaaaaacatctgcgcaccgcacttcctgcttctgctgcggctccatcaaaattagaaatg

SEQ ID NO: 113830 - DNA, 181 bp, Heterodera glycines
  Promoter: Source sequence=SeqID_29159; Location=1269..1449; Strand=-; Gene=SeqID_59702
ggggggtggggaggggtacatattgccgaatttttttatcctaatgtaagcttgagtatcagaacttcgcaaatttcaacaaaagtattgaccttttttgagtctcggtaaaaatctacaaagtgtgattagaccctcctatataagcaatagaaatccttttattcgaattcgccaaatg

SEQ ID NO: 113831 - DNA, 275 bp, Heterodera glycines
  Promoter: Source sequence=SeqID_39688; Location=579..853; Strand=-; Gene=SeqID_68199
ctaatttttgttcttgttttgagatgcaaaaaaactttgcgaggcgcactggtggtgcgccttgtcatgaaaaacgaatcgcagcaagagtggccagcgaattgtttaaaaaagtttactttttttttatgtccaaaattatttcgattttttttcaacagattttcacaccgggaggcacagaaacaacagcggcaaacacctggcactcggtaaaaaaaataaaaaaataaattttcgaaaataaattttccctttcccattttagacaaatg

SEQ ID NO: 113832 - DNA, 165 bp, Heterodera glycines
  Promoter: Source sequence=SeqID_34857; Location=229..393; Strand=+; Gene=SeqID_64557
tttggacaccagcagcagaaattcaaaagtcaaaagaaaattcatcgttgatgctaatatggtggtaaattttggggtacataattaaaaattaattaattacatgtttaactccccagggaaattcgattgaaaaggaatgtttggaaaagatgccaaaggatg

SEQ ID NO: 113833 - DNA, 650 bp, Heterodera glycines
  misc_feature (8)..(8): n is a, c, g, or t
  Promoter: Source sequence=SeqID_1202; Location=1..650; Strand=+; Gene= SeqID_46684
atcatacntgaaagaaaaagaataaaaattgtgagaccgctgtgttttcctcaccaaaaagcagacatctttcggtccaaaaagtggacaaatcttcatcgcgagaggaaaggaaagcacgctaaaataaatgttaattagttttcagaaaggataaatggcaactcatacaataagcaattcgtacaataggcaatttacaataaccaatttaataaaaaggtctaactctaaggctaaagcttcggcctagccctatccctacatatgtacgagttgctttttgtacgcgttgtcatgacaccgtcaaaaggaaagaattaagaaaacaaataggtacatacatatgataaaaataaaacaaattttgaataaagtaaattctgaataatttttctgggttttgaggaatacaaaatttaatggttggtcttcgattgttggttttctttttttcctactacaacagaacagcagatggaagaaatgaaaagagaaaaaaacgcagagagaaagaaaataaagacattttcttgctgattgggtgacaaaaaacaagcgcctaaaaggcaaaacaaaaaatgggcattaaattagcataattttagaattttgaattttaaagtgcttttttgtccgcagaacgaatg

SEQ ID NO: 113834 - DNA, 477 bp, Heterodera glycines
  Promoter: Source sequence=SeqID_2538; Location=4573..5049; Strand=+; Gene=SeqID_80275
tttatatcctttttttgcatataggtgcggtgtctgtattcatcgcaagcccgttacccaattcctgtggggggccttttcccattggcactgatggaaaaaagcgaacggggcgaattgagagagagaaattgggatatgtgggtcgttaaaaacgacagttatcccagggcgtcaaataaagaggtcagaacaaaaaaaagagccgcaataattaagtgtttaggaagcgaaggaactgcgcattgcgcaccaaaaacgccgccggacggaggacgaataccatctgtttctctggcggatcatctccagccgaattcgtggcgaatgttcatgcggaccgctttgtctgcacttcagtttgcgagacctggaggacatttgcatcggccaatttgggataatcgatgtaaaatttattttattcagtaatttccataatcccattccccctcattgttatagcggttggagatg

SEQ ID NO: 113835 - DNA, 1003 bp, Heterodera glycines
  Promoter: Source sequence=SeqID_19245; Location=1026..2028; Strand=-; Gene=SeqID_83990
tgagaaatacttcttttttattaataacatttttaaagagtgaaaattatggttttagacatcaaaattagtcacaatttaccatgattaaagtctataataatatttaaaaacatcaaattttcagtcttttaggttaaaaataaccgcaacttgattttttaattaaaattttttgatgaaaaaattgatgaaaagcggataaaaatctactatagaattattttattaagaaaaaattattattaatataacatttttgaaaatattaggaaaatctaaccatgtactgtatacatattatttattatatctttcttttattttaacacaattttttataacctgttcactaaaagtctcaaaaacagtgtgactattgaaaattttcccgaaacaaataaatcactcatgaaaaaataaatatttggctcaaaaaaaaagaaatcatttttcaactcaaattattttaaagcaaatatggtttttgttataagaaataaaatgcgttcggatttgaaaacttttaaaaaatcaggaaggggtccggcggcggtaccttcataagccgaaagatttatttttataaaattttctatgaaaaaataaaaatttttcgggaatggaaaaaaactgaagaaaatatatgtaaattatttagaagccaatgctcttccaaagttttttttttgtcgtcttatgattttctctccgctgaaatatatgcacataaatataagtgttaaccattcatagtctaatatccactatttctgaagaaatacagtatatttttgaaaaacaccataaacatagtttatatcttattaatgtaaagtggtacatacgcacgcatttggcatctttggaaaaacaccttcagttcaatattttacttactaaattagtaccagaaattaatctccctcaggcattttcagacatcaccgtttgaaaaaaaatgataataagaaaattaaatcactccagggcaaaaaaaatg

SEQ ID NO: 113836 - DNA, 259 bp, Heterodera glycines
  Promoter: Source sequence=SeqID_3611; Location=593..851; Strand=-; Gene=SeqID_51093
atcaaatgttaatagctaaacaaaacaatgaagggtaaacgaacctaacaatcttcttgttctcgactatttagtttttctatatgttcattatttttgctaaaatattttctgcggctatgctatttgtaagaattaggatttattaatttactttcgtcaaaggcggtaatggttggtccaaattcttttgaataattgttcctaaaattatgggttttccctatttttcaaataaaaatttaagcacagcaaaatg

SEQ ID NO: 113837 - DNA, 99 bp, Heterodera glycines
  Promoter: Source sequence=SeqID_18905; Location=786..884; Strand=-; Gene=SeqID_83615
tattcgaactcaacatacccgatttaccttgtttaattaaattcagaatttccaaaaccacttttaaaacattatgttacttggtggtcttgaaaaatg

SEQ ID NO: 113838 - DNA, 93 bp, Heterodera glycines
  Promoter: Source sequence=SeqID_39373; Location=245..337; Strand=-; Gene=SeqID_67953
tgtttggtcattggtcaaccaattctttgttttgtcattggctgtcccaatagccctcccttcccccttaggtggtcgttgtgaggaacgatg

SEQ ID NO: 113839 - DNA, 403 bp, Heterodera glycines
  Promoter: Source sequence=SeqID_31885; Location=513..915; Strand=-; Gene=SeqID_62195
tgggaaaaacatatagaatttattactaaaaaagcaataggaacatcttttgctttactcaagtcactgtaaactaaaagcccaaaaattctcataaatatattcaatgtttattgtcgatcaattttggaatttggttctccgatttttaatccatatatgaaaaaagacattgatgctcttgaaaatgttcaaaaaacatttttacgtattgtttttagacgtaataataataaggatgatatacccgggtataacgaactcctccaactctttaaacaagaatccctcttaaaacgcagaataaaaatagatttaaaactcttccatgatataattttggaaaagatccatattcagcataatgattccttttcaaaaacatattcagaactgaaaaatg

SEQ ID NO: 113840 - DNA, 375 bp, Heterodera glycines
  Promoter: Source sequence=SeqID_10119; Location=973..1347; Strand=-; Gene=SeqID_73210
tgtattcgttttcgtttatttttgagaggtgaatgggatgggaagggaagggaagggaatggaacggaaagctcgggcgggcaggaatggcttttggtcgagacaaatctcgactttttggcaaatatggcgagactttcgtccgttcggtctctaggcttcaccagactgaattagcaggcttggagccgcctcagggcagaaagcaccggcacggggtctgcgtggacttccgggagagcgaccccctcgggtgctacgtcgccgcttactgtccctctcatcggtggcgcggggggagagtccgtttcgccggcatcgatcagtccgagtctgacagcggccgcaattaaaagtgcagagaaaggagcaatg

SEQ ID NO: 113841 - DNA, 537 bp, Heterodera glycines
  Promoter: Source sequence=SeqID_8747; Location=1914..2450; Strand=+; Gene=SeqID_69096
aagaaagcaaaaagaatggaagaaggagaaattcatctaattgctgtcatttttactttatttatgtttattttttaaattctttttttcaattttcattttggctttataatactaattactattttatttgctattaatttcgtttattaaaacgtcgattttgtgactcagtttcaagtttcttcgaaaaaattcctatgaatcttaaaaattaatacgagaaacttcacaaaataatttaatttctcttaaataaggatggcatttcttgactcttggttttaaaattctgaattggggcattcttttttaggtcatcattttgccttaatttatgttaattgaccccgataaatatgttaatataagcaactgcagaatcagcagatgttcatttattacttctccaatttgttaataatttttctcatttattacttcttcaatttgtttaataatttatcatttattaaaatttacatcttttattgtgaactttcattttaggaacttaatgaaaagtttgtcaaaatg

SEQ ID NO: 113842 - DNA, 895 bp, Heterodera glycines
  Promoter: Source sequence=SeqID_4197; Location=2651..3545; Strand=-; Gene=SeqID_45739
ttttgaattctagtcataatttttttgagcattaacgaaattttttgaaacttagcaggctaatagagaacacttagagctttcgaatgataccaataatattagatttggtggaaaaagaaaaaagttatagtccaaaaactgggctggcgccgaaacgagcggcgccgaaacgagggtgtcccctatcgaattctcttttgttttttgaaaacttattttgtaactcgagatcggttcttgctagagtgcagcgggaccgggaaattgggcaagaccgggaccgggactttttgggttgaaaaaccgggactttttggctgggaaaaccgggaaaaaagccgggaatttccggtcaaaaccgggaccttggtactcagttgtctgtgtccaggtcccggtcccgctgcactctagttcttgcctttttgcacgcgaaaatcccaaaattttttttaattttgcaaagttaaaataaaaaattgagccgctgtgttaaagaaaacctataaggagaaatatgtatatatgtacatatgcatatgtaataaaattaaaaaaataattacctattatcctttacaattacacttaatttcggtgattttccattattttttggcgcttgacaaatttttggctggcaatgacaacgaaaagtgagggggatgaaaataattctgtggatgagaatggcgagccctctggcaatcacgcggagaattgcagcaccgggttggagttataaaagaaatattgtaataaactccaaatgtacaaatgagtcaacgatttctcaaggccctcttcgcctgccccgtcagtgtcctgcgaggcgtgcggtaccaatttctcacaacttgagaaggatgcttttgccgcagtacgcgaaatg

SEQ ID NO: 113843 - DNA, 396 bp, Heterodera glycines
  Promoter: Source sequence=SeqID_23090; Location=1..396; Strand=+; Gene=SeqID_53795
atgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttaaacccaattcaaaaaaggaaaaaaatttgcagtcaaaaaattattcgaatttctccaattttgtttccataatttccgaaagttattcggtatcataatg

SEQ ID NO: 113844 - DNA, 58 bp, Heterodera glycines
  Promoter: Source sequence=SeqID_8372; Location=188..245; Strand=+; Gene=SeqID_67832
tttcatcaagcagtaaaaagtgctggattgaaaggggagagaaagatgatggagaatg

SEQ ID NO: 113845 - DNA, 77 bp, Heterodera glycines
  Promoter: Source sequence=SeqID_31061; Location=1..77; Strand=+; Gene= SeqID_61434
aattaggatggcgctctgtttttgccaacttttccatcacaaacttttgtcgtcctggcattttctactttgttatg

SEQ ID NO: 113846 - DNA, 720 bp, Heterodera glycines
  misc_feature (47)..(47): n is a, c, g, or t
  Promoter: Source sequence=SeqID_40655; Location=1..720; Strand=+; Gene=SeqID_68917
tcatcgcaaaaaactcattacaaattcattcatttctgaccatcgtntagcaccaaccgccaccattgatggaatgcacatccaaaagtgattcatccccaatccaatccaatgaatttgactgttatcgctgttagcgatcagcttacccccctaccccttagctaattgttgattcgaatttctttttgctcggctttcatgggggggggattggacaatttacgcgacgtgtcacagcgccacccaccgcccgcccatcccgcccatggggttgtgttggggacgggggacgagtgggatgtatgcggttcccgcccattagccgcgctgcttcgccgcagggaccgcccatttgggcactgtcggccaccgcatttaagcgctgtccaatcagtgaaaaatcagtcatttccaaaatttcattctgctcctaaccaaaaagcattcaactgacaaataagctggtggaaggaaataggaaaagccaaacaaaaacatttttgaaaatcagtcaacgattaaaaaattttaaataatttttttcgaaaaccgtttcaattttttgtatttcacttaaatttagaaatcaaaaaaatttttggtttaaaagccaatattttgatttcattgttttttaggaagtgattttttcctctatttctgatcccaaatctcattcttcaaagcaacccgtcccactctcgaccgtctaacatg

SEQ ID NO: 113847 - DNA, 189 bp, Heterodera glycines
  Promoter: Source sequence=SeqID_10978; Location=202..390; Strand=+; Gene=SeqID_74287
ggtacataatcagtgatgattggacttgcttgaatgatttattttttttttcattcagttgagcattttgaacaatcattcagttatgaagggttagtgcaaccagcgaatttcgatgacatatgttcaacttcaaaaaatcaccatggaagctttggctctgccggatgcactccggtgaagaaaatg

SEQ ID NO: 113848 - DNA, 126 bp, Heterodera glycines
  Promoter: Source sequence=SeqID_20867; Location=1196..1321; Strand=+; Gene=SeqID_45609
ttgttgttgtaaaagagttatgaaaagtgacagtgttttcaaggctgaaaataaatttatgtttacaatattttccaaaataagttaagtttaaacccaagggagttcattcccaaattagaaatg

SEQ ID NO: 113849 - DNA, 71 bp, Heterodera glycines
  Promoter: Source sequence=SeqID_20188; Location=1714..1784; Strand=+; Gene=SeqID_84982
agagtaattaagcattaattaagcaatttaattttgtctttgatttatttggtagtaattagttgggaatg

SEQ ID NO: 113850 - DNA, 127 bp, Heterodera glycines
  Promoter: Source sequence=SeqID_9227; Location=1157..1283; Strand=-; Gene=SeqID_70686
atttccgacagaattattgggatgccaatgcttgtcatgagaaactcgaaatcattggcgacaaaagtctaactgtccattttaagggaaatgatattggtatttttccctattttacttatttatg

SEQ ID NO: 113851 - DNA, 143 bp, Heterodera glycines
  Promoter: Source sequence=SeqID_21821; Location=2183..2325; Strand=-; Gene=SeqID_52453
aggatgttatattcgtgatcagcgaccccgaaaatccgataagacatgttattacaaattttaaaacttataaaaaattttgtcaaaaaaggtgtgctaccatctaaacaattacccatttttctgttcatgcgccgtcaatg

SEQ ID NO: 113852 - DNA, 440 bp, Heterodera glycines
  Promoter: Source sequence=SeqID_26321; Location=1202..1641; Strand=-; Gene=SeqID_57070
tggtcgatttttagtgtaaattttcggctttttattttaaaaattcataaaaaattcttaaatgatgataaagtcacaaattttgttaaattgtttttgaaaaataattaaaaacattttttaaaagaaattttctgtaagttctaattcaataattcactataataatgccaaatgaaagtgatcacttaatttctaattcaataattgacaatattttgccaaatcagagtgatcatttaataatttctaatcaatattagacaatattttgccaaatgaaagtgatcacttaatttgtaattcaataagtgactaaaactctgccccataaaaggctgtcccttgacagtggtgaagcaacggtcctcagattcattcattcattcatcgtaatacccttccctccatattcccattctttctaattacccccaatg

SEQ ID NO: 113853 - DNA, 215 bp, Heterodera glycines
  Promoter: Source sequence=SeqID_32605; Location=1154..1368; Strand=-; Gene=SeqID_46311
ttttaacgcaaaatcaattaacaaatcagccaacactctccaaatttttccgacggcatcgtcggtcaccgatttccacaattttttggttccctcggaatgccaatttcagattgccgaaattttttttaggcgtctcggcacagctccctgatatgtgcaaccactttttaaaaacttttaccaaatttaattaaatttgttgccttaggatg

SEQ ID NO: 113854 - DNA, 1003 bp, Heterodera glycines
  Promoter: Source sequence=SeqID_7701; Location=2118..3120; Strand=-; Gene=SeqID_65672
aaagcggtcaaattttggcgcaaattgcgcatttttatccaaataacaattgaagtccatccttttcctgctcccgataattgaccagcgggaccgagacttctgcgcgattttacgggattcccgctatttttattcaacaaaaccaagcattactcaccgccaactatttttctgcgcaagtccggcttagaaatgagaaatttatacatttccgaaaatcaattttatttttttaaattttttgggtataggtgagggaagagtccggcggtgtcgataggcgccgcagggaaattttttgaaaatttaatgcaattttttaacaagttctgtccaaaaaatgaccaaaatttgcgatcttgggctaattttaagaaaaaaataggagttttggggggccggcggtgccgataggcgccgctgggggaaaattttaagaattttaatgaattttgttaggaattagccaaatttttcagaaatttcctcttttaaatgaaaataaggcactaccccaaatcagaacatttcttagaaataagaacagatacacccctgctctaataggcgccgccggaaaaatttttgtaatttttaatacgaattcttaacgattttgttcaaaaaatgacaaaattacgattttgagccaattttttagagagaataagaaaccgccgagagaaaaatttgaatattaactgaatcttgttaagattttgcatattaattcgcttcaaaaaacatttctttcaaaaattaccattaaaaactaaatttctccctaaatccaaaaaataagacgaaaataaggacaaagagcttaaataaggacaaatcttacaaataaggacatttaaaatttctaagatttggaccctcaaaataaggacaaagggtaaccctggtctctagtatgcttaaatgtacattttgtggttgcctgtattcaatgtttgccacatttattaaccaggtttattacacacattgaacaatg

SEQ ID NO: 113855 - DNA, 1003 bp, Heterodera glycines
  Promoter: Source sequence=SeqID_8642; Location=467..1469; Strand=+; Gene=SeqID_68752
agtgccgcctcgaggcggcttaagcttcccagcggcgatgtgctgtcgccgacgcccgccgcagcccaaaacagcgtaaagcacacacaacaaatacagcctttattcatcatcaatccattgctctcatctcacagcccatcggcagcagcagagcaccacggccttttaggccaaacatatcatttcgcaagaaccatcccccgaaaaggcaaaattccctcaaccaataaaagtcggttggctttgaattaattaaaataaatgagactcagtcgttcaattatggaaaggaaagaattcttcattggattattaattatttgctctcattgtcagtctgatgaatgccgtgctgctgattttctcatgccccactttctttgtttgagccaaaaatcaaattggcataatttttaattaagatttattcaaaattattaataattttatttgtgcacaattttttgaatggatggatctctccggcagcatcagcatggacagcagcaatagaaatgtgccggatcagcccggcacgtcggctggcggtggcagcgacgcgctgtccagcacaaggcagcccagtctgatctcatcactttggtcattaattatttgggaaacaataaatcaaccaaattgattggactattatgaagttgggggaaatggtcgaaatatttataaaatgctttttgctgacattttttctaattttgcctaaattttcaggtcaatccaagtgcaggttcgttttatattagcgaaatttttcaaaaaaataaataatacacaaaactttggatttctatttttgtacgttaattaaaacaaattgactttgtgaggcggagggacgaaggacacacccaatttaattttgggccccatttaataataaagtttgtggcaattgaattttgccattttctgtgcttatggcaattcctaattgcctcccccctcttagcatgaggggtccaactcggacttcccaatg

SEQ ID NO: 113856 - DNA, 51 bp, Heterodera glycines
  Promoter: Source sequence=SeqID_23249; Location=1..51; Strand=+; Gene= SeqID_53962
ccgtgactgatgataaatcatcaaatgttgacgattcttccgtgactgatg

SEQ ID NO: 113857 - DNA, 91 bp, Heterodera glycines
  misc_feature (81)..(81): n is a, c, g, or t
  Promoter: Source sequence=SeqID_6749; Location=1..91; Strand=+; Gene =SeqID_62731
aaatcaaatgaaagaaattcggcaaaaatttgagaatttaattggcgtttcgggatttcaattaatttacaaaacattttnggaaaaaatg

SEQ ID NO: 113858 - DNA, 400 bp, Heterodera glycines
  Promoter: Source sequence=SeqID_5641; Location=710..1109; Strand=-; Gene=SeqID_58748
atataatgagtgagtaccatttatcttaatttgtgcttagaattttgtggtatattgaactaatagcgtcaacaataatttttctattgaattagtcttttgcataaagagaaaatttaatttttctaattttattaacctttggctgagagcaaacatttttcacgttcagatctttcgacgctatttagtgtttgtggtaacttatatctgccaatttgacaatttattatttgtataaattctcagaaattgataaattcttgcacaaaacccgtgaaaaatttccaattcttaaaaaaaaattttttaaggtggctctcggcatcggtggccattttctataaaaataacaaaaaatttacctttgtcaaaaatttatttgaaaaggcaaaaaatg

SEQ ID NO: 113859 - DNA, 84 bp, Heterodera glycines
  Promoter: Source sequence=SeqID_2321; Location=1..84; Strand=+; Gene =SeqID_79114
tgagcaatttaaggtgtgattggaagaaatggtttttgattggctattgcgatcactaaattcagttctccgctcgccaaaatg

SEQ ID NO: 113860 - DNA, 362 bp, Heterodera glycines
  Promoter: Source sequence=SeqID_17828; Location=1..362; Strand=+; Gene=SeqID_82363
tttttctgtttttatgaaggggcttggggaggtggaggactaagtgtgctcaattatccttaaatttaaatttactacataatggctttgatttatttttttaatttggacctaattaccattaattaggtaactaattaatttttaaggttcttccaattattcactttcaatttatttgtactaattaattttttgcttacatgtgatttttttaatttgacctaagtgtcaataaatcaccaattaatgagattttttggattttttttttcatttttaaattgccaaaatgtgttcatcccctttcaataaaacccgtccccatttatttgttcagatttccattcgaaaatactatg

SEQ ID NO: 113861 - DNA, 430 bp, Heterodera glycines
  Promoter: Source sequence=SeqID_12790; Location=2917..3346; Strand=-; Gene=SeqID_76506
atcactgcgttctctctcgtttccaataaatgactgttcagtccgtcagatcagtctgttctctctctcacattgccattaatgcactgatcagtccgtccccatggatgggctgatcagttctttctctctcattgccattaatgcactgatcagtcctccccatttgttccctttgctctgtgttccttcgtcattcgcttgtgtcacctcaattcacttttttgcttcttacgccaagtgttcatcctccccaatgacagatgctgtggaggaaaaggaaggaaaaaggataaaatatttgaaaaaagaacaaaaaaaaacatatggccaaagcgtggtgatggcgaacattccctctgagccaatcgttttaagcgatcacttcgagtccctttcggtctcaatttttccgagtctctaaaaaatg

SEQ ID NO: 113862 - DNA, 334 bp, Heterodera glycines
  Promoter: Source sequence=SeqID_17473; Location=1249..1582; Strand=+; Gene=SeqID_81979
aacatttgttcaacaactaaaagtctcagttggaaacactgaaatttacgacagcggaaatttgtacccatataaggtttacattacgaacacactttcgtttccgatgaacgtcaaaaaaagcttcctcgcttcaactggtcactatgcgacacgcacacacgacagcgtcgctgacgagggctttaaagctcggtgtaaaatttttgagggtgggaagcgagcccaatttctttcacgtctggactttgacctgggaaaccaataactttatttgttgaacaatttggatcttttatttacaatttacaaagctcgtgacactttcatcatg

SEQ ID NO: 113863 - DNA, 106 bp, Heterodera glycines
  Promoter: Source sequence=SeqID_36963; Location=875..980; Strand=-; Gene=SeqID_66158
tttattagccccttttactgttgaattgagtttaatttttttttttggaaaatgtgccaaaaaaattatttaaaaaattctatttatcccccctggcacataaatg

SEQ ID NO: 113864 - DNA, 232 bp, Heterodera glycines
  misc_feature (44)..(44): n is a, c, g, or t
  Promoter: Source sequence=SeqID_4140; Location=858..1089; Strand=-; Gene=SeqID_53346
ttttaggcgctaatcaagaatctgaagtgaaaaatataaaacanccaagattttataggtgcttttcatcatacaaggttatcaggcaggattataagttgaatgcatttaaaaaatgccaactatgcactaaaaatccctcaaaaacgcctaaaaattctgaaagtttctaaatatgcactaaaatatgccttaaaactcacaaaaaatggctttgaacctttaaaaaatg

SEQ ID NO: 113865 - DNA, 99 bp, Heterodera glycines
  Promoter: Source sequence=SeqID_30441; Location=386..484; Strand=-; Gene=SeqID_60845
tagttgtgctaataaataaaaacaaaatcgttgaatttaacaaattaaaaattttgcaaattttaaaattagaaaactagatataaacaaataaaaatg

SEQ ID NO: 113866 - DNA, 861 bp, Heterodera glycines
  Promoter: Source sequence=SeqID_6087; Location=1233..2093; Strand=-; Gene=SeqID_60269
ttttccggcaaatttttagaatcaattgaagccaaaagagaattgtgcaagaattcggaattatttgcaaaaatttaacaaaaaattgtcatttgccgagaaaatctctgcattggaagaactggtcaatattttgggccaaatcattcgagattataaaaggttgcacaaagaaggcgtggccggatgtcgtggggggaaatttttttcagaatttaatgggttttttcgaattattaaatttaaatttttttcaccgaaagataaacggaaatctggaaaattggagagagacctgccaaataatattaaaataaaatataaaataaatacaatatggatttaggcaaagttagaaaaccaatttgtgccgacaagaagtcccagtgagaaaaaaaacataaaattattgcgatattataactagggctgctaattttatgtaattggcatccctaattataaccgaataacaaaaatttaaaaatttttttgtttcgtataaattttttttttaatttcgttcaaattgcaaaaattcccgacatcgcctgacgataaaattagatttaattttgcaaaattttgaaacaattatttataaaattgttcattttttcgacaaagactagtaaaaaaatattattttttcgcccacagacataattattgaaaaccgaaattggcgtcttcggattgcccccagattattttttatcgtgcctgtcctaagtcaatttttatttatttattctgccataggcaccccaaaaaaatgattcattcttcccaaatccgtcacgcctttcgtgccacgtaaatataaatgtagaaagagaatgtcaacaacagaacagaatg

SEQ ID NO: 113867 - DNA, 1003 bp, Heterodera glycines
  Promoter: Source sequence=SeqID_2874; Location=574..1576; Strand=+; Gene=SeqID_82085
aactaataaaaacaaattctttaaatcaatttaaaataaaacttaaagttcactagggtaatatgtaagaccgggaaagctagaatgtaacaaatttctaagtgatttggtatttcgacctcatttgactttgacctcaatttattattatttattttcacatatttttgtctttttttaattcctgtgatcatccatatattttgtcacttactctacgacacatttaccggaatagtcgtcagagtaagtggttttcgcccttctgatgacttttttattttttatgaataaataaataaatattatcaaaataaaataattttcgcatttttttctcatcataaaaaactcattaccaattcattcattttctgttcgtcaattggcaccaaccgccaccaccgaccatcaccaaaaatgaatcatccactggggggcttttatcgttaaaagcgatcggtttacccccggctaatttgtgaatggaattttctgttttgctgggcttttctccccccccccccccgggggggggggcggggaattggacaattttacgtgacgtgtcccatcccatccctgtgggctgtgtgcggtacggcggtgcgctgcccgcccattggccgcgccgcttctgtccgcagggaccgcccatttttggcacggcccaccagcgcatttaagcgctgctgggccagcgaaaacagtcactttcaaaaattttttccagctcacaattaaataaaattcaattaaaatagtgatagggaataggaaaagacaaaaagaaaaaacattttttaatgggacagcgattagaaaaagttaaatgattttttttttggaaattatttcaattttggactgaaaaatttttatgaaatttcatttttggttaattcctttcatttaatattattttttgttttaggaatcatttatttttgctcaatttctaatcccgacaaaatcaccaaagcactcatctcaatttaacatg

SEQ ID NO: 113868 - DNA, 346 bp, Heterodera glycines
  Promoter: Source sequence=SeqID_21224; Location=888..1233; Strand=-; Gene=SeqID_51814
ttctcaaaaactgagccaataattttaatgaaattgttcctcaaatgccaaagaattgaaaatttaaatgccacaaaaattaattgtctaaaaacgaattcatatgggacaaagatctcttaggcaaagaatttctagaaacagaacattatatatagtatttgtacctggaaacaaaatttaaaacaaggaattaaatttttatattgaaattcacattcacgttatatgtggtttgttttcggagaattgttacctatttaaacattaattgaatacctatctgcattgcaaataaattatagttcatttttggaaattcattatttatcaaaaactaaatatg

SEQ ID NO: 113869 - DNA, 771 bp, Heterodera glycines
  Promoter: Source sequence=SeqID_41837; Location=649..1419; Strand=-; Gene=SeqID_69891
ggccaaagtgacaacacttcatttccttgagagaaagcaaaaataataattaaaatgggaaaattcaattgaaagttgtggattaaaaaaacacatcgagaagaaagcccaaaataaggtaaccacaaccaaaacgtcgaaatatcttttaaattttcatcatccggagcaggggtgtgcgaaattccgtgtcgttttcatcgtcgtcccttttttgatcactttttgagtttcgttttcgtgtttcgttttcgtccaagaaaaaaattcgtttcgttttcgagttttttaattttcgtttcatgtttcgttttcgtgaaaaataaatattttcgtttcgttttcgaaatttttttttgtttttcgcacccatgggtcgggagatatcgtcccaaacccatatttaaatataatagtttgaattttcaataatttcatctataaaaaagagtcaaccttattttcgaaaaactctaaaacaattttcttttcatgtgttttctgggctccattccaacggattacaattgctgaagcatttaaagcttgtccatttgcccacctttctgctgcactgtgtggaaaaatatggttggcgtaacaaattctttcgccgagccctgaacattttttaaaagtgcaaatccgattcgctagaaaatgaacaaaagtcaactgggaaggaaataggggcaaaaaaaaataaaaaacggaccagaattttcaaaaaccgcggaccccctgttccccaaatttttttcttgaaaaatg

SEQ ID NO: 113870 - DNA, 247 bp, Heterodera glycines
  Promoter: Source sequence=SeqID_20951; Location=985..1231; Strand=+; Gene=SeqID_51532
aggtgttagcgaatggtgtggagctgaggaggaggtgggtattgatctgatttgggaagcccgacatcgatattcggcaccgacaacctcgggtgggggtgccgaacagcggtgcgggatgtttgatttataagaaagatggtgatactgggaaggaagcaatgagtacgaaaggcggggtaaataaagttagaaaaaatccatttataaataatataagtacttgaatgcaaaaggaaccaaaatg

SEQ ID NO: 113871 - DNA, 418 bp, Heterodera glycines
  Promoter: Source sequence=SeqID_4197; Location=651..1068; Strand=-; Gene=SeqID_53557
aatttcaatggcatttcaaccaatggaatctttttcgaaaaattgtttcgctttttacacatacaaaaatattttcattgcttttttaattgcttcactttcactctacacattttttaattttaacttcccaattgacaatagtccattccttactttttcttccattttaaaacttgttatttaatgatattttgctttccagcgaaaggatgaatctgatcctcgacaacgaccccatcccctttttcatggtctttttttgtcccttaattattcttatcccccctattggtagaacattgagcctgatgttgggtgccgtcttcatttatctggtctaaattgggaatggcacacattggacactttgcgttctcattttggccaatttggcacgatcgaacagctggaaatg

SEQ ID NO: 113872 - DNA, 656 bp, Heterodera glycines
  Promoter: Source sequence=SeqID_5941; Location=2406..3061; Strand=+; Gene=SeqID_59745
tgccgaattgtttgccggtgccgaatttgagagtccaaagttgaaaaaccgcttattgcggaaccgcaacctttcttaggtctgttggtttttcggtgaattaactgcaatatatgcagacctcacccgcctagggactattggttttgttgatggcgaaaaactgcagtatttgcagacctcacccgtctagggactattggttttgttggtgtgcattccgggtgtcttcttgttggttgaagacgactgctgactgcgccaaatttgttgtgtctttgtccgagtgaataagaccaacaaatatttatttacgaagagacaataataataaataataaaaatggcgaatggtcggtgggagagaataatgaataaaaataataaattgaaggcaggagaagaagtgaacatgggggaagagtccagcctttaaatagacaatgtgagggggaaggaacggacgagagaatggacaaatgtaaagatcaataatcgataattgaacatgagcaaagtacatttgctttttctccaacacattggaagaatttcgtagaaacaaacaaattaaagaattgaaaaatttgccggaaaattttcaaaatggccaatgctttggcattttaattgagccagatgataatgccgaaatg

SEQ ID NO: 113873 - DNA, 76 bp, Heterodera glycines
  Promoter: Source sequence=SeqID_10284; Location=1..76; Strand=+; Gene= SeqID_73451
taatttttcatttttctgaaaatttaatgggtttcattaagctacaaaaagttattgcagaaataaattagaaatg

SEQ ID NO: 113874 - DNA, 425 bp, Heterodera glycines
  Promoter: Source sequence=SeqID_9310; Location=1404..1828; Strand=-; Gene=SeqID_70957
ttcttttgcccaattggttggcctttcaatccggcacaacactggttactattcaaggcactgcctacacagtggccgacatggccaacttattggcattggccaatgtgccaaatttggcaaccatttaccaaaactcggcatcacaaattaacgcacagcaatacacacccgtaataattaaatgattttaatgggcggggcgaaaaaaattaaaatgaaaataaaacaaattttaatagtgaaaaattaattttaaacgaagcataaaattttactcgatttcctattgatataattatttaatcgatttattaaatgatttaattttagttggtttttgaaacttcaacacaaattcattaattaaactttcgctaaaatagaaattattttcaaaattcactctcgggtttctaaagatg

SEQ ID NO: 113875 - DNA, 524 bp, Heterodera glycines
  Promoter: Source sequence=SeqID_4650; Location=1009..1532; Strand=-; Gene=SeqID_55232
tttggaaaagtttaaaaaaaaaattaagaaatttgagaaatctttgtaattttcaacaatattttgattaaattatggcattatgtcaacaaaatgtaatttttttctcatggttgagaatttttgaaatttatggcataaagtttttcttaaaaaattagcccaaaatcgcaaattttggccatttttggacaaaaagctgtaaacaaatcgaattaaacattacaaatgtttcccggtggcgcctattggcgccgccggatcaccccccctgtcccacaaaatttttgaagaagcgcgccgcaaaaaaagcgtttttaaagcagaaaaaaaattcaatttaagtatcaaaattattagttgcatagcctattccaaaaaacttttaagaagatattttcttgataagaagccccgaaaacccccgggttggtcttttcatgagagaaaaataattttgggtgggacccagattctccaatatacgaattcattgatacagttattcttttctttaagttatg

SEQ ID NO: 113876 - DNA, 505 bp, Heterodera glycines
  Promoter: Source sequence=SeqID_14785; Location=1107..1611; Strand=+; Gene=SeqID_78928
atttatttacaattaaccgcaaatgatatttgtcgaaaaagtttgttttttgaagagtacgagttgggaaaatatgtatgatgagtcgggcagtacgagttggcctatacacgttgagtttttacccaattcaaactgttttgtatgcatttaaaactagctcagctatgttttatccagctaacgcgttcttgctgttacttcctcccctcccccttccttttccattctctcctcgccttatattgctctcgcccatctcgctctatttttgcacttcaaattgcccttcaagggtgcacttcattcaccattactacacgttttccaccattcatatcaaactttcgccatggattttccacagcatcattcatcagaatgtttgttattggcacaatgaattccatccttatttctgtatccaattgctttcatttgtaacctcaactctcttcccttcctattccatcgaagaaaacaaaagggaataattggatgcatg

SEQ ID NO: 113877 - DNA, 126 bp, Heterodera glycines
  Promoter: Source sequence=SeqID_20867; Location=1194..1319; Strand=-; Gene=SeqID_51452
tttctaatttgggaatgaactcccttgggtttaaacttaacttattttggaaaatattgtaaacataaatttattttcagccttgaaaacactgtcacttttcataactcttttacaacaacaatg

SEQ ID NO: 113878 - DNA, 868 bp, Heterodera glycines
  misc_feature (8)..(8): n is a, c, g, or t
  Promoter: Source sequence=SeqID_8432; Location=1..868; Strand=+; Gene= SeqID_68048
taataaanagtagtgaaaaataattctatagaaatacactctcctatatttaattaatcattcggaataaagtaagaagcataaattatttaataaaactaaatttcaacaaaataaataataacaaatgaaactattaaaataaattcataatttacataaaaaatttttcaattaaagcaatacgacctcaattcaatgattcaaaatgctcaaaaactccaacttttattaaattattaaaatacttctactttcaaatcaagactaaattaaggactgggaaggaattaagatttttagaagagaaaaaataaaattatttataataatggctttgaaaaatggaaaattaatgtactcaaataattgaattgaacaattggataagaatttttcaaattttatatataaaaatcttattgggtcttttaatagacaaaaaattttcttattagatagaacataaattgaaagaaaaaatgtaaaaagaaaacaaaaaacttttttttcaagaaagtgaaaaaaatttaaaatattgcttacaaaaaaattctatagattttaaattaagaaatagttaaaatatgaagtagtaaaatgaatcatatacataattttataataattaaatagaataaatcaatgtcttggacaatcatatgtcaccgataaactttttgcaacagactaaaaataaaaatattcattatatcgttaaaatctgaataggaaattaattttatgaaggagacgccctcaattaataataatttatataaaagaaatatataatgaaggaaaaaagaaattggtattaaaatcaaaaaaaatttaaataatatttttacagttgaaatcaaatatg

SEQ ID NO: 113879 - DNA, 397 bp, Heterodera glycines
  Promoter: Source sequence=SeqID_6139; Location=1..397; Strand=+; Gene= SeqID_46189
tttttttttttttaattttctcgggggggaaacgatgcgggggggaactgattcgggggggaaacggcgggggggaaacggctgggggggaaacggcggggggggggaaacggcggggggggaaacgagccgccccggtttagattagaattacggtaaatttagggattcaaattcaaaacttttgagcttggcatttcgttgttaaatcttaatctttaattatcttaatgaattggatcggctgatatattcgatgtaacaatacaaaattaaggctaagaaaaaagataaagatttacgcaacagaaacaaattcacacattttcactttctattaagcaccagctctgagtttttatttaatttcccacaattttgaaattaaacaacaatg

SEQ ID NO: 113880 - DNA, 794 bp, Heterodera glycines
  Promoter: Source sequence=SeqID_44663; Location=1..794; Strand=+; Gene=SeqID_72120
atatatttacatttaaaataaattattttagttaaaattattaattttttaaaatttgaaagttcctttgccaatttggccaatcgcgtggacgctctgaatttcattttgggccaattgcgcgaaagtgtccaattggtgggcggccgaggcgaagcgatggaggccaatctgagcacattcacagtgatcttcttcttttttgcttactctgatgaaaagcataaattaaatttgaaatataaaaaaattgagggaaaattgcataaatttttgggaatttctttcatttttattgaaattcctttaaatttttttagactgatttgcgcaccacattagatgcccaacacagtgatcaatggaaacgattggagacagatcgccaacagtctgagaaaaaatctaaaaatttaaattaaattaaatttaacgatgggaaaatgcggtgaaaggcatggaaatggagctggacaaaatgcgtgaacagcacacaaaggcaagcaaaagcacggattttaattacagtggttaaatgtaaccgtttctgttcgcctcctcttccaataattaattactaattaatccccctgatttctgattaattcctaattaatccctctgattttccttttcaacaaaatgtatttcttttaaacggtaacaatgaaatttgaatttatttcatttaaatgtcaaaatgctttattttctttctttctcctgtgttgggctaaaattgaaacagaaaagtgatcactgatcacagaattaatttaagagcacaaaaaatg

SEQ ID NO: 113881 - DNA, 276 bp, Heterodera glycines
  misc_feature (16)..(17): n is a, c, g, or t
  misc_feature (32)..(32): n is a, c, g, or t
  misc_feature (52)..(52): n is a, c, g, or t
  misc_feature (91)..(91): n is a, c, g, or t
  misc_feature (110)..(110): n is a, c, g, or t
  Promoter: Source sequence=SeqID_18285; Location=2228..2503; Strand=-; Gene=SeqID_82873
tgttttgatttttacnncaataaatatatcanctgatcattatcatttttcntatgagctgacgtatttataaaggctgtgatcacttcanctcgagggtttaacagacntaaaaaatggtctgatcaattctttccttcgggttttaactgatcccccatattgaattgatcataaaaatagcagtgttttaatcatttacgtgaattaggactcctaattatatggtcgcaggcttaataaacccatttatttcagcataagctgaactcgatg

SEQ ID NO: 113882 - DNA, 576 bp, Heterodera glycines
  Promoter: Source sequence=SeqID_10566; Location=1..576; Strand=+; Gene=SeqID_73803
ggtcgacgaggcattcacaacactcaaattcctgggtcatgcacccgcacggagtgtcttggtcagtttttttgaaaaatttaaatatcgaaaataatttgaaattacgataattaggaaattgaaaaaatttcgggaaatcaataaaaattcgaaaaaataatatttaaccaataaaattcccattcaacttaaaagttcctacattaaataccttatttaaatgaaaacagttttgaaaattcaccaaaatattatgatttaattttgaaaaaacatttcaatattaagaatgcaaaaaattttgatgcattaatttttagtttgaaaaaaaatgtgtttaataatatttttcaaaaaactgaaaaattcaaaccattttaattaagggttaattataatttaaaaattttaattcgaagaagaagtcaattttgggaaaattctcagaaatattaatttaaaaattccaattgaatttgaaaattatcattattttttaaaaataaataattaaggtatttactgttttaattaaatatttaatttaccaggttcgaggcagacaatttaatg

SEQ ID NO: 113883 - DNA, 100 bp, Heterodera glycines
  Promoter: Source sequence=SeqID_14016; Location=1..100; Strand=+; Gene=SeqID_77985
ttttgcattttttttaaaatattttcttcaaaaaagttacaaaagcatacattctaaagcccgatggtctaatccgtgtgtttgaatttagcacaaaatg

SEQ ID NO: 113884 - DNA, 343 bp, Heterodera glycines
  Promoter: Source sequence=SeqID_37278; Location=269..611; Strand=-; Gene=SeqID_66381
ttgcaaaaaaattaattaatattcgggaaaactgagaatgttttgcggattgacattggcaccaaaaaactctcacaaaaaagaaaattaaataaatgtaagaatcaacaaaaagcatttcttagaaaaaagagagcatcaaatccattttcaattggtgcgataagttcatttccaattgggattatttttcaaacccctcctagactgggggataattggatattgggggattaatggagatttggggataattagagcaaatacggtagtgagatttggccatgcctcaaatataattagtagggagtccaaaaatatggatataaaatcgcgaaatatg

SEQ ID NO: 113885 - DNA, 1003 bp, Heterodera glycines
  Promoter: Source sequence=SeqID_5049; Location=429..1431; Strand=-; Gene=SeqID_56715
gggacttgccgggaccagaaaagtcgggatcgggaccgggaccaagtttttcgaccaggaccgggaccgcgagaaaagccgggaccgggaccaccgggaattttcccaatagaaaattttttgaaaaaattttgaaaatagcattataagatggaaaaaacagttttgagaagaaacttcgtcgaaaaaagaatgatccaggctatttaacgcgataaagaaataaaaattccgatcaaatttgttttcccatataaatccaacaagaaattgttttattaattttggttttttgaggcaatatgtccggctgtatgttcggtacataattttatgagatttattataagattatacaacaatatttggtcatattttcccaatgtgacattttttcattttgtaatttttgacggtgtcgtaaatggcaaagattgacttgaatttgtaaatacctaacaccacttttcatgttcttatgagcaaatgtgatagcaaaatctagtctaattcgaactgaagctgaataatctccaaactgtatgttggaaaaggacatttaaatgatgtttgttatcattcctcttttccatgtcctttgtactattgattttgcccattctgctcattaagtctcttcccctcttttcccccaattcattctctttttggctctcctctggactcgcctaaatattgtgctccgctaaatattgaccccaaattattctccaaattctgctttttattttgttgttgttttaataaatatcttgtgttcaacaacatttgtttgtgaccctaaaagcacaacattggcgacgcccgaactcatcaattttcaagcaattctcgtgttgaattgctagttttgggaaatttaaaaatctcgtgctgatttttaaatttcgcggaatcatcaaaaaccaagatacctatgcggttgcggttccactatctgtggttttaattcgtcaacaatttcaaatcgtcaatcaagatg

SEQ ID NO: 113886 - DNA, 553 bp, Heterodera glycines
  Promoter: Source sequence=SeqID_39935; Location=479..1031; Strand=-; Gene=SeqID_68386
agtggatgaacaagaattggaaacagaccattggaatgtgatttcgaatttagacaattcttaaacccagtaattgtcgggaattttaacgggagaaagttcacgccgttatttgaacaaatgttggacttcgccacgggttcttacgcttaccaggcaaacccaacggaatcttctatcttatattgtacaccatttaagggatttcgcgactcaatcagtggcgagtctttgctcgtcggatggcttgggaattgggccgattataacggcgtccaaaatttccctacggcgctcactttgccgcgagtgctcaaattggccccgagcagaaactttcttttgacccctccccacccatccgtcgtccaactgagggtccttaaaaacgatttaattggcaattaaaacaatttttaaggaaaaagaattgaacatggacgacttccgaacatttaaaattacgcaattgccgaaaaacggtgccgtagaaattttcttcgaaatttactattggcgactgcaaatttacggttcgatagtgctagaaatg

SEQ ID NO: 113887 - DNA, 85 bp, Heterodera glycines
  Promoter: Source sequence=SeqID_1545; Location=7445..7529; Strand=+; Gene=SeqID_74364
ttccacaaaaaatcaattaaaataataataataaattattatttttattattgttattgtacatatgtatatgtagaacaaaatg

SEQ ID NO: 113888 - DNA, 527 bp, Heterodera glycines
  misc_feature (38)..(38): n is a, c, g, or t
  Promoter: Source sequence=SeqID_4985; Location=1..527; Strand=+; Gene= SeqID_56448
tttaattagcaatttatgccttgaaatgatttgctacnctatgtaaatgcgtcgtatttgtgcttcacaccgtcgccaatgtctttcccccgccctccctctcttctctgctcccttctccgatcactctttcttttactctcctcctccttttgttcaccgccgcttcagtcccggctaattcgtcttcgtccaattccccacccgtcgccgtttcgaaatgcgtcgccgtcgtccggccaaagtgcggcgccgttgctgcgttttgagcctttccgcgcctcggagccctaccgttgcggaatgttcgcggaacagacaaacccaagcggacccggcgatgcgcgtgttgcaacgggcacagaacgcactgatccgcacactgtcgcgcccatttccgcaccaaagttcgaaattggcacattaaactgaactgatcagatcgcattgaagagcattgatcagagcagttcattgttttccatctctgaacattttgctttttccagaacttctttctgacgatg

SEQ ID NO: 113889 - DNA, 121 bp, Heterodera glycines
  Promoter: Source sequence=SeqID_21365; Location=1066..1186; Strand=+; Gene=SeqID_51966
attccatgatactgtatttattctactataccccctaaaatatttatatcgtgtttttatggattgaaaatttttaatttatgaaacggattcccaatttttagccaaaaatgtgctgatg

SEQ ID NO: 113890 - DNA, 618 bp, Heterodera glycines
  Promoter: Source sequence=SeqID_19590; Location=1416..2033; Strand=-; Gene=SeqID_84328
acattaatttttataaaataaaaaaaggctctctattatattaagatggtcgctgatcaagaccgtgaaacgccaaccatttttattttaaactcttcaaatcactttgaagtgatacttgaaccaactcgaatttgaatgctaattataaaatcttatatcgatcacacaatcatgtatttgtaagagtaaactatgcttatgaatattatttctctcttaaaaatgtaatttggttgggaaatattaaatataaagctaaattataattagggccagcaaatataattaacatattaaaatagttatattattaattaattaaaatattattcggtactgaaatgacccgcctcttctgatcaccactcatttgcctttttgtcacttcgcccacatttgcctttttgtcacttcgcccacatttgcctttttgtcacttcgcccacatttgcctttttgtcacttcgcccacatttgcctttttgtcacttcgcccacatttgcctttttgtcacttcgactcaccacgaaaatgacctaattcatcagtgatcaaatgcattttatgaagaaaaacctctcaatttcggtaaataaatcagatgcataaaaatg

SEQ ID NO: 113891 - DNA, 427 bp, Heterodera glycines
  Promoter: Source sequence=SeqID_24272; Location=1592..2018; Strand=-; Gene=SeqID_54995
gagaaagtgggataaaggacctgagagaacctctataagtagcgcccgtagctcagttggttagagcacggcacggattgctggggtcgtgggttcgagccccaccgggcgagttaccttttatgttctacaaatttcctaaaaaacgcaggttccttgatattttaacccaggttccggtctgtatgcacaaaaattctgaggaaaaaaattcgtaacactttaattttttgaaattgctttcctgcaaaagcaaaataattaatttggtaaacaaacccaaaaaagccttaaaacaatcacagataatagccaaaaattaattaccccagcagaaataattttttgctgctattgaaaactaaagtatcccttaattgtcccagccgtggctataaaaacaaaatttttctcagccctaattatg

SEQ ID NO: 113892 - DNA, 175 bp, Heterodera glycines
  Promoter: Source sequence=SeqID_26921; Location=1..175; Strand=+; Gene=SeqID_57657
ttatgcgcgcgcgtgttaatacatttctttaaacatggccaaataatctgaatcggttttttgagtatttcagcaataactttaaaatttgtaatttaatagtcaatgatcgtacagtaccaaaaatgcttaaaatttgtttaaagaaataaaaaagttatgttacaaaaaaatg

SEQ ID NO: 113893 - DNA, 660 bp, Heterodera glycines
  Promoter: Source sequence=SeqID_5534; Location=1..660; Strand=+; Gene= SeqID_58371
tgcccgacagaattagaagcattagctgtgagattcggcgtcaaaaaatctttcacaatcacatcaacaatggattcccaccaaagttctaaccgatcataaagcgttggttccgacgtttaaaagcaaaagtgaaaccggaaacgcacgtgtcgataaacggataacggaattcgagtgcacgatttatcttcggaaattcgagtatcaacccaggaaaggcaaacataattcgcggatcgtgctttcacgttctcggcgcactcgaagccacgtgaattcggcggagaaaatttttagagttgagcaagtcgatcggaaatataagtgcttctcgtgccaaaaatcggaaatcgattgagtgggtcaacgcaattaaggaaagtgagctcggaaacctttaccaattcctcggaaaaaaggaaattgcctgaagataagcgggaatgtcagcgactttttgacaccattcataaattcacactgattgagggattactgtatttccatgattcgaattacggtaatcttcgacttttcgtgccacaaaaattccgcaataaactgatcgaagaaaggcacgaaggcaaatgtgcgggacatttaagcggcaaaaagattttcgggcaattagcagaaagatatttttggccaaacatg

SEQ ID NO: 113894 - DNA, 122 bp, Heterodera glycines
  Promoter: Source sequence=SeqID_15269; Location=443..564; Strand=-; Gene=SeqID_79484
actaaaacaatgaaacagaagacaacaatgaaggcatttttcaatcaattacagcttccccacgtgtaaattaaaaaaattttttttttttacataaacataagaattttcaggaaaaaatg

SEQ ID NO: 113895 - DNA, 209 bp, Heterodera glycines
  Promoter: Source sequence=SeqID_43943; Location=1162..1370; Strand=-; Gene=SeqID_71505
tctgaaatttttttttttcaagaatgtttgaattccgggttaggggtccggaaattcgtcaaatagagttcatattcatgatcagcggccccgaaaacccctggaaacactttttatcattaaaagcaaaaaattttatgtgggtcaaactgtataattacccatgaatgtactttattaattagaaatttaattatatacagtatatg

SEQ ID NO: 113896 - DNA, 1003 bp, Heterodera glycines
  Promoter: Source sequence=SeqID_2180; Location=461..1463; Strand=-; Gene=SeqID_78317
gttttgaaatttcaattttaaaagaaactatttggattaactcaggtaaattctcgattttttatggggttcaatttatagttaattttttttttcgtttaggctaataatttctgatttccaatatttcaaacattatttttgggcatttaaattactaaatattaaaattttaaaatctttagtttaacctttgtgaatattattttgaaatttaaacataccatgctaattttgaacttcttgtacatccaaatcacaatttttatattcgttcactataatttaattatttataatttttaaatcatatttgggaaatttgttcttttacacttgaatttaatgggtgaaatttgaaattgataaaatatttctacgtatttatgtaacttataattccgaattatatttaagcaatcaaaaaaattgaaaaaaaatttgttggaatttcataaatatatttttaagcaattgcgtcatttccgcacactatacgaatattattattctttttttgcccattgtctgaaaaatattttcattttcgcacattgcctcaggcaatatttgtccaaaactttccttaaaaaattaatcgtctcaaaatttggcaaatattttcacagatttttaattaaaaatttttccaggctatcattttgcactataaaaagcattcggccacaacacacaaccgcttattatttcagtgaaaaaataaaacattttttcccattgcccatcagttattatcgggaaaacaaacgaaaaagagatacggtaatgggaaatcataaacaagaaaaatatttattattttatcagaaaagatagccattttttgttgtcaaataaccacaaataatttaaaaatgcttaattttatgggtaggctaaataaaatgccaaaaaagttaaccttaaaatttttcaattaataaattttttaaatgagtaacaatgccaatttaaatttgtcgtatttcagtattacgaaatg

SEQ ID NO: 113897 - DNA, 568 bp, Heterodera glycines
  Promoter: Source sequence=SeqID_11273; Location=436..1003; Strand=+; Gene=SeqID_74643
atccaacaactgtctggggtaatccgttgacaaataaaacccaaggtattataaaaggcttgttttctacaagtcacaaaaattatggattccataaaataaaaagttttggccaaattcttgaagccagaaccgagtttggcatttttggcacctgaaattcggattttggtaccaaaaaactgacccggcaattcaacgctggcaatttctgccagcattttccaaccataatctcagctcacagaggacaacactttggttaattccggcaaaaacagaaaatggcaaaatatgactgaaaaatgccaacatgaatttaaacttactcaattttcatttcatttccttacggaaatgaaatgaaattgataaaaaaattcacgtgaatttattttgtttttatgtttttcatattataataaagaacggaagttgaattagtctgatgtaatttcaacaaatttctgtatgaattttgcatataaatttggcaaattttctcaaataaattcattaaatattttaatttatatatttttttaatttttagtgtttgaaaaaaatg

SEQ ID NO: 113898 - DNA, 303 bp, Heterodera glycines
  Promoter: Source sequence=SeqID_4430; Location=2664..2966; Strand=-; Gene=SeqID_54413
tagttttatctattagctgaaaatacatatttatatttttagtattttaatttttttttcttttttttaatattttgttatttaaccttttggaaaccgtctaagtttttcatttcaaagttttcgcatttcaatttttggattaaaaaggtgactgatgacttttttattaatacccatttttatggatagttaatatttcttcatccatagagcctgttcattttttggcattttgccgacccttacaataaaaatatctgtttataaaagacacaaacggccgaacattttggtaccatg

SEQ ID NO: 113899 - DNA, 198 bp, Heterodera glycines
  Promoter: Source sequence=SeqID_767; Location=315..512; Strand=+; Gene=SeqID_60743
aaatgtttgaagtcggctgcctttttctggattgtcattttatgttaactcatcttttgttgagttaggaatattttacttccaagtaaattgtctcgacatttgccataacattaattatttggtaggatgagctctttaaatattttttttcaattctcaatttatcgtttattttattgaaacggttttattatg

SEQ ID NO: 113900 - DNA, 614 bp, Heterodera glycines
  Promoter: Source sequence=SeqID_3464; Location=1129..1742; Strand=+; Gene=SeqID_84773
ttttggcgccgcgaactttaaagtgttataacttttttcttatccaaccaaataaaataattttgataccattaaatagacctaagtgttctttattagcttgtaaaatattagaaaaaataaattctgtttgacaaaagatatagcgtgcggcgccaaaatggccagaaaaagtcagttttttgaggttttttggccataacttttttgtgtttcaattaaattttttgaaattttgcaggctattagggactatcaagcgctttaaaatgatatcaagcttatttaatttgaatgagaaataaaaatgttatagcgtttggcgccaaaatggctggcgccaaagtggccggttcccggagacagacgcttattatgtcagtaaaggacaaatgaagaatgattgtttctgcgcttaaatcgtcccttttatacaaacattttcctacccgtcaattccgtgtaaaaattctctataaaaagggatgaaatttgcgagatccactcattcttcgcatttgcgacttttactctctgctgaacaatttcttctctcgacgacactttgcgcattcaatccgagcacacttcttcacccattggctggtcccatg

SEQ ID NO: 113901 - DNA, 848 bp, Heterodera glycines
  misc_feature (43)..(43): n is a, c, g, or t
  Promoter: Source sequence=SeqID_22439; Location=1..848; Strand=+; Gene=SeqID_53110
acgcgggcgtgcgcggcctgtcgcagcagccgcgcctgtaaanagcggtgttgaaagcaaaaaaggtcattgatttacattaatttacatggccggagaccccttcgcaaaattggaaaattggccgctgatcccttgttttgcaataatctgaattttgagctctacatctgaattttagtgttctttatcctgaatttgaaaaaaaaacttggtcaccctcaatatacatatacttctgaacaattctaatgctaaaaacaggcactcgcgcgaaaactgaataaaaattttgtatttgaaaaatttccaaaaatttttacgttggaaaattaccggtttttaccggtaccggtaccggtggaaaaagttggtaccggtaccggtttttgcattaccggtcagtaccggtactggtttttttacaattaccgattaccgctcaactctagtcgaattgatttatttggggtaaagtaaaactccccgaaatctcatcatttgcaaaatattctcctatttggtggtcctcttatgtgcgttccctttttcttccgatccgtcgtcattttatgtcaaaatgtttccgcgccttccgtttttggcaatgatttttcgcctcctattggcacttgtccaacccctcgagcccattggcaacagttgaagctgaactggttcaaaattgttttaataaaatgcgattctcgtgtttttctcatcaagtattatccgtaaaaaataggaaaaccctaaaaatccaggctttatccaacgcaattatttttctgctatttgtgtgacatcattcgaaattcaacagcaaattgtgctaattgccaaaaatg

SEQ ID NO: 113902 - DNA, 76 bp, Heterodera glycines
  Promoter: Source sequence=SeqID_1047; Location=4753..4828; Strand=-; Gene=SeqID_66886
ttctctccctcatcaaaagcattccgaattcgccgaactgctcaagagtctcatctgtccccaagtgatcaaaatg

SEQ ID NO: 113903 - DNA, 338 bp, Heterodera glycines
  Promoter: Source sequence=SeqID_38417; Location=495..832; Strand=-; Gene=SeqID_67232
ggggcggcggcacatgaaatatgtcatttaacgccatcaaaaattgagcgcaaacatttaattaaaaaatgtcgtaaaaataggagacaaaaagtaaacaaaaatttgtgggccaggctgatttattgtttgttttgatttcaatttaattaatttttttcgattgagagcaaataaaaatctttaaatgattagttttttttcaaatttgagagcaaacaaataattcttttattttaagtgattaattaattacctcatattcgcttcaacaacttctcattttatcaaagcgcaaattggctaattaacaaaaaaaaatttataacataataatg

SEQ ID NO: 113904 - DNA, 396 bp, Heterodera glycines
  Promoter: Source sequence=SeqID_7945; Location=1091..1486; Strand=-; Gene=SeqID_66461
aaccgagatggcacaccacgatataaggacgatctcattttgaagaatttatacttgttgatcaaatgacaaactctttctttgtaattttgccgagcaatacgccaggctttgttggaaataaaacaaacaaattcaaagtgcacttgccaaagaagttggtgttcgatggggccgggtggatggttggcctgtcaggcataatttacccaaacaggtgggcgaaaatcatggctattgggttcgatttttgacttaagttgggcaaagctgggtacatcagaccgacaatatgtgattgttcacctgcacgacggccgaaaataccgtttccgtgtgccaaagggaagttttctctcgccacagcagcttgagaggggaattcatcatggcatg

SEQ ID NO: 113905 - DNA, 153 bp, Heterodera glycines
  Promoter: Source sequence=SeqID_44115; Location=1..153; Strand=+; Gene=SeqID_71650
cgctaaaattatcagagtgcggaaaatcgcatgtgatctaaccctagcaaaaaaatgtggtaagtaaaaaatcgtaattacgctcaaaaagcttctcaaacaattttagcgcatccaattccttctacaatcgcctttatacatcccattatg

SEQ ID NO: 113906 - DNA, 727 bp, Heterodera glycines
  Promoter: Source sequence=SeqID_20446; Location=1997..2723; Strand=-; Gene=SeqID_50982
cgtatgtttgctgtaaagttgtcctaaaaatcgttttgaaaaaataatttccttaattttcaaacgttaaaattttattttaataaaaaatttaaaaaaagtaaaaatttattttgtgaaataacaaagtttttaaaaaagtcaaatattttattaaaaaacagcctgagaacatcacctttttaaaatatattctaaatttaaaattattttttctgaaaaatattgtaaaataaaatttttaaaaatattatttttaataatctaaaattttttgtaaaagccaattaaaacttttaaaaaaaactattaattttgctttttttaacaaactttttgtgaaaaataattattagggttgtaaattaagatattatattttctgatttctaagtgctctgaataggtgtttgtgaatggttcttttatttacatatttttaaatatttcccactttttttacatattttttaaataaaaaattcaaaaaatatttttttaaatgtcaccttgttatcaaaaattaaattaaagtattaaaacattattctaggcctaataagttcatttttatggcattttggtcttattcattcttttcaaagattttttgtgaaaaaaaatattataaaaaatttgtattttgagatttctttttcatacaattccagctttaataattataattaaaaaggaataattaattcaaattcatttgaaggtgatg

SEQ ID NO: 113907 - DNA, 85 bp, Heterodera glycines
  misc_feature (34)..(34): n is a, c, g, or t
  Promoter: Source sequence=SeqID_30542; Location=1..85; Strand=+; Gene= SeqID_60959
taatgcccgtaaaaatttgatgagcgactcctcnttccctctcgtgagaagtgcgccaaaacattccaccattaacacccgaatg

SEQ ID NO: 113908 - DNA, 91 bp, Heterodera glycines
  Promoter: Source sequence=SeqID_14194; Location=1..91; Strand=+; Gene= SeqID_78206
aggaaatcgacgaattcgacttaaaatgggtataattggctttgcaacggtgcccaaatggggaagcggcgatggtgccagcaattaaatg

SEQ ID NO: 113909 - DNA, 89 bp, Heterodera glycines
  Promoter: Source sequence=SeqID_2665; Location=1..89; Strand=+; Gene =SeqID_80970
tattggaggccttgtaacttttgaactaggcggaatgcaccgctaaaattaaaaattcacactagaagtcgaccctgctctatccaatg

SEQ ID NO: 113910 - DNA, 129 bp, Heterodera glycines
  Promoter: Source sequence=SeqID_22636; Location=1098..1226; Strand=-; Gene=SeqID_53308
aaagattaactgatttacgccaaaatgccaacaaaattatcattttttattatttaataccaaaagtttaaaataaataaataaaattaatttttaaataaatatttataacagtttatttcaaaaatg

SEQ ID NO: 113911 - DNA, 192 bp, Heterodera glycines
  Promoter: Source sequence=SeqID_34621; Location=1..192; Strand=+; Gene=SeqID_64363
attattaggcgctagaaaaattccagattatactaatattccaaatagtgtaaccccacccgtgattcgtattcagcaagttcacccattaaggatgtcggcgccggaattggtcgttactatgccgtcaattttccattgagagacggaattgacgatgaaacttacgagcgcatttttgcgcctgtcatg

SEQ ID NO: 113912 - DNA, 307 bp, Heterodera glycines
  Promoter: Source sequence=SeqID_12242; Location=935..1241; Strand=+; Gene=SeqID_75814
aaacatttttaattgttatttcaaaaaatggaatattaatatggttgagattttttatcttttttcttgagcattttcggtagaagcattttcttcatccaatttgaacttagaaatttaaaagtatgctaaaaatacatattttgggatttgggacataaatcctatttttggactttttcataagttttactaatttcccaatatttcaaaaaaccgtcgcttcataaaaataattagctcgcaaatttaaaaattttagagattaaaatttatttcttattttttacaggctgcaaaattgatg

SEQ ID NO: 113913 - DNA, 690 bp, Heterodera glycines
  Promoter: Source sequence=SeqID_42976; Location=1..690; Strand=+; Gene=SeqID_70762
attgtaaaaattggattggtcggaaccggggatttcgtcaaaaccgagacgggacctgggaagaccgggagacttcctggctcggtcaggtcccatcaactttaatattaaaaaaaaataataatttcaatgctttttgctaatttttatataaaattatttttgaaaatttaatagatgaagctcaactccattaaaccgtccttcaattgttccgtttgcagtcgaccgtgccaacatagcaagtatggcgtcaaatcttgtgaaagtaaacaatttttaaagaatggaatgaaaaaataataaattaaaaaacgctgaaaggaataaaattgtttgatgattaataataaatcggaaattaacataattattgaaaaataaatttacttaatacatttattagttttgacattataaaattatcaaaggtaatttgcttttttgtcgtattttttgaaaaaaaaaaaaaattttcaaacaaccaattattgatcctaatgaacaaaaagaccgtgttttcttaattttaatgctgattaggctatcagagtttgaaaaaattcaactttgagtccgattttggacataggcgcaaatgtcggggctccctacagatgaccttttttgcttttgaaaccactttttggagtgccttcttttcaaaaaaaacttttggggaagagcatg

SEQ ID NO: 113914 - DNA, 545 bp, Heterodera glycines
  Promoter: Source sequence=SeqID_45082; Location=1..545; Strand=+; Gene=SeqID_72464
atcactcatatcagtctgaacatttaagttgagcaaaccgtacatcgcaagaaaaagcgaagggatcgaaacagcggagaaaggcagcggaatgaccgtaagtacgccctcgtgatatactgtaccaatataaaaataaatgtaaaaaatgccgaaataccgaaataccgtaacccgggcaaccaaaaaagcaaaaatataacagtaattaattccctcatgagcagaacagaggagaaaaaatgttggacggaatttcgatgcaaaagcctctgaaggcgccgctgtccaggagaataacgcccgattttttgcgtgctgtggtgcaagacgggtgcgagctgacgcgttgccaattgatttggtaattcggcacaatgccaaacgatgggaaaagcctttctacttttgaacaaattcacaagaaacaaataataaatgggctaaatttgtaaagaaatcccggggaatgctttttccgcgttttaattgtgaaaagtcagttcgcttttcttcagttatcgcgtcaaattcgatgcaaaatg

SEQ ID NO: 113915 - DNA, 321 bp, Heterodera glycines
  Promoter: Source sequence=SeqID_28608; Location=1324..1644; Strand=-; Gene=SeqID_46120
gaagagaaatattgtgtggaaaacattgaaagggacgaaaaagttttaatggaacgaattcgcgacgcgaaagattgggcactgactaatgggctgacttttccgatgccaagaaggaaactgaaatgtgacgcatgtgacaaaatcaatgaggtggatatatataaatacggcacaaatcccttaaaacttggcaaatgccataggccattaattagggtaattgttaccatgggctcgagttatattaaattcaattttttgatttaaatgccaaaagtggtcaattcctttgcttagaatgttgttttggacgacatg

SEQ ID NO: 113916 - DNA, 244 bp, Heterodera glycines
  Promoter: Source sequence=SeqID_32444; Location=952..1195; Strand=-; Gene=SeqID_62752
tagcaatttgcgaatggccctcaagtatataatagaccggagagcgggccgccccaccattaaaccacctggagcgaacctattggaagagcggcttaggaaggacccaattttgtattcatggacggccccaccaaagagaccgtcacagagcaaaaccacccggacggaacggacaatcaagaaggaatttcgcccgaaaaaatggagctgatcaacaccactcttgacaaaatgtacaatg

SEQ ID NO: 113917 - DNA, 202 bp, Heterodera glycines
  Promoter: Source sequence=SeqID_28031; Location=721..922; Strand=-; Gene=SeqID_58690
agaaaaaagttattcattttaaattatttgagcacttctccatttatgattatcccttttatgacaacgttcttaaggtgaaaacaaaataataatgaaaaaaataaaataaaaatcattgaaaataagcatttattatttcatttgtttcaaatctcttaaaattttgattagaaaagaaaaaattttctcgttcagtatg

SEQ ID NO: 113918 - DNA, 260 bp, Heterodera glycines
  Promoter: Source sequence=SeqID_23701; Location=630..889; Strand=-; Gene=SeqID_54396
aaaatatgtttattatttacgaatgagctccagtagaaagtaataaaatttatttaatcattaatttaccaattggcaattattttgtcattaagataaaattattattattatttctttgaaattaaacaggatttccttattttattaagtaaaataatgatttattcagttttctaataagaaaaaaaatcatttaaatgcctcaaaaaatgaattgccatttaattgaagaaaaataaaataaaatattgaaaatg

SEQ ID NO: 113919 - DNA, 93 bp, Heterodera glycines
  Promoter: Source sequence=SeqID_5463; Location=3377..3469; Strand=+; Gene=SeqID_58148
actgaagaggacagacagacagcgtaaaagaaaggaagagaaagcggacgaagcgaagaggggaataatcccatggcaaaaggcaaaataatg

SEQ ID NO: 113920 - DNA, 393 bp, Heterodera glycines
  Promoter: Source sequence=SeqID_15757; Location=1..393; Strand=+; Gene=SeqID_80083
tctagagtcaaaaaataaaaattggaatatttttttattaattaaaatttaattacatcaaaatgatcaagaaaatatgcaaaatattgtatcccagctgggaattgaacccaagcgaaaaataatgaaaggcagaaagtttagccaatagaccacattccttctcttttctcacccagaccctccctttcttaccagtgcttatttagtcccgcaggacggactggcaaaaccggggccggaatttcaatttttccaaaaacctggaccgggacttacaaaaaccgggaattcccgtccaagtcccgtgcaactctaaataaacacaaacatgacattttaaaatgatcattagaattaatatttatttaggtattgtagaataaattaatg

SEQ ID NO: 113921 - DNA, 362 bp, Heterodera glycines
  Promoter: Source sequence=SeqID_10487; Location=530..891; Strand=+; Gene=SeqID_73699
tgctgttgtgtcccgatttgctctttctgggcactgtacaaatcaatgttggttttatacgatgatattggtttatcaaaaatgaagttacagagttacactgtctttgggcttttgaaaacattgacaaaaacgttgggttccatagtcgaaattaattaattaccgcggataatttgggactaagtttttgtttctatatactaacagctttcgaatgttccagaaatgtaggcttttttccaacatgaaaaacttttaaaagatgtttagttttgagccggacgcataaaatatatcccaataatagagccataccccaatactccaatactagagccatttctatctttttatagatg

SEQ ID NO: 113922 - DNA, 277 bp, Heterodera glycines
  Promoter: Source sequence=SeqID_11031; Location=743..1019; Strand=-; Gene=SeqID_74359
ttcactgctgtccaattaaaaaggagactattaaaaacgtatggaataaattggctttgtcacagaagtacagtaaggcggaagataaaaagtaattatcagtcactttctaagtcacctatcccgtggccctgtggcataatggataaggcgttagacttcgaatcaaaagattgcaggttcgagtcctgccagggtcgaaaaatttttttctatagtaattaaaaaataaaatttttctttttggttattaaaatcgagagaaaaatgaaacatg

SEQ ID NO: 113923 - DNA, 740 bp, Heterodera glycines
  misc_feature (29)..(29): n is a, c, g, or t
  misc_feature (71)..(71): n is a, c, g, or t
  misc_feature (99)..(99): n is a, c, g, or t
  misc_feature (114)..(114): n is a, c, g, or t
  Promoter: Source sequence=SeqID_21833; Location=1..740; Strand=+; Gene=SeqID_52466
ttttttttgaacccaattactaaatttgncgctaaatgcacatttacgcgatagtgacaaagctgtcaccnatgagggcgcttaaatttttataagttntataatatattcatntaattacaatgtttaaaagaatctgtggaacgaatatgcgcggatcaaagggtggaggaatttggcgaaacggaaacattttttaaagtatcaatttcgtgaatgaactttttgctgtgcttcgcgctactttaaatacacaaattagtctgccctctgccgcgctctttgccgcgcggacttttactcataaaaaatgctttttttggtaaacaggcgggcccggggatccttccaagaccataaaaaatttttggacgaaattttgtgcgcaaaagacagatcaacgaacgatcataaaaatttaagccggcccaatttagcctgataatagaagggcacaaatctgatgtttgattcgtcgaattaaaaatatatttagaaagcctaaatttggattttctttaaatttcaaaaattttaatctttgaacccaataaaaaaagtaaatttctaaatttaattttagttagatcaaattggtctttgatcatttatgaaagagcatttaaaatggtatttaaggatgtctttttcctcaaataaatgcacaaaagaattaataaatatattctaaatttccttacttcacccttaaaatttaatttgctcttattttaatgatg

SEQ ID NO: 113924 - DNA, 221 bp, Heterodera glycines
  Promoter: Source sequence=SeqID_9008; Location=646..866; Strand=-; Gene=SeqID_69984
ggtgggcatttattgcaatttatgccattgatcggaccaaaacttcaattaggggacgaatgggtggagaaagaaacaaattgtcattgttagacaattcaatggtcgtttagttaaatgccttcaaactgaacaactcgcccgaattcgcgttgcattcgcgctttgaccttcagacgggcgccgggttggaaaatgcgctctttccgcacttgcaaatg

SEQ ID NO: 113925 - DNA, 189 bp, Heterodera glycines
  Promoter: Source sequence=SeqID_33901; Location=1..189; Strand=+; Gene=SeqID_63822
aagaggttttgctcactggataagaaagcaaattttgcacagggggaggaggagtaaatcaattcggccgcgtcagaggattttgccaacgcttaacctgtggattgagataatggcgtttaaatttgggctgaaaagctcaaacaaagcattattttattaataaaaattgaaaaacgaatgcaaatg

SEQ ID NO: 113926 - DNA, 543 bp, Heterodera glycines
  Promoter: Source sequence=SeqID_23001; Location=1852..2394; Strand=-; Gene=SeqID_53703
aagttcagattagcactcacctccctttaaaaccgcttaaagttagttttgagccgaaaataaaaaataaatccgggaccacaattctttaccattgccaagcaaatcatgtcacctaccgcaagagaaggtcttttctttggcattcctccgagtgttggcgaattagaaaccaaaaggaagcgggtactaatgcactttaccagacataatttttttgttgttgtcttaattcatgtaaaatagcttccaggagttttcagcatcgctgaagagcgtatttaaaagaaagcctagtccgaaccaaaaagtttccttttctttaaaattgtatgcgagcattgagtttgttgatttttcactattgcatctttttgaaccatatttgactaggatttttaaaattttcgatgttcgatcataagttcgatttcgggttctggagtacgaaattagttgaaatgaacgccagattcttaatcagcgatgctgaaaactcccggaagctattttatatgaattgacaaaaaaaaaaattttatg

SEQ ID NO: 113927 - DNA, 54 bp, Heterodera glycines
  Promoter: Source sequence=SeqID_767; Location=1..54; Strand=+; Gene =SeqID_60744
gcattgggactgtacggggcgacggtgctcagcggctattttttggtgcccatg

SEQ ID NO: 113928 - DNA, 609 bp, Heterodera glycines
  Promoter: Source sequence=SeqID_17235; Location=387..995; Strand=-; Gene=SeqID_81704
agagaagtagcgagagagagagaggagataaaggagaagagaaatgatattggaaagaaaataaattaaatcgttagatttatcaaaataatttcttttcagaataaaacagagcggttggtgcctgcgaaagcggcgcccccccaagcgctcgtttataatacttacatacatcagtaaattttttgaatttttctattattttggcgttaaaatttattttataaatttaaattttaaattgataaatcaaaatcatcatttttaaagcccctgttaatgaggaaaattcaagttaaaagcaagctttgttatggcctggatccgggcctggtctggattcttcaaatttgttttaaaaatcaaataatttgaaaaaacaaatactaataatggcttatgaaaatctaaacagattttgaccaaaaaagaatcatgcagtgcgccaggaagatttcggaaaacattaaaatgaccaatttccttaaaaattccgaaaagtaaacttttaaggtggaataagaatactattagaaaataaatatacttcttaattaaccattttttaattcattaattttagaaagaaaaaataaactagttaaaatg

SEQ ID NO: 113929 - DNA, 491 bp, Heterodera glycines
  Promoter: Source sequence=SeqID_2778; Location=1941..2431; Strand=-; Gene=SeqID_81541
tatttcgcgattttatatccatatttttggatgccctatttatgatgggtgcaggaatgagaataagaggaaaactatagagagatgaaaaaagaagcaagagaggggacagaatgaagaaattctgagaagaaattagagaaccgtgagagagagacagaggtgagaggacgtgagagagagaagggaaagagaaggaaagagagagataaagagcagagagagagagaagagagagggcagagaaagcgaagagagagaaagcagagagataaagagataaaaagagaaagcagagagagagaagagagagtaaaagagaaagtgagaaaaaattagagtcgtgagagagagagagagagagaggtgagaggacgtgagagagagagaagagagaggacagagaaagcgaagagagagaaagaaaataaatttaaattttcttaaaaattaataaattttagcttttatgttttttttcttttaaaatg

SEQ ID NO: 113930 - DNA, 58 bp, Heterodera glycines
  Promoter: Source sequence=SeqID_44551; Location=1..58; Strand=+; Gene= SeqID_72031
gaggtttccgtcctctctgagctcgccttaggacaccttcgttacgctttgacagatg

SEQ ID NO: 113931 - DNA, 1003 bp, Heterodera glycines
  misc_feature (903)..(903): n is a, c, g, or t
  Promoter: Source sequence=SeqID_12374; Location=1454..2456; Strand=+; Gene=SeqID_75979
gaattttcggggactgggaaacgatccgctccggggtcagtggcaggtgaccattggtcatcaatgcatcctatggctgctcaattgtaaagtgtattattttttacagattgttgcacaagaagaggaggaccaaactgttggtgaagtttctcctataacggtcggttgttttccattaaaattaataattgttggtcactaatttttatgggcccgctttcccgtcgcaaaagcaaaaaaataaaaggtcctcaaactcgaagttgagaccacttactaattgacctcccatgacattctttcgtaaacggtctgacagacagactgcatatgaatgcgttaatcgttatgagaaaaacaaatttgtccccatttttggtctttccattggaattgatgaccactggtcattggttaatccgatgcacttagtacgaatctggcctttagcaaactcaatttcgaacccgaacccggattcaaacattttttgaaaatttaaaattctcattttttataaatattgcttgttgaatgcagcctatgtctttttccgtttttatatctgaatcccttggttttttcttcatctttattgtacaattcggtcaattccttggtaatagtatcggtggtagcaaatttccaaattgttttctcgagtgttggaatcagggttcggggtttgatattgagcctaaagaaggtcagattcttaataagcgcctcggattacccctgaaaataattttctaaaaacttatttaaatttttttcgggaccaataatctctatcacttgcgtaatcgtttatgagaaaaaaattgtccccgtttttctttccattgggaattgatttttgcatttgttccatttgctcttttccaacccgcagaaggngaggagacccattcaccatctctgctgctatagccaccatttacccaaaccaaagctaaaattattcccattttcgtataattgttaccctgaagccatg

SEQ ID NO: 113932 - DNA, 1003 bp, Heterodera glycines
  Promoter: Source sequence=SeqID_15990; Location=832..1834; Strand=-; Gene=SeqID_80348
tcagttaacaaattgattatactcctctgatcaattgatcaatgaggcaaatgcgcaatcagaaaaagaagtgggaatcgaaagaatttttgttattaaaatttaattgtgccgaaagcaccgcaggaaaatacttaactgaagaaaagataatcacgaaattggacttcaaattcgtaaacaaattaagtttttgataaaaaaaacgaaaaagcaaataaaatatgcgaaaagtgatgcaaatttaattaataattaatttattacacttttaaaattcaagcgttaagcatttatttgctgcctttcaatcaccccaatttcaaaaaactttgtgtttgtaatagtttttgggctgcaatctttgcgaacttttgccgttttttatttcgttttatccgatcagtcatcacacaattgacacttttatggtgacatttcgtgttttattaatccatttaaatgattactaatggccattttgcacctttctgctgcttactaatgcattttggtgaacaaagtcttttggggggaggccaaaacagcgcttaaaaagggcacaaattgcagcgtcaaccaatcaaaatcaaagaaattagtccaaaattgtccccaaacattttacttgacggaaattggtaaaaccccgcaaaattatgcaactctccgcaaatgcgaagctttcgacgacgtcgctttttgctgtgattttttgtttggtatattaatttgaaaaaaaacatttgtcggcttttcgttttttgtttaggcatcacttgccgtctgttttgaatggaagccgccggatgtaaaatggggggggggggggaggaagggaggaagggagttgataaaactcacaaaaatgcatgtccccgtttttcgtccattttccacgcattttaagcttggcttattaagtttccttctaaacaattcggctaattaactattaattgtttattattttttaattaggcgtgtaatcatcccaaagatg

SEQ ID NO: 113933 - DNA, 320 bp, Heterodera glycines
  Promoter: Source sequence=SeqID_14619; Location=3085..3404; Strand=-; Gene=SeqID_78700
aaaagtcaatgatttttaaaatttgagttcatattcgtgaccagcgtattttttaaccccaaattcattgctaaacttttttaaaaaaataaatttaaaaaaatcaattatgtagttgacaaaaaatcttagataaaaatcgatgattttcaaaatctgagctcagattcgtgatcagcgccttttttaagcctagaaaaaatacctagaaaatttttaacatttttcgtcgggacaccaattctagaccattgcctcagattcgttatcagcgaccctgaaaatccccgtaaacatgtttccatgactttttagacatg

SEQ ID NO: 113934 - DNA, 601 bp, Heterodera glycines
  misc_feature (113)..(113): n is a, c, g, or t
  Promoter: Source sequence=SeqID_29170; Location=1..601; Strand=+; Gene=SeqID_59711
tagtttaaatattttttggactgagcgcgcaagcaatgaatgtgggtagaattttcgcgaatgaatgggagaaatgcacttttaggtggaaatggacggctatttatactctntaaagtgggcggggctaaggtaaaaatggtctttggcaggttgccaactaaattgttcatgctatgccacactacactaaaatgagtcgccttctgatcaacattttatgccatccacggtcagtcattagcggttaaatgaccaccagcgggcgctcagatagcctctgcggcgcttaggtgacacgtgcgagcgctcaaaaaaataacgaaaaattaaagtttccgcgccaaattcaaaattttgaccccggttattatttggtaagacttggactcagcccacccgaaaaaatgacatgaatttgttataaaactgtttaatattgaatattattcacaaaaatgtatgaaaaagtggcgatatatagtgaaaatttttttatcaacatttgaaatttttcaaaaaacgtcatttttgagtgaatttatcaagaaatatgctgttacacatctatttaatactgtatttttagcaataatggatg

SEQ ID NO: 113935 - DNA, 360 bp, Heterodera glycines
  Promoter: Source sequence=SeqID_20028; Location=2228..2587; Strand=-; Gene=SeqID_84803
gcgagcgaaaggaatgacctactaaaaaaaaggcaaattgcgggaggcgggatgcaatggcataaatatataatatttatagattaaaaatatttcaaatgtgtcattgaaattagcacacattgaccggcattaaattgtatgtaattttaacccttgccttttgtgtgccccatcggatgtaacaattactatttttccgcccttattatgctatccaaatttttttaataaattaaatttcctacgaaaaatggcttcgcttgtacactaaatacataattttccaaaaatctttcatacaaattttttaatttttggtattttaatttttattgtatttttatttcagcaaaaatg

SEQ ID NO: 113936 - DNA, 1003 bp, Heterodera glycines
  Promoter: Source sequence=SeqID_10785; Location=452..1454; Strand=+; Gene=SeqID_74041
ataagagaaatgaaatacaatctgccaagggagtacctgatagtggatcatgaatgtactgtaacttattggtcaagaagaaacgtgatgtatcaaaataaagttttttgccccccggtggaaaaatgtgattcaataaaaattttgagttgggacatggttttaaatccagaatgctggacgaaatggacagaattattaattggtgtaataatgttatttatgttaattattatttcttgtatttattggtgtgtaaaatcaatttatgctattttgaaatttgctgggtcatgtttatgctttccattcaagataatgagaaaattttgtttaaataaaaattttaaaactgaatcggaaatgagtctactcgcatcaaatgaggaggataacgagaccaagaccaaagagtggataaaaaaaagagaaaccggcggttaaaaaggttgagtctaagtacaaaaatgggttctacaatgttatttatgttaataattatcataatatcgattaaaaatgttaatgctggggctgaagtagcagtaattcaagcatcatctgaagattgtattaaaaactctaatggcactttgtgtcgggttaggggagcagcagaaatgacaatcctaccagcgggccaagagatatcattagcattgaaaaatgataaggctcaagtaaaaggttcaattaaagtcagactaaaatcattaacattaaaatgtgtccaagagacagttgcttggctaagggaatataaaataaaagttaaatcagcaagaagatgccctacgatggggtcgtgcaaaaaagggagatgcgcaaacatccgactaagtgaaaaactaagagaattaaaaaattattggaattatcctggtaatacttattgtatggagggagagtcaatttggggttcaaaatgtgctttaccatcactgggtataaatgaatgcttcttttataaaataattgcgataccaagtacaaatacagtatg

SEQ ID NO: 113937 - DNA, 935 bp, Heterodera glycines
  misc_feature (169)..(169): n is a, c, g, or t
  Promoter: Source sequence=SeqID_8536; Location=1967..2901; Strand=-; Gene=SeqID_68427
tcaccaaattccaccttcctttcttacttcccctgtcgggggctagggggagggggggggggggggggagagggttgactgtgacttgactgacgggctctgctgctgtgctgctctgaacatggtgtggatgtgatggaatggggttgggggcggttggggtagtccnccttctcccgtcttcccccattgactgtccttccctctcctcttccttccctttcctccctgtccgccattcaaaatcattaatcgcttagggctctgctgctgggtccctcccttcccctccctcccctccctcttctctccctgtgctttctcctcccttccattccattccctcatcaccaatgggatgatgatgataaaacaaaaagatagttgttggattgttttgtacatatatgtatgtgtgtagagttaggttgtggtgtggtggagtggtgtggatagggaggaggaggcaaaaaaataacacacatttagaaaattttcttcactttgattgtgactgactgactgcttgcatcatttgtctttctcgaccaccattcgaccgacccctccttttccctccccttttctccccttttctttgctccctgtctgctcccccttttccatcactcccaatgtattagcaatgcttgtctttttaagtgaaaaaatcatttttttcgattcattgctttgcttacattacacgaccattcagtgccagccaacaccattgccaccactcattctcattcattttttccacttcgatttttaatttgacaatttttttaatgcgcttttctgattgctttgtgtttaatatgttttttaatgctatttgctatttcattttgaatttcattcctttcatttttagtttttgtttgattttacgcaacattaattcatcccaagttgtgcgaacgaaaatg

SEQ ID NO: 113938 - DNA, 135 bp, Heterodera glycines
  Promoter: Source sequence=SeqID_21997; Location=2180..2314; Strand=-; Gene=SeqID_52634
ggttcgtttttcagaaacaccacaatcccttggttttttcataattttcgttacggccctgcgtcattaaagcaaaaattaatttagagcaaattttttcatttctatgaatttaagatcgacacactttgcatg

SEQ ID NO: 113939 - DNA, 1003 bp, Heterodera glycines
  Promoter: Source sequence=SeqID_4227; Location=206..1208; Strand=+; Gene=SeqID_53678
ttatagggcccggattggctacacctcttttgagattatcccattccgagactcagtgagaatgccaccttacggagcctcgacatttgcggccccgacatttgcacctatgtccaaaatcggattcgaagtaaaattttttcaagccctgatagccgaaatagcattaaatttaaaacacattaccttctagtttattaggaacattaattcatgatcaaatgatcggatactgtggaatctgccattcgtaattttaaaccatttttgtttttcgcctttttgtcccatcccaggccttctggccgtccatcatcctattcatccaaaatttccttccttttccaattacctatttttatgacatttccccaatctctcttggattcccttcactcacatctcactcacaatttgctatgtaatatccttctgttcgcccctcccaatttgtggcactatttaagcctttgcttctctcattcagcacctttttttccccacacattcccaacttcagacaaatcctaaaagcgatctttttcaactgttaattaatttctttgcatttaatcacatttaacctttcgttttacctttgctttctgacttaaataaactcttttccaaaaacccttggtcaaaggaaaaagggttaagaaccgggaagtccaagtggtttggacacaacaactttttggtgccacgacccgggacccctaaaaaggaatttaggggaagcaaaggccaagagccgaaaaaaggctaagtgccggaaattttgagctggtaagagctgtgtgcttccagccgggctaagtgccaacaaacgagtgaatttgagctggtcaagctgcgtgcttccagccgggctgagtgccaataaaaacaacaggaaaagagctggtaaaagtgtgtctttccagccgggctgtgtgccgtacttttgaaaaaaaagtaaattacgctgtgtgcgcataaaaagtaaaagagagagaaaatg

SEQ ID NO: 113940 - DNA, 1003 bp, Heterodera glycines
  Promoter: Source sequence=SeqID_16140; Location=1512..2514; Strand=-; Gene=SeqID_80504
gacatttatttccattttatatttttcatttttttccttttaaatttttccattttaaattttacattttacattttttccattttatatattttttattttactaggctgccattgtttgtgttcttctgcttggcgagtgctgattcattcttccgttcattcattcgttcttcccccccccccccactccgcctctgttttctccaatcattgcgcaattggccctcattttgatgggattttgggacaataaaaattttaatggaattgaaaaacgtaaaaatgaaattaaaaacctgtttttcccctccaatttcccattcagtgtgtttttaatacctcaacaatcttttcagtctccgccacaatcacctcaaacaattgtgaaaataaaacaaaatttggttaatttggccaattgtctgttttactttgtccaaattgttggccaaatgatgagaaaaggcggggaacaatccttttaaatacaacgaaacatttaaatttttaaataaaataattttggcatttatttaaatcagacatttggggcggagtcgttatttaaaaaaccatcaatattatttgatgaaaatttatttatatcttagctcaaaaccaaccaaatttttaattcttatatcattcgaaagccctaaccgttctctatcagtctacaaaatttcaaaaaatttcgttaagtttcaaaaaagttagggccaaagatgctcgaaaaacaaggtttttttgagttcctctagccaaaacttttttgaaacctaacaaatctttttgaaattttgtatactgaatagagaacacttagggctatcgaatgatatcaagaattaaaaatttggttgcttttgagctaagttataaataatttttcatcaaatcatattgatggatttttaaataacgacataacaccagccatttccccattttaatttcaattctaattttatttaatctatctgaatttaattagagaatg

SEQ ID NO: 113941 - DNA, 434 bp, Heterodera glycines
  Promoter: Source sequence=SeqID_3237; Location=4737..5170; Strand=-; Gene=SeqID_83833
aattgttttaaagatattttcgaatagataataattgtttaaccccaaactttttatgaagaaatcataattattttttggggccgagttgttgcggaaaattttttttcaattcttaggggggtgtattttctgaattttttcagggcgtttcgtaagggtgtatgttctgaatttttttttcatttttattaaggatttttccgaaaatcctgaaaaattcgtcaaaaatggcgaaataggcacaaaagcgtttttcgtgcttatccaagcgtattagtgcgcaaaaattttaggcatttgcataaaaatcggatccctacttattatcatttaattattttttgcttttgcgtagctctacccggacaaatgcgaacagttgggcgatgactgtgagccgactcgagaacttttactgaaaattcaagatg

SEQ ID NO: 113942 - DNA, 144 bp, Heterodera glycines
  Promoter: Source sequence=SeqID_35835; Location=1115..1258; Strand=-; Gene=SeqID_65303
caacaaccgattgtgtacagggctttccatctggtgagcaaagctcaacaaattcagcaaggcgaactgccagagacgcaatgttctgcctattggaaacaatggcaaaatgaatggaagcatgatccgaagctcaaggacatg

SEQ ID NO: 113943 - DNA, 1003 bp, Heterodera glycines
  Promoter: Source sequence=SeqID_3706; Location=4906..5908; Strand=+; Gene=SeqID_51550
tttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatgattgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaaaacaatgcgcgaaaaccaaatacggtttgaaaggcaaagacctcttgaagaatttagggatgaatttattgcttataaaatttaagaaaaaaataaaaattcgagaaaaggaaactgcatgagaatcaaaggttgtgggacataaaccaaaaacaggtgaaaagggaaacaggtgaaaatagatgaaaaggaaacaggtaaaaacaggtgaaaataggtgaaatttcacctaaaaatatataggggcgtgcatttaatggggcatattagagaatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttctttacaatgacgcgccgacacaatcatcatcctgacactatattgattgaaatcgaagaggacataaaatatcataatttttctgcgggggcaaaatgctttttgggtggcaacaagaaatagttgatgatgctaagaaaaatccgagactccaaactgaatttagagatgaatttattgtttgtaaactataaataggatcaagaaaaaaataccaattaaataaaaatg

SEQ ID NO: 113944 - DNA, 1003 bp, Heterodera glycines
  Promoter: Source sequence=SeqID_18821; Location=1395..2397; Strand=-; Gene=SeqID_83508
accctattagtgctttgctgtgccgagaaccggcaggcaatggatagctttaaatctgcaagaaattagattggcaataagtggttgtaaaaaacttttgggtaatgaattattttttgaagtgagtcaaacaccctattagtgctttgctgtgccgagaaccggtatgcaatggatggctttcaatctgcaagaaattagattggcaatatgtggttgtaaaaaacttttgggtaatgaattattttttgaagtgagtcaaacaccgtattagtgctttgctgtgccgagaaccggcaggcatcaagtggttagtgtgcttgcctttggtcattgggtgttgtgggttcgagtcccattaatttatgggcttttcccgtcaaatattatatttaaattattcggtttaaaattttattttttaaatgtttttcttataagaattttatgagtgagttaaaagagaaagaaaggcataataaaaaatatggaggagcaaagtacttttggataaaaattgattactttcctttctttcctttttttatatgtaatgcacactcacaagtggtctttaacctcgccttttcaataagcaaaaaatgtctcctccttttctttccccagttcattatcaattgtttccatttacatcatcagttttttactgctcctacttttattcaataaatatttccaactaaattattgctgttttaatagcataaatttttagtttttgcctttggtggtgggcgacggttcgggtcccaccttttctgggtgttttcatccattattttattacattttttgaatgattttacttttttttaattaattaagtttattaaaaataatttattttaaatattaaaaatattaattctttcttcctaatttaacccaaaaatctattgtttgaccttttttgtgcaaaatcatttaaaaaatggagacaaattaataagttacctaaacataaaattataaatattttatg

SEQ ID NO: 113945 - DNA, 1003 bp, Heterodera glycines
  Promoter: Source sequence=SeqID_5101; Location=2461..3463; Strand=-; Gene=SeqID_56912
tttttacgattttctatgcatatagatagcccttcttactaatcatccatcattcaatgattagaacaaaatttttttttgatcaatttacaaaaatgctggagggaaggatggactgatcaaacattgcccaatgattgacgactgactgattgttggcattacaaaaatttccccctcattttgttcattttccggcaacaaaatttttggcgactgtgctgttctttcattcttcattcagcgtcccgagaagtttctcaagagttttactacattattttctgtttgtttgtttgttttttgttaattcccgccacttaaaattgtcgtacattgccctccctcacccatcagcagcatgtaaaattggcttttccttctgcttcaacataatgctttttgcttgcttcaatctttacattagcgcaggtcgccgacttccaatttgtttaaatttgaaattttgaactttcattggatagcggcactgttaagtgccgtcattgtgtttcgaattaaaagggggttccaaaatttgccgcttttaccagtcttgattaaaatttgtgcgattgcggactgcggcaaatttttggaaaattcgaaaccattttttgggatttgctccaaatttcggcatttgattttcatggaaagttctttttaatttatgatactccatcactattctcaagaatattaataaagtcccgataataagttatctgagcgagtaatacattattctggcgcaaaaatttctggaataaataatgccgcaatttcggtccccaacggaataaataatgccgaaatttcggtccccgaaaattggcgtaatgcgggatgcaaatctggattatgagcattcactggtcccataaaccggttttaatcaaaattaaaatttaaaaataagaaaataaattttgagttataaacattttggaacaagtcgtgccgtgcccttcattatttaatggaagcaacagcaccaatg

SEQ ID NO: 113946 - DNA, 398 bp, Heterodera glycines
  Promoter: Source sequence=SeqID_13965; Location=2980..3377; Strand=-; Gene=SeqID_77924
tttttttttttttaattcagatttgcctatctgatgaagcgctattggatgccttctctttattggatgtttttgctcaatggctattgggaggggcccgctaacttaaggaaagccttcggattattctcaagaagaccaagtggaaaatgaggaaccgtgaaatcagattaaaatagatatttcgaaccaaaaattattttaaaaaacgcatcaagattttattttttaaatgattgataaattttttaaagtttctgttgtgctgctgctgcaacttgccactttagagcattggaatgcgattagtattaatacattgtgatctgtgattttacttctttttactttcctctcctcattttttgtgtgggcttttgatttgcatttccaaaatg

SEQ ID NO: 113947 - DNA, 166 bp, Heterodera glycines
  misc_feature (152)..(152): n is a, c, g, or t
  Promoter: Source sequence=SeqID_27165; Location=1..166; Strand=+; Gene=SeqID_57864
gatggacggcgtgggtcagcgacacgtacggccccatctgtcaatggcgccgggtgtgtcgtgcgtgtggacgtatcgcctacgtggccacacatcagtgcccacatgaccagccagccgacgatggaatctgtcggcgctgcaatgggccncacacccgtcgatg

SEQ ID NO: 113948 - DNA, 60 bp, Heterodera glycines
  Promoter: Source sequence=SeqID_37694; Location=1524..1583; Strand=-; Gene=SeqID_66695
ggtttgtgccaattgtccgttgtggcgatatttcgtcgtttttcaattttagtccaaatg

SEQ ID NO: 113949 - DNA, 368 bp, Heterodera glycines
  Promoter: Source sequence=SeqID_2983; Location=1243..1610; Strand=-; Gene=SeqID_82639
attttaaatagaatttttattttgaattacaaaaacagttaattaaatttgtcactgcattaagaaaatctcgattttttaaatttaatttattttttattttaaatttaataaaacatttaacgtaaaacattaaaaagggtagtgtactgtcaattcatgttgagtcaataacgtaaattgaataataaatttactaacgcttagtaaatgaaaagccgtttcaaatttaattatcattttcagaatattaaattagtgagacttatgttatttagcattcagcattaaaacaaatatttattgggacacaataacacaaatatatttttaaaaatcagctaaaccttaccaaaagcattgaaatg

SEQ ID NO: 113950 - DNA, 791 bp, Heterodera glycines
  Promoter: Source sequence=SeqID_9256; Location=570..1360; Strand=-; Gene=SeqID_70770
tttcccttgccaaagttaaaaaaatgaaaaaattttaaattttcaaaatttaaaaggatgaaatgtagaacaattaaaaaatgtaaaatttcctttttttaaattgaatctttgttttggaaaaacgaattttaatttcactaaaatttgcaaaattttacacaaattattggacaaattgcgatttggaaaatttttatggccaaaaattttaattttttaatttttttttgagaaattcattcttcccgcaaattatttaaaaggtttataattatagttttagcaacaaaattttgcacaaaattttttattttcgtttactccgccgtttccctccccccaccgatttgtgtacgtccgccgccgtcgcctcgtcggcttcgtttatctctgctgttttgctggcccatgcgcacgcactttttgctgataagggccaagcgatggaaatgatgataatgatgataatttgataaagaaatgaccaaaaaagagagagagttggggatgatgaagaatcaatgaagaaattttggattagagaaggcaaaaagcaaatggcacagatttgcttatgcaatgaaagtcaaaagcgggcgtatttggttgtttttaattttattagacaaaaaatggccaaattttgggtttgttactttcaattacaatttgaaaattgcgttgggaaatcaaatttatggcgttttattttaaacttatttaaaattttcaactttttttcgaccttttttgttttcaataatcatttgctaattagagccgggatg

SEQ ID NO: 113951 - DNA, 145 bp, Heterodera glycines
  Promoter: Source sequence=SeqID_6546; Location=4693..4837; Strand=+; Gene=SeqID_61962
agtaccgtatcgggcgtacccgcagaacaatgcggatgttattatgcaggaaattaataagttggggcagagcggggacggagatgaaaataaaatgctgttgctctcggagcctattacgatgaaaattacttgcgttacaatg

SEQ ID NO: 113952 - DNA, 258 bp, Heterodera glycines
  Promoter: Source sequence=SeqID_1157; Location=1234..1491; Strand=-; Gene=SeqID_68981
tatggtaaaaaagcaaattctgtaacaaaataaacaaaaaaaaaatatgaaaaaaaaggtgaaaaaattttcaaaatagtgctctttgcaagtagcgccgaaaggcgagttttgaagaatgaataattttattttaaataattttaattaattttattttatgtattttatttatttttttcctacattagttcctttaagcttgtgccagcacataaactcattttgaaacacgcgtccgaagtatttgaggcaatg

SEQ ID NO: 113953 - DNA, 430 bp, Heterodera glycines
  Promoter: Source sequence=SeqID_7725; Location=1412..1841; Strand=+; Gene=SeqID_65753
ttgtaagaaacactgaaacaatttgagagagaatgaaaaacagtttggaaagaacaattgaggggagaagcataactaactgagtagaacaaatggaggtgaattggctttaataaggcattcgggaatgaccttgagaggaggggaaggacccgggaatggttttaagtgcgggagcttcggggggggggagggaaggggaaagttgagaatgagtccgcccattctttgccagtccttggaaagcaaacattaatctgtgcgttttgcaacgtctaaagtactgtactcccggggagggtctttttctacgcggattttgtcattatccgttcttttccctccgggtttttcgcattttgtactaatctctgattcagcgccgcccaaagggattcattccgttgcattaaagcgaaggagcaaaatg

SEQ ID NO: 113954 - DNA, 283 bp, Heterodera glycines
  Promoter: Source sequence=SeqID_42568; Location=159..441; Strand=-; Gene=SeqID_70429
accaattttttaattaattaatataaataaacttttaaaaaatatattttttttataaatctatgaataaccattaaaatttattttgagtttcgcaattttgcctaataaattagaaattttttataatatttaacgtgccttgaagcttttaaatcagtttttataatagtacttttgtcaccgctttttcattttaacaaaaatggttttatttcatttgataaattaaatatgtaatccttgttaattatataattaatgttttagttacaaaacaatg

SEQ ID NO: 113955 - DNA, 166 bp, Heterodera glycines
  Promoter: Source sequence=SeqID_6211; Location=486..651; Strand=-; Gene=SeqID_60725
aattattaagctatacattgggagcaggaaaacggctttctctgcttttcgaatggaataaactgtttaagccattctctcgcttttctttggaggaaaatggtgataatttaattatttatgttttaatatttcaaatttggcattctccacaattctcaaaatg

SEQ ID NO: 113956 - DNA, 782 bp, Heterodera glycines
  misc_feature (51)..(52): n is a, c, g, or t
  misc_feature (91)..(91): n is a, c, g, or t
  misc_feature (110)..(110): n is a, c, g, or t
  misc_feature (115)..(115): n is a, c, g, or t
  misc_feature (121)..(121): n is a, c, g, or t
  misc_feature (132)..(132): n is a, c, g, or t
  misc_feature (135)..(135): n is a, c, g, or t
  misc_feature (144)..(144): n is a, c, g, or t
  misc_feature (186)..(186): n is a, c, g, or t
  misc_feature (196)..(196): n is a, c, g, or t
  misc_feature (201)..(201): n is a, c, g, or t
  misc_feature (230)..(231): n is a, c, g, or t
  misc_feature (239)..(239): n is a, c, g, or t
  misc_feature (241)..(243): n is a, c, g, or t
  misc_feature (257)..(257): n is a, c, g, or t
  misc_feature (260)..(260): n is a, c, g, or t
  misc_feature (271)..(271): n is a, c, g, or t
  misc_feature (273)..(273): n is a, c, g, or t
  misc_feature (276)..(276): n is a, c, g, or t
  misc_feature (278)..(279): n is a, c, g, or t
  misc_feature (281)..(282): n is a, c, g, or t
  misc_feature (286)..(286): n is a, c, g, or t
  misc_feature (288)..(288): n is a, c, g, or t
  misc_feature (292)..(292): n is a, c, g, or t
  misc_feature (296)..(296): n is a, c, g, or t
  misc_feature (308)..(308): n is a, c, g, or t
  misc_feature (316)..(316): n is a, c, g, or t
  misc_feature (319)..(319): n is a, c, g, or t
  misc_feature (322)..(322): n is a, c, g, or t
  misc_feature (325)..(325): n is a, c, g, or t
  misc_feature (328)..(328): n is a, c, g, or t
  misc_feature (335)..(335): n is a, c, g, or t
  misc_feature (340)..(340): n is a, c, g, or t
  misc_feature (350)..(351): n is a, c, g, or t
  misc_feature (355)..(355): n is a, c, g, or t
  misc_feature (362)..(363): n is a, c, g, or t
  misc_feature (370)..(370): n is a, c, g, or t
  misc_feature (372)..(372): n is a, c, g, or t
  misc_feature (378)..(378): n is a, c, g, or t
  misc_feature (381)..(381): n is a, c, g, or t
  misc_feature (393)..(393): n is a, c, g, or t
  misc_feature (396)..(396): n is a, c, g, or t
  misc_feature (398)..(398): n is a, c, g, or t
  misc_feature (408)..(408): n is a, c, g, or t
  misc_feature (425)..(425): n is a, c, g, or t
  misc_feature (441)..(441): n is a, c, g, or t
  misc_feature (453)..(453): n is a, c, g, or t
  misc_feature (459)..(461): n is a, c, g, or t
  misc_feature (471)..(471): n is a, c, g, or t
  misc_feature (477)..(477): n is a, c, g, or t
  misc_feature (479)..(479): n is a, c, g, or t
  misc_feature (484)..(484): n is a, c, g, or t
  Promoter: Source sequence=SeqID_12093; Location=4663..5444; Strand=-; Gene=SeqID_75652
gaacgaaaatttaattaaaaaaattcctgcacacgcctcccaggttaacannctttgattgtttgagatgaaatcttcttacttaattttnattttatttaaaaaatagnaaaantttttngatataaaagntangaaaaaatnttaaattaaatataaattttattgaaaaatgataaaaaaaanttaaaggttngtttnaataaaatttaaaaaaatgaagaattggnnaattattntnnnaatatttttgtggnttntggtggttttnanatnannannattngntggnagtnaaaatttgtggnaatggganaangtnaanggnaaatgtnaaaantttgggtggnnaagnggttggnnttataananggaagnagngtgtgagtgggntananttgaggtttnggttttgattttttggnaatatttaaaaaaaantggattaagggntatgannnggtttttttntttggnanaaaanaaatttttttttaaagcgcaaaaaaattcacaaatgaacagaggcggttgctggcctttttaaaagcaattttatttttgaacatgtctcgattaaataaaattgaaaatttgctctaagcatatagagagttagttatttttgagaaaattttcaaaatttttcattgtgtacttttcgatttgcataactcgcaagcaggatgaatctgtgccaaaagcccagtccaagccttagtcaaaattaagaatttttatttcctcttgtctaatgttttttgttttgtttcagaaatatg

SEQ ID NO: 113957 - DNA, 1003 bp, Heterodera glycines
  Promoter: Source sequence=SeqID_10853; Location=1087..2089; Strand=+; Gene=SeqID_74129
aaaacctctattagaacggcccccagcagctaaattagcctttttgagcccaaaacccgaaaaatttttcaaaaaatcattttttcgccaaaatttctcgagaatattgaataaatttaaattttcctaaaaattggttaatttatgtgaaagataagcaaaaaatggaaaatttcggttttttggtcgggtttttttgaaaatttacccctcaatttagaaaaatttatgtccatatttttgccattttatgtccatattttgagatttttaccattttatgtccatatttcgcgatttttagtccatattttatggccatatttcgcgattttatatccatatttttaccatccctagttatgaaaaagtcaaactatctaaacgattaaaatggaaaatcatacataattcgtgctatgccaactcgtaaggctccctgatgtttcgtcactgaaataaaaaaaataaaaataaacactatgccatatacttaataaaatttttgaacaaaaaagcattaaatttgtgttaagtggtgtgatatttcacatacataacacaccatcccgaaaatgagctcttgtaagagtttttggaaattggcaacaatttgaaaattttggtatcattcgaaagcaattgatgagaagaagctttttctcattaaatgctaaccgattggatgagttagaaaaaagatatgggcgttcgaaaattagttttttgaataaattttcaatgggtcttgtcccgcaggtttttgaatccggcaaagagttgttacaaattgttgtgttgcagataaatggactttcttaaggccttttcacataatcccgttgaccgttacattatagtaatcggatacaatgtgctgccagcgaccaaatctttaaacattcgcttaacaaatgcttaacactgggggtacttccttgttttgctacgcctccctccccaaaatattttaaaaaatcacagatattttgtccagtctatg

SEQ ID NO: 113958 - DNA, 292 bp, Heterodera glycines
  Promoter: Source sequence=SeqID_8622; Location=2427..2718; Strand=-; Gene=SeqID_68702
taaaacctggacaaagaaaaccaaatgtgctgagaattgaaccaacaagaaggccgaatttggaagaggtcaaattgctgaaatcgccacgacaacccgtccaactattactaccactaatattccaccgacaattcgtcccgtctctacaacgcgtattccatcgacaattcccacaatcgccactcatactccaccgacaacccgcccaatcgctaccactaatattcctccgacgattcgcccaattattacgactaatattccttcgacgattcgcccaattactatg

SEQ ID NO: 113959 - DNA, 848 bp, Heterodera glycines
  Promoter: Source sequence=SeqID_5669; Location=1..848; Strand=+; Gene= SeqID_58846
ggacctgatttttaaggaattcattttaaaaaccaaacgaatttttaaaaatcttattttattacattaacaaaaaattgtattgagtaaaattagttaagccattgttttttgaaatatcggaattgcacatggattttcggtaaaaaatgtattgaaaggatattcagagatttatcccggactgatagaaaagtccccaagtttgaactccccctgctggaggaatgttagtatcctcaggcttttttcggcctcctatttagctcctgttgtttacgaatttaaaagtttacatcgactaaattaaatttttggcgtgaatttgaaaaaaaaatgccattttgcgctcaagccgactccaactgaatgcaagcgccacatggcatcattgccttgccggacttgtgccggacatgcccaaccctcgacctaggccgatcggctggcacaccctttacaatgcgaatgggggcgcgaaacagcgccggcgagcagacaacgaaactgcgttgtcagccattatatatgctgaaaatttgttgttcttttttccgttggggtgtaaaagacgcgaggaatgggtggcagagggacccaagtcatgcactatttctccactgcgctgttttctttggttctggtcggttttatgcgtcccatgaatgttcatcctcagcttcgtaggccataacttttttctaacttagtcaaatcttacattattggtatcaactataagaaaataaataattaagacattaagaaagaattacggtaatagttacggtggttgcccccctttttcgaagagttttttttttgttttctgaagtcataaaaacatg

SEQ ID NO: 113960 - DNA, 95 bp, Heterodera glycines
  Promoter: Source sequence=SeqID_28132; Location=1..95; Strand=+; Gene= SeqID_58787
atacatcttgaatgcctaaaggctggggtaaaatttcaaatattttttctagatttacagaattatttttatttagccttgacaaattatctatg

SEQ ID NO: 113961 - DNA, 70 bp, Heterodera glycines
  Promoter: Source sequence=SeqID_2358; Location=375..444; Strand=+; Gene=SeqID_79312
aaccaaaaaatcaattttttaatgtgttagggagtccatgtttgacaaattcataggcaaacgcaaaatg

SEQ ID NO: 113962 - DNA, 90 bp, Heterodera glycines
  Promoter: Source sequence=SeqID_40881; Location=1276..1365; Strand=-; Gene=SeqID_69111
taggggaacgaattgccgtgccttggcaaacttggcctgcccaagccgttggagtgccaactgtggcagcggtggtgcacgcgcgtaatg

SEQ ID NO: 113963 - DNA, 596 bp, Heterodera glycines
  Promoter: Source sequence=SeqID_39946; Location=1..596; Strand=+; Gene=SeqID_68396
gcaatttgctgcaaatgcagctcccctcgtccaaattcgagctgttgacccaccagttttgccgtactttgttgtgcataaaattttaagtggttcagttttgttcagggataaaaacattgccaatagtctaagcaataacaaatttacactccttgaacttatttgttagctttatttcaaatgccgataatttttttgtttgaaatgtttaatcctaaacccgtagcgaaatccccaaatatggttttttgtgcgggatcccgcaggagccgcccattgtatttttttattcaaagaacattaagccaagtacctattttttgaatacctatgtatttgccataaataaaatttagtcattaatcggcaacccagcagttcttccctcactagcgtgggaagagtatataagtaagaaattgttagggtttcttccatttgccttattctccaatatcagaatttgcctccctatttggctcttccatttgccttattctccaatatcagaatttgcctccctatttggctcttccattgccttattctccaatatcagcacttgcctccctctgccgatattcgtccaaatg

SEQ ID NO: 113964 - DNA, 138 bp, Heterodera glycines
  Promoter: Source sequence=SeqID_34079; Location=403..540; Strand=+; Gene=SeqID_63961
tttgcaagtacgcttgctgaccttggcccagtctctggttgatggtcaatttaatcgtggtgaattgaccaaacaacggagacttttgaaactttgcacacacggtcaatgacctctatcaccgtgttgtgaagcatg

SEQ ID NO: 113965 - DNA, 168 bp, Heterodera glycines
  Promoter: Source sequence=SeqID_22910; Location=1312..1479; Strand=-; Gene=SeqID_53613
tcttcaaaattaacaacaatgacaactattgccttttttatgcactggaactgatgcgctactactcattatatatcaggggagtaatttcaaggaaacaatttagatggctcaaagataatcaaacaactgttctttgtcaaaaagtactacttttactccgcgatg

SEQ ID NO: 113966 - DNA, 132 bp, Heterodera glycines
  Promoter: Source sequence=SeqID_32211; Location=962..1093; Strand=-; Gene=SeqID_62532
ttttcttgaaaattataaaaaatttttcattttctaaaaaatatttaattgtaaatttgaaaaaagattttgggttggtggtgtggaaatgtagttaattacttatacatttagtttctagaacatttaatg

SEQ ID NO: 113967 - DNA, 857 bp, Heterodera glycines
  Promoter: Source sequence=SeqID_4176; Location=1..857; Strand=+; Gene= SeqID_53479
agccatgtggagacggacaaatggcatattagtgaaaactgtggttaaatggcataagttaaggctctattacagtttacacggccataaaataatttggcaattttaatgaaccatattaatattcgagacattatttgatagcccaaagagtcttctctattagtcatacaatggaacattcccaactgatgagtgtccaaatcactttaaaaccacttatcgtgtagagcatagtcgatttgctactgtaaattttcggcttttttttttttgctcttacccccaattcatcagaaaaattgatcaaatgttttttagttatttattttgttatatgatagaaaatttgaacgatttttgctgatcagttttggcgatcagggccaaaaaagccgataatttacaataaccaatcacctctatacttatggttaacatttttaaaattcaattttttgaggttttctgaccataacttttttgaacataacggaattctttgcaattttgcaggctaatggaggaatataagagctaccaaatcatattcatccaacaaattttatagtcgtgtctctttttttatgctcgcaatagagccataactttatgttttttcaatcatcattgtgatcaatcaccttctgcatcaagaaatatttgaaatgaaatactttttggatttaaaaggcggaaatgggaaaagaatttgctttatccaaatccaatcgcttaatttaaattttggatttcaagcaaactaattggaccaatattcccgacaaaattattgcgcagtaaaaacatacttctacacatttacaatcaaaaagtaccgtaaagtgtgacggatg

SEQ ID NO: 113968 - DNA, 382 bp, Heterodera glycines
  Promoter: Source sequence=SeqID_7096; Location=2807..3188; Strand=+; Gene=SeqID_63827
atttgtgaaaaaatgcaaaaatttttttcgcagagttttattgtttgggcgcgaatcatttggacgctttgcggacagaatgactgagtgtttcggtgacggaactttctcgctcgcgccaacccaattttatcaaatttatacgatcctggcaaagtctgttcgtcttaaatcggttttcaaatttgtaaattaaaatatttagacgtgaaaaatggattttcccagtgtgccatgccctaatgacttccaaatcgcaaacatcgtacgaaagaatgtttacacttttgcgtgctgcgtggccaaattttgctcccatttctttttccgtggcttttgaaatggccatgtcaaatgccgttacgacaatctttcccggatg

SEQ ID NO: 113969 - DNA, 602 bp, Heterodera glycines
  Promoter: Source sequence=SeqID_16627; Location=861..1462; Strand=-; Gene=SeqID_81037
aaaatgtaaaataaacattttaaaaataaattcaacaataattttaacaataaaaaatgtaaaaattaacagaaattcacgggttcataaggtaatttggacaataaaacaaaaaatcacgggttcattcgatagttgcgagaaattccccggagaaactccaaaataatgtgaaattgattttttgaattcgcatctccaaaattttgtcatcccatcagaactcatttagcgaaggtgtaaaagtggccttcgtaagacaattttactttttgttttttgtgttggatgtgttgatatttaatattattaagtttcgacacgaatacttttattgattagttatttgttgatgggtccactccgaacgggtccactgcgtttcggcgccggcgtttcggcgctggcgtttcggcgctggcgtttcggcgccagcatgtttttggctataacttttttctatgtaatccaaatccaacattgttgatatcattcgaaagcttaacatgtttagaagctttttctaagcgattgcttcgcgattagacaattgccttcgagcaggcgatggtcaacgccctccgtgccaaacatccacaatg

SEQ ID NO: 113970 - DNA, 629 bp, Heterodera glycines
  Promoter: Source sequence=SeqID_423; Location=4103..4731; Strand=-; Gene=SeqID_52150
ttgggttgcactgtatattccgcgtttgaacaccatatggtattttgatagtttggcccttcctgttgcttttaacgtacagaaatttctgtcccacttccctcatgtcagtaaaaacaaaatggcatttcaatctcccacctcagacgtttgtgggcactattgcatattttttatttatttggcttcaaccggaatgttatatgatgaaattttgaaacaactgaaattgtattgtgtggattataattgtgacattgcaattaaaaactacgtgaataaaattttgttttatcttcttggggggagccttcaattagtaaaggtggatgattccgaatcatgatttaaaaatataccagctagtgccagtctctgggcattggggtcaaaaggcgtcagctgacacatttctcctgtgtctatctcattttgatgcgtcagctgtctagcattttagtccttaatttattagagaaaaagaggcattgagtatcgtaaaaagagaggtattgagtatcgaaacgattcattcataattttatggaaattactgctagtacggggtataaattaagtgaaaaattcaatacaacctcatttattggccaattccaaaaatcatcatg

SEQ ID NO: 113971 - DNA, 397 bp, Heterodera glycines
  misc_feature (6)..(6): n is a, c, g, or t
  Promoter: Source sequence=SeqID_13115; Location=3432..3828; Strand=-; Gene=SeqID_76913
gagaanatagcatttttaattgggaagaaacaatttgtggggagatgtgatgtagatttggaatttaagtttcatttggaaactatcaagttttcatcaaaataaatttcatttatttgtagcaaaatatttggactttctttattgctctattgacaatcaatttgaaattataaagaaataaatttttaataaatttctatgcatataatgaataaaaaatatatattccagcgaaaacatacacaaaaattcatatcctaggtagaataaagcatttgagataaattttgctttaaataaaaataaattaattgagattcaaatattattttattttatatgcagaataataaatcataacatagctcaaaatttaattcagtttttagtgatg

SEQ ID NO: 113972 - DNA, 467 bp, Heterodera glycines
  Promoter: Source sequence=SeqID_28304; Location=1..467; Strand=+; Gene=SeqID_58930
aaatttccgactttttatcaaaaatttctgaaattggaaatcggaattccgacgtccaaaattttttcggaagtcggaaatcggaattccgtgccatccctggtataatgtacctaaatgattagatttcgactgtatacattagaatcgatgtcaaagtagacagtgattgggttaattaattttttttaatcacccgaaacaaaactttgattttatatccggtaggtgagtaatgtcattgttcatctaatcatatcacaaaaattggcacatttttagggtctgacggtgccgataggcgcaagggaatttgaaagttccagtataatttttgacaaatttatgaaattgcctcctatttttggtcacatttaaaaaccagatttaaaatatatcaaattttatgaaaaattttcagatagttacagaaattactgctaataaattttctcagcaaaagaatg

SEQ ID NO: 113973 - DNA, 376 bp, Heterodera glycines
  Promoter: Source sequence=SeqID_1379; Location=1519..1894; Strand=+; Gene=SeqID_73142
atcggatcggtcaaccactgatcaggattggaccgaaccacaggaaaccccaaatagtcagaactcggattttggtccgagtcaaatcgagaggtcgggaagcctgagcagcattccgactatttacattatttttttcactattttttattgaaaatgtaatgtcaattacggacactttggaatgtccgcttaatcatataattaacaagcaaatggttgcctgtgttcctcagaaatgattcagtgaatcatctcatacttactggaaacaccagtgagctcctccttcattcagagggtcgggagcaatcggaccgtatttaagcagaaaagtgaggagggagaaatcacttctcctttatttccaaaaatg

SEQ ID NO: 113974 - DNA, 126 bp, Heterodera glycines
  Promoter: Source sequence=SeqID_37522; Location=482..607; Strand=-; Gene=SeqID_66571
ttgccccgattttaaaaatgagatttgatagatcactgataaaatttgatcagatccctaagaaattttggtcaaagcactgataaccattctgatcaggttgctgtgtccgcccattggctgatg

SEQ ID NO: 113975 - DNA, 365 bp, Heterodera glycines
  Promoter: Source sequence=SeqID_36150; Location=1..365; Strand=+; Gene=SeqID_65544
gagagagagagagagagagagctgtttgatattccccatcctttccgaggcaatccctccattgttctcttcctccctctccatgtccactctagcgcaccattgtgcggaaagctatcgacggcaatcataggattggattgcactggtcaggggggagggggcggcaagtggggcgcggggggcgacttgccatgtccgccggaagaggcggggccaagccgacggccggcgatttaagagagcccggagactgcgcactttgcatcggaggagtggccaagcaaagaatgcgtaggactgtgtctggcaaaacaattcccaaccaaaagaacactcggcccagcacaaattccatcagaatg

SEQ ID NO: 113976 - DNA, 351 bp, Heterodera glycines
  misc_feature (75)..(75): n is a, c, g, or t
  Promoter: Source sequence=SeqID_11597; Location=956..1306; Strand=-; Gene=SeqID_75048
ttttgttttttccaatttcaaattgcccaaaagacgatctactaagaagcgacacacaatacaatacaaaatagntaattatccattattcgatcgggttacatttttcgattttgcataccgatgtgttgttacagttacatataagcattgaaaaaaccatttgtctccaaataaacaaattttaatgttcagagccaaagtcaatagtgacagattttatgaaatccgcctttttgattatttttaaatttatttgtgatgagataaatataatttaataataacattgatctattgtatgacaagtacaacaaattaaattgttcttcgctgttcagcaaagaaatg

SEQ ID NO: 113977 - DNA, 405 bp, Heterodera glycines
  Promoter: Source sequence=SeqID_9803; Location=814..1218; Strand=+; Gene=SeqID_72749
ttcatctgtcgtcccgttgccttttctatcctccctttttttcttcaggccacactctcttccgcaatgagtgccttccgcctcgggcattgccaataagcattgagaaaattcacactcattctgccctttttgcgccccaatcagcagtgatggacagtccatcttcagtcggcacaaatttcgaccccaatttacaggatccaatcccatccaaaaccgtttcgcccggggcaatgtgtcggttggtatttagtctgccgatgtttcacgtttattttcctccctttttgtctgtcattggagtgtccctatcgtacggaatgtgtccgtggcgtgtgccgttgtcagaaggatgaaaccatcgtaaatggaatgtgtcggaagaccatacacgaggtaatg

SEQ ID NO: 113978 - DNA, 884 bp, Heterodera glycines
  Promoter: Source sequence=SeqID_9513; Location=137..1020; Strand=-; Gene=SeqID_71703
tctggaaaaaattttgttgtcatttgtagatttaccaagggtaggatcattcattattaatggtgtatcaatcgagtttttgaatgggaaggcttttaaagcggtgccgaacggttgcgccgggcaaaatttgaaaatttttgggatttattaacaaatattaaatctatttttaagaaaattaagtctcagtcagttatagtctcgttaacgaaaaaaaaaattaaaaataaccaaatttcttagaaatgttatctcaaaagctattcatgatctttttctatgcataatgacagaaaatttagcaccaccgctaactcttgggctaccgtacaccaaccaaaacaacagcaataatgccgaaaacggcaaaggtgccgaaattggtgatgagggcattgtttcggatggaactcggcgaaacaatgccaaatgaacagatcaaatgaaatctgatgagagaaccactccactcattaaagtcatttattttttaattttaaacaatttcattaaaattttccatttctttaatattatcatttcaaattatatttgccattttaccaatttagcaattgattgttggccaaaataactaatttatcaatgggcgccgtagagaaattaaaattgtaaaatataaaaaatttctatattacgcatatcatttgcgtatatccaattgatttacaaaattattcaaaattattcattcttttacattttctctttctaatttattaattttttttagattttatttttagaaagcattttattatattttttttataaaaattatacatgtttaaaaatatagttgtttaataatctataaaatgtcattaagagatatccaacttttttttattacagagatg

SEQ ID NO: 113979 - DNA, 106 bp, Heterodera glycines
  Promoter: Source sequence=SeqID_20965; Location=1..106; Strand=+; Gene=SeqID_51543
gatacattcgacatgagccgtgtccgtgccgatgggaaaattttgccagagggtctgaagtgcttgcgtgcctggatttttactcaaatcccacgattccctgatg

SEQ ID NO: 113980 - DNA, 1003 bp, Heterodera glycines
  Promoter: Source sequence=SeqID_3601; Location=1063..2065; Strand=-; Gene=SeqID_51047
ttaagatgaatttttagaaaaaacaaaatactttcaaaaataaattaccgacaattaaaaatttgtaaattccacacttgaacttttcgtatttcgaccaatcaacagtcccacaaattggtgacaaaccatttcactcaatcagatcacagacaaaattcgccctttgctcccccaattcattaatcattaaattccggtgaatgaatggctaataaatgggtcactaacagctcacccgctcaatgtcccctggggggaaaagcggcgacaaatcatgaggaaaagcacgccgggggcgcgtcgaataggaagcacagcagtcagcagcagctaatcgctttgttctctcgccttttgaaaacggatgaaagtgataaattttggttgggcgccgccgtatcgaaaaaatgggaatttataaaagaggaagttaatggaagcattttcccttcaatttcgcttttttcttcatcattcatgcattttgtattagtgagtgccctccgtcaaatcgtaaagcttatgaaggaattggaaaatgggccgaatggatgataataagctggcatatttcttaaattccgccacgcgatcattttttgacaaattgtcataatttttttcaatacaaatttggtagctatgaatgttgttctctaaaaacagttttgttctcaaaagctcacaaaatttcatcactaggcaataccaaatataaaatgtgcttagaaaaaaaaaagttaaaacattttttgttgaacaaacgttctaaatggcagatttaagaaatctgccagtattaaatcccgtcttattttaaatctcgttttactaatgatccaggctttggctcgggattaatctcgtgtaattctttgttgtttttaaaagaaaaggaatgggaagaacaacatattcagagatgcaatattgttcatcatcatcttcatcttctgcttctcctccttggcccaagtcctcccatttgttcgcctcgatg

SEQ ID NO: 113981 - DNA, 131 bp, Heterodera glycines
  Promoter: Source sequence=SeqID_41601; Location=527..657; Strand=-; Gene=SeqID_69682
ttttgatggtttttgactaacgtcccagcaccgaatgaacgtgtgtaagacaattaaaagatgatgacaaaataataattaatgcgttgacaatgtgataatgaatgagagttaactataaaataacaatg

SEQ ID NO: 113982 - DNA, 864 bp, Heterodera glycines
  Promoter: Source sequence=SeqID_19513; Location=2292..3155; Strand=-; Gene=SeqID_84237
ttgactaacgcccgttttgatcagctacgcataaaattattttgatggtttttgactaacgtcccgtcaccgttctgtccgtcccttttcaactgatattttcctttttaaacttttcgttttcattctttttgagattaaaagataatcacttactgataaatttatgagggttccaagtaaatatttaagataatatggggattttcaaaattttttggaatttttacccatgttaattattatttatttttttacggaattgcaaatgagtgaaaccttttaatttacaattcttaaggtatgcaaaaaataaacactttttacaaaaataataatcaataaataacataaatgatacatatataaattgtaataattattaaacccttaaaaattggtcacatttttttggtactttctcaaaattttggcactgtttgttcttgcgcagcaaaagcgtcgtccaatgtccattctcaaaagccgacttcgatgaaaagggacaaaaattcaattagtacaaaataaggtaattaaacttttggcggcatggatcgcaaacacagcgaccaacaacggcaccacaagtgcgatcacctgctgtccggcacgcatcgcagcggtgttaggactcaaaaatagtttggaaacatctcgaatttatattccttatgctctcggtttattaagaatgaatgcattactaattattcaatttttacattaaaacggtcaaaaaagattggatgacgtaagcggtcagcttcctcccattctcactaattgctgatcattaactttcgttccatttaaaattaccctttccccacataaataaatgttcggttgccggtcacaatg

SEQ ID NO: 113983 - DNA, 267 bp, Heterodera glycines
  Promoter: Source sequence=SeqID_26369; Location=478..744; Strand=+; Gene=SeqID_57105
tttgaatggaataagcagaaaaaatcaattgctaaattaattttaaaagagtgttaattttattattaacaatttgcgtgcatttttaatcctcacaattaaaaattaaacatttaatggataaattgaacaaatcaaaggcgaagggtgattgcagagaaatgttaagtagtgacatgaaagtgtgattggctgacgaatggttgagaataaaaatttgaaaggggagaaaagtgccgaactgacaaatgaggggacaaattgatg

SEQ ID NO: 113984 - DNA, 1003 bp, Heterodera glycines
  misc_feature (512)..(512): n is a, c, g, or t
  Promoter: Source sequence=SeqID_12625; Location=612..1614; Strand=+; Gene=SeqID_76293
cgatttttttttaaatgacgccttctatatcgataaagatttatgtgtgtattatgattctaatccattgggaagaggatattatggtacaaatttaccagaggtacaagtggtttagaaaagcattgtacagtcaattagcatggatagaggagttaataatgtcaaatgaaaattccgggtcagattttcgagtcattaaaaatttggacgaaaaagcaaaagtaaaaattcactaattggttgtccaaggccttaaaatttgaagaagataaacttcaaagcattaaaaacggaaatgtcatttcaaggcctcaaaaaagaaaaacgaatctttggggcctaattgaaattccaaaacttttaaacattttgtaaatgaattcacgttaagttccgaaattggatagacggaatttccggtctttaatacttggaatttaaaattcgtccaatttgtgccctaaataggccaagtgccatagccaaaaattcactttcccccccccccncctccatccacccattttttataacgcattcaaaactcaattcacttaagcatcccaaccgaagctttcacttcagtgtcccctcatgaggatgtgccaaattcggcataatgtgtgcccactaagttaagatggcactccttccccgcgcttttgacgtgccattcccccctccccctctctctcccggcacttccgttttgccttctccgctctccttttcggcttcctcctccggtgccgtctttcccaatttgtgctcatcgcccgttgaaagtcccgagcgttaaaaggcttctttttttacggtcgcgaagcatttgaccagtcaacagtctcatttatcccttcattttttgttctttgcctctggcgtccaattttattgaaatttcgaaactattatttcttcatccctctcataatttcgttaatttaccatcaattaccgttaattggcccattaatcattacacagtaatttggcaatg

SEQ ID NO: 113985 - DNA, 829 bp, Heterodera glycines
  Promoter: Source sequence=SeqID_4680; Location=4594..5422; Strand=-; Gene=SeqID_55355
gacatgcacagcacaaaaagcagattcactcagttcgcctcatacgggtaaagttggcattgccaaactcattttttggcacatactttttgacccttgcgaaacattgaccattttcttctaagaaattgacgcttatttgagattattaaaaaacattttacaaattaacactaacttttgttttaaaataattttttatgaaaaaaggtgtaaacatttggcccctaatttgtgtattttcggcttaggcgatcacttacaaattagttgagagtgactgcggtgttcaataaagtttaagtgacagtaattatatttgtgattatatgggattgtgttttttatttttgaaatcccctcaaggcactttctccgctgcggaaaggcgtgccagcgcggccactttcaattgctccatcgcctcctcaacggtcaatgaatgtgccgtgatgattgtacgccgtcaaagcgaagagtgcaccacgacatcagtgatgacaggtgctacagtactttactacaagcaattaccgtttttcgccattattctcccgccgcaacggattccgctggagggagagttttttaaaaagacggctaataaaaattagtaaattgaaatagacattaatattactaggggctgtgatgacaaagtagtgtattgtcaagtcactgttcacattgttccaaaaatgatcgcttacaattagagagagaaacggcgccggacccgcgcccaatcggccgcaggggttgtacctgtccctgcccatgcccttggcactgttgttgctcccttcgctttgccgtcgttttgctaatg

SEQ ID NO: 113986 - DNA, 980 bp, Heterodera glycines
  Promoter: Source sequence=SeqID_24460; Location=843..1822; Strand=-; Gene=SeqID_55191
ttgttttgttttggtcacagcgccaataaattaattcccttcgtgcttctttttttggtacatatggccttcgaaaacgagtttgtagccgcccatttgtgaaggaaaaacgtagccattatatttaatgaattttgtaaatttagttcagcttttatagcacttattgtatttcaggctattcgggcaaatccattggcaaaatttaattctaattagttaagattagtggtttttggtcatatagaattttctcattaataggaatagtgatttttgatcatatagcatttggtcatgtaacatttttctcattaagattagtgattttttgtcatatagcatttttctcagtccaatttgaataaatttagtaactggcatttctctcacagcttattttaaatcttttaatacattttaattaattatatttttgggggtcctttgtccgtgggtcctctgtctttgtgggtcccttgtctgtgggtcctttgtccgtgggtcctctgtctttgtgggtcccttgtctgtgggtcctttgagagtacaccgacgaaatcaaaacaaaaacgcttaagtattgacaaaaagtacgaaaatatagacaaaaatttctgaaaattggtttgaatttttgaaaaattcgcaacccataaaaatttttaggccgaaataagttaacaaaaaaatagggcttccattcatataaaatagacataattacaatttaaataaaccaattttttgtactttttgaccaaggtgcgtcaaggaaaaatataattaattctaaaactagagaccgcaagcattacatttgttataaatttattattttttaataaatgattttttatcttttcgtggctttctggaaaattcttatgcaaatcattgattttttgttggcattttcttcttcagcctaattaaggcagaaaattattactaatatttgttattaaatttttcaaatg

SEQ ID NO: 113987 - DNA, 98 bp, Heterodera glycines
  Promoter: Source sequence=SeqID_1091; Location=2452..2549; Strand=-; Gene=SeqID_67687
agtgggacgggtcgcagcaataatgggaatggagattcccgaaggcactcaaattacttggaattatcaatttacatgcaaaataatttataggaatg

SEQ ID NO: 113988 - DNA, 341 bp, Heterodera glycines
  Promoter: Source sequence=SeqID_7410; Location=1696..2036; Strand=-; Gene=SeqID_64738
attttttcatcatataatcccttaaggagcgaccaaatttttaaagattatgttcgacttatgattaagttgaaggtttattttatttatcttctatgtacgtgaaaaattttaaaacaggttgaatcaagcggattcccggatggcgttcaaacggaactgcagaaacaaatgttcgcagatgaatatatgaggcgatacactgttgagttggatttaacacatgtgcgaagaaaccccggcctacgtttcattgcaaagctgatgctaaacagtttatggtgtgtttttctccaactaaattggacagaatcagccattttagggggaaattcagcatg

SEQ ID NO: 113989 - DNA, 84 bp, Heterodera glycines
  misc_feature (18)..(18): n is a, c, g, or t
  misc_feature (57)..(57): n is a, c, g, or t
  Promoter: Source sequence=SeqID_8455; Location=1..84; Strand=+; Gene =SeqID_68126
gcacagccgcgctgtgcncaaaaagtcaaacttagttgggtaaatttcgaagttttntaaaattattttaaataaaaacagatg

SEQ ID NO: 113990 - DNA, 66 bp, Heterodera glycines
  Promoter: Source sequence=SeqID_20200; Location=823..888; Strand=+; Gene=SeqID_84996
actatttggagaccaatcgaaattagcaaggacaaaggaccagaaccgaaactatctgtgtggatg

SEQ ID NO: 113991 - DNA, 965 bp, Heterodera glycines
  Promoter: Source sequence=SeqID_37694; Location=380..1344; Strand=-; Gene=SeqID_66696
atcagagcacaatcaatggatgtcttctgtcccccccccccctctttggtcccctttttcattcatttccaattgtgtcccaaataccctcgcgtccattcaattcatacgcatggccccgcctcccattgtccctcccgccttcctattgttcaaaattgggttgatgggggggggggggcgtcagtgatcgaagtcgtcgataagcgaagggcccttcactgtgttctttctctgccattactcgcgccgcgcatttttcaaaaataaaatttaaaacgacaaattgcctcaaattcaattagcagcggcagtctctcccccccccttttctcaattcctttttttccgttcattcgttccccatatttataagttcgtaattattgacttaccaagttttgtaatttttttatcctccaattgtcaaatgagaagctttaaaaatgttttttgatccgactatttttttctgattcaatttgtccaataaatgtgggcctatcattcacagaacaggtaattaacactaaacgcgggtccaaattggaccaaaacacgattcaatgacacctttctgtctgaatggtgagaaagagcacaaattcgcccaattctcagacccgcgtcgtgggcccattactacggccactcggccgcggaagagcaacgccgggcagcgaccaattcggggatcgccgccggcctcactttgatccttttcctcgtggttttcctgattagtttaggctgcagacattacaacaacaaaagacacaatcagcaaagttggaaacgattgagtgctaaaagtgtcctcctccgcacagattcgctgccttttgtctgtccttcgtccccagtgggaccttccgtcgatgcgtcccctcccccttcctatgaaaatgcacttcgactgcccgcctttccattggcttcttcggcccctcctccgtacataaatg

SEQ ID NO: 113992 - DNA, 337 bp, Heterodera glycines
  Promoter: Source sequence=SeqID_2748; Location=3420..3756; Strand=-; Gene=SeqID_81387
aatttttaataaatttaataaataaattttaatattaaaataattttaatttgaaagaatttgaatattatgacaaatttcggaatattaatttataaaaatagatgtacaaattattaatatttaaattttaattcatttttatttgtaattttcctaaattaattggattaatttaattaattagttaaattagattctgcaacctgttcaacaaacggcaactaaacgcggtcttaataaatttgcaaatccaaatgaatcagttatggaacataaaactgaatatattcaagcaaataaaaatgttttgaaaaatgggacaaaaaatacaatg

SEQ ID NO: 113993 - DNA, 124 bp, Heterodera glycines
  Promoter: Source sequence=SeqID_19403; Location=1..124; Strand=+; Gene=SeqID_47582
cctctctaatatttgcataaattcatatccatatacattctaattttatcctttcatcataattaatatatttaaaaaatattttttctttttgcctatcgcatattatatcaatctatagatg

SEQ ID NO: 113994 - DNA, 110 bp, Heterodera glycines; identical to SEQ ID NO: 98226
  Promoter: Source sequence=SeqID_34145; Location=85..194; Strand=-; Gene=SeqID_64015

SEQ ID NO: 113995 - DNA, 706 bp, Heterodera glycines
  Promoter: Source sequence=SeqID_15847; Location=1..706; Strand=+; Gene=SeqID_80178
gagacagtgcttaaagacgactgaagggaggagaccaattaaaaaacaaagatggcactgagacagtgcttaaagacgacttgaagaaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatggcactgagacagtgcttaaagacgacttgaaggaggagaccaattaaaaaacaaagatgtcactgagacagtgcttaaagacgacttgaaggaggagaccaattcatgggttggcactccgtttaaattgaaattaaaaaacaaagatggcactgagacagtgcttaaagacgacttgaaggaggagaccaattcatgggttggcactccgtttaaattgaaattaaaaaacaaagatg

SEQ ID NO: 113996 - DNA, 295 bp, Heterodera glycines
  misc_feature (58)..(58): n is a, c, g, or t
  misc_feature (81)..(81): n is a, c, g, or t
  misc_feature (101)..(101): n is a, c, g, or t
  Promoter: Source sequence=SeqID_38113; Location=327..621; Strand=-; Gene=SeqID_67023
ttttttttttatcaaaaaatattgtataatttaattatttttttttgccatataattntaattatcctttccctcctcccncaaggcacgccaatcggctntcatcgaagtgcttagtcatgtgccgtcccagccctcgtccgatcaaacggtgccggatcgtccccgggctgttttggcaccgggcaaagatcgccccaactttcacattgaattgcgctcccaagagctgtttgtggggcagccgcttcgtctggagacaaaactgacgccgatcagtagcgacccgtcaatg

SEQ ID NO: 113997 - DNA, 254 bp, Heterodera glycines
  Promoter: Source sequence=SeqID_7209; Location=1096..1349; Strand=-; Gene=SeqID_64161
ttttgaagttcattttgcaattttttttcggtgtaagcggagacgaagggaaaggcaattaatttaacaattaaaaagcgaaaagaaaaggaggaaaggcggcgcatcatcgatcaaaagttcatctgatcaattcactgaaatgttttggaccaaacggtggaattaattaatttaaatggattttttatgtgtaaatgagaattaattgaacaattattatttattgagaatgtgcagatgctattaaaatg

SEQ ID NO: 113998 - DNA, 519 bp, Heterodera glycines
  Promoter: Source sequence=SeqID_18298; Location=1..519; Strand=+; Gene=SeqID_82885
aattccgactccaaaaagttgggacattgggaattccgactccaaaaatgtgggacatcggaatttcgcctccaaaaatgtcggacatcggaattccgactccaaaatgtccggaaccggaattccgtgccacccctgcgttatatcaaccaaggggaaaattcataacatgacttaattttaatgttaaaaaattctggtttggttcaagattctttgaaattttataataaaatttttttttaatatatttttctaaaaatagttttagcataaatattattaaagataaccttaaaaaaattttaattttttgttctcatatttcagaaggccttataaacaaattgtaattgaagaatgaagggttgtgcggaaaattatgctcaaaaatggccatttttcatttttgaagcacattataaattccggcttttcttgtaattttgtcaaaaaatctaggtttccggcctaaatggccacagggccctgtttccatcagaaggactgtatataatg

SEQ ID NO: 113999 - DNA, 1003 bp, Heterodera glycines
  Promoter: Source sequence=SeqID_8141; Location=4146..5148; Strand=-; Gene=SeqID_67113
aaattaacaaattttcccacttcaatttgttacattccgaatttgtattgtgcccgcaggcattctcagtagattgttttagaagattaagtcaaaattaatgtgaaggagagaaaaaataataatagaaaaaaaattgtaaaaattgggtgaggtgctttcaagcctttctcatatttgtacatgaatgatggacataaaacgacagatcgggccaatatgtcggccgacatgtggtttaaatcaacgcaaaaagttgatttggcgatgtgtaaattttaattgttttccataagagtcccattggtgacttttatttcctctattttggtcatttaggcgattaaaatgaatatttaattattattattgtactatttattaattaaagatttctaaaatataaatggttaatgataaaaattaataatagatgaataaaaggcaaaaaatgattttccgtcggacgacagacggtttaaatttagtgaatttattgaaacgaaaagttttggcgaaatgtgataattaaaataaaataaaagtaaaaaaaaaaaaaaaaaaaaaaaaatttggattgtaattaattaggtgtataagcataagtaagtgtgagaaatgaaagagaatataatgaggaagaaaaaatagaaaaataaattggcgagaaacgcagtccaattagcattttctgccgatattggactcgcgctggggtattgcgagggggaggcactgcattggcgctgcacatgtggttcttcaactcttcctatcaggttttttttttgtaaaaaggtttttgaaagtaagagaaaaataaatgtttagttggtaaaagggcaattgaggtttggtagagttaactcaatcttaaagatttttttttttggaataaaccatttttaacaattgtaaaaaaataaacttttttttggcaaaaaaaaaaaaaaatataatttggtatgaactataggttctttcccattatagacaatctatg

SEQ ID NO: 114000 - DNA, 448 bp, Heterodera glycines
  misc_feature (13)..(13): n is a, c, g, or t
  Promoter: Source sequence=SeqID_21889; Location=1..448; Strand=+; Gene=SeqID_52529
attttgattatgnattagatatttgttttgtgaccgctctcatggccagcaaccccattgtgcggccaaagttcggcctggtggaaattgcacaggatttgttaatggttgtcaataataatttgcttatttacgaattaattaattcattatacctttttaatgactaaattttcaggtaatttaactttgtaggatttgaaattttgcaagaaaatatacaattacctaattaattatgaacattctgagccattcttacaaattccaattaatgaataaatatattttagtaattaaaagtctttcccaaataatacgatgaatatttattaaattaattatacccatagttatcgatattataattattatgtcgttgttaataggcatttaaaattcaaaatatattaatgataattttcaggtgaagatgtttgtcataatg

SEQ ID NO: 114001 - DNA, 55 bp, Heterodera glycines
  Promoter: Source sequence=SeqID_5080; Location=1340..1394; Strand=-; Gene=SeqID_56823
ttgaaagtgaaattgctattgaaattggaattagtcgggataaaatttacaaatg

SEQ ID NO: 114002 - DNA, 418 bp, Heterodera glycines
  Promoter: Source sequence=SeqID_4998; Location=2659..3076; Strand=+; Gene=SeqID_56500
aatgataccaagattatggttgtcaaataaaaaagttatggtccaaaaacaagacgcggcgccgaaacgacctagtccccagttacagacccggtactgaaatgtccaactacccccgggactaaatcgtctaatggcttttttaggaagcataaaaaaggcgcaatttatttattaatttgtcaaaaagaaaaataatcgatgaaagggaagcaaagctccaagactttttgaattactatttcttcggatgtccaatatcccattccgcccggttcttcaagtgtatccgaatatataaagcggaccaaatccccttccagtcatatccttcatcacttttattccatttgtttgataaattttgttttttcagttaatttctttttaattttctgtgcttaccaattcaaaaatg

SEQ ID NO: 114003 - DNA, 837 bp, Heterodera glycines
  Promoter: Source sequence=SeqID_1505; Location=6727..7563; Strand=-; Gene=SeqID_74048
aagcattaaaatcattgcaccaaccaacaaaattgttcaccaaattaatcgctcgaaaaacaacaccttcatcttttcaataaatagttctgtcagacctccaaaaatttccttaaaaaaatacattattccagtacttacaatttctcaccaaaatttttctcaaaaaaagaattttataaacttttgcattttagttaatttttttgtcttaaatttttcttgcaaaactactataaaaataaatttcatattttgaaattttaaatttttcgcattaagttaaattttattgtagttacattgataatttttaatttgccgcttaatatttttttggtaatccttaaaaactgaattaataacataagtattataaatttaaatgatatatttaaaagaacgagttctttataattttatccataaataaaaatcggatagaacctttaaaataattgctgtactgtgtcgggttcttttacattaatgtaacaatttttaataatatgagaaataatttataaaatttaattataatataaaatatatttatctatattgaaattcttaaaatgtaataataatacaaaaacaaaatcattaaatgaacatattaaaatttataatgaaaaatgaatatttattagttttttgtttatactctttgtttcaaataattgttaattttttaaatattttcttctatttaaatatgtttttcatttgattctcatgataccattaattgtattttacatataaattactggcataaatttacttctattaaatttgtataattttaattatagctactatttatattcataaatg

SEQ ID NO: 114004 - DNA, 75 bp, Heterodera glycines
  Promoter: Source sequence=SeqID_1607; Location=3035..3109; Strand=+; Gene=SeqID_74786
tcggacatcaataaaaactgatcacctgggtggtgtaaagttccgctgggtgcggtttaatcaacaatcaaaatg

SEQ ID NO: 114005 - DNA, 239 bp, Heterodera glycines
  Promoter: Source sequence=SeqID_6739; Location=1..239; Strand=+; Gene= SeqID_62701
acttttgcgtagagaaacattttttcatggcaaaacaggtggctgataatctaaactaatataaacatttgttggtttgatatttttatctcattgacacattcatttagactaaaatcggtcctttccatgaacattcaaatcaactttacaacatcagtgctgtgaatacttggttcttttgccctcttttattattatttttgtttgtttgtagggatcggatcaatgaaggaatg

SEQ ID NO: 114006 - DNA, 208 bp, Heterodera glycines
  Promoter: Source sequence=SeqID_9595; Location=2137..2344; Strand=-; Gene=SeqID_72010
ttcggatatcaacggttttttaacatggcttcaaaaatatactaaaatgttttatatatgcttgaaaatttccttaagagcaatagactaggatttagaaaagaattgtttagacaatcatcgagaaattgtcggagtcaaggaaacagtgtcaataattattttagtcctgataataaattataaatattttagtataattttcatg

SEQ ID NO: 114007 - DNA, 528 bp, Heterodera glycines
  Promoter: Source sequence=SeqID_21377; Location=562..1089; Strand=+; Gene=SeqID_51984
tagttcggcctcacgaattttttgtaattcgtgtcgcttgccttccccagggtttggccccacggattttttgtaatccgaggcgcttccccggtcccatagttcggcctcacgaattttttgtaattcgtgtcgcttgccttccccagggtttggcccctcggattttttgtaatccgaggcgtctttttccttgctcagttggcccctcgggtttttcgtaacccgaggcgtgttcctttctccagtgaccgacccctcgggttttttgtaacccaaggcgtcccccattgtgagcaggtcgctcctagggttttttgtgacccaaggcgcctcccgcttacacggtcggacccatcgagtttttcgtaactcgtagcgtccttcttcatacactgtaagactcttggtgggtctgaagtcaaactcacttagtccactgtttgttcatactgctattttgtgaccccgaaccccacacaatttgttcggaagtcgggtagcagaacccaaaagtgagcaaaaatg

SEQ ID NO: 114008 - DNA, 98 bp, Heterodera glycines
  Promoter: Source sequence=SeqID_19603; Location=1..98; Strand=+; Gene= SeqID_84346
ctttttttgtcttcataaaaactaagaaaataataaatttaaaaattaattaaaataattaaatctttccatttgcttggattgatcactattgaatg

SEQ ID NO: 114009 - DNA, 482 bp, Heterodera glycines
  Promoter: Source sequence=SeqID_388; Location=6069..6550; Strand=-; Gene=SeqID_51071
atattttcgtcagtaagcattttcgtcagtgaacgatttcgtcagtgattttcgtcagcggataatttcgtcagtgaacattttcgtcagtgtactatttttatttattttgctgttttccatttttttcgtcagtgttccaattcgtcagtgaacattttcgtcagtggatgcataaaattaaaaatttttcatttttatcaacttctttaatacagtatttatcgctttttgcgtatggtaactctagataaaataagtgattatttgtactttaataaatgatttacataaaagaaattgtactttaaaactgttgaatattattagtaaatttacttctcaaacttcttatctcgccatcgttcccatgcgttctcgagtgcctgcctatttgcatatttgtttagtccttatctagtttttgcaatgcataaaaatgaacgatatgaaaattcattcgtttactgcaaccaaaaatg

SEQ ID NO: 114010 - DNA, 70 bp, Heterodera glycines
  Promoter: Source sequence=SeqID_38256; Location=1..70; Strand=+; Gene= SeqID_67131
aaatcaaaacaattattatgaaaataaaaagcaggaatttattaaacgaattgatgagattaaaagaatg

SEQ ID NO: 114011 - DNA, 454 bp, Heterodera glycines
  misc_feature (15)..(15): n is a, c, g, or t
  Promoter: Source sequence=SeqID_5562; Location=1..454; Strand=+; Gene= SeqID_46069
ccatagtagctaccnttcttctttaaaaaaattgaaaataacatacaacaaaatgaggactcgaacctgagaccccccttttggtgactaactcacagaccactaagacgaaaaaaccaacttatttgcgcttggagcccaaaattgaatcgccgtgttaacccatccttccttaccctttttccaattttcaattcagcccccaaagttagataacaaaattattattgattattttttgaatttttaaaacttttgtccgacggcattctaatgtagtttggaatttgctagttttgcaaagctttttaaaattttgagacaaaagtaaaaaaaaagctgaaaaattacaattgcaattgtatttacttgaaatggttaacgtttcacacagttttgattttcagatttcgtgtattattatcttaacaaattaagggtgaacatctaaatg

SEQ ID NO: 114012 - DNA, 1003 bp, Heterodera glycines
  Promoter: Source sequence=SeqID_15288; Location=546..1548; Strand=-; Gene=SeqID_79510
ttttgttgttaaatttattgctttttaattggatataaacggaaaaaaggacattgtaaaattgtcataaatttcaaaaaaggtgacaaaaatgccacaaaaaaacattgtatttttgagaattttagaaatgaatggcttttctttatttaatgtcgttttttggttttttacttttattttccaataaatttaaattgatcaattcggaatttgttcaacaacttcaattttgatggtcaatgatttttttcaaatttatgcccaaatcgtttttgccaaaattattatgctcaactaataattacataatttgtttaaaataaattttatttatatgttttttcgctttttattataaaatgcaatttatatttgaaatgatttaaaaataataatattgggagtatatttatttataataaaatttaaaaaaaaatcattctttaaatagcacagaaatattttcaaaaatttatgctaaattttgtcgaataaataaataattataggcacgaatagtgaaagagaggcataattttattttatcattattttcttcacattttttcttcctccattcttttaaaggaaaatatattagaaaataagtccaacaaattttgttgaaaatgaatagacaaattaaaatccacaaataaaattttttttttatttagatgtcgatttaaaatttttgttttaacatattctctcaggacagcatatactgtaccggaaataaaatgaaggaaaacttttacataaaatatacttttaacatatttgtaaaatttttaaaattttgcaggcttgtaaagatatttctatgagctattgaataataatatcttgatcagttaattttgttgattccaagaaaattttcatcagaaagtggcacttacgtcgagaataaaaatagacaggccccaaaattattgcaacaatttattagattaatatagttattattttaacaattatttttaattctagaatg

SEQ ID NO: 114013 - DNA, 333 bp, Heterodera glycines
  Promoter: Source sequence=SeqID_29586; Location=1..333; Strand=+; Gene=SeqID_60062
aaaaaagcgggacaaagagctggaacctaggtaaaacaacagtccacgcaagaagacaatttgttagaaaaagcaaaaaaggaaatagaccaaacagcacagaatgcagccctaaaagctgaatatattcgcacactagttgccaactcaaaacataatagaggcgttgcagaaggtaggcttaacacatattcaggtgtccctcaattcaacgaatggcttgaccaaattgttgaattagataagaagatagacgaattggcaaaaaaggtaggaaatgaaccgtcaaaggtaataaacgctaagcaacaatttgataaaccttatcgaatg

SEQ ID NO: 114014 - DNA, 150 bp, Heterodera glycines
  Promoter: Source sequence=SeqID_40982; Location=292..441; Strand=+; Gene=SeqID_69202
ttcatcaccattgacctcggactgtgcaatcaataaataaacataaaaaaaaggcccaccgctgacttgcacacattcattcaattcacacaaagttctatctttttttttttttctttgaaatctctgtcaattcacatcatcaccatg

SEQ ID NO: 114015 - DNA, 1003 bp, Heterodera glycines
  Promoter: Source sequence=SeqID_13923; Location=34..1036; Strand=+; Gene=SeqID_77876
ccttcaaatgcaatatttcccccccccccccatttattgtaaatttcttcaacaatctcacattttctttctctttttttgttagttccaatctgttaatgataaattgagcctatttagtaaagcaattagataaataattttcattttgaataaattacataattttcgcaaaatttcagtttccccccccccccccgcattttaacatgaatggcaaatgtttacttacataaataaatggccaaacttccaaagagaaaggatgtctcgagagggcacttatgagaaaaatgattgggatgggacgtacggaagggaaaggggaaagagaggggaaaaaaggggggggggagggttatcaccgaacggtggggagaggggaggggtcgatgatcagacgcacgccacgcttttaattgattaattaaccaatcgctgtgaagacaaaagtttctgtgcttttgatcaattttaattaaaaattgaattaattccttaaaattgaaacaaagcaaaagaatagtcatctatttctctgtttccgtcgcttttcagtttaagggaatgcctttcattaatcacaactttttaacattttatcaccttttttacagtaaacctttcttatttgctttcaaccatttttatgaaatgaattcgactccattaaaaatagattaaataataatttcatgttactacaataatatattttgatttaggcatttattaaagtgaattccgaaaggaaagggaagcttttttgtcgaaaaatttaattaacgaccataagggcatcattatgttggttaatgattgccattaataaacctattaaaatgtttttaactgctatacaattcgagacaaatttaaattttaaatgaattaaaagaattataaaaaaagataagaaagtccagcactaaatgcattccatttgctgtatcatcccatttgacaatgtttcacttcactaattaacaaatgggcaataatg

SEQ ID NO: 114016 - DNA, 141 bp, Heterodera glycines
  Promoter: Source sequence=SeqID_27899; Location=1509..1649; Strand=-; Gene=SeqID_58563
gtgtcggattttcctagagccagaatggcggggggggggtgaggattaacaaacatttttattttgtatcatggtttaacaacacatacacaggcgggcagggatttggcatttgaagggatcaacaaaagtgccaaaatg

SEQ ID NO: 114017 - DNA, 255 bp, Heterodera glycines
  Promoter: Source sequence=SeqID_39223; Location=1..255; Strand=+; Gene=SeqID_67844
cccccctccggcggtatttgtcatcatcactcttccaccagcctaccgcccactgacctaaacaaccgctgataatccatcccatcatcacacggccgaaaccctactaaattgcccgtgggatggtttttggaaggaatctttgggaagtgatcaatgaaaatgaccacctaatgggactaattattagggagggattctcaagttgatttatggggtctttcttaaattgcaattttcgagaaaagccaaatg

SEQ ID NO: 114018 - DNA, 226 bp, Heterodera glycines
  Promoter: Source sequence=SeqID_7970; Location=1..226; Strand=+; Gene= SeqID_66544
atgcctaagtttataatgactaaataacaagaaataattatttacacccttcctcagtggccggtggcgtagtgggtttcgcctctaccgcaccttttttctgtcctaggttcaaatccccgttatgtaaatattttttcccatttatttttgcactttatgcaaattatttggccgaggaaaattgattcccgtccaataacattttcattcattttttcaaatg

SEQ ID NO: 114019 - DNA, 463 bp, Heterodera glycines
  misc_feature (16)..(16): n is a, c, g, or t
  Promoter: Source sequence=SeqID_5419; Location=1..463; Strand=+; Gene= SeqID_57958
tttagtttatataatnttgtttaataaaaaataaatattttttgcacatttttgccaatttaattgattttaatttaattttttgttccacatttcaatcacatgtccataaattatcacattttgtcaatttttgaccatttttgttatcatcattcttgccccattttattagttgcaatttttaataaatccaaattccgataattaaattaattaatcaatcatttcttcctatgtttccaaattttatgcactgattaaatacttgaaattttatttttgttttttggttattaatttttcggctataatccttcaataatgatcagtatttcactaatttttgcgggaacaggaattaattagcttaatttgtttccgatcaatttgccaatggcaattttaattttaatttctatttttattatttcaactttaaatgtttgttattgtagtgatg

SEQ ID NO: 114020 - DNA, 284 bp, Heterodera glycines
  Promoter: Source sequence=SeqID_2038; Location=1135..1418; Strand=-; Gene=SeqID_77450
attttgcgtttatcgaaacttagctcctaaatttaattttcgtatgttccgttgccttgcgctaaaaatctttgtgctttaatcatttgatcccttcttatgatactcattctttattaactcaaaataattaatgtttgtattttgctcatttcttccgtgtaaataattttttatttaattcacacctgttcatgtaagcgtaacaatgggttttgtcgcattactttttgtatattattatacataagcagctaatgtaattttagtgttttaaacgcatg

SEQ ID NO: 114021 - DNA, 231 bp, Heterodera glycines
  Promoter: Source sequence=SeqID_20461; Location=794..1024; Strand=-; Gene=SeqID_50993
agcctaaatctcgatctctggatccaaatcagtaccaaatctcgggtctctgggtccaattcagtatcttggacctaagtctcgagaaaggccaatattttgcccaattctcgagtatcttaggccgaaatctcgcgagagggggtgattgtgcaaaacaattaaatatttaaaaataaaagattaaattattatttaattaacgaatttgccgaaatatcggaggacatg

SEQ ID NO: 114022 - DNA, 345 bp, Heterodera glycines
  Promoter: Source sequence=SeqID_1736; Location=2617..2961; Strand=-; Gene=SeqID_75601
gattttgtatgaataattatactttagaattttttaaatattattgtggtaacaattgccaagtctgcaattgataatccgaaattgtcgtaacaacaaaatagtatacatatatcatataaataaataaaaataaagccaaaatcaattttttcattttaaaaaagcttttcctcaactctttcaaacagaaatgtcttatttatttcttttgtagctaatcaaggcgtaaaggcatttatttaaattagttgaccgtttttatttttttgacttttaacaattaaaaaatccattcacagaactgggaatatgtagcaacaacgattgcgtcaaaaccgcatg

SEQ ID NO: 114023 - DNA, 76 bp, Heterodera glycines
  misc_feature (41)..(41): n is a, c, g, or t
  Promoter: Source sequence=SeqID_15503; Location=1151..1226; Strand=-; Gene=SeqID_79783
ttttggggctcacccgcccccgcgaaaaagctacccccgcncacggggtccaaaccctagtttaaattagaaaatg

SEQ ID NO: 114024 - DNA, 262 bp, Heterodera glycines
  Promoter: Source sequence=SeqID_14460; Location=1..262; Strand=+; Gene=SeqID_47205
aatattatttcttcgttcggtttcgaatttgtaattttgcctaatttagtaatcacattgctcaatttgcccccgtttcgcttcttccgtctccctttccaagagaagcgtttgagaaagcaattgctgttcaggaggtcaacgaataaaaatgcataacaaccgtcaattttataaaatatttaatttaattagattaattaattaattgattaattaattttataattaaatgattaattaattttctttccaggccatg

SEQ ID NO: 114025 - DNA, 127 bp, Heterodera glycines
  Promoter: Source sequence=SeqID_10169; Location=660..786; Strand=-; Gene=SeqID_73273
acgtgattgtaaatcgttttttagattattgccaaaaaatgaaatttcacgggttttagtattaatttttaaattacagccgaaaaacagattttatcgctcaaattgccaaatcgacacaaaaatg

SEQ ID NO: 114026 - DNA, 516 bp, Heterodera glycines
  Promoter: Source sequence=SeqID_7844; Location=1165..1680; Strand=-; Gene=SeqID_66137
ttttggttgcaaattttcaaaaaattcgcaggtctttgctcggccacctccactcggtctgctcgagctcggcacggctccggccaaagtttgttttttgttgttggcatattgacggagattgactaacaaaaaaattataagaaaatattaaaaaaaaaaaaattttttttcaacgattttttttggaagaattctataaaaatttagtaattcatcatttactttttccaaaaaaaaaattttcttgtaattcttttgtaaaaaattaagaatttttttgaaaattaaaaaaaattggaggtggtgggaaaacggaaggctcccctcaattacagcacctatgccccaggaaatttacgacgtgaaaaaattgggattttcagggggttgctggtcacgaatcaggccccaattttttttagtcagaaatctcaaaaagatttttcattttttataaaaattgtttggtaattttttttttgttgcaaaataacattttccggagaagagatg

SEQ ID NO: 114027 - DNA, 133 bp, Heterodera glycines
  misc_feature (88)..(88): n is a, c, g, or t
  Promoter: Source sequence=SeqID_26757; Location=1..133; Strand=+; Gene=SeqID_57522
caatttggtcacaatattttcttagattgtgacgtccaatgatgctaattgactgcaaagtgtttaaattgttttatttcaattaatntaatttatcatactaaatattcaagattaagtgccgtagaaaatg

SEQ ID NO: 114028 - DNA, 196 bp, Heterodera glycines
  Promoter: Source sequence=SeqID_19998; Location=1..196; Strand=+; Gene=SeqID_84769
gcattttatagcaaaaacaataaatcttttagcagtttgaatgacttctgcggttaatccattaaaggcatttggacaaattggtgcgcggctcgggattcgcgagaagagaagccaatttgtgcagaaggcgtggccatacattgaccccggcacgcattttggttcgttgtttcgtaaacatatttgagatatg

SEQ ID NO: 114029 - DNA, 116 bp, Heterodera glycines; identical to SEQ ID NO: 105272
  Promoter: Source sequence=SeqID_44031; Location=660..775; Strand=+; Gene=SeqID_71583

SEQ ID NO: 114030 - DNA, 176 bp, Heterodera glycines
  Promoter: Source sequence=SeqID_21657; Location=1..176; Strand=+; Gene=SeqID_52260
cggggactctaagcaggatctgttattttttctttttcaaaaatggcacataatctgtaaattttacatgatttgccaaaataaaacaattaaattatttataattaccaacacagacttgttctcatttgtactgattcacattttttgctcattttcaggtgattggtcgcatg

SEQ ID NO: 114031 - DNA, 339 bp, Heterodera glycines
  misc_feature (53)..(53): n is a, c, g, or t
  Promoter: Source sequence=SeqID_25869; Location=1..339; Strand=+; Gene=SeqID_56643
tatcggaatttgcacgagaaatcgtttggagtgaacgtaaatgtgaaactgcntgtgtacataaagggaatgccatggaaaatatgggcaggaattaatacgaaaaatgaaagcactgagaaatggttgggctttttccttttgtgcgatgcttctaaaaaaggttttggttatcaaattattaatagaaataaaaattattttttctataaaattggtgtaattaattattgaaaaaacttatgtaaacagtaatttttaacataaaattaaaagtgattttttaaaggaaatgcgttaaaatataaatttgattattatttaatttgctttaagatg

SEQ ID NO: 114032 - DNA, 90 bp, Heterodera glycines; identical to SEQ ID NO: 109661
  Promoter: Source sequence=SeqID_32455; Location=1142..1231; Strand=+; Gene=SeqID_62763

SEQ ID NO: 114033 - DNA, 232 bp, Heterodera glycines
  Promoter: Source sequence=SeqID_111; Location=1..232; Strand=+; Gene =SeqID_71399
attggcccattggtataagcgtatcaacatttttcaaaaagcgcataacccactctgattttccacttcccgtactgccagatatggtcaatgtaaatgggtgtcgaaattttgtgtcatccacattgaatatttgaaaattttgctccattaaaaaaagttgtttttcttaaatctaaacatttatatatattctggttcaatttttattgtctaaatggaccaaatcatg

SEQ ID NO: 114034 - DNA, 1003 bp, Heterodera glycines
  Promoter: Source sequence=SeqID_8294; Location=956..1958; Strand=+; Gene=SeqID_67606
acagaaaatcccgcgattgcggatacaatttgccacgaatagagaaatgttagggctatccaatgatatcaagaatgtttaagttagttgacactagacaaaatgaaccaagagaaaatttaagaattttggtaagcgaaccgactggagaaaattggaatttcgaaattctttggggaaaataatccaaatccataattctctaataaataattttctttttaaaaattttatccataattgccacaaactcccaaaaattcagcggaacgcggaaaaatcaacaaatggaaaaattttgacagaaaattattcataacgttgtccaaaatgaactaaattgttaattatttatatcgttcgatggccttaagacttttctaatatcatccaaaatttcaaaaaataaaaaacaaacgctaattaattaaactcatttctgttaggctatccatttagtagttaattatggtgctatgtcattatttaaaacatcattatgtgcgttatttaaaaaacaccaaaataaaaatttttgcttataactttgctctaaaacaaataaaattttcttaatgatggctttttaaataacgccctttatgatgtttgtttttttaaataacgactccgccccgttaattatgttagccacataattgcaaccaaaaaaatatctgaattcgtggtgtggtcaatgaagtgagagatgatcaaaattttgaccaaaaaaaagtctttgaatatacataacatgaatctcgaaattgagagcaaagaaaaatttgaaataatttatatttgcttatgttttgatgctgatcagaaaagtctcttacagcaacttgatcagatcacgcattattcatggcgaacggaacaacggcgggaaaccccaaaatatatgcaataaaaagcgaggaaatttccgaaaaaatttccaaattttgccttttagatttttccaacaattctctacctgttgtcaagtatcccaaccatg

SEQ ID NO: 114035 - DNA, 66 bp, Heterodera glycines
  Promoter: Source sequence=SeqID_14342; Location=575..640; Strand=+; Gene=SeqID_78373
ttgggtgggcattagcctgttctcctcctggacactcatctcaatcatttaccgcacttacctatg

SEQ ID NO: 114036 - DNA, 1003 bp, Heterodera glycines
  Promoter: Source sequence=SeqID_15780; Location=30..1032; Strand=+; Gene=SeqID_80104
cacggccaaaactcaaaataattttttccataggatagtaagaaactggaataaccttccagttttagcggtgcaaattaataaggcaaaggaattcaagggtttactaaaagcaatgagttctgagtaggaaattttctgtgccacatatacactatattttaatcacctgtgaatttttaacatttgatttatttttattcatttttattacggtattcattttgtattttttatttgatcatttttatttgtttgtttttggcaccatataagagcactaatgtgcctttggtttgctcgataaattaaattaaattaaattgatgaagaattgatagcaaaaaatttttttaccataaccattttttttgtttgtttaaataataaatttaaaaaatttaaataaataaaaattccatgaaaaaattattcaaaagcatatatcaaagacaacttttattgctgtttttaaagttaggtttttttccgcgaagctttgcacaatgattgacagcaatttacccccgagggatttattcaatgggctttgccccattttttgaatttggcactaaatatgccattttttggcattttatcactcccattattttcctgaaataataatcaaagaaattgtttttttttattaaaaactttttactcggataagaattggtttatttttacagaaactgaaaatttttattattttatcaccaatttaaattttaaaaatttaattttcgatttaaaaaattttatttaaattgactttttaatttttaaatttcttttggctttaattttttaaatttcttttgacttttaaattgaataaaaaatgctaaaataatttttgaatttacgaaattttaaattattctaaagccctacgattccatcaatcattttgattcactttttaatccctcaaggccggccaactcattagagcattattcattggcgttttgccttttgccattgtgcaataatg

SEQ ID NO: 114037 - DNA, 194 bp, Heterodera glycines
  Promoter: Source sequence=SeqID_9742; Location=2113..2306; Strand=-; Gene=SeqID_72552
ttttcgtaccgccgttttcgtaccgccgttttcgtaccggagacgttttcgtaccgccgttttcgtaccggagacgttttcgtaccgccgttttcgtacgagtgagtatggaaaaaattgcattcaaataatttgttaattttttaaattacttttaatgttttgacagttaagcttttattaactacaaaatg

SEQ ID NO: 114038 - DNA, 797 bp, Heterodera glycines
  Promoter: Source sequence=SeqID_4411; Location=2505..3301; Strand=-; Gene=SeqID_54353
tggtcgcctcctgttgacgaagagggaagggggatttagagccaggtgcgggggatcccgcgcgggatttatccctgcggaatgccgtccgcaaaatttttgagtttcaatcccatagcgggatcttttttaaaaaaagtttagaaagtcagtttttgattctttgacttcgaaagtcggtttttgaattttttggttcaatctttttgaagctaagaaattttttgaattatgtagccattagcgaattcttcgagcgattgaatgattccaagaatgttaaatttgaatgtttctagaacagttaattgattgagtaaagtgaaacccgcaactgtgtattttttgtttgtttgtgatcctaagaaatacttcttgaatgccaaacagatgaagcccaagattcggtggcgggtgagttgtttttcgaaacgtctcgcttgcacgcattgtcaggctttggctcgctccgccgagtattggccatgagtcgctaaacgacgtgttgtcatggcgagttggcaacaactgcagctgactcggcgtggggacattttgttgttgcggctgcacctggcagagaagcgattgagtggggggttaagaaaatgggtggaaaatgcaaaacgtcccgaaaaagaatgaaaacactcgaaacttgagacccaaaaacacatacaaaaccgccgaaaggtagaggattacatttttaggaaaacttgggtgttgatgagaaaatttctaccgacaaaggataaatttgggaagtactcggattcctgtcccggaaacaaatg

SEQ ID NO: 114039 - DNA, 728 bp, Heterodera glycines
  Promoter: Source sequence=SeqID_12061; Location=1285..2012; Strand=-; Gene=SeqID_75605
attaaagatcatttttgtcaaattacacgatttttaaaatccaaaattaattttcattatcaaaaacaaatttgcttaatcaattttcaattttgattctcataattaaattgtttttttacacactttttgtcaaaaattaaaaaaaaaaaattaatacattttaccctgaaattataaatttgttccacaatatttggctttttatgtcaatatttcagcgatttttcccttattttgccattttttcttccaccatgtttctttccacattaagaattttctttccgcgctctattaatttatgaatttgaagcgaaactaattagtgcaattaaatgcaatttctttgattgatagtgtatttttaaaatttttcttaatttattaaaaattgtaaaaacaaataacaaatatataattttaagaaaatattgtggagaattggaaagaagatgtgatttatttgatcacctatccacgccttagcgcaataaaaaaagggtaaaaaacaatggcacccgatgggatttgaacccagccatcctgggtaacactagcacttatataccagaaatttcaaatttgcggattccgctgcgggattggaattcaaatttttttttttacgggacggttccaacggtattaatcccgcaaatcccgtatttaaaatttgcagaatcccgcgcgggattttggaaactcgaattgtggttacataaatg

SEQ ID NO: 114040 - DNA, 177 bp, Heterodera glycines
  Promoter: Source sequence=SeqID_27724; Location=1..177; Strand=+; Gene=SeqID_58394
gtatacaatccggaaaacccaaaactttccaaaaaagttttggtattcttcgacagcggatccgaacgctcttacgtcgaaaaggcactggcctcatttctcaagctggaagccaaaaatccagcagagataaccctgaccgggtttgcaggtgtcgacttaggcacctacaccatg

SEQ ID NO: 114041 - DNA, 90 bp, Heterodera glycines
  Promoter: Source sequence=SeqID_24709; Location=1237..1326; Strand=-; Gene=SeqID_55459
aaaataattcataattaaattttaaataaaataatttttatattaaaaattaaaattttttctcgtatagtcgagaatattaaaacaatg

SEQ ID NO: 114042 - DNA, 282 bp, Heterodera glycines
  misc_feature (21)..(21): n is a, c, g, or t
  Promoter: Source sequence=SeqID_17251; Location=1..282; Strand=+; Gene=SeqID_81721
gcaggtcacattttttaaaantccgaaagcaaattgatagtacgcggaaatgccaatttttttttgtttataatttgttaattaagttttgtgaatttagacaattgtagagtcaaatggtgccaatggcgaaaatagggacaaaatgaaaaccctaaacgtactggattacattaaatttgcaattattacttgtattttgctatatgtactggaactgaccttaacgatagcataaacgatgtcatattttatttaggtcaagtttccgccacttcaatg

SEQ ID NO: 114043 - DNA, 111 bp, Heterodera glycines
  Promoter: Source sequence=SeqID_3848; Location=1..111; Strand=+; Gene= SeqID_52119
atttgcgaaaggatcctcatccatttgatgagcctcgatgagggggaggaggaggcggggaggggccatttcctgcgactttaccccgtcgtcctttgctgttacgtcatg

SEQ ID NO: 114044 - DNA, 204 bp, Heterodera glycines
  Promoter: Source sequence=SeqID_19032; Location=1..204; Strand=+; Gene=SeqID_83762
aatttgtggtatgcaaatgtgagtgtgtaggggggaagatacggtattttaatatgttttgcaaattataccaagatagtctaacttttcttatatttagctaatttgacccaacccggacaattccgctaaatcaaggtagaaaattccccactccttcaccctatacatatttaaaacttttagttcgcccacatttctatg

SEQ ID NO: 114045 - DNA, 378 bp, Heterodera glycines
  misc_feature (144)..(144): n is a, c, g, or t
  misc_feature (150)..(150): n is a, c, g, or t
  misc_feature (260)..(260): n is a, c, g, or t
  Promoter: Source sequence=SeqID_11697; Location=3016..3393; Strand=-; Gene=SeqID_75177
aaaaaaaaaatcaaagtacttgatgagaaaaatcatagacaaaatcaacgattttgcaaatccgagcttggagtcgtatcagtgccttttttacccctgaaaaagctcaaagaaaatttctatctcttttctatcgggacaccnaattcnccgatggatttcccattttttttgacatgttcgtcacttttgctgataaatttgggggtagagcaaaaaatgccgaaatttgaatattctttaggtcccccaaaacccgngtcacgtctcttcccccggttcaatccctgtttttaattgcttatttaccgaattcaaataattttttgcaaggtgatccgactcgctgccacaccggaagagcctgacgagcccatg

SEQ ID NO: 114046 - DNA, 393 bp, Heterodera glycines
  Promoter: Source sequence=SeqID_60; Location=1850..2242; Strand=-; Gene=SeqID_58489
caaaaaatctttcaaataattttaatttgtaaattgctggatatgtatgaattaataaaaaggtatctctataataatttttacaattcaaaataaaagaaaaggagaatcaaattttttggacattttatacatttgttataccacatttaaatcattcatgttcaaaaaaatgtccttaaaaggtacagaaatatttaaaaaaatcatttcactaattttatatagttcatgcattccggctatttataaattaaaattaatatttgctctacagattgtatatagttataggtgggtcctacccccgcgcgtagttttaaaggtaaaggtaaaaaggtaatgttatatcaaaatttgcattgttaaacaaaaaagttttgcttaacaatg

SEQ ID NO: 114047 - DNA, 293 bp, Heterodera glycines
  misc_feature (24)..(24): n is a, c, g, or t
  misc_feature (95)..(96): n is a, c, g, or t
  misc_feature (107)..(107): n is a, c, g, or t
  misc_feature (114)..(114): n is a, c, g, or t
  Promoter: Source sequence=SeqID_12394; Location=1..293; Strand=+; Gene=SeqID_76003
ttattatagtcgcgagaattaaangcagcaatagtgcgaacggaaatttactcaaaaatatattacgggtaaaaacaaagaagaagcgcaaagtnntagttgcactnttccacncagaagcatgtcaatgccacggaggtgattccgttgtacattgtgaatgtgaaaaaagtccacttaccgaaatatttgctaggcaagagaaccttttacccattaaaacacagggaagttacgtatacttcgattcccaaattaaagctaaaatacaacaaacaacttctcttcaaatg

SEQ ID NO: 114048 - DNA, 413 bp, Heterodera glycines
  Promoter: Source sequence=SeqID_5886; Location=3128..3540; Strand=+; Gene=SeqID_59562
gtcaacagcagcacacaaaaataggacagctaataaaagacaattcggactggttgtgtgcattggcaaggaccagatcctctaaaaagtgtagaaagatggtgtgtcacgcaaccagcgaacagctgttagcactcgtggaaatttgtctaaatcttgtcgcttcgcgtttccaactgactagccgacagaaaagaagactgatgccctacgtggaaactgtgcgacggatgagcagagcgagaagtgaacgcggtgcgagacgtgtgcttgtgcagaaaggatcaggattcgtggggttgtttgccgccctcctaacacccgtgctaattgaagtagcaaaatcatttgtcaccaaaaacgcataaatacccgacaattttgttgttttcgtttacattttttgcaaaatg

SEQ ID NO: 114049 - DNA, 112 bp, Heterodera glycines
  Promoter: Source sequence=SeqID_14634; Location=999..1110; Strand=-; Gene=SeqID_78721
tctgagaaacggcgcccgagccagagaaaggcggtggttgaccccattgaacattgccgttcttaggggtgggggccgaagtaggggtgtggtgggggtcaccaaatcgatg

SEQ ID NO: 114050 - DNA, 93 bp, Heterodera glycines
  Promoter: Source sequence=SeqID_29181; Location=501..593; Strand=-; Gene=SeqID_59719
tcatccacttccgctaatgatgatgatgatccctccgtgtttgagcatctttgttcgccctcggccatacggaggcaaggcgaagaagcaatg

SEQ ID NO: 114051 - DNA, 76 bp, Heterodera glycines
  Promoter: Source sequence=SeqID_14224; Location=1814..1889; Strand=+; Gene=SeqID_78240
ggtaaaaaatctcaattcctcccttaacattaacaatctttcacctacagcaccggacaaaggcgactgcgaaatg

SEQ ID NO: 114052 - DNA, 460 bp, Heterodera glycines
  Promoter: Source sequence=SeqID_1285; Location=1..460; Strand=+; Gene= SeqID_71574
actaattcaaaatttacactggtaaatgccttttttgtattgaatgatttctcatttctcagttacaaatttcttcattttttgctttctttttgctccttttctctccccattttatttctcaaaaagtgacattttcttcagttaaaaacatttaaatgttctgctgatgactgacacttctcaaaatacaaatgcatttgctttttgtttttcccttttcttttctcttttctcttttctcttatgctcaatttcccatttctccgtcccatcgatttgctaagtgaataaaataaacaacacagccaaagaaaggactttcgactttcgcttttccttattttttaatttaaaatatttttgtagttaaatttcaaacattcttttaataccatgtaaaataattaatgcaaatttcaaattttagctgaataaatattattttagctgcgaaatg

SEQ ID NO: 114053 - DNA, 958 bp, Heterodera glycines
  Promoter: Source sequence=SeqID_10810; Location=542..1499; Strand=-; Gene=SeqID_74073
aaggcggagtgagagctgcttttgacagtcaatcgcgtgttttgacatgtccagcagatgacaattgtccagaggggtacaaatgtgtaaacgaacattgttgtcctgctaataaaggtattaattaatttattaaagaggtcgggaccgggatcagtcaagttttttaccgagataagtcccggttcatgggtttatagctggatttcccggtttttctttttgtttgactgattcgccggtccataacctggatcctgaccccgggttccagaattctccaatctttttacctaccctggataagtgatttccaatgataatttttgccagcaaaaaggcgagaagtaatcctatgcgggaatctcgcgttttcccgttatcccgcagaatttgcgggaatccggcacttaaaacgggaaaattctttctgagaaaaatgattttttttttctggtggattaattccacaaaaatgccatcctaagcaatggttgttgcgtttattatgttaattatttaacaattttcagacattgtctgcaaggttcaaagtgatagtgggaaatatgtgtttcaacagaatcatacacaagttaattaatgatttttcagaattaaaattgatttcaaaaaaatttagcgttatttttacaaagctttggctggaaattgtgtggtgttctcttattttggtgcacttggcaatgcgaataattttgagtaatttaagaaaaatatccatttattattttgaaaagttttattttagaacttacgaagaatgcatcaattattgcaaaaatgcttagaagacattttttgaatttctaaatttttctacttaaaataaatttttctcagaatttgttataataaaatattgttatatcaaatcatactaacattttattatttttatttatgttaaaaaaataatattttttttggcaatatg

SEQ ID NO: 114054 - DNA, 120 bp, Heterodera glycines
  Promoter: Source sequence=SeqID_8942; Location=787..906; Strand=+; Gene=SeqID_69746
gttatctgatgagtcattcatttgccaaaacctgttggtcctcacaaaaaaacaactaaactaaaacagcgttcctccggcacttttgttgcgaccgactcatcgggcggcgctcagatg

SEQ ID NO: 114055 - DNA, 1003 bp, Heterodera glycines
  Promoter: Source sequence=SeqID_6500; Location=1473..2475; Strand=-; Gene=SeqID_61806
aattccgatgccccaaaaattttcggaagtcggaagtcggaattccgatgccccaaaaattttcggaagtcggaatttttcaaaaaaaaatataataaatttttaaaaaaatatttaataggctaaatttttaaatttttaaccatgtaaaaggtaatttcaaactgtttttagtttatttctatgttttttaaaaagatcaaaatattttaagtaattttacattattttggattttttttgggaaagttacaccctttttttgcggcgcgctttatccaaagagaatttgagaaactgtggggaaggaagggtccggcggtgccgatatgcgccgccgggaaaaattttgtaattttaatgtaaattgttaacaaattttgtccaaaaaatggaaaatttagcgattttgagcaaattttcaagaaaattaagtttttttttgagtccggcggtgccgataggtgccgtcggaaaaaaaattgaaaatttctatgcaatttattaacataaattgtacaaaaattgctaattttttgaaaaaaaaactcaaaaaaattccgaaaaattccgacttttcatcaaaaatttcggaagtcggaagtcgggattccgaggccccaaaaattttcggaagtcggaattccgtgccatccctggtatgagtgactgaatcccattagtggggggggggataaataagcattggaattgcagtagatttggcttaagtataaataaatgtttaatgcatgcggtaataatttaaaaaaaaaaactttttttctatctgtcattttccctttattttggggtcatcatttagcctcatttattatatttccatttgccctcacaaataagtgacctctaatacacaaaaagtgcttttatgcagcaatttctcagtttctcaaccaaactaacaataaggaatataataaataattattattttattttagaaaaaaaaataaaataaatttcaacagaaattcaaatg

SEQ ID NO: 114056 - DNA, 272 bp, Heterodera glycines
  Promoter: Source sequence=SeqID_26197; Location=1..272; Strand=+; Gene=SeqID_56942
tttttgaccaaaattcgttaacaaatcgcattaaaaattaaaacattttcccggtggcgcctatcggcaccgccggaccccctgtttccaaaaagtcttttggaataaccgccgcaaaaaaagtggaatgaaagcaacaaaaaaaaaatcgtcacccgtggggaggtaggaggtacccccctcccacccaagccgaaatcttgggaccgtccctggcctttatttgaacaaaatttattgttgtatacttttacaattgcaggcgcagaatg

SEQ ID NO: 114057 - DNA, 132 bp, Heterodera glycines
  Promoter: Source sequence=SeqID_21255; Location=516..647; Strand=+; Gene=SeqID_51848
tctgtagtgagacgtggccaaactgagtcgacgcggcccggtactagtgcagtttgagtccgccttttgggtcaaattttttcaaaattttttttttcttttttattgtcgcaattgttttttagattaatg

SEQ ID NO: 114058 - DNA, 463 bp, Heterodera glycines
  Promoter: Source sequence=SeqID_31907; Location=245..707; Strand=-; Gene=SeqID_62217
attgctctccaataatttaagaaatcatccaaattttgttggccattttattaaattgactagatttattggtaattgattggtaaatggcctcataaattgcaattcattgattgatttataattcctttctgctgccatcagattggtgttgtgcttcttgggagacaatcggtcgacattctccaagctgtacagctttcgtgtcaacgtctccatggaaatctgcacagtgtgtttttattgcctaatttgggtccaaatggccagagggcgatcaaaaaagtcaaaagtaagaagggcaaacgacaatctaataaataataatttatttattaattaattgtttaaataattattgttaattgtttaaataatatttattcttaaataaaactaattaaataattgattattaattgcttcattccttaatggctaagtcacttcgaccagcaacatg

SEQ ID NO: 114059 - DNA, 582 bp, Heterodera glycines
  Promoter: Source sequence=SeqID_3270; Location=2265..2846; Strand=+; Gene=SeqID_83992
ggtgcgaagctggtcccgcactttgtcaagaccagtggactggtgagaagtaacgtaggaaatctgagttcatcgaatgaatgtggactgccttttgaggattgtggttcaatggccagtcccttaaaggacgaccatggctaggctggtctgctttgcgaccatagccatcagtgtcggtctgctttgcgaccatgacacagtgtaaaattggttcgctgactggcccttcggggcttggtcgcactaatgtggttcgctgacaggcccttcggggcttggtcgcactaatgtggttcgctgacaggcccttcggggcattgtcgcatcaatgtggttcgcagacaggcccttcggggaatgtatcgcaccaacttttgcatctgcattcttattgagatgtgtgagccctggctgatggatttcagcacaggacgactacactccacggcgaagaatgatgacagaataacctttttgcgcaattttaaataaatatttttattttatgtgcatcatatggttattttcctcatactttgtgccacatttgcaacactttctgatttgttgtttcagatg

SEQ ID NO: 114060 - DNA, 207 bp, Heterodera glycines
  Promoter: Source sequence=SeqID_23968; Location=1..207; Strand=+; Gene=SeqID_54671
tggtactctcatgtcatcaacgtcaacatccaaacggctcactcccgctacggtgaatatgtgttcaagcgcgaaggtcaggtatatcaagtggacagctacatcaaaggcacaaatgggaagcgggacaaaataatagaggtgaatgggtgtctgtggcacggttgcgaggagtgtttttgtaatattgacgaagaaactaaaatg

SEQ ID NO: 114061 - DNA, 846 bp, Heterodera glycines
  Promoter: Source sequence=SeqID_7344; Location=1..846; Strand=+; Gene= SeqID_64531
ttggccatcgatggtactcaagaatgtaaaatttgattgcctttaagcaaagttatgccatgttttgtcgaaaaaattgctaaaattggcggattttatgaaacgacctagcaccttcataagcaatcaagaaaaagtttaactaacgataattaacgaaaaactcacaacatttagacacttctacttttgaatcggcccaagacgtctttagtgccgtcaaagaaatgatgttcaaggaggatgacgagcccatacaaaattcaatgtgttaaattaatattaaaatttagctatttttaaaataataacttttttgccaattagtcagttaaaattttccaaaaagattttcaaaatttctgaaatattcagtgaaatacaaaaaaatattagatttatactggtaatgaataatttattatgtttgcatttgctcgtcagcatgataaaataggatgagagaaaaattaaaagtatatcctggtaacatcattaattttaggtgtttgctacaagacataattacgggaaaaaattttcatcgcaaatcggtggaagagctccaaaacataatcagactcgacacacttcaattggtttgtaagaaaaaatcattgttatcatgccattgatgaaagacattttgaaattttttagctaaatattttttacttatttttgatttttagagcatatttttgtttttttttatgatctgaaggctacctattttggcagtttttagagactaaaaatcgtgtcctttagtcaaagtgccatgaccaaattttctgaaggctttactaacaataaaaatgtattttttattttttgtagatgatg

SEQ ID NO: 114062 - DNA, 93 bp, Heterodera glycines
  Promoter: Source sequence=SeqID_30148; Location=1..93; Strand=+; Gene= SeqID_60580
taattaaagtgatttttgataggatggcattctgtgtttgcgaaatttcccatctccaaatgttgtcgtcccttaattttctactttgaaatg

SEQ ID NO: 114063 - DNA, 359 bp, Heterodera glycines
  Promoter: Source sequence=SeqID_18834; Location=2985..3343; Strand=-; Gene=SeqID_83527
ttttgctgtttcatttgatttatttcagcattttcacatatattaattttctatgattaatcttaattttattttacttaagccattttttaaataagacaaaattatatgagataatagattcaataattttaaagaaataatatatcctttttttgttgcataattaattaaatttaattttttcatatttcgatttggtaattttttatttttttttatttttcattatgtctccatctcttcgaatcgaaacgattgataattatttgatttttctgatttgtgctttgagattttcttttttattaaatttttcagtcgatatttattatttttgaaggttttcctcgagaatg

SEQ ID NO: 114064 - DNA, 226 bp, Heterodera glycines
  Promoter: Source sequence=SeqID_25030; Location=1..226; Strand=+; Gene=SeqID_55763
agtacaaatgccgcgcgaatggcgactgtccaattgacaaaggtgagagagagaaagccaagagtatgaatggcaagtggttattttgataacacttgtttcatctttggattaggtcgatcattttcaatacttatacttttgtgctgttttctttctgtactcagatggcatgcgcaattgttgtcgtgcctgccgccttcggcgctgttttgaggccggcatg

SEQ ID NO: 114065 - DNA, 82 bp, Heterodera glycines
  Promoter: Source sequence=SeqID_33737; Location=122..203; Strand=+; Gene=SeqID_63711
attttcgctttttattattttttttttaattataaatcatatttatttgttaaacgattttagaaactacaaagaatgcatg

SEQ ID NO: 114066 - DNA, 137 bp, Heterodera glycines
  Promoter: Source sequence=SeqID_13760; Location=1164..1300; Strand=-; Gene=SeqID_77679
atggcaccgaaaatcatttcgaattttgaaaaggcaccttttatcgggcagggaaagcctttggccttggaagtgcgggccgagtcgaggccaaaaggcaagcgaaaggcgaaaagacgcaaattgagatgaaaatg

SEQ ID NO: 114067 - DNA, 216 bp, Heterodera glycines
  Promoter: Source sequence=SeqID_6858; Location=2806..3021; Strand=-; Gene=SeqID_63124
tacagattgggatcagttcacatgggatcagtgtgttcagtgaggtagggttttctcacttttgtcttatatagcgaagatcagagcagttttgcaaaaaaaaaagaggaaaaacttttatttatttgaaaaaaattaaataaaacactcaaaaatgaaatgcgtaacaaataaacgagtgaattttaataaattttgaaattcattcagcaaatg

SEQ ID NO: 114068 - DNA, 204 bp, Heterodera glycines
  Promoter: Source sequence=SeqID_16419; Location=2949..3152; Strand=-; Gene=SeqID_80822
tttaagctcgcagggcgcatgaagaaaatgatatttgaaaaaacagaaaaatttttcataccaaagaaaacaaaattttaattttttttcttttcattttaaattaattttaaaacttcgaattcttcttgagattaaaataaacaaaaataaaaatattttttagatattatatatttaattgttttattttgatttataatg

SEQ ID NO: 114069 - DNA, 64 bp, Heterodera glycines
  Promoter: Source sequence=SeqID_188; Location=3044..3107; Strand=+; Gene=SeqID_47110
ggggcgactgagcaaaccacctaaaagtttaaatttaaactcagaaaaagcaattagcaaaatg

SEQ ID NO: 114070 - DNA, 1003 bp, Heterodera glycines
  Promoter: Source sequence=SeqID_7753; Location=41..1043; Strand=+; Gene=SeqID_65838
taaaaagagtatatacggtattctttgcttgttttttttgttatgtttttactgaaaattgtatttttgactacttttggctcataattttgccattttttgtcaccttttcggatttttgtcaaactattttcgcgtattttcttcactgtttcgttaactatgctgagatttttggcttcaagaagctaattatatccaaaaatgatcatttttttcgttaccctaatgcggaatattggcttgacagccatgcacatgttataacctttttggtaattgcctaatcgcgaagcaataatttaaatacagcttctaaacaagataataaattgtgaatgtaattccgactacaaacctttcgaggaaatggtcatttataaatttagaaatagaaattctaattaaaaccttcatttagttccctggctattaggtcaatatttagtattaggttattcatttcaataaaattatagaaagtaatttcatcagtaaaaacataacaaaaaacaaacaaagaataatcgaggtttggcaaaatctttgaaatttgcttaatgtagaatattttttcgaaatttcgatttctccacttcggccatctccaattggaaatatttttagacgatttttttaaaaaagaaaaaataataatttccttaaaaaatttaaaaagaccgttttttagggttacctttttaatttttattactttaaaataattggtcagtagatgtaaaaaataatgaaaatcaattttcatgtgtatattcgtcgctcaacgaataaattgagttgctaaaatcaataaattggcgtaacgcactgtcatattgattattttatacaattcattggcactaaaaatttagttttagaaaaaaaattttcattgaaatcattattttgcaaaaatgaattattataattaacattttttaataatataatttataaatttttgcatttaattttttgagatttaattctttagataatg

SEQ ID NO: 114071 - DNA, 81 bp, Heterodera glycines
  Promoter: Source sequence=SeqID_19837; Location=374..454; Strand=+; Gene=SeqID_84591
agtaatgttaattaattttaatggcatgccatttagaatgatggcatcggctccattctcaaagacattgcgccgcaaatg

SEQ ID NO: 114072 - DNA, 206 bp, Heterodera glycines
  misc_feature (47)..(47): n is a, c, g, or t
  misc_feature (53)..(53): n is a, c, g, or t
  misc_feature (72)..(72): n is a, c, g, or t
  Promoter: Source sequence=SeqID_32050; Location=1..206; Strand=+; Gene=SeqID_62361
aaaagctcgggaatatgtttcattacttttgatgacataaaatgaanattttntcgacaataggagatgccnaaggcttacggttactcgctctaattttggtttttccatctccaaaaacattgcatttcccgaaaattgccttttttttatcccatctctaaaaaatgccatcaattttcaggcgcagaatttgtgagcgcatg

SEQ ID NO: 114073 - DNA, 1003 bp, Heterodera glycines
  Promoter: Source sequence=SeqID_3606; Location=3690..4692; Strand=-; Gene=SeqID_51073
atgtcccgcgccaaagtgaccccgaccccaaaaaattgtggtagaaaaaaatcaaaaacatgcaaaaagtgctatgaaattgagttggactctctgatccgaatttaatgtgtgaatttcccataatttcctcatctttatcctcttcggttgcacaatgtaaattaaacacatttgaagatatgtagtattcaagcgtcaaaatgtttgatcgtccgccaaatcatggtccaggatctttgctttttgaaaaatcgattctgaggggtgcattttttgaaaaaaagtaacgccaattttttgttttgtttttttattgctttttcataataatgtttctgttgaaaagcagaaatatttaaaagttttttaaaaatttcacaagtcataataattgtttaaaagtcgctctaaatcgaaaagtgatcgaagaaaatgtgtttttgcgcttatctcagcatatgttatccccccaaaaaagtaggtgaaaacctaaaaatccgttccctgctaatatcgatgattgaaaaattgttaattgctaggaaactgaggcggactctctgatcgggtttttccggatttggtaattctcaccgatcgatgcacgttcaaatgcacgaaagcttgcctttgatttgaatgttgcttgcttatttgttagctcggattcgtatgtacttgaatggcaagtacgtacttgaaattgactctcatgcgagaaaatttagaaaaactctcgagatttttcgtcactaaaaatcgcaacctttcttattaccctagtgaatttttaattatttttttctaagcggggggatgagtgaacccttaactacttaatggatttccaaattctctagataatcgtttcaatcgaaaattcatttctcaaatacaattaatcaatttaattattcatttccgtacacttaatcagcagacgacatttttgttgctttgatccgcttcttcttcgtctttttgaaaggttaccaaaatg

SEQ ID NO: 114074 - DNA, 62 bp, Heterodera glycines
  Promoter: Source sequence=SeqID_10134; Location=1100..1161; Strand=+; Gene=SeqID_73228
tgtatttttgtttttattttatatattattaaaaaaacaagcaataattttcagaagtgatg

SEQ ID NO: 114075 - DNA, 131 bp, Heterodera glycines
  Promoter: Source sequence=SeqID_2808; Location=960..1090; Strand=+; Gene=SeqID_81729
aaaccccacaaaaggccatcaagtttttcaaaaacccggcaccgaaccccaaaagccggcaaatcccggcttttccattcaaaattgcgatcctgcagaccaaccctgctgatggcctgctgctggagatg

SEQ ID NO: 114076 - DNA, 1003 bp, Heterodera glycines
  Promoter: Source sequence=SeqID_5695; Location=30..1032; Strand=+; Gene=SeqID_58936
aaaaaatgttaccgtgggaaaattttctgtttgctcgtttttgacaaccataaaatcaatcaatgttttaaatcacatttaagggatgtaatttttaaattaaattgtaaaaaaaattttaaaaatcacttcaatagaaaaaaggatatttaaatttaaaaataatacaaaaatgacgggtccggattcggaattggaatcttgcagcctgggttggattgccgagattaaaatcccaattttggcggaatttgaatcctgcccgggacaatcctgttttttgggatcccgatcctgacccttaaaataaattaaatttgtcgtttattctcgttttcgaccgagaaagtgaaataaataatagaacctaaaaagggcaaaaatatttggcggtttaatttatggcacagctgttaactcccgaaagatttttttttaaattttaaaaatgtcataaatttttatttttataaatggattaaagaattaggattatacaaatatcacagcaaatcaaaaacggatgaacaaaaaattgaaattgtgcaaaaatatataaataattcggaatgaatggaaaaagattaacggagaaagaaaaaatggagaaagtgaaaatatattggcaaataaaaggagaaaatccaaaaatgagtgacgagaaaatttcaaaaataatgaaaattaatgaaaacgctcagagatttcttgtgatcagtaggattggaattttaattaacgatgaaatttttttatttacactattttttaaaattattgtctagcgaccaatcagtagaaaagagaaaaatataaaaatatttttgagaaataaattattatttatatctctaattatattgaataaatatcaattttaattaaaaaaaatatcaacaatgaaactgtccatattattctttttaattgttcaaattgaaattggagcagaaaagaaaaatttgaacaaaaaagcatttgaagaaatatttggagaaaaatg

SEQ ID NO: 114077 - DNA, 1003 bp, Heterodera glycines
  misc_feature (465)..(465): n is a, c, g, or t
  Promoter: Source sequence=SeqID_2397; Location=294..1296; Strand=+; Gene=SeqID_79526
acatactgtacataattagtaattacaagctctagttatggcctatgttaagaaacgcgattgaaagcgcttaaaaataagctaacgagcgcatgaattcctcggtgtgcggacatctcgcctactgtcattttgtgtaatgacatttccaaaatcggacgtttcgcctactaacctaaaatcggacgttttgcctactaaccaaaaagcggacgttttgcctactaagccgattcggacatttcgcccacttaaccaaaaacatcatcaaaaaaatcattgatatgtatagggcaccgaactggctgcgccgaaaaaacccgcgccgaatggcccgtcgaactgggcgattcccgttttcgatcattttcccttgaaatacggtagaaatcagtcatttttgagttgtccaacttctcaccctctcttgctctctgggtataagtcatagacccaccacccaanaaggcaattcggtagagaattttgtgctctttccaatgggtttatttattttctctaaaagaattttcccaacctcctaagaatttttttcgaaaattttcctgatttttagtgtattttagggtaactctttccctatgcaggagtgatcactgatcagataagttggtgtaaaagacttttttgaaagtttagtccgtagtccggggcccaaaacatgataaaaatttgaaagactcgaaacttttttcatatgagttaaattgcttagcattcgcttagagaaagattctcttttcaaaacttttcgaatgatatcaatattcgatttacttggtgggaatgaagtgaattatggctgatctaaataaacaatacaataaatggcaatgatcagtgtaaattttgaaatagcgcacaaaattacgaaaattggcgttatgtatttattcattttgtctattttaattttctgttcctgacaaatgagccttgagcttttgaaatttttgagtttgggtaattttggcaaacaatg

SEQ ID NO: 114078 - DNA, 768 bp, Heterodera glycines
  misc_feature (49)..(49): n is a, c, g, or t
  Promoter: Source sequence=SeqID_38672; Location=1..768; Strand=+; Gene=SeqID_67415
gcacattttgggtaaaaaataataaaaataaaaataattaattaaaatntaagtgaaattgaatacagtaggacagattttgatgaaaaactggagagattgtggaaattatttgggggaattctgtccaatgcgacggagggatttttggacaatgaaaaaagcgaaaatgaggcgaatttggcgaaggcattggccgatttgagcggttatttggagagggaatttggcaaaattggcgaaagtgccaaaaattacactgtcaattttacagtgaccacaattaacagctttttactgttttgcttaaatgaaaataatttggaaaaagtgcaaaaaatggcgcaaaaccggcaaattttgaaggaaattttccaagaagtaggggaagggattgaaaattttgaaagaattttcggacgcttttggcagtggctagaagagaaagcggccgcggaaaatactgggggtaattaattaattactatttattaattgattttataaattgagttgaacgaaacagtttaaattttacatttaaaaatttctctttttctcaatttttatgcttttttgtcatttgatacattttgccatttttaaaataaataatttaaataaataatttttatatattctttttaattagaaaatgacagcaaaaaaataccaatagaatttgtaattgaacaaaaagccaaagagaaaaaattagaaaatgcaaaaattataaaaacttacgaacaatgcccaagggcaaaaatg

SEQ ID NO: 114079 - DNA, 361 bp, Heterodera glycines
  Promoter: Source sequence=SeqID_13262; Location=611..971; Strand=+; Gene=SeqID_77092
attacctattttataacagactaataattttgctaaatagttcattgcatttaatcaccatttcatattgttctaataaatttaaatattaatcattataaatttctttaatcccctttggtgtttgaatacacccgtaaatgtgacaagcgcatcgccggtagcggcatgatgcattagtttctcttttgtgccggttcagaaatgccgcacatccctttgttatttgaatttgaccccgttcgcatcggtcaccgaagcgtcggaccttggctacacagatggccacgatcccgtctcatataaaagggcacatgggaaagtcgccctctttttttttcaccattcacccccaaaaatg

SEQ ID NO: 114080 - DNA, 535 bp, Heterodera glycines
  Promoter: Source sequence=SeqID_8521; Location=479..1013; Strand=+; Gene=SeqID_68380
agtgagcgaatgaatggaggcaaaaaagggggaattttttttttttttttgatgggaaggttagttttttttatcagaaagaatggaaaaaaacactttgtccttgtgagcgtattattgtaaagcctggggccagcgtgggccgccgcgttaaattcgcgaaatgcgaaaaatttgaaaaatttccattctcttgaacattcaaacagcatttatgtatgtacaataccataaatagaaattgaaaacaaaaaggaaattgtaaaattattccgggtgaatgaatgcggcgaaaaatggtaagatttgggcaaccctaactgggcctttccaagaagaaatttcatcggtttagacattttttgtcacattccttttgtacccaccgccctctaaaaaaaaaaaaatttttttttgtttttttttcgagggtaatttatgcggtgaacatttaggaatttatcatgaaaaattgtcaaaaaaatttttcaagcgaacataaaagaaccaaatttttaggttagttgccaaaatg

SEQ ID NO: 114081 - DNA, 110 bp, Heterodera glycines
  Promoter: Source sequence=SeqID_41440; Location=724..833; Strand=-; Gene=SeqID_69557
ttggactgagaacgcgtgtggccaaatacgcggaagcaaacgaaaaatgtttattgaccaagtccggacccgaagaatttaaagaacacacaattccgattcggcgaatg

SEQ ID NO: 114082 - DNA, 77 bp, Heterodera glycines
  Promoter: Source sequence=SeqID_675; Location=4689..4765; Strand=-; Gene=SeqID_58772
ggtcagttaagggggagcagtgccgttatttcttgggcggggacagttttccattggtgtactgtatgtaacacatg

SEQ ID NO: 114083 - DNA, 743 bp, Heterodera glycines
  Promoter: Source sequence=SeqID_4211; Location=1100..1842; Strand=-; Gene=SeqID_53609
ttggctttacttcgccgtttttcaatttctctcccaaattcaatttgaagtgccaatgtcggatatcgaagcggggaattactttaccgttttgataaaactcagctttgtagacggttttactttaccgagctgataactgtcgaatctttccgcttttctccaccaaatgtgatttgatttcacttttacactccttccaactcgtgagttacttttcactttttggagacgctgtcggacttatagtctacaaattccccggatagtaccgcgttgatcgtcacctttttccaggagcgccacgtcgtaaaattagccgcctttttgccggggtccttctctgctcttttgccgaattccaaaacggggcgaaggagaagaatgagaaggaagacttttaaaatcacttaaagccacagcaatccaaatcaattaaatttaaacaacacaacaattaaaagcaccattaaaattaccacacaaaaatccacatcaaaaattaagtccggggcgatgcaaaaaaacaaaaatgaaaatgaaagacacaaaaaaataaaacaaaatgccaaattaattaaaactttaaaagtcaaatgaggtcattatttaattatcacacttatgtaatttcttattataaatcatatattaaaataaattgttatattaaaattgataaaatgattaaaaaataaatgcataaaaaaggctgaaaaataattttattaaatgagcaaatg

SEQ ID NO: 114084 - DNA, 719 bp, Heterodera glycines
  Promoter: Source sequence=SeqID_16644; Location=1768..2486; Strand=-; Gene=SeqID_81054
tctttaattattgacttattcttttcctgtcaaataatttttcattttttctttttttaattttttgttcattcaataattattgattcgaatttgatctttattaattttttagttaagatgtgatgttctcgttccaaaaatatttcgagaaggctctcgaaaaggaagagtttttctggccgaaaaccagaaaaaagtggaggcgttgttaattgagtcatcaaattataaaattgctgtacatagagactatgaaagccgcttttctgatttattgcaacatatcgccgcatctctttcttctttttctgtaagattgtgagaaatttaagatttttacgactcggaaaaaggtacgcctatgctaagagcaatgggcaaagcctggggcagagagctacttttgaaccctgttgattttttaattgacaacaaacgtgtagataggaggaaacaaaaaagaaaacaaaatttcaaaattttttagagatttggttcgatcatgggacctactctatagacttccgccttcacttttcgacacttcacgccgtgtgattgctgagaataaactggaagaatttttaaattacaagcattattctcatgattttttataataaatattaaatgcaaagttctttttaaagtgaaggttttgaccaaactattgatacaattttaatttactatttttttagaaatttcaaaatatg

SEQ ID NO: 114085 - DNA, 100 bp, Heterodera glycines
  Promoter: Source sequence=SeqID_8381; Location=2336..2435; Strand=+; Gene=SeqID_67868
ggcgagtcgacaacaataattatttttcactgaccaatgtcaatttatttcatttgcaatattttttttcaagtttttcggaggacgaaatttttacatg

SEQ ID NO: 114086 - DNA, 749 bp, Heterodera glycines
  Promoter: Source sequence=SeqID_24295; Location=1124..1872; Strand=-; Gene=SeqID_55015
tttttaaattgctaaagaaataagaatttaaacaaatgtacatattttctttaaataaaaatagaaaaaaattcattttataaaaaataatcttacaagaaatcgtctcgaaaaataatccaatagtcaaattacggatcaaaatttcggataaatcccaaaaatacgcaacccgcaatccgcaattacgggggtccaaaaaccccgcaatttccgtaatccgcaatccgcaatccgcaattgcgtccagccctggtgctgtcacagagtgtcctttatgactcgaaaagtttcttttatttgtaagcggcaattacttttttaagacaattaattaatttatttattttttgaatttatttgtgtaattaatagggcggaaatttatttatttaaacttttttctgccaggtttatttgatgaaaaatgcaagaaaattacttcattttttgccgtaaatgtttcatttgaaactttaatatccataatataaattaaatgtttggagctttcataaataaaatattaatttatggaaaatatttttattaatattttatccatatttgataaatattttgtagtttcattcgtaattcatttaaatattttgatatttttcataaatataaatgccggccttattaattaatcatgtaaatcagagaaaaaaagagatttccaaaattaatcatttaaatttttaattttttcataaaaagtgcccgaagtgaaaggaagtccaatg

SEQ ID NO: 114087 - DNA, 613 bp, Heterodera glycines
  Promoter: Source sequence=SeqID_19175; Location=779..1391; Strand=-; Gene=SeqID_83925
taatttaggtggtatacgccggcaatgttttcactggcattgatcgattgattgtgatattttcaatgaaatgtaaattcacaaagaaatccctcaaaaatttattgtttttcaggcactccaaattcaaaattcgcctgtatttaggctcaatgacaattttttctgtattatatggttgctgtaactgtatcaatgtgttttatttcgcaaaattagatggtgatcagttgatcactggttgccttgctgacttttatttggtacaaattaaaaaaagggaatttttagcatttttttcgccaaaatgacaaattttcagcttttttgatcaaattttaaaaaaaattcagtcaatgtagtgttcgactatgccgacaaatgcagccaggaaaaatatgaaaattcaacaaaatcttgataataaaattagctcaatattttataaataaacaataggttttttcattcgagtttaattttacaaaaactgcgaaatttaactcacattttgggaaaaatatgtttaattttggatttttagtcgtcacttttttatggccacatttacaattttattaaattttagcataccaattcattctttaacatg

SEQ ID NO: 114088 - DNA, 1003 bp, Heterodera glycines
  Promoter: Source sequence=SeqID_3631; Location=968..1970; Strand=-; Gene=SeqID_51203
atcggtcttcaatttggaaagataatcccccaaaggaagtggccaattgtgccgccgtgccgcccctcgggcggcgcccggcggctccgttcccttttcggtgaggagaagggggggggggagaataatgcgccaattttgcccaattatattacgatgatggcacttaagtgggaagcgtttaattacggtgctgaatgctgttgggatggtggtcggcaaacaccaaaaataattttgggacaaacatttgccaaatttggcagagcgcgaggtgccgaaaatagggaattttattttttggcattttggaacagtatttggcaatatttaattggaccaggcaatcaaaaaaataattgacagattcaatgttcgaatttaacatttttcaaatgtatatttattgaggaaatatttcttgaaaaacagcaaatgcctaaactaacatttgaaaatttaatttgaatttaattaatcccaaaaaattggcattttgcccatcttttacgcgctcattgttcaccagcagcagcagttcccattatttttgttatttttgttttgcacaaatatgcaactcctcagcctccttcactaatctcattaagtaattgttttttttttttgacttttttgttttcccataaacccccgaggggttaaatgttttttttgcccccagcaaagtccccataactaaagtcacaaagtcaattcatcatcatcttcatcgtccctgagaggaccccaaaatcctctccatgctgatccaatttttgggagcacacatgggagagaatcgcgtgatgagacgcccccccccccgtccccgttaattcggtagccaattatccccccgccgccccaagccttccaaatttgatgatggccgataattatgcgttacggtattacggtaacaaatgcgcacgcccaattttggcattttcccctcgggggtcaacaaaaaggtgacgacgatgatgatgatattataatg

SEQ ID NO: 114089 - DNA, 455 bp, Heterodera glycines
  Promoter: Source sequence=SeqID_12643; Location=1..455; Strand=+; Gene=SeqID_76318
taatcacccaaaactgttcatacgtttttttagaaagtcgaaactttagaccaaaactctcgaacagcgctaacaattattgagtgttctatgcattattcatttctttttaattatttcaattaattaattgcattttttgtccatttggctgtacgtccagccagggtcaaaagtattgcatcaaaaaaatatttttttgaaaaatacgattttctctaaaatgaatggagggaaaaaagtattgtttacgccaaaagaaacgtcaattaatgcactaacaaatacccaaaaactgggcccgataactctctttgtcgtcgagaattggtcatgaccaaaaaaaccctttttttgatgggacaaaagtaatgtatcaaaatattttatgattgttctcttggtttcatacgatcaaaatagcgtaatacttctctgattagagtcttaatatg

SEQ ID NO: 114090 - DNA, 81 bp, Heterodera glycines
  Promoter: Source sequence=SeqID_8477; Location=3459..3539; Strand=-; Gene=SeqID_68208
ggttggccaagcacattttgcacctgatggttaattttcattgattgtttcaaatgatagggcaaatggactcatccgatg

SEQ ID NO: 114091 - DNA, 321 bp, Heterodera glycines
  Promoter: Source sequence=SeqID_23314; Location=1205..1525; Strand=+; Gene=SeqID_54019
aaaatgtgtcatttcaatactaaatcgtttcgattcgattcgtcgctcaattataacgtcttttcgtgactgccttatgttaaccgaaaattttaataaataacaaaaaatgataaggacaaaggtgagaaattgattttgaactgggctttttgagcaagaaaagaaagaatcgataaatcggtagaaatgcaaaaaaagaagacataaatctagggatttggcttttgttttgaaagaggcaaaatttgtatcactgatcatctgattcattatcaccatcattttcgtgacgaagaacgggaattgcttgtacatatg

SEQ ID NO: 114092 - DNA, 62 bp, Heterodera glycines
  Promoter: Source sequence=SeqID_28458; Location=888..949; Strand=+; Gene=SeqID_59072
ggtggggaaggggggaagacaggtcgagactctcgactgaattaattggaaacaaaggaatg

SEQ ID NO: 114093 - DNA, 1003 bp, Heterodera glycines
  Promoter: Source sequence=SeqID_3606; Location=3791..4793; Strand=+; Gene=SeqID_51074
attgtatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagcaagcaacattcaaatcaaaggcaagctttcgtgcatttgaacgtgcatcgatcggtgagaattaccaaatccggaaaaacccgatcagagagtccgcctcagtttcctagcaattaacaatttttcaatcatcgatattagcagggaacggatttttaggttttcacctacttttttggggggataacatatgctgagataagcgcaaaaacacattttcttcgatcacttttcgatttagagcgacttttaaacaattattatgacttgtgaaatttttaaaaaacttttaaatatttctgcttttcaacagaaacattattatgaaaaagcaataaaaaaacaaaacaaaaaattggcgttactttttttcaaaaaatgcacccctcagaatcgatttttcaaaaagcaaagatcctggaccatgatttggcggacgatcaaacattttgacgcttgaatactacatatcttcaaatgtgtttaatttacattgtgcaaccgaagaggataaagatgaggaaattatgggaaattcacacattaaattcggatcagagagtccaactcaatttcatagcactttttgcatgtttttgatttttttctaccacaattttttggggtcggggtcactttggcgcgggacattttggcgccgcaaaataggtctaagtgttctctaatagcctgcaagatgctagaaaaatatattcgttttaacaaaagatatggcgtgctgcgccaaaatg

SEQ ID NO: 114094 - DNA, 201 bp, Heterodera glycines
  Promoter: Source sequence=SeqID_44685; Location=1..201; Strand=+; Gene=SeqID_72133
tcataggcgggatgttgtatattcccagcagcggtgccgcaaaattatccgaaaccgacccttttccggtcggcattttttttcattcacctttatggcacatcatcaattcatttccaatttaaattcttcaatttttaatggggcaaagtgcacctctctttctctctctcactttctgaaaatgccattttaattatg

SEQ ID NO: 114095 - DNA, 1003 bp, Heterodera glycines
  Promoter: Source sequence=SeqID_18312; Location=534..1536; Strand=+; Gene=SeqID_82904
tacaaaaattcttttctatttaaagttgtgcttctcattgcttttaagtcccaccatttccagactcaaaattgcataagatgactaaattgatcagaattttcattgccaaaatgtccttttttggtgaaaatctgttaataaatcaggacgaagttacaaaatttttccggcgtcggattctcttccctcgcccattcaataaaagtcttttttttgtaaaaatgcgccgtaaaaatattggtaaaaatctgattttttcatcccgaacagtgatgccaacccgaacccgaaacccgaggtttttctcaaccagaaacccgaacccaaaattttttgagtgaattggacggagaaaacgcaatggcagtgctttacgcaggtaaaaattttcttttagggtttttgtggtaactaatgaaattttatttcgaactagggtctggctggccccgaccccgaacccctacatttttctgggttaacacgacgcttccgacccttaaccccgactcgtggtcggggttaaatatacactcataagaatggcattttcgaaaaggcaaaagaatttataaaaattttgaatttttttaaactattttgccaaaattttattaaataaagtaaatttactatgtttagtcatatgtagagcccggacatgcacgaaaaatgtgaaaaaaggcataaaaaaataacaataacatcaaaaaaggcacgaaaaattgaaaaaggcagcaaaaatcaacatttttctagcaaaaaatctttcaagaaacctttttttttgctcttcgggcctaatttttttttctccatgttatatcaacaatttcagcaccggagcgaaaaaaaaaagaattttttataaatggggtccggcggtgccgataggcgccgctgggaatttttttttggaaattgtaagaaatgtgataaaaaaaatagcaaaaaatttaagaaaaaggcatatgtttcaaaatccaggcttagtcatatg

SEQ ID NO: 114096 - DNA, 54 bp, Heterodera glycines
  Promoter: Source sequence=SeqID_5108; Location=1372..1425; Strand=-; Gene=SeqID_56935
attcatgacccaaagaaattatgttttatgcaaaaattgaaaatcaaaaaaatg

SEQ ID NO: 114097 - DNA, 76 bp, Heterodera glycines
  Promoter: Source sequence=SeqID_42998; Location=1..76; Strand=+; Gene= SeqID_70776
aagaggtacaaaagtgattagaagaggtaccaaagtgattagaagaggtacaaaagtgattagaagaggtacaatg

SEQ ID NO: 114098 - DNA, 54 bp, Heterodera glycines
  Promoter: Source sequence=SeqID_15031; Location=638..691; Strand=+; Gene=SeqID_79207
ttttgacaccttaaattataattaaatgttcagttggtcttccaacaaaaaatg

SEQ ID NO: 114099 - DNA, 361 bp, Heterodera glycines
  Promoter: Source sequence=SeqID_3385; Location=4255..4615; Strand=-; Gene=SeqID_47606
agtgagcagcagagggaacttgtaataaccatttaattggaggagggggtggggttcgagcagttcgtttcaaaaaaaatattaaataactaacaaaaacggactcaaaaaacactcacaaattggcaattttttaaggaaaaatcaattttctcaatttgattttttggcaatttgaaaaacaattagattatttatggctttcactaattgccaatttttaggggaattttttctcacaaaacatgcaacaaaaaaaaaaaatttcgaaaaatcatggttttttcattccttttttttcaaccattagtcggatgtgttcgtcgattatgtgaatgatggcacccgcaacgacacaatg

SEQ ID NO: 114100 - DNA, 122 bp, Heterodera glycines
  Promoter: Source sequence=SeqID_13730; Location=532..653; Strand=+; Gene=SeqID_77648
agttatttttgttttaaattatgaacaaacatttccttacattcagacattggaaattaagtccgtcattttcctgtcggttttttattcgcgcacttttttaaaatatttcagtaggaatg

SEQ ID NO: 114101 - DNA, 997 bp, Heterodera glycines
  Promoter: Source sequence=SeqID_3987; Location=870..1866; Strand=-; Gene=SeqID_52705
tcgaggactagctgcagcaaatcgactctgctctagactttgccgcaccgaatttgcaggacgtgctgaaagtgaaggttctcatgacgaagctcagcaaggaagcgtttgccgaatacaaaaagtcctgcatgccgaaaaatgtgacagagttcgactttgcggagactgtggagcagctgaagcgtttgtttgccaggcttcaatccatttggattgacagatatgattgcctgagagcatccaaactggaagacgaggaattcagagcatttgtgaaccgacacaaaaggaaaaacattttaaatttttattggattttcttgaattttcatcttttttccggcgttaccgctggtgcaataaaacaaaaaataaacagaaaatataaaccttgaatttgtgtgttaatgtttgattattggcattttatttagtaattatgttgtcccttcttaatttttgtctcattgtctgtcattgtagtctctcgcctaatctatattttgccatcccttcccagcagaaaatgttcccccgtcttcccttcaattcattctgttggcagtgcactttttatattgttgtcgtcagttattttcctcggactttcccccatttttattgttgctgatttaaataaaattaattgtccccgactttggaaatatttgttgaggaaagcaattaataggccccgacccaaacagcattatttagcacgtggcgctcctggcgaagagttagctgtgccggtattgtggatttttggctgctgaggagaagctgatttggagaagcgaccagaacaaacgcattgctgcggttctgttgttttaacgcattgctgcgaatttcaccaattttcgtaccactgcaaacgcattactgcgataagtgtggatatcgacaaaccaccgacaaatcgtgccgtttttcaaggattcgccgtttctttgttgtttagtagtacctctgcggtaactcaaacaaaatg

SEQ ID NO: 114102 - DNA, 545 bp, Heterodera glycines
  Promoter: Source sequence=SeqID_147; Location=459..1003; Strand=+; Gene=SeqID_75159
aggacatcgcttgtcggagggcgaggatgtcgtaattaataatgacctcattttatttttgattttatgatatttttggcattttgttttaatgtttgtgatttcgtttttgttttcttttttgttggcagactttaatttggaattgcctgacataaaataataaggctttattctgtgtgctttaattgtgtgcaagtgctgaactgttcgacgtgctgctgagtaaaattaaattatttgtacgttgcgctcctgcaaaaaggtgtggtcgacgcgatttttatacggggaattgtagaagtaggaaattctacaaagtcttcaactactgcggcgacaaaaaagtaaaaagtgaaaagaaattcaccaacgatttgtcagctcggtaaagtaattccgtctacaaagctgattcgacaaaaagggtaaagtaattcccatcgacatttcatcttctacagaacggaaattttgtgaaattcatcagttttcttctcaccgaattcgacaagtgaaattttgtggaaaagggcgaagtaatg

SEQ ID NO: 114103 - DNA, 419 bp, Heterodera glycines
  Promoter: Source sequence=SeqID_12706; Location=601..1019; Strand=+; Gene=SeqID_47072
tgataagtacggtgcgtgcagctcgcgcctccttcgatttgttttggaatttatctaaatttcagattcttacgattagaggtttctctagttaaaataaaactaaaaaattcgattttttaaatttacaacaagttttttaattggttttctttgcaaattgtaatagtaaaaaaaaaaatctattccctcaaaaaacagaattaaaatttctcattaaaaaaattaagagtaaaaaaaaaattcttatccccaaaaacagactttaaattttcatttttaaaatttttttcggcgtggcgatgaaaagctgctccttggtatttcaagagggataattatgccccatcattgtcaagctgttcgacccatcctctgacttcattgtccatgccgactttcgtctgttcgcctgtatg

SEQ ID NO: 114104 - DNA, 119 bp, Heterodera glycines
  Promoter: Source sequence=SeqID_26449; Location=1240..1358; Strand=-; Gene=SeqID_45993
ggttcttttccgattcccctaaattttggataaacgaactttaatgatatatttaaaaattatttgttttgcctttttaagggcacgccaaaactttctttttgagcaatatttgaatg

SEQ ID NO: 114105 - DNA, 604 bp, Heterodera glycines
  Promoter: Source sequence=SeqID_8086; Location=2003..2606; Strand=-; Gene=SeqID_66942
ttttcccacaatttcgcttcatccaaaaaaggcattgcaaatttgccgctgtgattttcggggttgctgattatgaaaatctgatataaattttgatttgaccaatccctaactcgaaccgaaagccgaaaattcaacttttttgaatttcattttgttcaaattagtttgaaattggtcataatttatgacttattcgtgatcactgatcatcgacaccaaaaacccctctgaacaagctcacgacttatgtattattatgacaaaaaaaatttcaaaccaaaagggtccttccttttttcgggggttcccaactgtaagaattgggtggttcccatttacaaaagtgccctttttaatttgggttttttcaaatacttttccaattatgacaacagacgccttcaaattgactaaataaattgtgccgtttttcaaattgtccaaaattgtgccgttttatataattcgcatttttcaatcttttttcaatttgaggccctccaaactgttcgaactttaatttttcttctccatttttagattgtttactctattttaattacaacttttatttgcattcattgcatttaaaaaaaaaatg

SEQ ID NO: 114106 - DNA, 783 bp, Heterodera glycines
  misc_feature (545)..(546): n is a, c, g, or t
  misc_feature (562)..(562): n is a, c, g, or t
  Promoter: Source sequence=SeqID_14723; Location=1..783; Strand=+; Gene=SeqID_78850
ccccccgcccactttttccatatatggctttttccatatatggccctaaacttggctggttctgagttgacccgcttcgaccggtgaccggacatttggacagtggacatctggacagtgaatgcaaaattttgaaaataaaatacgtaaaacatacagtcatggtcatatttcaataaattttagacaccgaaactgaagttgccatatctcagcgagtataaatcgtataaatttttggtcttacataagtattgtagagtattttgtgttctttttgattgcttactcattatttccaaaaatttgccaattccctaggaattttttttttcaaaaatttctccgtttttcagtgtattttggggtgttcagatcatcatgacgaactgatctgttcaagtttgaagaaaatacttttgatcgctaacataagcaggaagttttcaggaatttgactaaaattgtctgttttatcaccagctaccaaaaccatgaccatgacagtatgatttacgtattttattttaaaaatttacattcannctgttcgtaaatgccnactgtccccaatttccacttctgtccatatgactttcattgtcctaatgtccactgtcgaaatgtccactgtccaaatgtccgggacatattttggcgtttggccatttaaaaaatgttttttttttcgccaaaatttgcctactgtagtttaaataaattataacgtaataataaacataaaaattaaaacaaaaaattccaggcctgcttttcttcatg

SEQ ID NO: 114107 - DNA, 207 bp, Heterodera glycines
  Promoter: Source sequence=SeqID_21317; Location=2259..2465; Strand=+; Gene=SeqID_51912
ggtgagtttatgtgagcaggagtgttgaatgtcatgcgtagctcagttggttagagaatccacgggttggaagggtcgtgggttcgttttccaccgcgagtcaatattttatccagcttcatcattacaccaatatgacaagaaggattgtgcactaacggattgtccacttattgtttatatactacggattctccttcactgatg

SEQ ID NO: 114108 - DNA, 1003 bp, Heterodera glycines
  Promoter: Source sequence=SeqID_15302; Location=35..1037; Strand=+; Gene=SeqID_79536
gtatgaatgtaaattttaatttaaaaataataaataaaatgataattaaaatattaattaataatttaaaaaatcaaaaaatttgttcagataaggagtacctcaaactttttttccccatcaaattttcgtttggcgaccgcgaaatttcaattgatttggaaaactttaacaatgaatttttgtttcgaaaaattggtgaaatgtggtccatgccaaatttggatgagatttgtttttttggtatgaaagaactgataaaaaaccacataaatcagccttcctttcagatttaaatcgaacaaaaagacgccacactcgatcgggacaaattgaaatatttttattttatctgtcaaaaaatggaattgcctgtttcactgaattcttgttgattgctattttttctcgttagcccttgagaaaggcgaataaatttaaataaaaatttcattgaaaataggttaaataatatttgtatatgaaaattggttgaataaaatagaatttaaaaaattaaaaaaaataataattgttattgataataataaataatttataatgtaaaaaaaagacaaaaatggtagaacataaaataaaaatcaaaaatcaaaaaaaacgaagaactgtgtatacagaaagtatttctatgtgtgaattttcaataaaaaggtttctttttaaaagagggttttttatataacgccctttttgacggttttttatataacgcccaaaacacaaggaaaaatcaataaaaacacaaaaaaaaccatttgaggattttttatataacgccctttttgagggtttttatataacgactcagcacccatatttttctaattgtattcattactttgttttccgctataagtgcaactatgttgccttgcggtttgttcaaataaataaaaataaataaataagtctgaattttagagaaatttagtcagaagaccagaaaattgaaaataacattaaaataaaataatttacaatg

SEQ ID NO: 114109 - DNA, 127 bp, Heterodera glycines
  Promoter: Source sequence=SeqID_31327; Location=90..216; Strand=+; Gene=SeqID_61695
agtaacacagaatattgactccaatttgacttttccattgtttctcctaaggtgtcgctttgaattgtcctcctttgatctgatgcccgatcactttgagccctgcggcgtcgtcgaatttacaatg

SEQ ID NO: 114110 - DNA, 409 bp, Heterodera glycines
  Promoter: Source sequence=SeqID_35295; Location=1..409; Strand=+; Gene=SeqID_64879
attaaatatgtttgcctcagatggcaaactaaaacatttaatgaatttttcattatttttatggggcatcagggctgtatctaaggccgaaaaaagcccatatcccgattacctttgtggcacacaactgaattgacctcctaaatttaaaagtttactaggtaaaattatttatgaaaaatagctataaaaatgccataaaaattattaatttatttatttattttatttttatctttgttttctgctatgacatttggcttaaagatgatatttatctgcttattctgatgacactggtaatcacagaaaaggccattaccacaattattcatttctcatttcacattctttgctgcagtttgggagaaaattcatttacataatttggtgcaaaaatgacataatg

SEQ ID NO: 114111 - DNA, 74 bp, Heterodera glycines; identical to SEQ ID NO: 113194
  Promoter: Source sequence=SeqID_16109; Location=1960..2033; Strand=+; Gene=SeqID_80466

SEQ ID NO: 114112 - DNA, 108 bp, Heterodera glycines
  Promoter: Source sequence=SeqID_4710; Location=1868..1975; Strand=-; Gene=SeqID_55474
acggtgtcaccattcctgctcaataccacattacgggaacacctcgcgctattcgactccgacctagcaaggcggatcgaagagaatctgtacgtcgacaacatcatg

SEQ ID NO: 114113 - DNA, 1003 bp, Heterodera glycines
  Promoter: Source sequence=SeqID_22463; Location=1454..2456; Strand=-; Gene=SeqID_53134
ccggtctgatattttcagaagcaaccggtttccgggcccggcctctcaaaaaccggtcaaccggaaaaccggattttcaaattgccgggcccggaaccggtttccggtttggtaaaaatttaaattttcacatgtatttcacccaaaattaccataaatcgtgccagatgtaaaatttcggctctatttcactttaggcgtcaataaatgacctcttcaataataaaatttcaaaaaaataaaaaaaatttaaagaattttttgaaaaattttttgtaaagtgcattagtaccggaaaacctagtaagtaattctccataaaaagaaaaaaaatttctttcttagatatttgtggaaaattttttaagattttgaaatttctgtttggaaataaaaaaaaattgcgattttgagcaaatttttctaagaaaattaaggatttttagggtccggcgttgccgataggcgccgccgagaaatttttgaaaatttcgatgcaatttattaacagaaattgtataaaaatgaagaatttttggctatatcataaaccggtaaaaaccggtacaaaatgtcagtttccggaacggtttggcattttcaaaatgaccggtttccggtgccggcctctcaaaaaccggtcaaaccggaattttccctaaaatcgccggaccggtttccgggcccggtccggtccgttctctactaatttttaataaaaattagtaaatcgacccaaacccagcaaatgcgtgggaaaccgccaacttaatttttaaattagcgctatttggcaaaaaaaaaagatggaatcggtgaaaaaaccctcgcaaatttcttcaatcctaaaaacaaaattctccaaaattctgtgccaaatcccttccccagcaattcgctaacttttgcaaaaatttactaaaaattgtatataaacaataaaattaaatttagatttatttacataaattttgctcattttcttttcgttctaccaaaaatg

SEQ ID NO: 114114 - DNA, 245 bp, Heterodera glycines
  Promoter: Source sequence=SeqID_3582; Location=2130..2374; Strand=-; Gene=SeqID_50947
tttttaggaaaaaattgaagaataataatacaaagaactaaaaattttgcattttatacctttcaatgtttatttaacccataaaataaatttggctcattcgaaatcattataaatagcattatacttgcttaattttttcattttgttgtcttcatctcattaatatttcagttttaccctataaattgcagtcttccattcgctaatttttccaaaattgtagcttccaaattgtctaaatg

SEQ ID NO: 114115 - DNA, 362 bp, Heterodera glycines
  Promoter: Source sequence=SeqID_5447; Location=1279..1640; Strand=-; Gene=SeqID_58077
ggtgacaaaaaatgcgccgattgcggtgcacatctcttctcacattaagacagtagcatttgctgccggaagggaagagttgtgctgccaatgcttaactcgcatcctgatgagctcaaagagctgattgtggggaataagcaatcccgtgaagggaaagaatttgtgcgaaacatgtcgcgttataacaacctgttccaatttgcaagcgtttccgctggcaacaaaccaagccctgctggcggtccgatggccgttattcttaacggagaattccatcgccgcataagcagcatgcaggctggtacaactcagattcctggctttggcagttgtacattctggacccagtcgaggctatg

SEQ ID NO: 114116 - DNA, 1003 bp, Heterodera glycines
  Promoter: Source sequence=SeqID_7993; Location=732..1734; Strand=+; Gene=SeqID_66621
ttcaatcccaaaaactaactcaattttcaattatttattttatttaaaataaaattttcatttatttacaattaaatatttgcattccaagcaatttccgtttaatagaatgaaaaatggatttcccaacaactatttgtcatccatccttcctttttttctaaattattcattcatcagccatttttgttgttgacgttcacattgctgttaaattacaaaaaatttaattgaatttatttattcaaaaaataatttcattttgcttaatggcacactttaaaagcaatttttccttatttggtccttttttccaagacttgcccttaattttaggttttatgtgattgatttcatgagatttctttattttctgtttatgaattttatgattccctctaaatcattaagaatgacttttttgaataaaattatcaaattttggtcattaattgtttgaaaaaaaatattttagccgcttttaaaccgctttgttgaacgcaattaaattttagatgcattaaaatttgaaaaaaaagtaaagggaaagcaaataaattgccgaaaaatgcttcctttccaatatatttaattagaataattcaaatttgaatttgccagatcacagctttgatcaattccattctgcgtttttatatttccaatcacttttcaatcagcgaaagcacaccaaaaacggattaaacactggcattgatcacagtgttcaataacaggttaagcatgaaaattcaattttttcaatcaatttccaatttagcagtatccgatcacaacaacgaacggtgatcacaaattcagctggtcggttagagtgatcagaattcttacaaattagcaacataagagttctaaattttacaaactctttcagatcagtttcaccctgtgactcaaaagcgcgacttcttcatccctttgatcagtgcagttatgaacctaattaaatcctttcaataatttaaattccagttttttgatg

SEQ ID NO: 114117 - DNA, 121 bp, Heterodera glycines
  Promoter: Source sequence=SeqID_20474; Location=1..121; Strand=+; Gene=SeqID_51010
tggtggatttgtgcatcggagcaccccgggggtgccttagcgccgtccggacgaagtacgcggagaccgagaaaagctatttgtgcaaatttgccttgaccaaaattccatgccacaaatg

SEQ ID NO: 114118 - DNA, 106 bp, Heterodera glycines
  Promoter: Source sequence=SeqID_30564; Location=913..1018; Strand=-; Gene=SeqID_60979
tgctgttgggaggtgggaggggagagacaaaagggggaaaggggagaaaaggaggaacgagggaggcaaaaagggagaaaaaaggggggaggcaaacgaaggaatg

SEQ ID NO: 114119 - DNA, 309 bp, Heterodera glycines
  Promoter: Source sequence=SeqID_17178; Location=2022..2330; Strand=-; Gene=SeqID_81620
aaaaataactgcaaattccaaccccctgctttagaccgattaaaaaagaaattgacggcgaccaattccattcagtttccgattacgcacattttagcgtgaaggagtgcatcgaccaatttgatgggtggcttttttattatttatattttgttatttaggaattttaaattctctaaaattataacttttttgtttttcaaatttttcctctttttaattaaacattttggtataaaatgcatttatttagtaaataaatatttaaatcattttcaacaatttttcagctacattgacttgtgcatg

SEQ ID NO: 114120 - DNA, 626 bp, Heterodera glycines
  Promoter: Source sequence=SeqID_11115; Location=500..1125; Strand=-; Gene=SeqID_74456
cgagagttaatcattcattcattcaactggtttttgatcatgacattcgaggaatagcagttgatcaagtcaatgggaatgaatgtgtttaaaaagtgaagtttttgatgcatttgacacacttatttttttgggaatggatatattcaaatgcaatgaccaagtttttcatgggtttttgcgattgatcaaaacgtcgaatttccatccatttatttatttttataagtctgaaattcggtttttaaatttcgacaactttcgacatcatcaattaagggtgcaattttaaattttttatttcaattttttatgtgcagtttttgggctataattaaaagttttaaaattcacttaactatttaaaaaaaacaattaatacttccaaaattgttccactcaataatattatttcattttttctaaattaaacatttatttatatttgccacattaacacataattggggcaattttaaagcaattaattataatttaattacggcctaatgtttactcataatgaacggcatggcgtttttttggccagcgttttgtccaccgtttcactgatggccgttgttgtgctgctcccgatcgcgcatcagcattttcagcacaaaatg

SEQ ID NO: 114121 - DNA, 197 bp, Heterodera glycines
  Promoter: Source sequence=SeqID_36262; Location=1..197; Strand=+; Gene=SeqID_65626
taattaattttctaatagtatttcattttagagtccactctttaacatcttcgaaatttaaaatgctttttttttgtctttttatccttttaaaattgattaaataattactaaaaatattgtaaattatatttatttcattataataaatgatcgatttgagttcataattattattttaaaggttattcgttatg

SEQ ID NO: 114122 - DNA, 299 bp, Heterodera glycines
  Promoter: Source sequence=SeqID_18899; Location=960..1258; Strand=-; Gene=SeqID_83608
tctgaaaaatatacagatttattgtaagtatttgcatgacttaaagaaatataattttaactaccaaataaatcaaaaacaactatataaattcgtaaaaaacattatagatgaaaaaatatatgtatataaatatttgttctgaaatttaaaaaaaaaaaattcatcatgattacttttatcaacatagaaaaataaatactccttaatagcaaatcaaaaattaaaatcgccatttaaatttattaactaatcaaaacattctaaatttcccgttggtgctttcggcaccaataatg

SEQ ID NO: 114123 - DNA, 627 bp, Heterodera glycines
  Promoter: Source sequence=SeqID_4557; Location=3092..3718; Strand=-; Gene=SeqID_45843
cgattaattaaaggtaattaaaattaatgaatgataacggagagaaaacggacaattaaaatgagcagagaaataaaataaaccaagtaaaaaataatcattttcattcacattcaatataaataaattccttttgtgttaataattgataagcaaatacaaataaattgcatactgtccaacaaggagtaagaccaattgtaagaaattcaaacttgaagacaaaacgccaaataattcggatgggaagagaaagaaaaacattcaattggaaataggagaacagagaaaaggccaaaaaagcgtaggcggccagacgcgaacggagaaaaattcattttctgtatggtttctcttctttttttctccacaagtacaggtcacagactaaacaaattccgccgcttgaaaacgaattgattcaattcctttctttcttccaattttcactctttttaagcgttctttaaataactaaaaatcatttttaattcctttgttatttttttttaattttaattttttgcattttgtctattcatttttccctctttttttctttcagtttccgccttaatttgcccttgataatttgttatttctctctgctgaccaaaaacaataatg

SEQ ID NO: 114124 - DNA, 1003 bp, Heterodera glycines
  Promoter: Source sequence=SeqID_9324; Location=2113..3115; Strand=+; Gene=SeqID_70998
ccccaaaccttttagcattttattttcacaaatcctgagatttttatgatgggttttcggatcctgaaatttcatttttgaaaatgtgccaaaacagtgcgggtttttttttgcatttcctccccgctcgccccgcgccgcgatgccgccgccgcgaaaaaaaaatcgataacggaatttggaagaagtgcaaattaattgatattggcagcaaataatatcaattataaattggacaataaaattaattatttaaattgtgtttaaaaataaaaatcgaaaatgaataaataaatcggatgaaaaaccttttcaaaagtaggtcacctgtcaaccaaaattgattgatgggtttttatttctcttccattattccgcaatctgcacgtgactttttgttccaattatttcgcagtgtggaccattaattaggtcaactgtcaataaaatgggattgattggtttcttattgaaatttctccatatttttagtttttttgttccaattatttcgcaatagggcccctaattttgcaaacctgtcacaaaaaatgattgatgactttcgaaataaagaatatccagacgatttttttttttgcagttttgaataaaatgtgacagttgtctacggaaatgattgattaccctcaaaattaaggcagacccagacagtcacgtgactagcccctcctcttttttacccatttcgtacacccggcccaaatcgaaaatcattcaactaaatagttggatttcattaaactctctcttcacgctctaattttatttctctccgctctatttttatttgcattaattaaatctattactatttacctacgtctttttcttttcaaatctctgctctctttaattcttctgtttcaatttcttgttttaaaatgtcttttaaacgcgtgaactccttccaacccgccgtgccaatggccaaaaaatgggatttccgatcaatcgggtaagtattacatgcgttacaatg

SEQ ID NO: 114125 - DNA, 720 bp, Heterodera glycines
  Promoter: Source sequence=SeqID_3933; Location=1105..1824; Strand=-; Gene=SeqID_52504
attcttttttttcatatatttttgttttgtcacccccaacggctgtccccattgggacgggcgggtgggtggtggccggcgggtggccgaatgttttgaaaattaaaattgcgatcaacaggcgcctcaatagcgaggcgtctctaacccaaacggccctctttagggccgtaagagtgaaggaatacagtctgcccgccgtccacaaatttataactcatatatttgttctccacttagccatagctgggggatatgctagtgtaagcataactatttcggtaaaatgtgtattttacattagtattaaacgcttacactagcccgtctcccagccagcaaagacccctgccgtttttcctcaaatctttgaggttttttacccggcgggtcttcttctcaccccccccccacttcatcatttattcttttttattgtgtcagcaataaatttacctgtaaattaggttacatgtttttagtaaaatgtttttaaaaaataactatgatttttacttaatttttataccactttgctaagcttttttcccttagtcggcatgcctctctctaatcaaaagctcaacacaataatcaaacatgtggccatttggtgaaagggaaagcaagatcttcgtcttcaggttgagcaaaggcgtcagcagctggaaggagaactagctggactggtaaaagcatgtggacgccgcaaaagtaatg

SEQ ID NO: 114126 - DNA, 1003 bp, Heterodera glycines
  Promoter: Source sequence=SeqID_4665; Location=2145..3147; Strand=+; Gene=SeqID_55289
caccacccaattttgctccaaactcagtcagcccgtactcaattgtcccggctcccagttttacgattatttttcaaccacttttttgctgttcacacaatttcatttactaacctaatttacataattatgtttatgttttgttaatcgtcaaatgtccgtccgtccgatccgccgcttttgccgtcacattccatcccatcccaccactttcccagttgatgtgatgagtaatcactgttgatcagcggataatcaaatagtttttttttattttctgctgggggttgggccaattcattgtggttggctctgattggctgctgcttttccagaggcaaagctccgccccttgccaatgttagccgaacaaccgcagaattcattcattcaatcatttgttttcaaatgaaataaattttctaataaaatatttttaataataaaaataaattagggataagaattaagttagttctctgatagagccaagttcctaaggacactaaatgggattagtcggtcattagagggaagttacaatttaattagcacgactccgggtcggtcaagtctgctaattgagctccattagtactggcctgaacacaaaaacattaattagggaggataaaattgtcagcttaaggcaattagccctgtggcttaatgatccttaactggggaaccaagtgcaattagcctaacacctgtgggtaataaaaacgattagttgaatagcgggtgaaaatgagtgtgttgtacgtacgatctcaatgccaaacctcgggccaattagcttacactgatggcaatgactaattaagacattaaattagccccgtggcttaatgcctcttaactggggaacaagtacaattagcttaacacctgagggtaataaaaacgattagcttaattaattagtgtatgctttggacgatatcattgccaagctttttacacttatggctaattgagacttttgttgcctttcagaatg

SEQ ID NO: 114127 - DNA, 143 bp, Heterodera glycines
  Promoter: Source sequence=SeqID_29425; Location=845..987; Strand=-; Gene=SeqID_59932
ttcgccgaccgaactgtcctcctccacacgactctgaacggcgttaagaatttcgcacgggtgagcacaggccaactgagtccatcccccgttcaatccacgcataaaagttgtcccattgctttggcaaccgaactgtgatg

SEQ ID NO: 114128 - DNA, 111 bp, Heterodera glycines
  misc_feature (31)..(31): n is a, c, g, or t
  Promoter: Source sequence=SeqID_25881; Location=1470..1580; Strand=-; Gene=SeqID_56653
tatgcgcttggtataaactctactgaatttntgtcattttcaatcaatgttttaggttgtgaagcgtgtccggcacaaggaaaacgctccaaccggtcattccagacaatg

SEQ ID NO: 114129 - DNA, 84 bp, Heterodera glycines
  Promoter: Source sequence=SeqID_6764; Location=1804..1887; Strand=-; Gene=SeqID_62807
attgtttttatggcatttaattgggtttagcgaagtcgtccgtcaaaggctgtgccgggccgtctgacgaagaaccggtcaatg

SEQ ID NO: 114130 - DNA, 173 bp, Heterodera glycines
  Promoter: Source sequence=SeqID_44280; Location=596..768; Strand=-; Gene=SeqID_71785
ccttatccgatctctaatgccaatggttgaaaagatttcgaggaatttagaaaatactcaaaattaaatgggacccattggcctaattggatgatgatttattgccaatacttttttcgtttgttttttaaagagtgcttccattctcagctcctcccatgcagtcgaaaatg

SEQ ID NO: 114131 - DNA, 452 bp, Heterodera glycines
  Promoter: Source sequence=SeqID_15797; Location=1..452; Strand=+; Gene=SeqID_80117
ttttagacgctcaaatttttatgacgctatacctaattataacgaattgctttcaatttataacatggaatctctccaaaaaaggagattaaaaattgatttaagacttttccatgaaataactaatggttttgttcaaattaaacataatgaacatcaaacccatttttctaatagactgggtaatttaattaagcctagctttccattcgacatggataaggtacaaaaaatatgagacctaaattataataaaggaacgaaaagattggacaccaaatcacgctgtttttgttgtccatcaacagtgtaataaccaacgaacgggtcgaagaaccaatcgaagaaaacgctgctgtacacggcgggtttgatgaacacggcccagcctaggatgtacagggaacaagcgaaaaaccatgcgaaaatgagatggcggagaacaaaagatg

SEQ ID NO: 114132 - DNA, 1003 bp, Heterodera glycines
  Promoter: Source sequence=SeqID_7519; Location=1749..2751; Strand=+; Gene=SeqID_46434
ttcagtgtcgatcagaacaccatcaaggtcgaagaccacgtgcgtaatagtagaagccatttattcggagcagaacttaatattcaaaggaaaaaaggcgctagttaaaggttgagctatttgaaattataatgatcagttttttaaatccttttgaatggcaaatttttaaattttcactaattatttacttttaaatagattcatttcattgtttcgattccctttgacgtattgtcctctttttcaaatttatttgttttgatcattttgattttttttggacaaatctgtttttctctccttccctcccatctcaccttctatctccctcccccctacgttttgtatgtttgtcatttccttttgccccaccatatacctatctcttcacattatcgtaaattgtggcggacgaccgtattcaaacgtctctttctttccatcgtttaaaaaaaatgtaaaagcatttagttgtatagtatgtatttgagcatatgagtggaatgaaagagagaggaaaaagggcatgggggagagcaagactttttttgttgatttttttatgaaattatcacagtactctccttttcgtcgacaaaatgcatacgatcgttttctgatttttgatttcgctcaaaatccaaattaaagttaaaattttggcgttctttctttaaaaaaataatattgtcgaacagacccaaattgagttgctttctgcaatagagaaagccctacattttgcaatttagttcaatattgcgagagttacaatttgactgccctattcaaaaataacaattttacttaaaatctgttaacaaatgtgactcgaatttgaaattccaggcgacgcctataaattaaataattctttgttttgtttcgttcttcagtttctatgtccaaacaaattcgaacttgttgggtgtggcgtaagaacaaccgttggtggcgttatttgccgcgacgtaacgactcccacaatatcatcgacatg

SEQ ID NO: 114133 - DNA, 1003 bp, Heterodera glycines
  Promoter: Source sequence=SeqID_12080; Location=2088..3090; Strand=-; Gene=SeqID_75636
ataaaaacatttcatttttaaaatatttacctatttaaataatgaaagctgctaaaattaattgttctttgcttttcacaggcttaataaatttttacgtcccaattgacaaggaatggttggagggaatcacgggcttggaatgtcccacctgagaatgaatgaaagaatgaatgatgaacacatgtttaaatgccatttatgtattattaaccattttaaaaaagatcatttttatttaaaaataaataaataagaaaaatcgaaaaataatttacgagttgttaaatgaatttatatatttttacatttttgaggttaacattttacgagagaagcacggaagttttgatttaatatttaatttctgaagggacaacgaacagaaaaatagacaattggaaattgaataagtgatggattaattaataattttttattttaacaattttaaatttcgctacataattgaaatatatttttattaatcatatacgtggtgaaccgaagtttaaaattgaattttcttatatggtttgctttttgattttggcatttcggactatgaagacttccttaaaaaccaataagaatcattcataaattttggcaacaaatgcaaaaaaattcaaaaaaatttccgtctttttatcaaaattaatggcaatggtaaacaacccgaaagaaaatttttacttttatatacctaaactttttcaagaaacttttaagaatttttgcagctaatttttgaaaaataatataaactaaaaatacattgataaaattttttcataaaattttttaaggcactcccggccgattaattcaaatcctctcaagtaatcagtaatgaccaaatttttggttgctacctccaactcaggacaaatgtgacaaattaggacaaatctaatccctaactaatttttcatattttttaaatcttgacattttagaacacaaaattgaattgaaggagccattcccccctccaataatg

SEQ ID NO: 114134 - DNA, 317 bp, Heterodera glycines
  Promoter: Source sequence=SeqID_27735; Location=636..952; Strand=+; Gene=SeqID_58406
tcaaagatacggcgaaagacgacgaattggcggaggagggagacgaaacggcgacgcacagaccccccgggttggcacagagcgatgccgagttggccaaacccacgcccgtctccggttccgatttgctgtcggccccatcgttagccaatgccaacgcagtctccgccccgaatggtgccgtccgcttcccctccctccgcgcgtgtcctccgttttgctgctgcggcgggtgtctcttcctcgccgactgcaattttgccacttcctctcctccttaaccattttaaaggccattttaacaaaatgccaagatg

SEQ ID NO: 114135 - DNA, 89 bp, Heterodera glycines; identical to SEQ ID NO: 102642
  Promoter: Source sequence=SeqID_21858; Location=778..866; Strand=-; Gene=SeqID_52489

SEQ ID NO: 114136 - DNA, 933 bp, Heterodera glycines
  Promoter: Source sequence=SeqID_885; Location=2307..3239; Strand=-; Gene=SeqID_63281
gatcccgcgggattaatcccgcatttaaaaaaaaatgtaagtgttaatttgctgctgttcctctctcttttctgcttcattcttctctcatcctcctcttccttccgtcgaatttttccttttcctctctttctcttccgtctctcctccttccccaatgctatttccctcctcttcccttgtttctccatttttgctaccaacaaatgttggatttggttgacaaagaaaatttctaactttttacaaatgaaagttggataaaaattatccatcgaattgattgatttggggataaggtaaaacgcccggcaaatgtcatcattagggatcggatttttaagtttttgcttatttttctgcggctttaactcgacgagaaatgcacgaaaaacacatttttcgctcggaaattcttcgttttgacgcatttattcgaaaatttttcttgacgagatcacattttttgcaaattttcaaaaaattttccacataaatttattttttcattgaccaaaatttttgtaatttattttctttcttgaccaaattttggttttttcgcccttatttaaggccttagtttggactttttcgcgcttaaaaatccgttccctagtcatcattttgcaaaatattctcctctgttgcgttccctttttcttccaatccgtcgtcattttatgccaaaatgtttccgcgccttccgtttttgtcaattggttttcgcctcccattggcaacaatttaagacgaacaaaattcaaaaattttttggataaaatgtgattttagtgcttctttcatccaaagtacaatccgtaaaaaataggaaaccctaaaaatccaggctttatccaacgcattaattcttctgctatttgtgtgacatcattcggaactcggcccaattgtgctaattgccaaaaaatg

SEQ ID NO: 114137 - DNA, 197 bp, Heterodera glycines
  Promoter: Source sequence=SeqID_3535; Location=1932..2128; Strand=-; Gene=SeqID_85069
tttttgtagatagaactatgaatgatttgcaaaatttggcggaagttcaaaagcgtgccgattttatatgttttcattcgattaggctccgcccacttttcgacagttcgaagctccgcccatttttcgcttcccaaccttcacccacccaaaatcaggattcatttgcaaaattttcaaaaaattctatcgaaatg

SEQ ID NO: 114138 - DNA, 345 bp, Heterodera glycines
  Promoter: Source sequence=SeqID_24720; Location=996..1340; Strand=-; Gene=SeqID_55467
aatgaattaatgagctgctgatgaaccatatgaaacaaatttttggggtttttaactttttttttcatttttaaatgcaaataaattaattatttggaaatgttcaacttttttataaacaaatttaaataaatcaaatttcttgtctaatttttatttaatataggaatacatgcttttattggtgttgggtcgttactacaaaactacccaaaatgggcattactcaaaaaagcacaaatggaaattttgacaaaacgcttaatccttatggcataagtagccaaataaattaatcattgattgctatgatctaattttttatagtacaaagttttaaaaatg

SEQ ID NO: 114139 - DNA, 127 bp, Heterodera glycines
  Promoter: Source sequence=SeqID_3108; Location=1616..1742; Strand=-; Gene=SeqID_83218
ttttcaccgctttttcacttcaattacaacatatacatatttgcgcattaagaatgaaaatgttcgcatttcggagttcttcgtgtccaccatttggccaatgttcggcgattccattcggcacatg

SEQ ID NO: 114140 - DNA, 86 bp, Heterodera glycines
  Promoter: Source sequence=SeqID_17269; Location=3512..3597; Strand=-; Gene=SeqID_81735
tgctgattttcacataatttttcatctttgctaagccaattgaaatccgacgaaaactgtcttaataatttcccctcaacaaaatg

SEQ ID NO: 114141 - DNA, 448 bp, Heterodera glycines
  Promoter: Source sequence=SeqID_21793; Location=1764..2211; Strand=+; Gene=SeqID_52408
tgaattgatctgtcccatttttcacgcaaaattatcggaatatttggattcagattatcggttttacctatgttgcagaattataaattacttttagaatgactcttaatacataaaatttccccgatcgtcccctcgtttaatcataatttcaccagtttttataacgcacattaaattcaaattttttccgccaccaaatcatgtcagtggggcgcctaaagttgcttattcttttgtgcacaatattcctagcactaatctttgctgatcgccccgagccaaacaaaggaagataacatctgttgtatggccattctgacaatgaaaagacgacaaattgacaaaagaaacaaatttttggagaactaaagtggatggggaaggggggggggtttagcgatcgggccatattccgctggtcatttctccgaatattcgcgccatg

SEQ ID NO: 114142 - DNA, 66 bp, Heterodera glycines; identical to SEQ ID NO: 105850
  Promoter: Source sequence=SeqID_8; Location=3161..3226; Strand=-; Gene=SeqID_61202

SEQ ID NO: 114143 - DNA, 1003 bp, Heterodera glycines
  Promoter: Source sequence=SeqID_11716; Location=2361..3363; Strand=-; Gene=SeqID_75203
ttaagaaataaaaaaaattattattttttttattttaccaattttctgaacaataaaaatatccttttcgattttataaactaaggtcttgcaaaaaaatcctgaataaatgttttaacccataaaaaaaaaatttttttttccactatgccaattttgtttttaattaattttccatcaataaaaaacgtaattttgtctagggattcaattccacaaattttatgatgattgaatttgggttcagtggttggtgtgaaaaaaaagttttgagcacatttactaaaatggctttcaatatttccgaaaaaatagcagataaaatgattatataaattatttcaatttcagcattcaattaacagcgtttcaaaatcgtaagccatcccgtcaaattttgtatttttataactaaaattaaaatcataattataattaatatataatataatatacttaaaaagtccgacaagcttttcttactaatgatgtgtacaaaattttgaattgattgggacaaaaaacttaattttgaaaaaaaattcgtcatcattgcgcacaaagtgacattgaccacgctggtgaagcattggagaatttctttttttgtttattcgaaaaatgacacttaactgaacttctcaaatgccataactaacgggcaggctttatctgtgccggttatgccatcagaagaaagctctgtccgtctttgctaatccgcttttaatcattaggcgccatgtttgacaatagattttttgacaagtcaacttcgtgttggcgcgtttgtattgtaaatttctacactcatattataaatagcgctaaatgaataaaaatataaaataaataaaattcggcagttgaccttttaattaaaataatgaattatttttccattttctgattatttggcggaattatgtaagtcattaacccggtcagctagccgaaccaagttttttttttttaatatttatcacttataatagccattatg

SEQ ID NO: 114144 - DNA, 80 bp, Heterodera glycines
  Promoter: Source sequence=SeqID_42275; Location=1..80; Strand=+; Gene= SeqID_70205
tatatatatatatatatatatatataacgtgtcaaatgtctctagtttttattttggggcaagagataagcggcataatg

SEQ ID NO: 114145 - DNA, 173 bp, Heterodera glycines
  Promoter: Source sequence=SeqID_28912; Location=1725..1897; Strand=-; Gene=SeqID_59482
atgaagcaatgcaaaattgtttgcatatatttcaaataatctaaaataaagtatttagctatttttcagactattatacgcttttttgtttcgttgaataatttgaaagaatataaatatttattttttagttataatttattattacaatatttttagattatacattaatg

SEQ ID NO: 114146 - DNA, 452 bp, Heterodera glycines
  Promoter: Source sequence=SeqID_12412; Location=1359..1810; Strand=-; Gene=SeqID_76020
agcaatggaagcgccaacggatgggcatcgacacgagcactccgccgattaaaaaagttagaaaaaaagcatctaacttataaaatctaattagtacagtatccaactaaattaactaaggggggaggaaggctagctgaaaagaagagagagatatagtagatagtgtgggaaatgaatattaaacgatctgagaagttattgtaatactatttaaattatttttaagcgtcgcctgtcccccgtttcttcttccatttcaaaagtaagaagggatttaattttaacatgacgcttgtacattatttttattagaaaatacttaaatgatttactataatccttttttatccctttcccacggcctctctctttttttctttccgcctcatttttctatttgaaaagtacaaaatgcgccattttctcccatgatttccattcaaaaaatg

SEQ ID NO: 114147 - DNA, 651 bp, Heterodera glycines
  Promoter: Source sequence=SeqID_25775; Location=1..651; Strand=+; Gene=SeqID_56514
tcaaaaaatagttgctaaatggattgaaagcttttaccccatgaaaaatataacctcataaaaaaattttcaactttttgttcgaattcgggtccggggttttgaattaggtaaaaccgggttaagactcgtaatcatcaccctcgaaaaccccttaaagttggtttctagcccaaaatttagaaaaatattttttaaaaattaattagggatcacaattctttaccattgccaaagataaacatttatcagaaattctgtgagccctcaaaaatccacagagttcaagtcatccgtatttgtttgacaaaaaatccgcaaagaataacaaaacaactttttgaatgttttttttttgttgttattataaacattatgccaaaattttatttaacaataaaaatgaagtaaactgaggaacaaatttagcctgtcaaaaagttgtagcttgtagtcataagaattttctgaataacaagttatggcacaactgtaagagcccttttgtggattgtgaaatgcatgcaatagagcccaagtttttaagatattttagcccctaatattcacatattatgcaatttttgtttaagtccattttattcaatcactttttttagcaacatatttgttttaatataagcagcaatg

SEQ ID NO: 114148 - DNA, 453 bp, Heterodera glycines
  Promoter: Source sequence=SeqID_33605; Location=276..728; Strand=-; Gene=SeqID_63620
ttaatctcggaagttgtaacgaagaatgtgcagaggttggcaaaccgttaattaaattagaaaatgcttaaatctaaatgaatatttgcaattaaattttttaataaattgatagaaattttcaaaatggacccaatcctaaccccacccgccctttcattcaccactaactacgggcttggatgtatgaatgtaaatgaccacattaaacgaaatcaaaagttatttgattgatgaatcgatctttagttcttgttggttaggttgatctaaatgccaattatccaaaaacataatgccatgaaaaataattcaaatctttttaattacctaactttaatctgtacgtgtttgggctaacaataagctgacacttatgtacagcgagtaaagaaaggattaacagaaataattaatttatatacaaaataaaatttaggtgaaaacttaatg

SEQ ID NO: 114149 - DNA, 574 bp, Heterodera glycines
  Promoter: Source sequence=SeqID_20054; Location=1110..1683; Strand=-; Gene=SeqID_84833
ttttttgattttattattttgttatgtaattcaagcataaaatcttatgcttttttgtgcttattgacattatttttttaatttgactaaaacatcgtcgcccagcaatgaaaaaaaatacccctatgaaataaaaaatttccttgaaaacttcaaggacattcagcacgtgtataattaagcctaaaagataaatatatattataaaactttcttcataaaaaatctttctcaaaataaaaatataaataaaaatttaatgttctttaatttatttgtattaatcggcttttttaataattttgatcaaattaatgaattatataatttatataattaattttttttttgtaaatcttttggttaaatatgttaatataattgattaatattaagtaatatagaaatattttgggtgtaaaattcatttgtatttttttcttgtttattaaacaagtaattttgatgatcaaaatatgtcaatgtgttttcagcagcccagttttaccaaaagtatttaatgaaactaatattttgaagcatcactcacagcccaataagcattccaataatg

SEQ ID NO: 114150 - DNA, 500 bp, Heterodera glycines
  Promoter: Source sequence=SeqID_45419; Location=1..500; Strand=+; Gene=SeqID_72712
aatttgaatttaaaaaaatattcaaaaatttgagaaatcttttgctgaaaaattaaacaaatttaacgtggtgatcacttatctcgaatatgaaaatcaatttaaaactttgttggcaaaattggcctaaatatgcccgaaaactattcaaaaaaaaaaaaaaattgactaatccactcataattgttttaagaaaacactaatttaaatcacttttttaatattttataaaatattttactaaccctctcataattgtttatttttaaaccacaataatttaatttttaagaattttttaatctaattattttcccaattttataaatatatttattacattgccgcaggcattatttaatttttttttcaattgtttggcatttttgtcatatttggcaatttcccattagtttttggccatgcttttccatcggtttggcacattggcccatatcattgcctccaccgagttgtggtgctgttcccgtcggccaatg

SEQ ID NO: 114151 - DNA, 166 bp, Heterodera glycines
  Promoter: Source sequence=SeqID_18627; Location=1909..2074; Strand=-; Gene=SeqID_83284
gatttattcaagcaaatcattgttattgtttatgaatattaaacggattgctttttttcatttattcatttaatttcgtcctagaattaaccatttaaagtacatagtgtttttaaattttattgtttgtttctatgtaatgtttgcctttttgagaaataaaatg

SEQ ID NO: 114152 - DNA, 178 bp, Heterodera glycines
  Promoter: Source sequence=SeqID_8963; Location=250..427; Strand=-; Gene=SeqID_69830
aggggaatttcaaataactgtgttatggatccgtgatttgttattttcattttttcgtgtattattttttataataaatgatttatcaatgtgcaagaactgaaaattttttgagatttttgaccattggcgccaaaaaacactttatagcgtgcgccaaaatggccgcgccaaaatg

SEQ ID NO: 114153 - DNA, 61 bp, Heterodera glycines
  Promoter: Source sequence=SeqID_15523; Location=887..947; Strand=-; Gene=SeqID_79801
ggtcagtccctccccccccccccctcattaattaatttgccttccttctgattttgggatg

SEQ ID NO: 114154 - DNA, 232 bp, Heterodera glycines
  Promoter: Source sequence=SeqID_32781; Location=549..780; Strand=-; Gene=SeqID_63026
tttggggaaaagggataaaaatgaatgaaaaataaggaacgagagtctcgaacatcggcgattgcatttgtttacccaatcctttgacccgtagcaatattttggtcgataaacggaaaggatgagggaacattttttaaataaactatggaacggaagagaatgaaaaagggtatataaaacgattcgattttaaatttggtaacattcatgatcaaagctccaaaaaatg

SEQ ID NO: 114155 - DNA, 152 bp, Heterodera glycines
  Promoter: Source sequence=SeqID_39406; Location=910..1061; Strand=-; Gene=SeqID_67976
ttcaagcgcttttatatgtgcgtaggagcaccgtaactttgtctttcacgtagcgcgcagcactgtaccttttcgctatataaaagcacgcaaatatgacgcaaaacttcattttaatcacaaaaattttttttttttgcaaaataaaaatg

SEQ ID NO: 114156 - DNA, 196 bp, Heterodera glycines
  Promoter: Source sequence=SeqID_43242; Location=1..196; Strand=+; Gene=SeqID_70964
ctgaaatttctgaaaatttccgaattttatcaaatttcggaaatcggaattccatgccatccctggtgtggccccacatttttggcaaatcactgttttttgtttccaaattgtttagcattttcttcgtgccaatgccatttcttccgtcagttacgaaattcatttttctgttcgcgtgccgtcaatgcaaatg

SEQ ID NO: 114157 - DNA, 53 bp, Heterodera glycines
  Promoter: Source sequence=SeqID_38829; Location=987..1039; Strand=-; Gene=SeqID_67544
ctggggaaagaatttaattgttcgtttaaaatttaggtattgacggcggcatg

SEQ ID NO: 114158 - DNA, 189 bp, Heterodera glycines
  Promoter: Source sequence=SeqID_7870; Location=2512..2700; Strand=-; Gene=SeqID_66231
ttagcattgattaaatttgcgcctagttctgatccgatcactcgatttcggctaattatacttaatcgatcacattaggctaattaccccttaattgatcacccaaatctactcggtctcatattagtattaattatccaaatttctcccccttccctcgtagagcaagagctggtgaagaagcggatg

SEQ ID NO: 114159 - DNA, 889 bp, Heterodera glycines
  Promoter: Source sequence=SeqID_23979; Location=1208..2096; Strand=-; Gene=SeqID_54684
tttgggctgatattactgattcttcgactttttcacactatattctcagaaatagggtcaacaattaaagtgtctaacgctatgtaccacgcatgttacaaattaacaagtggttaagaaaaaaccattcttctcaagttttcgttaattatacacatttttttgtgtgcatttggcgacggttttatgtttgaccaatttgaaatagttattatttaggcactgaacatcgccgaaatggccgaatcgaacatgaacgcatgccccgcattcggagtgtgtcccacatgccaatggcattgcccttgcagtaagtcaaattcataatttttttttccctcttcgatttttcgctgaaattcgatctctaattttttttttttcaattcacttcaaatatcgtttattcacatactcattttcaattccgaattaagtatccaaagttactgtattattatagcagcatttccatatgaactttgctcattacagtcacttaatgttgatgatttctaagccgcggccgatattatcgcgatgggaaaatggggcgtaaaaaatttattacaacccgcataaagcattccgtctctccagccacaaatcattttcatttccaagcgctttctaatcgcaaaacaatttcccagctactacttctactgcacacagccaaaaaactttcatacataagtatccgcgcagcctaaattgcacgcttcctttcccgtattactcaccactgcgcaaatctatctcattcccactgattagtcgtaagactataagaaaagtttttggtttgttttttttttgagtgctcatttaactcattcatctaattaatctaagccaaatagtagaagtctaatacactgaaattatg

SEQ ID NO: 114160 - DNA, 262 bp, Heterodera glycines
  Promoter: Source sequence=SeqID_30159; Location=1188..1449; Strand=-; Gene=SeqID_60593
ggtccgtttttttttctctcctttaaattgccctttgtgaggcattcacgtatcatttagaattttcattttatccattttttaatctaatgaaaaaattagttgcaaaaatatacactcccatcccgaaaccaaaaaaaaaatagttttttttttgcgtcttttaattttcaatttttgaaacggcatgatgatgagatttgtattttttttttgtttctgtcttccaatttaaactttccaggcctacccgcttaaaatg

SEQ ID NO: 114161 - DNA, 62 bp, Heterodera glycines
  Promoter: Source sequence=SeqID_40688; Location=1..62; Strand=+; Gene= SeqID_68943
tatgaaaaaggggttcattttaaaattaacaaaaaaaaaatacaagcaattaattaattatg

SEQ ID NO: 114162 - DNA, 321 bp, Heterodera glycines
  misc_feature (22)..(22): n is a, c, g, or t
  Promoter: Source sequence=SeqID_11038; Location=2146..2466; Strand=-; Gene=SeqID_74370
agtcatggccttacaaaaatantgacatttgggtacgacccttttgttccggcagaagttatacttttgccagtacatttccctggacattggactctcattgtccatgatgtgcaatttggcactcattttgccgattctttgcctaccacatatggcaggttggatccgcaactgacggataaaattaaaaatatcatttcggatattttgccgtcagcactgttgacagggattgttgatgtcgaaaatctgacggtccaacacgatggtaatagttgtgggtacttcgtgtgcctgtatgctgagtcatggcttatg

SEQ ID NO: 114163 - DNA, 331 bp, Heterodera glycines
  misc_feature (12)..(12): n is a, c, g, or t
  Promoter: Source sequence=SeqID_18848; Location=1..331; Strand=+; Gene=SeqID_83542
cgtccaaaaaanatttcggaaaatccgaagctttcatcaataataaaaaaactaaaataaagaattgattgcataaaacgacaattttttgatcattttttttcatgtctaatcgttaatcagcgaaaatcggtgattgaccgaattcacttttccgattcaagcagtacacccaacgaccgctttcttctgcgcacaaaaaatcctccaattgaacaattccatacacacacacacacataatgaatgacctggaattttaattgggtgctgcaaaaactttaaaccctattttaaataagaaaaaatgaatataattttttagaaaatg

SEQ ID NO: 114164 - DNA, 243 bp, Heterodera glycines
  Promoter: Source sequence=SeqID_8849; Location=997..1239; Strand=-; Gene=SeqID_69420
cctttaaaaattttaaataaaaaaggtctcaagtttcgcaaaaattgtatgtatgctcattaaaactaatttaaaatgattatttttaatcacttaattatttaaattcaaaattttaagcaaaaattcaaataaaatattttttactaatatttaaagaccggatttttcatcaccaaaaaatgatgattaagcacttaattcagcatcaaaaaatgctaaattcagcacgaaatcagcatg

SEQ ID NO: 114165 - DNA, 325 bp, Heterodera glycines
  Promoter: Source sequence=SeqID_3869; Location=4168..4492; Strand=-; Gene=SeqID_52233
agccgtgtcgcccaatttttttgtgtttttaattataaacaccctaacaatgaaaaaatttatttttaagcaaaatgttgaaccttttattgtttcatacccaaagaggaaatttttaggtaatttttacattgattttattcttaattaacggaaatatttgaatacggataattaaaaataaatctagattttatattcaattttatatttaattttgattcattcagataaatattttaattaaaaaattgttatcatacaaaaaaataatatttctttttaaataaaaaaaaatttgaatttatccaaaaagcacaaaatg

SEQ ID NO: 114166 - DNA, 596 bp, Heterodera glycines
  Promoter: Source sequence=SeqID_33748; Location=713..1308; Strand=-; Gene=SeqID_63718
tttttgtgctttatacttaaattattattttatttttaatatttttatgaatttccattctcctgatcattgtgatttgtcattttatgctttatttttaaaattttatcattataattttctatttttattctcctgagcattgtgatttgtcattttatgctttattttaaatttttaaaatataattttatatttttatgaatttccattcttctgatcattgtgatttgcctgttttctgtagttacactgatctgtagtttgtttgcacttactgatgagtgaatgctatttaaacccgacgatgctcaacaaaagcacacttcataaaaaaagctgaaacaatcccatgacaaacccaaaccctactccccgaaaaatgattttctcaccaattatcctttttctaagcattctgtgcttaccgtcgattgtggaaacggtacaaattaataaaataaaattataataaaaaaataaagaatatttaaaattgcaaaaattttgtaggatccaaacgaccccaacgctgtgttcgagaaaagtgaacaataccaaagcgaagcattcccactgaaatatgcgaatgaatg

SEQ ID NO: 114167 - DNA, 99 bp, Heterodera glycines
  Promoter: Source sequence=SeqID_20226; Location=602..700; Strand=+; Gene=SeqID_85027
aaaaataaattttttttgatgaaaaaggatgtttttatttaatgttttatacgcttgtattttaaaaattatttagctaattatttttagttttaaatg

SEQ ID NO: 114168 - DNA, 303 bp, Heterodera glycines
  Promoter: Source sequence=SeqID_41308; Location=345..647; Strand=-; Gene=SeqID_69463
aaaatttgaatcgattttggacaataaaaggtgaattttggtgagaaatgagttttcttcgaattcgggtccgagattcgaaattggtcaaaatgtcagattcctgatcagcgaccctcaaaactgcccataaacatgtttccatgactttttagaacaaaaaaatttttttttctaaaaagggggcgcaccatctatagtattaccaattatattactaattaataatccttttacttacaattagtgtttttttaaatttatatttctttgctctgcatataacaatcaacgagagaaatg

SEQ ID NO: 114169 - DNA, 53 bp, Heterodera glycines
  Promoter: Source sequence=SeqID_6221; Location=1539..1591; Strand=-; Gene=SeqID_60775
caccagccagtgatcagcgatcggaaggtactgtggagaaaagcccatcgatg

SEQ ID NO: 114170 - DNA, 414 bp, Heterodera glycines
  Promoter: Source sequence=SeqID_9306; Location=3187..3600; Strand=-; Gene=SeqID_70933
tctgaatggggcagaaaggatttttttgttgttgtttataaaattaatttcgcccagtaacggcatattttaatgtatgcctttcaaactcaaaaaacgccgcgcaattttcaaaaaaaaaaagtgggaaaacattgctgaattgagggccagggggggcggagtgtgatttttgggctatggatgccaataggcgttgcgagaaaggcaaaatttttatggtatatttttttcaacaaaaattgagaaaaaaatttggcaaaacccaaaaaaaaaaaaaaaaaattgtttttgcccttcaatttgattcccgccgggaccactactctgatacaaatttctacggttactttgaccatccataaagaaacattagaggtcggacttactgtaagttccgtgtccaaacgcatg

SEQ ID NO: 114171 - DNA, 173 bp, Heterodera glycines
  Promoter: Source sequence=SeqID_19851; Location=521..693; Strand=-; Gene=SeqID_84606
aacattgttaagttgtcataaaattatagcatgtattacataggaaacccaacgggggctcatcatcagcgagaggcgctcctccgccaacattttttaaccagcaacttcagacaccaatcgctccaaatccaatctctgcaaaattagtggctaaagccacacatcagatg

SEQ ID NO: 114172 - DNA, 141 bp, Heterodera glycines
  Promoter: Source sequence=SeqID_32061; Location=1..141; Strand=+; Gene=SeqID_62373
tgccacaggacactttaggagtacaaaaacaaaatccgccccctccgggtgcgcactttggacggaggggcaatcaaaacagtttttgtggacgaatcgcagcccgtttcgcagctgatggtggtgatctgctccaaaatg

SEQ ID NO: 114173 - DNA, 1003 bp, Heterodera glycines
  Promoter: Source sequence=SeqID_13216; Location=1465..2467; Strand=+; Gene=SeqID_77042
ctgtataaaactgaatacccgtccatttttgcttgggagatcagggaccggctgaagcaggacagtttgtgcacggcggagactttgccaagcgtgggttgccacaacccctcgggggaggacggtagcgccggaccggccattcatttatcgtcattaaaattgttttgttaccgattgtaaaggtgttcaatatttttgtaagcatgaattggtactggaacatacatgtaatccatttacagtatgtttgcatttcttggatttcgtgacttcctgttgtttttgaacgttcaaaaaaacagaattattgaattcaaacaaatttccttaaatttgggtcctttatactacaataagtaatgatacagtatcaaaaaataaatggacaataaaaaaatacttttggtagtgaaaggccggttcttcgcgaaagtaccgtataccctcgtccaactatgctactgtattggttataccattataatgtttaaagatctcgtcaatcaacactgtgcttcgttcccatgcaatattgtgaaagcagcagatgaaaagcaaatttgacgaaatcatgaaagaaaggagagggatgaatcggcaaacaaatgatggagacaattatttgattatttttttttgtttatttaatcgtcgcttgggtggtaaacgccatcataattttcttttacattttgtagcaatcaaatatggtgctctttcattcattttgaaatgaaaaaagaatgattgtttggcgttccgttggcccatcggtttgggccgaaaatgtccggtttttttcttttttgcttccacattagcatgttcgtttcgtatcgagttggctccgcggcaagaaaattagaaaatgactcttcactcataaaaaaccgtttgaatataaagcaaaatcaataaataaaacgagtcaaagagatttttcaattactgtgctctttcgaattttgaatatctaacaaaaggctatatttttccgatg

SEQ ID NO: 114174 - DNA, 184 bp, Heterodera glycines
  Promoter: Source sequence=SeqID_42590; Location=1346..1529; Strand=-; Gene=SeqID_70445
gtcagtcagtaagcactggattgtgtgaatgatcacaaaaaagtcatcagtccgttcttatttttaaattgtttccttttttaattttttttaaaacacaaataatttatttatttaaatttatttttaattctcgatgattaaaaataaaactttcaattataatcaatcaacctcaacaatg

SEQ ID NO: 114175 - DNA, 514 bp, Heterodera glycines
  Promoter: Source sequence=SeqID_1742; Location=146..659; Strand=+; Gene=SeqID_75633
tttatgaaatggccttttttggattggaattcggaaatatgcgacaaaacatccaaaaaaattattcatttttagaggtgggcttagttgaaatgataaaatattctattttaaaaatttaactttagaagaatcgacaaaatttcatccgatggctttggattttttacacacaaaacgatgacaaaatgttgaggaaagaaatggagcattgggacgacttctacacacttttcttcacgattttgtgcattcgactgcaatttccacgcattttccatctgatcactgtcactttgaaaacaaaaattatattttaaattttatttaattattttatttatatatttttaccgattattcaatttaattatccgtttctccacaggcaattttggtctatgagcccgagaagaggccgaccgcgaatggcattttggcctttttggacggaaagtgtcatttcgagttaatgcgcagtaaaacttcgcggcttttcccttggcttggcatg

SEQ ID NO: 114176 - DNA, 1003 bp, Heterodera glycines
  misc_feature (776)..(776): n is a, c, g, or t
  Promoter: Source sequence=SeqID_20137; Location=160..1162; Strand=+; Gene=SeqID_84924
ttttatcgcataattaggcacggggggcttaattttgatgcttaattaggttttttgaaaatttctcgtacacattcattaaaaataaaagaacacacttaagtaacaaccattcaaattttctcaaaaatacaccgctttgaatgtaaaatttaaaaaaaaattaaaatttgtttatcgaataaatttttatgcttatttttttatccctattttgcttttttaggcttactcatacatgaattttgatgctcaattaaataaatttattcattcattaattatactgattttttgtcgaacaagtattttaatggtggatttatcaaagaaatgacctaataatatttaaagaaataaaaaaatgacaattttttgatagcaaatttaaggaatgggaatttgaacaacgaaaaccgtccagcaaattcccacaaatttgaacaaataacaaattattggggatgacgagaatggacggcctgatgagtttaatgaattgcccgacaaccagcttttgcatgtgagtgatgtcccggctgtttaaaaattaaccaagggcgtacttgaaaatttttttacatgaattaatcactaatgttatgccaaattttaattcattaatttatcagcatactcaaaaaaaaaactttaaatcccagccaaaaaaaatattattggtttcatgtccttaaataaaggaatttgatttttggtaatgaaatcacaaaatatgaaaaaatttgattggcctgcatatctcatattcatttttnaaaaagataatatgacaaacagattggttcttaaatatacataccactcacattaaaacggcaaaagataaaatttcctctaataaaaataactaatcgaatattggattaagtttttatttgtagaataatcctcaaaaaaaatatatttaaataaataaaatttggcaaaaaaaaatgtgtcaattgttgaacgtcaaaactttgtttagctcaaacaggacatg

SEQ ID NO: 114177 - DNA, 499 bp, Heterodera glycines
  Promoter: Source sequence=SeqID_820; Location=2609..3107; Strand=+; Gene=SeqID_62029
tcattaagcaaaagttatgaacatattagctctgctgctcgcagtatttatttagtctcaggcccatattaccagaaaaaaaagtttcaaagtgggaaaactgaaaaaagatgctttaaaatgttttttccggtgcaaatttccaaaaaagtttgggcgccaacgaaatgtgcgaatttttctacccccccccccctgattatgggcctgataaaatgccatttttatgtattgtttgttgcattgtttttttgttgtttttattgctgcaattcataaaaattggctggtaaattgaaaaactgctgatcattgagggaagaaaaatgaaaaattttgttttttatgttttaagtaaattcaataaaatatattttacttaaaaataaaaataaagaattatttttccaatttactctttttaaaataggtttttgtcaattttattataatcaaaaaatgttttgtttaatattttagtaaaaaaatcaataaaatg

SEQ ID NO: 114178 - DNA, 177 bp, Heterodera glycines
  Promoter: Source sequence=SeqID_2438; Location=1399..1575; Strand=-; Gene=SeqID_79726
tttaggagaggagggtattttggctgatttatttagcccgaaaatgtgacacatttatcgctaattggctccctgacattttcgaggtgttaaacgaatgtctttactggttttggcgaaacatcttttccagctctattgcccaaagatttgttactcaaactgatcaaagcaatg

SEQ ID NO: 114179 - DNA, 66 bp, Heterodera glycines
  Promoter: Source sequence=SeqID_11314; Location=1132..1197; Strand=-; Gene=SeqID_74692
acgaaaactgaccaaaatatgcgcataaatatgcaaataaagtcgtgaaaatatacaccaaatatg

SEQ ID NO: 114180 - DNA, 825 bp, Heterodera glycines
  Promoter: Source sequence=SeqID_17874; Location=1359..2183; Strand=-; Gene=SeqID_82420
aaacgatgcttttgcgcatcaaatcgtggatcaccgaccaatgattggaggagcatgcacgcttgaacacagaccaattcgtcctccaaattcaccgcccgtcgcctcttttgtattaacggctcgaacattttctttaacgcatttggcctcacgtggttcagcaccaaccatttgagcttctccgcctcattaccaatgcaaagaaagttgaaattggacgaagtggcagaggaagaggaagaagcctcaattggggaatgaaagggaagagcggacgaagaggacaaagtggaatcatccatttgacaataaaacagcaaaattagaaaaaacggattttgtaaaagtaattgacaaaaacaaaacacaaaaagtaaaaatcaagcagtataattttatcaaaaaatcagactattatgacaacccggcaaatgaaagaattttgcaacaaaaaatgcagtgaatatgattcaaaaatgtattaattgcactaactatcgaacataaacaatcgagatttggtcacaaggtcaatgagcaattgtcacgtgtttggataattaaagcttcactaattaaaggcgtcatcaaatgcttcggcttcttcttccgtatcaaaaacatcggccaaggttgaacagctcgccctcatctcgccaattttcaactagtaaataaaaatcgtttttttcaattagcattgccaaatagcaaaatgaaacacacattttcactaactgccgcagccacttggaggatgaaacggtcaagccaagttatcgagcgaggcctcagagaattgccctcgagaaagcccaaatg

SEQ ID NO: 114181 - DNA, 119 bp, Heterodera glycines
  Promoter: Source sequence=SeqID_25144; Location=713..831; Strand=-; Gene=SeqID_55870
tctcgcagccccctacggggaaattggatggacttatatactcgcacaatggggatggactttggataggatgaggggtaatgacggcaaaacacaaaagggaataagagaaatggatg

SEQ ID NO: 114182 - DNA, 311 bp, Heterodera glycines
  Promoter: Source sequence=SeqID_12725; Location=3443..3753; Strand=-; Gene=SeqID_76424
accgtccctgggtgcacaatcaaaaatataacgtttaaacatttgaagacgtgttttgaataaatttttatgaagctttttgatcaaaaatgaggcttttgaaaattttaatctgggagccctgagtaaaattgtcctaaatatttgaaattgattagggtaccaacagattcaatctgaaaaacactgtccaccatttgttcggcattaaaattcttataacggattaaatattattttccgtccattttaataaataattcatttatgtttttaagctggcgaggaaaatctctcgcaattacaaaatg

SEQ ID NO: 114183 - DNA, 403 bp, Heterodera glycines
  Promoter: Source sequence=SeqID_5355; Location=1455..1857; Strand=-; Gene=SeqID_57776
tttcagttcaatttattaacagaaattataccaaaatttttttttttgaaaaaaaaatttaaaaaatttccgaaaatttccgactttcatcaaaaatttcggaaatcggaagtcggaattccgacgaccaaaatttttcggaaatcggaattccggccccaaaaacgtcggaaatcggaattccgtgccatccctggtgcaaatgttgcgcaatttgacaatgccatcagagcacaacataggtaactctgttttgcttttatttcattattttaaattaactttatattataatatttttttcagtgtgacgtgtgactttggactgtgcacttacaaattagcgcactctaaattttaaaccggctttattaaattatttgagttaataaagtgttagatg

SEQ ID NO: 114184 - DNA, 1003 bp, Heterodera glycines
  Promoter: Source sequence=SeqID_2248; Location=1178..2180; Strand=-; Gene=SeqID_78691
aaaaattgggataagaaatctaaacaaagtcgcatcagatgaaaaaaaataggtcataacaggtggaaaaaaaaaggtcagacagatgaaaaaaaagtcagaaaaggtgaaaatggtgataaaacaggtgaaacaattcataacaaatgtgaaacaagtgaaaaaaataggtgaagaacaggcataccagtgtaaaacagctgaaaacaaggtgaaaaaaggtcaaaggccaaaatagaccaaaaaaaaacgaaataatgtgaaaaacagatgaaaatggtgtaaaattttcatgatgtaaaggtatggggtgactggtattgttgcgttatgatgcgatttgtcagttttttcaatcacatttcaaaagcggcattttgcgcccgtgccagccaaaaaaaaaatcgtgccagcaaaaaaaatacgcagtacgcagcagttaaataatgtgacggcttccttttgcattcgtcgccgaccaaattaaatttgactctctagcataccgttttccctctcacctgtcaatcaaatttccatcgtttgggacaggcttccttttcccttctagtctgatcatacaccaaaaaacttcccctctctgcgtgccattccccttcccacctgtcaatcaaatttcgtagccaaccaaaattcaaattttggttctctccgtgccagttcccttctcgttgtcattcaaattggttctttcgctagtcttctcccttctttcgccacataccgcactgaaaatcgatcacgcttcgctaattgttccgccccttcacattttgccggaattggcgtcctttcattcactcttctctcaataatcagcttttcaacaaaccttctcctattacttcaatttattccttttttattacttcaatttcttcctttttcaatttttcttatctctatcctttttcgtcgtgacttttttttctcctattgaatttatttcattttttctgctcaactttcttctcgaaaaatg

SEQ ID NO: 114185 - DNA, 358 bp, Heterodera glycines
  Promoter: Source sequence=SeqID_11648; Location=1..358; Strand=+; Gene=SeqID_75099
accatcataaaagccgattcgacaggaatgggtcgttttcattggaaaccgtggcaatttgctcccatcaacggctttgccaacgacctgtgaagttcgcaccgcattggaatgccaaattgtgaattgtaaagttgctaatcaggcactggcacttagcaatttcactaatttgatgttggaaccgccggtgatgccattcgaaggggcagagagtgaaaaatggctgcaaatatttggtcaggctccctggattctagagaccatccgggccaagatcgtgcaccgtttgccgatgttggagacgccgcgggtcataatcggtgactttacggcccaacaacttaactccgaaatg

SEQ ID NO: 114186 - DNA, 87 bp, Heterodera glycines
  Promoter: Source sequence=SeqID_3444; Location=1..87; Strand=+; Gene =SeqID_47619
atttttatttattttcaaattcccctcccctccccgaaacgacgtgttgctgagacggtgcacatgccccccatcttagccgaaatg

SEQ ID NO: 114187 - DNA, 1003 bp, Heterodera glycines
  Promoter: Source sequence=SeqID_19192; Location=816..1818; Strand=+; Gene=SeqID_83941
tttggtcagcttttgaaattcggcaacacgatggcggagtgttcttatttgtcacagctaatttcccggcacaaacgattgtcctctcgtgttggtcaaaatgtttcaattttcttggcaatatgtagatagacagagtgagtgcctttgatgccactgactaattcttgttgttttactctatgattcgtattttatatattattcggaatgacttaatggatatccttattcttatgtcggataacttttgatgtataataaatgtctagacagaacaacgcggattttacacataatctgattcaacacgataaacaattttttttttttgcgcacgattaaaaatactacgattcgtggtacattaaggagataattaattgtttagccgctccgtttttttctcaaaaatgcggccgccgacttaaattcatggttattaattgccttaactgtcaaaatgcaataggagacaatctccgctttgatcttcgcaacaattttacattcgttccgtgtttggctctcgaaaacttgctctcacattttgactgccatcgaaaggttgtctgcatttttagggtgaaacagtgaacagatttctgtatatattttggcggctataattacaccgttcacatatccaataaaaataatgcgtaggactaaatctgaaccatccgtccaaaaatttttggctgcaatgtcacaaaattccaaatcagaaggaggtggtgaaaacggtagacaacatcatccagtggatgttttctaccgttttttccaacgtttgcacgatgcccgcgggggtcgtcgtcttgttacgacccctgcgacatcgattttccatgacaacagggtcccgattttgtgtaggttttcctaagatatttaaaatttcaacattaaaaaaaaaattatgtagaaatgagttactgtaacctttttatattaatttataagttaagtgccaaaaatatttcttgcgggttcaaaaatg

SEQ ID NO: 114188 - DNA, 478 bp, Heterodera glycines
  Promoter: Source sequence=SeqID_11533; Location=3298..3775; Strand=+; Gene=SeqID_74964
taataacaccccaaactggctgctcatctgctgttgcaaacggaacagtcaagcgcaaattggtgactttgttccacacggcgattcaattttgggctccaagtacaattaccgtatttgctctttttatatgccagtctccattagtctgccagtctccaattatatacccccttctgagaaggttgaaaaataatataccatggtatataaaaagagcaaatacggtaagttggttttttcgtcttagtggtctgtgagttagtcaccaaaaggggggtcccaggttcaagtcctccctatgttgtgtgttaatttcaatttcttcttttaacggcataatttcgtgctgcgcaagaagacatcagtttgtcagaaaccgccgtccaactatgcagaagcggtggcaaaattcatcaattttgttgaacaaaggcgaaaggcgaagaacaattttcccggcggcatctttgcaatg

SEQ ID NO: 114189 - DNA, 965 bp, Heterodera glycines
  Promoter: Source sequence=SeqID_6842; Location=989..1953; Strand=-; Gene=SeqID_63077
agggaaccaagagcaaaagtgttaaatgggtggtgatggtggtgagattattttttcttataatttaagtttttttttaaagttttttttttggtgaaggtttaatacaataatttttatctgcgatattatttctcaatttgtgataaatcatttttatacgaattggtttatgttaattaattatagattgaattagctcaatctataatgtaattttcctttgaaccttttttaagtcattactgtggttaagtggctgtacaatgagtttaactgatacatataaagttccaattcgttagccttaaattattttcgtttaattaaaataattaaaattacaaatttttaaaaagattgtcgcgttttggataactagatggttggccggttggtagtgttgtgtatttgaccctctggatgttcgagtccgtttgcttgtaaatgaattaaatccatccttgttaaatgggtgctgaatggaagcaagtatatggacccctgctctagggatattgggttcgagtccctctgcctctggatgaattaatttaattaattctctcatggatttggaccccggcacctgggacaaaatcatgaagaacaaaaatgggtgtttttttaagcaggggcaggggtctggaccccggcccctgggactttatactactcatttcaatctctgggactcaattctcaggctttccaatcactggaactcaaatctctggcattccaaacactgggactcaaatctccggcattccaaacactgggactcaaatctgcggcattctaaacattgggactcagcacaccaactttcaatgacattccaatcactgaaaatcaggccaccagcattccaatactgggactcaattctccggcattccaatctctgggactaaaatctccggcattccagacaatgggactcaacccaccaactttcaatg

SEQ ID NO: 114190 - DNA, 52 bp, Heterodera glycines
  Promoter: Source sequence=SeqID_18032; Location=3299..3350; Strand=-; Gene=SeqID_82612
ccataatttatgctaaaatatgtgtccaataattaagcacacattaaaaatg

SEQ ID NO: 114191 - DNA, 143 bp, Heterodera glycines
  Promoter: Source sequence=SeqID_8498; Location=1236..1378; Strand=-; Gene=SeqID_68289
agtgggcaccttaattaataattagcaattgccttagggggacacggaggaaaaagcaaaaaattgcaaatggcaccgatggaaagtattttagcccatccacgggtcaatattacgggacgaacgtgccgggcgcttacatg

SEQ ID NO: 114192 - DNA, 117 bp, Heterodera glycines
  Promoter: Source sequence=SeqID_32885; Location=403..519; Strand=-; Gene=SeqID_63118
tttttggaaactgatgatcctttgggtatcggttacgccattctttttctgcaaattgcacccttttcaaatatttttcattctggtttttcaaatgtttccccctaaaaaggaatg

SEQ ID NO: 114193 - DNA, 52 bp, Heterodera glycines
  Promoter: Source sequence=SeqID_41552; Location=197..248; Strand=+; Gene=SeqID_69641
ggttcgttagtcgtttcgtaaattttaattgtttttactttcagcgattatg

SEQ ID NO: 114194 - DNA, 631 bp, Heterodera glycines
  Promoter: Source sequence=SeqID_17140; Location=485..1115; Strand=-; Gene=SeqID_81579
tctgaatattcgatattgtggtgagtgatgtgaggcattaaaagcaaattaattccttttatacggcttaatggaaaagatcacgcggcttaaacttcactctgggcactatggttgttgatctaatatcgtccagatcgatcattgaaaaaaaaatcgtaaacccataatttttgtcaagaaggaaaaaatcattttaatacatgaattatataattcgataattgagccctccttcttaatttcatttgatatccctaatttttttctatttgtttgtctacccaatttcaaaaattttattcttaaatttataaaaagtatgatcaaaatatttgaaaaaacctgtttttttgcgttcttctggctataacttttttgaaaggcaacaaaaatgtttttgaaattttataggctaatagaaaacatttagggctattgaatgataccaagaattaaggttgtttttaagttatgttatgaataattttttcaaaaagtttccatttgatgctttttgaataacgatagtttctccagtcccacctttttcaaaatatgccaatttttttttcgttttcaatttggaagcctttttaattccatattttttgaattttagacagccatg

SEQ ID NO: 114195 - DNA, 111 bp, Heterodera glycines
  Promoter: Source sequence=SeqID_42837; Location=448..558; Strand=-; Gene=SeqID_70646
cctgaaaaaatgacaattgtaattggttttaaatttttttagaaattctcgagtttttaactgtttatttattttttgaaaaattaatcataaatattttttcagaaaatg

SEQ ID NO: 114196 - DNA, 178 bp, Heterodera glycines
  Promoter: Source sequence=SeqID_22134; Location=1837..2014; Strand=-; Gene=SeqID_52784
ggtcagtgtttttcatccgcaaatattgttaattacgaacaatttgtgccgttttcagggtcaagatcgcttcggagagaactgtggccaaggcaaatgtgcctttctgaatgtctcctgcaactttcttcaaatgactccggtcgaaggcttgccgaatgcgcgtcatttcacaatg

SEQ ID NO: 114197 - DNA, 121 bp, Heterodera glycines
  Promoter: Source sequence=SeqID_24157; Location=1..121; Strand=+; Gene=SeqID_54863
cattttggcatattggattttgcaatctctaattgcccaattaaaattaccaatttataatttgactttttccaccgtaaatttaaaaaaaattcgtttcaagtttttttaaactaaaatg

SEQ ID NO: 114198 - DNA, 886 bp, Heterodera glycines
  misc_feature (177)..(177): n is a, c, g, or t
  Promoter: Source sequence=SeqID_6363; Location=916..1801; Strand=+; Gene=SeqID_61268
agtagggctgaggatctttaagcgcgaaaaagtccaaaacaaggccttaaataagtgcgaaaatatcgcgaaataagtgcgaaaatatgcatgaaaacattccaaatttaggggaattttttaaattgctttttttatatgaaaataatttcaaattaaggctaaaaattttatccnttattgcaggtactaatagggtacatttcagattttcgggattaaatggtcgattcttcggaccggctcagttcggccccagcatgtttttgcattataacttttttctttgtcaaccaaattcaacattcttggtatcattcgaaagctctttacatactctattagccttacaaaaagcaaaaattttcaaacctggaaaaaatttatgaagaaaaaaatttcaaaaaaaaaattgattttttcagttttcatgttataacttttttgaaatttgtctgtttgccaagcaatagcttagaaaagcttctaaacacattaagctttgaatgatatcaagattgttggatttggttgacaaagaaaaaagttatagtcaaaaaatttgctggggccgaactgtttgcaatgtaattcagccaaccttgggtatttttggcaaaaacaattgttgcaactttattttaaaccaacaaatataaataattttacttagtttttcaaaagttctagccaaaaaacgggaaaaattgtcataacttttgaaaaacaataaaattttttgaaatttagcaggctgataaagcaattcaagggctatcatatgatatcaagattgtacaatatcggttgcgtctaagaaaatttatgagcagatttagtcaaaatttagcaaatttgcacttttttccttcgacccaccacgatg

SEQ ID NO: 114199 - DNA, 371 bp, Heterodera glycines
  Promoter: Source sequence=SeqID_44696; Location=1..371; Strand=+; Gene=SeqID_72142
atcgatttttttgttttcggcgtagtccccccgaccctctgcgcccagatttatggggagaccgaatccttccggaatatcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 114200 - DNA, 502 bp, Heterodera glycines
  Promoter: Source sequence=SeqID_4592; Location=2990..3491; Strand=-; Gene=SeqID_55009
tttattgtgccaacaaaaatgggttggcaaaaaaaacataaacagtgccgtcaccactttgtcttgagaggggacccaatttttcggttgggtgccacccgcctccccgccccctcctaaatgaagaggtgtgacccagcaaagcagagaagaagcaagcatgttgatgaatttgaaattgataggaaagcaaattggcattggcacttctcgtaaaagtgccaaatatggaaaggaggcggcttattaatattcttgatgttatgacgtcactctaaaaccatcaaaatgggcgttgctcaaaaaaaaattaaaataaaaaatctatgcttataaatctttgcaaaaaaaaaacaaccgcaaccatatttttaattcttgtaatcattcaataggcttaagtcataaaatttcgttaagttccaaaaatttatgttccattattttggataccaaaatcccttcttttgaataatgaacaatttaaaaagatgtgaaaatg

SEQ ID NO: 114201 - DNA, 419 bp, Heterodera glycines
  Promoter: Source sequence=SeqID_18323; Location=1..419; Strand=+; Gene=SeqID_82921
cctattttataaaagcataatgtgccctatttgttaccgcgccgaatcctactattatttcactatttaattggaaatctatatttttggcactcatttgcaatttaaatttgaacattggcgttccgacaaatcttgaagaatgggaaacaaaagttcaggaaccgatcacaattattgagccggaaggcaagcttttttctatacaaatctcaattattaattctgaaattcataaaataaataatccacaaaaatccacgtctaattaggaaccaaaatattgaggtttttgaatttttaaaatcggataaaatcccaacgtctataatcagccggttctattttatcccatttttttccaatagtttatttcagcagatctgcacgttttggaaggccatttacagaaattgatg

SEQ ID NO: 114202 - DNA, 135 bp, Heterodera glycines
  Promoter: Source sequence=SeqID_25466; Location=919..1053; Strand=-; Gene=SeqID_56197
gctgaatttggcattgtgccaaagttaatggacaaaacattcaaaaaatagttttgacccgtttttggcatccaaagaaccatggaataatttgatggcaaaattgcgccaagagctgccctcgtcgacgcaatg

SEQ ID NO: 114203 - DNA, 406 bp, Heterodera glycines
  Promoter: Source sequence=SeqID_10640; Location=238..643; Strand=-; Gene=SeqID_73878
acggaaaacacaatgataaaaatgccgaaatacaccgttgtaatattcactttttgcgtgctttttttgcaataccaaatttcacacgttttttgtagctttgtattttttgtctgtgttttttaactcaattttacaaaccacttaaagtgtgctgcttttgtttggtgtttgaacaataataaaacaattgaaagtgcacggattggataaaataaaaattaaaaaaaaattattgaatcaaaaatggaaaatttgaaaaaacaattaacagaattataaatctattaaataatacaagtttattaattaataaaatttcaaaaaatttctattataaattaaaagaaaaatttgaaaagcaattaaattgaattaagaaaatatttaaattaaatatcaaatg

SEQ ID NO: 114204 - DNA, 846 bp, Heterodera glycines
  Promoter: Source sequence=SeqID_15048; Location=1..846; Strand=+; Gene=SeqID_79224
atcgacaaaatcccatttggaacaacgccaatttgtgccggaatcggtcggaatttgcgtgttgtgcgccatttactttgtatataattagcaatgaaatgagtgaaacaaaaaattcgcgtcacttatccattagcgggaggggttaagagaaaagtgaaaagaaatagagcgaaagagagagggaggagagaaggcgagcgagggggagaaaaaagagagatggagaaagagagaaagtaagagaaataaataagaaattagtaaaatagagagaaagaaaaacaaacagagagcgagcaaatgagagagagagagaggaggaggaggagaaggcgatagagtgtgcggaaaacaacagggcagacagttagatagtgatggttagctaattagatgctgtatgtgccctgcatatactccatttggaagcatttacgtgacaattcaaaaaacacagttaatgagcacgtcaatttccaatttcatctttaaaatttatcgattacttctcagcaattcattcacttctgtcgataactttggccgagagctgcgttagaaccagggctgcacgcaattacggattacggattgcggaaattacggggttttgggagttacggattacggatttttccgtaattttgatccgtaatttgacttttggattattttttcgagacgatttcttgtaagattatttttataaaaaacaaatttttctattttttatttaaagggctacccgtatttcgatttatttaagaattaaaatagatttataattttttatttgttgttgttaaggctatttgggtatttttaaattttgactacaaaatg

SEQ ID NO: 114205 - DNA, 329 bp, Heterodera glycines
  Promoter: Source sequence=SeqID_42768; Location=678..1006; Strand=+; Gene=SeqID_70584
tttctaaaaaaaaatatttttttttaattttcaagcaaatattaaaattaaattacctatgtattaaactactaaaaactaaacctgattccgtacccttaaaaattccgtacagggtccggtccgacgccgggcactagcactttacttggatttttagcaaattttaaaaatttgtctatttttcatttttcgaaaagcccggatttctatccgacaataagccctagcaccataaaatactaattttccaaaaagaatcgcaattatactgtccattatacataatttctttttaggcgtttattggactttcttttatcattatg

SEQ ID NO: 114206 - DNA, 322 bp, Heterodera glycines
  Promoter: Source sequence=SeqID_29436; Location=1..322; Strand=+; Gene=SeqID_59937
tggttcattatgatcaataatttttggtttgaaaattttattattttttcaaatttttttgaagatcaaatgatcggatacaatcacttttaatcgcttatttaaagctatttatgcgatcattgattgaaaaaaacttagttttgaaccagattttggacaaaggcgcaaatgtcgggccgcaaaagtcggggccgcaaatgtcgggacacgaaacagagggggttggaggagggctaagaaccgctagaaatttcaaaataaatttttagaggcttgaaaaggggcaaaaaaatttcaaaattttaacgccttacgaatg

SEQ ID NO: 114207 - DNA, 242 bp, Heterodera glycines
  Promoter: Source sequence=SeqID_6788; Location=1017..1258; Strand=-; Gene=SeqID_62912
taattaaaaaaaaatttgttatacttctcgtgtaccataatttattaaatctatattgtctatctttatatattaagcaatatttggttacttattaataatgtctgaagttgaaacaaatcgtcacaaggataaattaattaacgatggattcctttacattttcgacaaatttaatgttgatattagtttgaaattctggcgaaagggacgaatgtcgagggcgaattcacaccgacatg

SEQ ID NO: 114208 - DNA, 439 bp, Heterodera glycines
  Promoter: Source sequence=SeqID_4242; Location=997..1435; Strand=-; Gene=SeqID_53737
ttcctcctccatcattccctttgtgtttttgccgtcattatcccactcatcctatccaaagtccctccccattatgccccagtatttaattcctcccactttccccctcgggggctgcgagatttctgcggtggtcagtctgctcatttgtcagtgctgttctatgcctttggtcaacaatccttttccaaataacaaattccactgatcccaccaaaacagaggtcgttgttattgaacaaacttattccccccccccttttatttaatacatattattttgtaaatgcttttccttattataaattcatctctttaaaatggtaattagaaatggcttaaaagctttaaatccgggggacataacatctcctttacccattactacataaatcttgatcacattgacattttttaaccgcagcaggaaaaaaaaatg

SEQ ID NO: 114209 - DNA, 79 bp, Heterodera glycines
  Promoter: Source sequence=SeqID_3004; Location=1518..1596; Strand=+; Gene=SeqID_82725
ttgtctggataaaaatggtaagcatttggaataggtttttgtaatattatggaatgccaaagattgttttctcaacatg

SEQ ID NO: 114210 - DNA, 469 bp, Heterodera glycines
  Promoter: Source sequence=SeqID_21404; Location=1724..2192; Strand=-; Gene=SeqID_52014
agactggggggattatttttcaacctcctcagaaaggggggggataattggagactacgggattaatagagactgggcgataattagagaatatatcgtatgtttattagtaaattgctccgaaaattaaaaaaatattaaattgggactaatccgggaaaatcccgaatttccgaccagagtcgagattcagctttacgcatttgacaagggaatcattccaaacagttgttagatagaaaataagaatttaaattagacaccatcggatggagcgaagctgattcctattgtaaatttttaaagtttttcccataaccgaaaacccagggggattttatgaggcctcgaaaacgggattttttgactgctgataaaaaatctctgtattatatgcttaaatgatttcctaaaatgagtgctgtttttaaccaaattagaaactattttaactaaaacagaagaaatg

SEQ ID NO: 114211 - DNA, 1003 bp, Heterodera glycines
  Promoter: Source sequence=SeqID_26460; Location=1198..2200; Strand=+; Gene=SeqID_57192
tttgttccctgacaaaatttgccatttgaaaaaatatatttttcttttgcctttgaatttctgatggaaatgtcttcgctaaagcattggccaatgaatgaatgattaatgggttcctttcttcctctgatcactcactgtcatattcattcaaatcaaatctcttttttcctgtaattttgaatttatttaaatttaaatttaaacaattcgatttattttcttaggatttcctttttaaggcaattctttcgtctttaattggttttttaataaaacaatttctataatgcttaaattaattaaactctaaattaattagttaaagtcattggtgccataattcttcataatattattcgtcaaaattggattttcccattgttttttttgtttatttttggtattaatttaattcatattcaaatgccaatgttattcgcgtgccgtgccgtctttcacatttgaatttgcccattttagctttggtttggcagggtgttgggaggtgatttggcattcatttcccatttggtcgcactttttgctacaaattcattttaaaatattaatttatccttagcctcctttttggagcaacaactataatcacttttattcagcgtttgtttcatttttcattttgccattgcttccggcctcccaactcatccgtcataatccctcaggaaattaggaaatctctgttgagggagtccgaggcaacaacagaaagaaacggcaacaaaaacaacccttggcaaagcgttcgttggcattttgccttttcgccgtttgccctttcctccgacatttctcttctgctgatgaatgagtgagtgctgcttcgtcttcgtcttcgtctccgtcttcctcttctgccactgcttctgatactgctccgtcttttcttttccttttgctccgctgctgaacaaaaatcacaacgacgcctcacatactgaaatcggcagaatcgttcactttgtgtttcggcaaaatg

SEQ ID NO: 114212 - DNA, 732 bp, Heterodera glycines
  misc_feature (15)..(15): n is a, c, g, or t
  Promoter: Source sequence=SeqID_43976; Location=1..732; Strand=+; Gene=SeqID_71536
tctcaggtgataacnttttttgaaacttaatgaatttttttgaaatttcgcaggataatagaaaacacttagggctagctaaaaataccaagataataaaatttgattcattttgggtgaagttatgaataattttctgtcaaaaaatttccatttgatggttttttgactaacgcccattttgatgggttttgactaacgtcccagcaccgttttactgatacattttaaacacataatttattttactcttcttccgtttaaaaaataaataaatgtttatttctaaatttgtttgctgaattgacctttgcttcctttgcttttttttgtaaaattgcgaagttatctttccacagataattttgtagcaattaaattgaaacaaaagatcggaaaatgatattttgtcaattagatgatggaatggcgatttaatcgaattagtggcggatgacgatgaccataatcagatttatcaaccaatcactacgctataagaaaaccaaattcttgcaaaagatgagcataaattacatcaaggtttaaaaaagtgataatcggaataataaattaataatttaattgaacaatttcacagaatatgcccacatttgcgatttaataaattcattaataataattagcgaattgagaaaaaagtggcaatttctgcgataatatggtccaaattggcatgttagttctttgaaacgaaaatgttcagaaatg

SEQ ID NO: 114213 - DNA, 57 bp, Heterodera glycines
  Promoter: Source sequence=SeqID_1949; Location=2666..2722; Strand=-; Gene=SeqID_76976
agcagcccaaggcgccgtgaggatgagcagcggcggcgatcaccaagcgtgatcatg

SEQ ID NO: 114214 - DNA, 195 bp, Heterodera glycines
  Promoter: Source sequence=SeqID_15318; Location=677..871; Strand=+; Gene=SeqID_79556
ttccggcgatcacttcgccgtggtggagacggaaaatgaacggcttaaatggggatgggatgagtgagggtaattaaatgaacaattttggctcaattaaaaaaataattaagttttgggccagagaatgtaattttttggcattgcgattcgtttagtgtgtattaaaagtcaaacaaaaattttaaccaaatg

SEQ ID NO: 114215 - DNA, 127 bp, Heterodera glycines
  Promoter: Source sequence=SeqID_25612; Location=1..127; Strand=+; Gene=SeqID_56359
tgaggagggcgggcaggggacgaatccaagacattccttcttggattgttacccaagccttacaaatagacacaaaaactagatcgggtaaattaccgttttatttggaaaatatttttaaaaaatg

SEQ ID NO: 114216 - DNA, 127 bp, Heterodera glycines
  Promoter: Source sequence=SeqID_29608; Location=647..773; Strand=-; Gene=SeqID_60079
tctgaaaaaatacttatgaattaattttgcaaaaaataaataattaatgaaaaagtcagaatttcgaaaaattttaaaaacaacaagcgttggccattttttcaggttaagttagtcctttacaatg

SEQ ID NO: 114217 - DNA, 466 bp, Heterodera glycines
  Promoter: Source sequence=SeqID_31338; Location=372..837; Strand=+; Gene=SeqID_61710
tttgtcggattttgcccccagcggaaatagcctctgcttggcgaggattatccctcccccggccggcgccggagggagcaccaccgctgactaactgacaacgtgaatgtgcgcagcgggcgcgcacggcctgcgcccgcccgtaatcaatcaaaaccgccgccaaccaaaccaaacgctgcagcacagtggcagcggcggcgggtgatgtccgctctgccgccctttgtgaggcacgcagcgcggtgcatgcacacaaatgatgtgtgtttgtttgtgtatgtgtttcagtgcggcgcatgcatccggcgtgcatgtacatgtgaaaccggaagcgcacactgagaaaggaagccagtgcacgcaagttgattatatttagagaaaaagaagaagtaacggaaagtgtagaaaaaactaattggggttattaattgttggtccggaaaggacacgccataaaatg

SEQ ID NO: 114218 - DNA, 214 bp, Heterodera glycines
  Promoter: Source sequence=SeqID_9089; Location=3036..3249; Strand=-; Gene=SeqID_70210
tccgcccggtatcgaagcctaatttttaaaaattttatagccgaactccttcaattttcgtcaccaattttaactcgaattttaaattttggccgaaaatgtgaaacataattacctaggtatccattttggttgtttccggcacaaaattgagtgaaaaataatgattttgtcatgataaaaccgataatttgcaggcggtggcctcaagatg

SEQ ID NO: 114219 - DNA, 145 bp, Heterodera glycines
  Promoter: Source sequence=SeqID_195; Location=3137..3281; Strand=-; Gene=SeqID_77172
ttattcattcattccctggcccttttacagcttggcgatgacaaccaacgtggccaacccaattctgtacgcatggctcaatccgaccttcaaagagttgtttttacgcaccgcaaatgtgttggtgttgcggcgcaacaaaatg

SEQ ID NO: 114220 - DNA, 351 bp, Heterodera glycines
  Promoter: Source sequence=SeqID_11979; Location=677..1027; Strand=+; Gene=SeqID_75496
taattaagggtcaaaaagaatcgttattttattttaagttttaaaatcaacaactgtttttaataccgaagttaacgcttttgaaactcccgcatttcttttcatgacgcacgaaaagtaatcatcgtttaatgaactaataattattgatacaatgattggtagacaatttaaaatttgcgcttgacagaatccatcattttaattgcgagaaatatgtcacgaacaaaatcaattttaaaatgaaatgtgtcacaaactttggagaaatcaataacggctgtttaataccaaatgtttttttaatactcattttataacacacgacacatttttagtttgacaaatatg

SEQ ID NO: 114221 - DNA, 277 bp, Heterodera glycines
  Promoter: Source sequence=SeqID_2110; Location=1..277; Strand=+; Gene= SeqID_77903
ttcatgtttaaattgcgtcaattagcaactgttggatgaattaaattgtacttaaaattgcaaatatttaaaattttatttttcagaaattgtcaataagattttgccagtaattaatggctttttttaattattttgatgatttgtactacatatttacaccagcagcagtaaaaaaatatataaagaaatttcactttgtttttcgcaagcgatctgaaacaacaatacgaccactgttgggtataccatcggatgtagttcgttgatccaaatg

SEQ ID NO: 114222 - DNA, 190 bp, Heterodera glycines
  Promoter: Source sequence=SeqID_440; Location=345..534; Strand=+; Gene=SeqID_52869
tttttttattttccaaccgctttttcggctctttcttccaaaaaaaacttttggaggacagtgagggtcagacggcgccgataggcgctgttgggaaaattttgtagtttttaatgcaatttgttcacagattttattcaaaaaatgaccaaattttagggtttttagccaattttttaataccaaaatg

SEQ ID NO: 114223 - DNA, 704 bp, Heterodera glycines
  Promoter: Source sequence=SeqID_20486; Location=2063..2766; Strand=-; Gene=SeqID_51023
atatataattcaatgccattaaataaaatcttttaaatgaaatttaaatgtttgcaaaacagagaaacaaataaaatttatttcatttacataaatcaaccgatttggcctatattattttgaaaatattaaataaaaaaagagaaatcaataaaattaattcaaaatgtatgcaaaacaacccaacagatggtactattacactgcattgaatacgacgagagattaaaaaaattaacaataataaataatttaaacatttaaaaaagccgaatttaaaagaaatgaaaagggcattttttaaaacaaattaaattaactatatttcccttaagatcgaagtatatatgcataatattatttattgtttatctaaaaaatggaaaaatatgtccgatgaaaattgtgaaagaattgcaaaacatccaatttaaattggttaaaaatattagatcacaataattgattacatataggctgccccaataaaaaaagaataaagaaattaaataaataaaacaaattaattttttagctcaacagaaaaaattaaaaatatatctcttgtcgacgtgaacttcttgtaaaccacaacatgaaataaaacaacaaatcataattttataagaatttaagttttaaattctatttaaatttccattaatttaggcattaaaattaaaagaatataaaatttgaaaatg

SEQ ID NO: 114224 - DNA, 103 bp, Heterodera glycines
  Promoter: Source sequence=SeqID_15540; Location=1..103; Strand=+; Gene=SeqID_79820
agtttagcttagaactgatgcttctaggatattttttctaaaattttcattatattttttccccatttttaatatttttttagataaggctggagaaaacatg

SEQ ID NO: 114225 - DNA, 98 bp, Heterodera glycines
  Promoter: Source sequence=SeqID_29751; Location=779..876; Strand=-; Gene=SeqID_60213
atgtcaagttgttttttttgaaattgactcgaaaaaccgaatttaggcctacggtagttgacaatgacccgcacattcaaatcagtgcagtaaatatg

SEQ ID NO: 114226 - DNA, 84 bp, Heterodera glycines
  Promoter: Source sequence=SeqID_3973; Location=1095..1178; Strand=-; Gene=SeqID_52636
tttttggatcaatcaaagcttaagaattcctttcacttttttataatttcgtttctagcgtaattcagattctagcaagaaatg

SEQ ID NO: 114227 - DNA, 608 bp, Heterodera glycines
  misc_feature (47)..(47): n is a, c, g, or t
  misc_feature (101)..(101): n is a, c, g, or t
  Promoter: Source sequence=SeqID_41147; Location=1..608; Strand=+; Gene=SeqID_69339
tttaaggcattcaccattcacaccagcagataaaaactaacgcgaancgctcacaacatttcattatgatttcgtttttttttgtattaaatgttttcttntgaggccttagaaacggatcaaaacctattctcctccaattttttgttgttgttttactgttactcattcattcataacaaacatttgaataagttgtttaaaggaatggactaattgcttacttttgttctgttgcgatattttgaatgtcataatgaccaattacggtgattaaatttcgaatggtcgcaattccaccctatcaaaaatcaatttgtcgttaatctatacattggggacgccatttgattgctatataaaatcgggttggatacctatttgtggtgggaattgaatttgggggaagatttggctttatgacaataaaagctacaaaaaattggttttctgttttgatcttaggtgaatttttttttcaaccttcgtaacagagaacttttgaggcaattgaatgggcaaaggttagtttactcgatttttctctgtgtttataagggagtttatgaaacaaaaacaacaacagcaattggtcatcgtctcacatg

SEQ ID NO: 114228 - DNA, 833 bp, Heterodera glycines
  Promoter: Source sequence=SeqID_45115; Location=186..1018; Strand=-; Gene=SeqID_72481
tattttgtgaatccttttttctgttatttttttaatgtaataaattcttcacttttttatttacacttctttttgccgcaaataatttctaaacaaatagaattggtccgctaaaaaccgcctaaaactagttgcaatcaatctctaatgacctctaagcatcacaataatagtccctaggcgcggaaaataaaaaaatggttttttaatcggtttaaatcacgaaaaatgaaccaaaatcaaccataaaaacattagtacggccttcgcttccgatcacgactttttagggactggcagaatacatgaaaagggttggtgggttgatcaagatttttagaaggggtctgagggttgaagagcgacggtcaaatttgttaaccattccaccaaattagagtttttatattgctcttcacctgacttttttgcgaagcgcttttttcgttttatttgaaatttattcagaaaatttttggcattctgtttgtaaaattcaaaaaaaaatcaatttgcggatcctgtagcgggatgaaactcaattttttcgaggtctcgcgggataatccctcaaaccccaaaatttttgcggggttgcgaactggaattccacaaaacacaaaatcccgcgcctggctctaatttatattgttcatattagagccagaaaattacacaaaaaaagtctattttttaatttttaaggtcctgtaatttgtatggtcttgcaaactaaagagtctaaactttgcatataagagcaatttgttcattgaaaatggaaaagcatttataaattctatgtattttttcctttcttttttacagaaatg

SEQ ID NO: 114229 - DNA, 538 bp, Heterodera glycines
  Promoter: Source sequence=SeqID_7894; Location=1385..1922; Strand=-; Gene=SeqID_66308
tttttctaataaaatttataattttcagatatcgtttttcgcttgtatgaatttatattaggagagggacagtattccgggttcggaaccccgtatctttttaggaccgcggcggaactccggattctttgattaaaatttctgaaccgtaattttattttaaaaactagcggttttgataagtaccaattcttctgcattgtttttattggacttacctaaatctaatcaaatcatgattctctttttaataatttaaaaattcacaaaatgactatttttaatgcagtttgtaaacttgcatcgcaccgcagtcgcatatttaaaaatttccgggttatggatttttatgggacctgatgaattccggaaactttcacaacctagggtcccaccccgaatatttatgtatttcctaaaaattctcatccaagtcagaatggcgactaagtcttgtaaattctccattttttattttcttgctataaatagattttaggagaattctttcatttgctttcaacttttgactgaaatg

SEQ ID NO: 114230 - DNA, 971 bp, Heterodera glycines
  Promoter: Source sequence=SeqID_1120; Location=2797..3767; Strand=-; Gene=SeqID_68145
tgggctgaccattactaatttggacactgatccgattatcatagtcgagtctggcgacaaatcattttatatctgttcaaatatgagacaaaagaaattaaagaaaatttgaccttaaagcatctttctgaaaagcccaaccgattggaatgcatcattagcaattttggctacaatttgcttcaacggatggaaaaatttgcagaagaattttttacagaaattgttccaaattgcgacacattaaacattaaagaatggctttttaaaatattttcatataattcattcattttttactcaaacgaatgatcaattatgtaaatttgaaatatttaataatgacagccaaaaattatttaatgagtcaataacctttaagctacaagagtagtaatgggttacaggggcaggggtccagggctttaccacaaacctaatccaattagccatcctcctcaggaatctcgcgcagttttttaaattatttaaatgcgggagaattttaataaaaattaaattcgccgcggggtgggggactcgaacccttggaaacgggagctctaaccactcggccacggaggcggttgaaatgatcggagcaaatgttggatatgtgccgataattttcctcccgatcctgccccaaggcggcggcgatgatcggacccctgcccctctccccggaaacccctccccctctcccggacccctgccccctcttcttcatcatcgttttaatcacttcaatcccccttctgccgcgccatttttcctccgttcggattattcccacgtctaacattgatcggccgaccggtagaagcaattaataaaatttgaagcatttcaaagttttttttcatttataaaataactttgtaaatggctttttctttttttaattcgcactttttccctttttccgcttatttcaccacattctgcccctaatctttactcctaaaatg

SEQ ID NO: 114231 - DNA, 421 bp, Heterodera glycines
  misc_feature (49)..(49): n is a, c, g, or t
  Promoter: Source sequence=SeqID_21680; Location=3058..3478; Strand=-; Gene=SeqID_52290
ttaaagggtcaggagccccccttttcctcaatttttccattattaaacncggttcaaaaaccggttttttgccatttccgaacctcaggagtatttttcctgagcattacaggccacgagagaacaaatggtatcaattttattcattttgtttgtgggtggtagactatagtacagcccatttttccataaattttttctcaaaaacttgaataaaagtacgattgttgaaaacattttttcgagaattgatacaattcataaattaatgtctgtttttgccggttctgttaaaactgcttattttaaaataatcaatcccgaaaattaattttattaatttttttttaaatttttgaccttaataaaagcagttttaatcatcatttatatagatgatagcgtacgcctattaccaatg

SEQ ID NO: 114232 - DNA, 1003 bp, Heterodera glycines
  Promoter: Source sequence=SeqID_23736; Location=730..1732; Strand=+; Gene=SeqID_54427
tccgttaattgatttgtttattaggccttattgcagcactcttccccttcttcattgatttgtttattttgttcatcttaaggggtcctgtaattaatttggtttagttaaaataattatgcaaaaaaataaataaataaaaaaataaaatattgggctcataaattaaatttagataaaaaaaacattcaaagccaaagagttagaaaaaataaatttgcatcaaagtataaaatttcattgaaattttaattgtttgaaatttaaaaaaatatttgttattattttaataataattaactaattaattaattagaacattttttaaaatttataaataaatattatttaattatacggtcccccatttctttttcgctttaagtcaaaaattgggaaattccgttaattgatttgtttatttgaccccccttcccttcccgccacccgaactcgccatttcccttatccctcgctgcaacccttcctcgccactctcgctgccgagcaatttctcgccatttttctcgttgcaatgtactctcgccacactctcgcccccctgccaatcgctgctgcctactctcgcccccactgccactcgctgttgcctgctctcgcccccctttccctgctggtgacgtcaaattttccctttatgagagcaaattaatgtttatcatcaattgccaatgtggccgagtggttagtgcgtcagtctggccgcccccctggggttcggatccgcttggtgcggggaatttttggagaattttaaatgaatttaaattcaacgtctttgacctttaagacgtttaaaataatttaaaattaaataaatttaattaaaataatttgcataaagtcgcgcagtcaaaaaagtcgcgcacccccctgcaataggtttgggtttgcaagaaaaagtcgcgcaataggtttgggtttcaaaaaaagtcgcgcaataggttttggcttcagtactgaaaagtctggcgctcaaatg

SEQ ID NO: 114233 - DNA, 215 bp, Heterodera glycines
  misc_feature (36)..(36): n is a, c, g, or t
  Promoter: Source sequence=SeqID_5555; Location=7311..7525; Strand=-; Gene=SeqID_58448
aaaaaatatatgcctaaaaagtagtatagattgaanttaggttcagatttttgaaaatttatgtattttaccgccttccgttaccaacaaattagaaaaaaagttacgttttgtcaaaatctcaggttttggacatttagcgaatttaaaaatataatttgtttttaccaaattttccctacattatgcaatcccttccccggattaggacaatg

SEQ ID NO: 114234 - DNA, 1003 bp, Heterodera glycines
  misc_feature (386)..(386): n is a, c, g, or t
  misc_feature (581)..(581): n is a, c, g, or t
  Promoter: Source sequence=SeqID_2595; Location=2516..3518; Strand=-; Gene=SeqID_80627
atgcatctctttatgtatagatcctgaaggtgtaatgcgttcaccccgtcgctggtatgtctgtgagtgttatgtgtagggatgtcaaaaatatgtacaaaaattggtaaaaatatgtatataaatcagggttcggatctgtccttatttataagatttgtccttatttggagggtccaaatcttacaaaataaaaatgtccttatttgtaagatttgtccttatttcgggctattgttcttattttgttcttatttcttaaatatattcaaaattttgaaattttatggcagaatgtcactattttatcaagaaaatatagggtttgctcaaaatttagttattttttgacaaaaaagcaatcgcattaaaaattacaaaatttntccccggcggcgcctatcggcgccaccggaccatctccccccttgttccccaaaagtagttcttttttcttctaattttcaaaattattcccttttcggtgggaattcaatcacaattttaacaattaaaatgagaaaatattgttatttttggactaaatttgttcacaaagtgcactaaaaatttcaaaattntcccccggcgaaaatttgaaaaacccaaatgaaaattcacttttttcaaattttaaagccaattccattacatatgtttaataaaatccacaagtttttttttcatattcattattgcagtctgtaaaggaattataaagcctcaatttttttttcttcatttatcatagtggactttttgatcagcacaaaaagttatgcttacatgaatttttccagatttttatgatgtctttgaaaaaagttttttgtgttttatgaagtagcctgataatttctttacagcaaatttgggcaaaattttggaattaaattcataaaaataaaatttcttttacatttttaattttttagtgtgtgattcttaatatttatagggggagggtaaaattggtaaaaaatttcagctcggttgggacatg

SEQ ID NO: 114235 - DNA, 723 bp, Heterodera glycines
  Promoter: Source sequence=SeqID_10075; Location=4022..4744; Strand=-; Gene=SeqID_73140
tgattaatctctccggccggcgcttggaggggtggcaaaaatcattgtctgcccacctcagcggcagcagaaggaaggcccaaaaagtgagtgctgctgctgctattggtggatgagctaattaatgatgatggcaaagattggtggcgcaatttttggcacaaaaatcacggaaatgcatttaaaattaaatatgcattcaaaattgaaaaataggtgggcacattttctagtcaaacaaaaactttgaaagtgaaaatgatttagaatcagattctaacctttaaaagttttattttagagcacgaatatactccgttcattaaggataatgattatcttaatccttggggtatatttcaaattgactaattaattattgagtaatttaaaaaaataatttgggttgttttttgcaacatttgactctttaatgagcatttgtggtgaataatttatgtaattttggggtactcattaactttttaagtttttttttggggcaaatgggcggcgatgtgtccatggccacgtccgtcggcaacggttgaactttgagtaaaagaaaaaagagttattcggcccaatagaatttgaaaaaatgataattaataagcaatttttcttaattagatatgtgcttaattacctattttccatatgctttcactcttctcgaaaaatgattgccttgcgcccaaaattggccgcctaaaggcaatg

SEQ ID NO: 114236 - DNA, 187 bp, Heterodera glycines
  Promoter: Source sequence=SeqID_35621; Location=436..622; Strand=-; Gene=SeqID_65136
cgctcaaccctactttaaacacagggggggggggtaggggaggggtacaaattgccgaatttttctatcttaatgtaagtttgagtatcagaaatttgcaaattttcaaaaaagtattgaccttttttgagtcttggtaaaaattttaaaagtgtacttagaacctcctatataagcaatagaaatg

SEQ ID NO: 114237 - DNA, 126 bp, Heterodera glycines
  Promoter: Source sequence=SeqID_21869; Location=1525..1650; Strand=-; Gene=SeqID_52500
ttagtttcttttttccgcctcaattttttttgctatttaaccacagtttttttaaataaaaatcatttgtgttccattttttaaaaaattccatcctccttcgttttttccgatcttcctgcaatg

SEQ ID NO: 114238 - DNA, 440 bp, Heterodera glycines
  Promoter: Source sequence=SeqID_2527; Location=299..738; Strand=+; Gene=SeqID_47322
aaaaaaaatgccacgactaagaccgcacaatcaaaaaaaatacacacgactaaaccgcacaatcaaaaaatgccacgacgacgattcgcaatgtgtaatggatgagtgggtatggatgagttgggcgtgactcatcattgatcacagatagatcagttgactgattaagagcaatttgaagtgattaaccttttgcttttaactataattgataagcgctttccaaactgatcacagatttttgatcacaaatttgatcggctggaaaaatttttcttcatgccgacctgcacattctaattagtaccaaactaattaattggtactgcattaaatactacaactattatattcgcaatccgtaaaatttctaaaaaaattttttttttctgacgggacgacggggagccaattacatcagcggcggcaacggtggcatg

SEQ ID NO: 114239 - DNA, 62 bp, Heterodera glycines
  Promoter: Source sequence=SeqID_37412; Location=1..62; Strand=+; Gene= SeqID_66492
aaaaaacaaaaattatgcgccaacctcataaaaaaaatttgcgatagttttaaaaaaaaatg

SEQ ID NO: 114240 - DNA, 929 bp, Heterodera glycines
  Promoter: Source sequence=SeqID_5432; Location=1..929; Strand=+; Gene= SeqID_58010
aataaagataataaataatttactatttaattttttctctccaagtggcacgccgcaagggaattaaaaaaaactcattagttatgcataattagtttcctatgtagacaaaatgggagttatttcataaaatccacaaatctaccaaaaatacggaaagaatagtaaatttaaaatttaacatgctgtctcgcaatatctcacactgtctctctctctctctcacacagtctctctctctctcctctttctatctttccctcgctctgtttctcttctctttatctttactttatatcactcattctttgccaaatagaaagcgacacaaagcgacgctaacatttcgcacaattgtcattattacggatgatacttttagtgacgaaaaatcccgaaagagttaactaaaatagttacgaaaaagtgccaaaataatgacaaaatagtgaaaaaatccaaaatagtgacgaatagagacataattttcagccaaaaattgagcaaaaataatttttattcactatttgcagttgcaaatgagttggactgagatttttaagagcaaaaaacccaaaatagttacctaaataaagtttttaaacttaaaaatttttgccaagaaagtaaatttttgaataaaaattttttcatttcataggaggagtatattttgaaaaattttagctcgattctgaggggtgtatttttttgaagtttttttaggtcgattcttagaggtgtattttttatagtgacaaaaagccaaaatagtgatttttaactattttagtgacaaaaccctcaaaattgtgatttctattgaccgataatggcctcagaatcaaaaatttttaatgcagaaatgcgttttttgagcccctttcttcaaatcaattgagcaaaaaatttaggtatccctacaaatg

SEQ ID NO: 114241 - DNA, 292 bp, Heterodera glycines
  Promoter: Source sequence=SeqID_17282; Location=963..1254; Strand=-; Gene=SeqID_81753
agtaaatgaatttttttcatgcagaggctgcagaaatactcaataaagcagcaaaaaggaggatctcttcgcagattcattacgagagcaaatgaaggttttttaattaaaaagagggcaacccaatggcaaattttatgagagataatcaagtaacacgtatttcacttaatttgttattacttacctatattacttttttgtaatttgatatgcaatgacaacgacaaatagcgcctccaataattacactggtgaggtgagcaaaatcgagaaaaggcagcaaacgatg

SEQ ID NO: 114242 - DNA, 527 bp, Heterodera glycines
  Promoter: Source sequence=SeqID_15724; Location=700..1226; Strand=-; Gene=SeqID_80046
taatgttcaaggtaataataatattgctgaattggcctccctggcggaaaataaattaattttttttcaattttacttgtgtaaaaatgcattgattaaagaatttgagctgattgtcagaatttgtaagtttttcatcaagcacatgatcttttggcatttttattttaaaattaaggtacttttcggttttgtgtacacatcccaaaatgttaaaaaatatgtgaggatgcacacttttttgacgggacaaaagaaataatttttccaagacaaaacagagggtttttttgccattttatggcaaattattccttttgttccatcaaaaactccgtgcgtcatttgtacatattttttaaaattttggaatgtgtacacaaaaccgaaattttcgactttttgttcgaattcgggtccgtagctcgggagcagcttgtcccccccccccctcccgcatcgttccccccgtgaattttttaaaaaatttactaacttagaaatttttcaagaaaaaactcagtatg

SEQ ID NO: 114243 - DNA, 350 bp, Heterodera glycines
  Promoter: Source sequence=SeqID_26046; Location=1072..1421; Strand=-; Gene=SeqID_56793
ttttacaccccctaaaaatgaggtttttagagcctattttccattttttagtgcctatttttggggttttttagagcctaaagcctacctattttggcagtttttagcgcctaaaaattgcatccccagtaatttaatgagctcaacaaatttctgaattttttctctttttcttgccatttcgcacgactcaatgaaataattgagaatttatttattttttcctttatttacactttgtgttgcattattttttagtttggattacaacttggatgaactgatttcatgcattttttgtgatgcattttttgccgtttagataaaaagaaattagacttacctcaatg

SEQ ID NO: 114244 - DNA, 855 bp, Heterodera glycines
  Promoter: Source sequence=SeqID_8017; Location=3787..4641; Strand=-; Gene=SeqID_66701
atgaaaagaattttggcaaagagacggcaacagatgtcgccatccttgaggcccggagtatgtcgccaaagcgacacaaatttctttgaaatttcttttatttttgatccttttcgtcgatcaattttctcccttcgctcgctcctttaattatgactcatcttttcttttctccatattttcgctatgagtcatcatttttgagggaattttttccctttgcttgtgcacatttcttcacgtgcctggccccgcccccatcgattgtgagggtataaaagcccggcccattctccattttcttcactctgatcactttttgattaagtcagtcgtgacagttttctgtccaagcatttgcattaaattgtaattgtgcaattgaattgaataaagattaagaaagagtcttagtcttttctctatctgtaaaagggacgctcaggagccctttcatacagaccattaagccgttgacccccgttgggtcaaagaaaaggcttacaaaaggaaaggagaaacattttcctcctttcaaattgtcccttcagtaaaggagaggaatttcctcctttaatttgtccctttggacattcagtgaatttctgtcttttggacagaaattcgctttgcttaaaagactccccccttctgccgtgagagtctgcttccccttctgccgggaagtgcaaatttttgtggccttttgcccacaaaattggagccccgtaggggtcgacttccagtcgtaagcctaccctccaaccaaaccaatccaaagcgcggcctgagcgcttggatcaaacacacaacccaaaggggtttattgtgttttcattaagcgtaagagcaatg

SEQ ID NO: 114245 - DNA, 67 bp, Heterodera glycines
  Promoter: Source sequence=SeqID_5473; Location=1081..1147; Strand=-; Gene=SeqID_58183
tatagaattagccccttggcaaaacggagcaattgaacgccttaatcagaatgtcaaaacagcaatg

SEQ ID NO: 114246 - DNA, 101 bp, Heterodera glycines
  Promoter: Source sequence=SeqID_21518; Location=605..705; Strand=+; Gene=SeqID_52128
tccccgatcgccatcccttggtttttttcttgagtctgatcacttacgggcgcattagtgtctgtgtggcatttcagcgaatttttgatcatcgggtgatg

SEQ ID NO: 114247 - DNA, 166 bp, Heterodera glycines
  Promoter: Source sequence=SeqID_1357; Location=971..1136; Strand=-; Gene=SeqID_73009
tattttaggttttatgaaatttttccgcttttttcttcatttatgatgttttagacttcaaatactgaattaattagatgacatacaattagcagcagagcagaaacagtttcctaaattattttagggctatggcttctttttcaggtacgtcccttatgaaatg

SEQ ID NO: 114248 - DNA, 72 bp, Heterodera glycines; identical to SEQ ID NO: 101114
  Promoter: Source sequence=SeqID_371; Location=1901..1972; Strand=-; Gene=SeqID_84705

SEQ ID NO: 114249 - DNA, 597 bp, Heterodera glycines
  misc_feature (33)..(33): n is a, c, g, or t
  Promoter: Source sequence=SeqID_8431; Location=2325..2921; Strand=-; Gene=SeqID_68047
atccggctcccattggatgcagcttaaatattntagaatattataacattattttttagactccaaaattttcaagaagatcgcaaattacacactttttataacggatgaaaatatttttaaattaccgtggcactaaatgtcgaaaagttcaactgagaattcgttttttaataccaagcacatttaaatagatagaaatgagtgtttttgtgccaatatttataggaattcttaaatatttttttaaattttgtaaaaccttaaggaagaccatttgagagtggaaatgaatttgtgtatcatgagcaagaaatggaggaatttgaaccttcttccttaaaaaaatttgggccattaacaggcaaaaatttatattaattttatttaattttacacaattacatatgagcaaattcatgtacaaatttaaaaaaaacaattaaaatttatcaaatgacattcatatattatcatattatgaaaataaaaaattaaatgatcaacaataaaaattttttagtcattaaaaataatttagacaaaaatttctctgaaaggttcaaaaattcatatgcagaactttctaagacaatg

SEQ ID NO: 114250 - DNA, 163 bp, Heterodera glycines
  Promoter: Source sequence=SeqID_27026; Location=1..163; Strand=+; Gene=SeqID_57757
gaaagtgaactccgcttcgcttttcaaaaccgacgtggcggtagatggcaaagaaatcaaattcgtactcgacagcggggctgaaataattgtgatcgatgaactatcacatgaagtcatcggcagcccccgactccgcaaatgcaccgaaagtggatgcatg

SEQ ID NO: 114251 - DNA, 301 bp, Heterodera glycines
  Promoter: Source sequence=SeqID_38840; Location=1..301; Strand=+; Gene=SeqID_67557
aaaaaatatttttacgtattttggcgttttcccaaaacatataacaaaaatgcaataaaaacgaaaaaatatacccctaaaaccgatcgcttcagaaaaatacatctctaaaaatcgacataatttttttccaaaaatacaaccctaagaatggaccaaaaaatttctgaaatacacatccataatatgaaactttttgttacctattttccattttagcaactattttaggagttttttagaaactaaaaactaactattttggcactcatccctaattaacatatttttcagtccgatg

SEQ ID NO: 114252 - DNA, 601 bp, Heterodera glycines
  Promoter: Source sequence=SeqID_12334; Location=1..601; Strand=+; Gene=SeqID_75934
ccccccccccctccgaagccctacgcttttttattaccttgaaaatgccgcattcggcacgctctgcgcacctgcgtacgactttgaatggcatggctcgtcttccgcttcgttgtgtgccatccgcggcaccgttgcgcgtgtgcgattggaccatacacaatgcttttggactctcacaacgcacgttagtgcccgcgtcacgcgaagcgtcagcagcagtcaaagaaatgcaactggggtccgtgtcggaagagcacacgtggcaaagcagtggaactgaggcggaagggaaaatggcgaaaataaattaataaaaaaacatttattcgatttgcaaaataaaatatttaatgaatttacataaatattcacccttttccgcgcattttccatttgcgtttattttctgaccatttggacattggcaaccaaaaaaggacgactaaaagaacgaaaattaatttatttgtttattattttattagctcttttttcgaactccgttctctggcagaagccaattgccgcttggcgaacagatcagttgcatcgttttgccggattggcattttgccgaaattgtccgattttcaaaatg

SEQ ID NO: 114253 - DNA, 67 bp, Heterodera glycines
  Promoter: Source sequence=SeqID_34583; Location=827..893; Strand=-; Gene=SeqID_64338
ttcctgctgagactggtaacacaataaataaattgtaataatataattgcaggtactggttgggatg

SEQ ID NO: 114254 - DNA, 427 bp, Heterodera glycines
  Promoter: Source sequence=SeqID_19941; Location=1..427; Strand=+; Gene=SeqID_84710
cttttggccataaatttgttcaaaattgacgaaattttttggaattatgcaagataatagagcatctgaaggacactcgaatgataccaacaatgttagattttgttgacaaaaaaaaagttatagtccaaagttccttcaaaattgtcattccttcaaaattgtcattacaaatgtgcccgaaagcaaatcggacaaagcgacggagagagcccgggaggaccgtgccgttgtggacgaaattttgaatgccacggacgttgatcaggcaccaattgtcttccgtgtcggcaaacgaatggatggtcgaccgcgccccctcaaaatggaattcccgagcaaacacgcagcgcggcacgtcatccgcatgcgcggaaaggtgcaagcgttgaatggtctacacactgtacgcatccgcgaaagcatg

SEQ ID NO: 114255 - DNA, 200 bp, Heterodera glycines
  Promoter: Source sequence=SeqID_27198; Location=1..200; Strand=+; Gene=SeqID_57887
tgaaaaatttcttgtatgttttcttataaacagtttaaatttttctaactttctgacacaggcgccggcacggccctagtcctagtaatagtatatttgttcatcagtttggatgcaatttttgaataaaatttgttaaaagtaaaatattttaagaaagggataaatttttatctttttttagcgaggccaacataatg

SEQ ID NO: 114256 - DNA, 1003 bp, Heterodera glycines
  Promoter: Source sequence=SeqID_6248; Location=1045..2047; Strand=+; Gene=SeqID_60875
gacaattgggcgaaagggtggccaaatccaatgaataatccgacggataattgggcaaagggccaattttgacaattctaccgccaaaaagcccataaagcgtggggacggactcgaaaacagctcctcgcagtgtctctgaatgagttcgacgtcgctgggctgtgtgctttcccccgcaatgtccgccgtcgcttcgccttcgttttccctctcaaattcgactccaatttcgtaacttggattcatcaagaaatttgaaaaattaagctttaaatcattttctatgcacataaatatttctaaatgaactataaaattataattaatttaaaggaaaatttaatacgcaaaataattattcgaaatgaaaatgaaacaaacaaacaaaaatagggtaatacatagtttggtttgttcccccccccctcctttttcaaaaaaataataataattacaaaaaatcatgcaatacaactttttattaggttttcattgtcagcattcactgatcggtgttcggtttttgctggcgattgattcttttttttttatttatttccttttcatttgatttttacgaggcctttgtttttttaatttcgtttttctctttcctcatttgtttttctgagaatatctttttcccttctccgatttttatgattctctgccgaccaacaaaattattattctcttttcgcttattttattttgttgattaatttgagaaggtaaacaaatttcattgaagagaattacattgaaagcctaaatattctagatcgtgataactctatgaatggcgtatgggcgaattaattgataacatgtaccgatattcttcctgttctagttatgcgaccacacgcacacaacttgcgtcataacagcgactcacggttccaccgcgcgcaaccgatttcaaatggaagaattccaaaacttccgtgccaacaatttcttcgaggcattgctcttcaactggctaacacgcaacatg

SEQ ID NO: 114257 - DNA, 294 bp, Heterodera glycines
  Promoter: Source sequence=SeqID_5217; Location=1..294; Strand=+; Gene= SeqID_57296
ttttgtcgcttcgagcacactcatacttttgtcactttcgataatccacgcggaaataggggactgataagatccatataagaaagggcggatgtgcctcggtagattaatagtaaacctgccctcggaaagggtacttgaatggattccattcccacccgaggcttatcatttcatccatttcgtactgtagtgataaatagggatgtcaacaataagtacaaaaattggtcaaaatagattcataaaaacgtaaaaaagaatatccacatatgtataaaatcacaaaatatg

SEQ ID NO: 114258 - DNA, 812 bp, Heterodera glycines
  misc_feature (30)..(30): n is a, c, g, or t
  Promoter: Source sequence=SeqID_36835; Location=1..812; Strand=+; Gene=SeqID_66063
cagggatggagttccgaggcactaaaaatnttcggaagtcggaagtcggaattccgaggccccaaaaattttggaagtcggaagtcggaattccgatgccccaaaaattttcggaagtcggaagtcggaattccgatgccccaaaaattttcggaagtcggaagtcggaattccgaccccaaaaaatgtcggaagtcggaactcggaagtcggaatttttcaaaaaaaaatataataaattttttaaaaaatatttaataggctaaatttttaaatttttaaccatgtaaaaggtaatttcaaactgtttttagtttatttctatattttttaaaaagatcaaaatattttaagtaattttacattattttggattttttttttgggaaagttacaccctttttttgcggcgcgctttatccaaagagaatttgagaaactgtggggaaggaagggtccggcggtgccgatatgcgccgccgggaaaaattttgtaatttttaatgtaaattgttaacaaattttgtccaaaaaatggaaaatttagcgattttgagcaaattttcaagaaaattaagtttttttttgagtccggcggtgccgataggtgccgtcggaaaaaaaaaattgaaaatttctatgcaatttattaacataaattgtacaaaaattgctaattttttgaaaaaaaaactcaaaaaaattccgaaaaattccgacttttcatcaaaaatttcggaagtcggaagtcggaattccgaggccccaaaaattttcggaagtcggaagtcggaattccgaccccaaaaatg

SEQ ID NO: 114259 - DNA, 748 bp, Heterodera glycines
  Promoter: Source sequence=SeqID_1774; Location=1759..2506; Strand=+; Gene=SeqID_75882
ttgccgtccgtccctcacatttccctccattttctccctcgcgtttgcccaactaaacaacgccaccaccccatttactatcgacgacgacggaggaggattcgaaggcagggaggagaagagaagaaatggaggggagcgccctctttcactcatcagcagaggcaaccactgactgactgactgagtgtgttccctcccccccccccgccctcccccattcattcgcctctccccattcagcagcagcagttctcctctgctcaacatcgtcagcagccccacagccctaaatcgacgacaaaatccttctccaatcgcagaaatctcttccaattcattcccgaaacggacacaattaagcgaaaacttgaacagagtgagtgagcggtttaatttgtaaaattcatgcctcaatgtgttttaaactacaagatttgctcccaactttctaaactattttctctgtcttttttctattatttttttttttgttttccatttctaacgcccctctcactctttccttctcattttagccacaccatacgccgccactgccttttttgtccatggtattattttccgtgttaatcatcaacaaaaaaagaagcagtagcaatccaaccaccaccaccatcatcaacaccatcatttgtattaactctcaccagtgatagggccaaaaatagaaaaagtgtgtcgtccttccgagcaattcgcagcagtttcgaaacgcctgcgcatg

SEQ ID NO: 114260 - DNA, 133 bp, Heterodera glycines
  Promoter: Source sequence=SeqID_14379; Location=3625..3757; Strand=-; Gene=SeqID_78416
aaaatagacattttaaaaataaaaaattataatttactcgcttaaaacacaggtgttgcctgagccggttgtcaagtactcggtgccaagccagccggacaaaccccgtggtgcgcaactttggccgaacatg

SEQ ID NO: 114261 - DNA, 59 bp, Heterodera glycines
  Promoter: Source sequence=SeqID_10182; Location=780..838; Strand=+; Gene=SeqID_73287
agtgcatttaatacttttttcggttgaccaattccccttgcctaaattgttttcagatg

SEQ ID NO: 114262 - DNA, 1003 bp, Heterodera glycines
  Promoter: Source sequence=SeqID_12870; Location=862..1864; Strand=+; Gene=SeqID_76605
aattactttaaatttatttacgaaatttttggaaaatttgaaacaatttaaattttttgaaattgttggccaagtcatatgaaaaagtttcggacgaattccgtttttttgattggaaacattttttatacaataaattgaaaaatctaaaaaaaatcaattaaaatttaaggcggatttcatttttttgcctgcataaaatttgagacatggcccgaaatttgagaagtatttgttggccaacaaccatcatcattaatgcatacaatttctaaggctttctttgtgtaaacaaaaattttttagtccgtatttttataagtgtgtgggaggtacgccgctctctccgccgtgtttctcctctcattgctatatatatataatatattgttgctaattttgataatgtttttgaaatgaacaggcatggggaacgtgggacagttttaaaatatgaaaaatggccaaatatggacactaaaaatgaactaaaactgccaaaaaatgcatttaacaaaaaactaaaaaaaaaaatctgattttcgggcaaaatgcggtgccgtcaaagttgaaacttgatcatttcaaacaaaaaaattgttgccgtttcccatgattaacgctttttaaattgcaattttaggcggggaggagggggcatttttctattttaagcacatgggaacagctggcataaacatagtaaacgctaactattttaggtttcgacagaggaacaaaaaacgattttatatttttttctttgtggtaattgacggatatttaaaaaaaatttaacaaaaaaaaaaaaaaaaaaaattcgcaggccaaacgaattatggatgaaggactaaaactatacatatttaacgcttttaaaagcagcatcaaaaaacgtacatatgattttgtactatttattgtacatgtgattggagtccagttgaaataattttgtgtaaataatggaccgaccgactcaacccaaatcaataataaaatg

SEQ ID NO: 114263 - DNA, 824 bp, Heterodera glycines
  Promoter: Source sequence=SeqID_15391; Location=122..945; Strand=-; Gene=SeqID_79653
tcttaaaaaatatctgtttttaatcattttcccttgaaatacggtagaaatcaatcatttttgaggtgtccaattttgaccccaacctatctcagcgagtataaatcgtagcctaaccatccaaaaggcaattctgtagtgaattttgtgctctatccaatgagcctattcaaaatttccaaaaaaattttcctaaccccctaggaatttttttctaaaatttccccaatttcaagccatttttgacattcctggtcaccatgaaagagtgatctgatcaagttgatgtaagagacttttttgatcagtatcaaaagataagcaagcatgaattatttcaggtttttagattaattttaaggtggtttttcatgttctgagtaaagacttttttccgccctttttttgagtaaagagtgatcaaacgactcatgctcagaatgaatgagtggatcaaaataatgtggtgcataaaaagcacataaataggggtaaataaaaacacaaaaaataatcaattaaattttctagtcgaaatcttaattttttctaatttgatcggcttgagtaaagacttttttccaccagtgtatcttcaaactttgaaataaaggcatttcgccaaaataattttttttttcaaatttgggtagttttacaaatttagttcccgttattagtcccggtccatcgaaattcttttttgtgggactagtaaaagcgtacgattaccaagatttgatcttgcccggggaagtattggaaattttgtctctacaattttttttaacactttacccaaaaattgtcattttttaagaatg

SEQ ID NO: 114264 - DNA, 1003 bp, Heterodera glycines
  Promoter: Source sequence=SeqID_322; Location=689..1691; Strand=-; Gene=SeqID_82142
aaatatatttattaatgaacgatttcaacgattgaacgataaaaaaatggtgattttacaatggtttaaatacggcaattttacataggcgggctgacagaaatttaaatgtaaacaatgctgactaataaaaaggcttaaaatcacaaaggttatgaatttggcgtaaaattattttaaacagatgaatcataaaattttaaattttcgtcgctaaggatgaaattagagacacactgcctccctcttccctatccccaaaacgagttaacaattccaattaatttccaacttcacttcacacatcccctcctcctcctcttcctcctcctcttccttctccttcccccgccaccaaatttcgcgcatcccaaccgcagcccatcaaattcgcttcctaaattgtcgttcttctgagtatgtttgtgtctgtcgtgctattagcaacggcggaatgaatatatctcctctctctttctctctcccctctctctctctccccctctctctctttctctttctttccccctctctctctttctctcactttccccctctctctctttctctctctctcccctctctctctctccccctctctctttatttcttgctaattattcgacatgaagcgaaccaacgcatcaaacatcactccgcctcgcgcaaaacgttcgatggcacccccactggacctggacccaaacactgtcgcactcgcagagcaagaacgccaacgcacattggtcttcattggtctcccggaaagcaatgccgttcgcccatcggagcgcgttcaggaagacagggaagccaccaccaaaatcttggaccatcttgaagttgaggccgaaccaaccgccgtctttcgactcggacggttcgacccccagcgaacaacacctcgtccgctcaaggtggtcatgccaacagctacacatcaacacgtggcactcgggggatggaagcacgagcgtgctcgactccttctcaacagaacatg

SEQ ID NO: 114265 - DNA, 757 bp, Heterodera glycines
  Promoter: Source sequence=SeqID_2477; Location=1982..2738; Strand=+; Gene=SeqID_79931
tctcaagcctttaatagtagattaattttaaaaaagtaaatagctgttgtttgtgctaaattatttataacttaattgggtaattattttcaaaatcctttataatttttttttcaaatattgccgtacataccctcttaaattaatccaattaaatatattatcgttcattaccgtccgttcctccataatattgggttaaaaaataattaatttaataattaaatattgtatgggagcgaaataacagatattacaatatatgatgtcaccaaaaataagaaatgtttattatgctgaaaaggtccttaaaagcgatcacttaagaggaattttttaaataaaatatttaaatgaagaaaacaaaaatgaatgaaacgaaaatggaaataaattatgctggtgatgggggaggaatagatgacgggagcggatttattactatttaaggactcgggaatggctgggaaatgtattccgattttaatagaaagccgtctttccgagtttaactatgttctagattaatccaaaaaattttatcttcgacctgatatcccatctctgaaacatttataaaaataaagtccccatcccccacctctaacaaagaacctttttagttttgtttaaaaatgtcggttcctatgtataaattacttattaaagcaaaactaaattgcaaaattttagccccagctgacattgatcaccaccgaacacaaagtaaaaaatcgtctctgcccctctgaacatg

SEQ ID NO: 114266 - DNA, 73 bp, Heterodera glycines
  Promoter: Source sequence=SeqID_39979; Location=1..73; Strand=+; Gene= SeqID_68424
tttgacgcctccctaccatccgatgagtaatggagaagccgaaaggtttgtacaaaccttcaagcacaagatg

SEQ ID NO: 114267 - DNA, 1003 bp, Heterodera glycines
  Promoter: Source sequence=SeqID_17891; Location=516..1518; Strand=+; Gene=SeqID_82441
aaggcatcgctcggccacggcttttgcctttggttggcttttgcgtggacagcaattgcaatttgcagaatatttggcgaattcagcggccgatagcataatgaattaacaattaatttatgtgattttgttgtattatttgcacaaatatgggtattattatttcattttatttttaatctatattattgtattaaaatattaataaaattaattaaaatattgtgaatcattcacttttcaacaaatttttaatgacataattggcatggcaattaactaattatttgttaataaaattaatgaaaaaagaaatgggcagaaaaaagaaagaatttgaaaaaatgagttgggtcgtataattgtcaaaatgaaataatcttcgcctgtcctaaattaagaggcaaaaaccaatcattcaacaatttccatgcccaattaattcaatccgacgatccgttggcaaattgaaattgttttacctctccaacccatgtgatatgcccccaactcacccccttctcattccccccccatcattcacctcaccattttcatcccatccaaataattaattttgttcatagaatcttaccatttattggttacataatgtcggttaagaatgaaaaatgccataaaaacaaaagaaaatgccgtaatttttcataaaagcaaccatttcaaacattgttcgtatcagttgacagttctctgttgtctcagactgcaaaattaaatttcacggtaatttaactactccaaaatcttaaatttattaattgtttgtttaaaaaattcgtcgcgagtgtccgtcttttttttccatatttcgctgtcgcatcaatggcattttttcagacttccttccattttgccttgttttttctttcctctttccttctgtttatttgctttttcttccgttttcattttacagtatcctccctgtcaccgtatctaataccatctccgtccgccgtgccactctccgcttgcaatg

SEQ ID NO: 114268 - DNA, 875 bp, Heterodera glycines
  Promoter: Source sequence=SeqID_4888; Location=537..1411; Strand=-; Gene=SeqID_56098
gaaaattggcacatgccacggcactgcgacgcacgcgacaccattagcattgagaaaagaacggacgaattgcaatttattattatttattagttaattaatgataaagacggaagaggataatttgccaaaagatgtcatcattaaaaaagagcgaaatttgttttaatttttaattaaacaattttggcgcgtcttcgtttggctgtgcgttggcaaatgaaatgccgtgcctttcgctttacttccgcgcgcccctcccatggcttttcctgccaaaatccacgtaaaccaacaaaaaattgttggcttaatgatgcatataatgaatgaaagcaataaataacattcattcatttgccaattcgaataacaaacattccttaatttattattattattattttattatttataattaatatttttatttcccacagttcgttccttttccatgcgtttttcttcattttcctccccttttctccccctctttttcctttctttgccaattgcgtttgttttgtccggccgaactttgccgttcaccggttcgcaattggccaatgaagtggccagggcattttttaattccgtcaacacttgggacatgtcaattttcggagccgggactaagcagggcgaggaccgttacaagatcagcttggacggcctggacagaatgaagaacagattcagagtgccgttgccggcggggcaggggttggaaaagctgctcagatcgtacagagtggagcctctcagagaggattaccttggggtgaacaaaggtatgccaacctgacaaagtttaaaattacgggacggataattggaaacaattaaaacggaaacctaattatgttactaatatg
